United States Patent 9,328,346 (POLYCOMB-ASSOCIATED NON-CODING RNAS) - sequence listing, part 70

SEQ ID NO: 13154 - RNA, 25761 nt, Homo sapiens
ugaaugggggcagcaugaggccgggcggcuuuuugggcgccggacagcggcugaguagagccaugagccgauguguuuuggagccucgccccccggggaagcgguggauggugaguggcguggggcggcgacguaggggcucccggucccuagcuucaguucggccauuaugucccgggagccgagugcccccaaauugcugcucuguuuucuuaacuggugaguucagugcucgacgggcuccaaacuucuugaagcuccguuccugcacuagggcgcccugccugcccagccuucuggaguucucaggggucggguuucugggccccuucuucgcgccccuuccccacugcagcguugcucugcguuuccgcuccucugcguuggggcccacgggacgcugugagaucggggguggcgagaguuguugggccucaguuucccuggugccgcccgcagguggcuggccuggggaaucccggacugcccggcacgcgacacagcgugggcauggcggugcuggggcagcuggcgcggcggcuggguguggcggagaguuggacgcgcgaccggcacugugccgccgaccucgcccuggccccgcugggggaugcccaacugguccugcuccggccacggcggcuuaugaacgccaacgggcgcagcguggcccgggcuggugaguugagagcgccaggggugggcgggcgggccaaggggguggggguuggggcgcgggggccagaggggagcacuggcugugacagauccgcggguucaccuccaaguaccuguugagcuccaguugcugcauggcuuuggguacuucggggggccucaguuucuuuauaugugaagugggauuaguuguggucccucaucaugggagucgggacagugccucucugggcagaugggcaguaaccagggcugccguuucccugugcuaagcggagcuguuugggcugacugccgaggaagucuaccuggugcaugaugagcuggacaagccccuggggagacuggcucugaagcuggggggcagugccaggugagguccugagauggucaggguugggauagggcuucaggccucccaguugggguggaguagggcugcugacccagucuccacaggaaaugggcugcucugacccagccggggcagggagggguggaaggacacugccccagggaggcacuaacugccccucccauaucccuugaaggggccacaauggaguccguuccugcauuagcugccucaacuccaaugugagucuacccuuuuguugugcaacugggucgggugggccaggggucccccagcaccucgccaaagcuuccugggccucucuggcucucccacaggcaaugccaaggcugcggguggguaucgggcgcccggcgcacccugaggcgguucaggcccaugugcugggcugcuucuccccugcugagcaggagcugcugccucuguugcuggaucgagccaccgaccugaucuuggaccacauccgugagcgaagccaggggcccucacuggggccgugacacuaguggccauggcugccugccugacuguagugcccaccaacccagccacugccacagagcugccacgccagccuugguaucuacuuuuuauacaaaucuccucuagacuguuccaggcugccugcggauuaaagugggggugacugugacuggaccaguccauuucuggaguagguucuucucucuguguccuacuugggacguaggggaacuucaggaagacuaaacuuuucaagccuuuuuagagaaccaggggcacgcaucuguaagauuaaagaugcuggcuuggaggccgggugcaguggcucacaccuauaaucccagcacuuugggaggccgaggcugggggauugcuugacgucaggaguucgagaccagccuggccaacauggugaaacccugucucuacuaaaaauacaaaaaguagccaggcaugguggugcaugccuguaaucccugcuacuugggagacugaggcaggagaaucacuugaaccugggaggcggagguugcugugagcugagauuguggcacugcacuccagucugggugacagagugagacucugucucaaaaaaaaaaaaaaaaaaaaaaaaaaaagaaagaugcuggcuuggaagcugaggccucuucagggggaucccacucuuucccugcuggugggggagggaagaacaggguccagccaaccccccucccagggcaugugugggcaugcuuuggcccauugaggcuuggccacuccuuucuucagcccauuuuacagaugggaaggcucagagagaucugguuacauccccagggccacacagcuguggccuggcagagccucaguuuguacccaggacuagcugccaccuugcuuucccuggggccccuggcacccucaccucagggcugcugugugcccggaagguccccacacgggugauauaugacagcagccugagguccuggggguugggugggauguggaccuggcgagguaccaggccuagaucccccggcugguagggggugaugucagagagcugcggcagcagagacccaguccugggcagcuggaugcugggccggcuguggggagggggccgagggucacagagccuucggcgagccagguuucuggcccagggugagccgagcacuguccccauggcugaaugccuuugcccugcucucuguggcugccucugaggccacacagggccacuugcuuaccucuccuugggugggccaugggacugugacuccugguggggacacgcagccuucugaggucucguggccacaguggagcugagcaugaccagcaguugcugcagcaucuccuugugccauggcuggaacgucacgucaacgucacuguccucuucaucgcggugcaucuguuggugagggugggguggcagcaggcccacaguggccccaguacccacccucguccaggaaauuccaaccucagugcccauuuccacgaaguuuucccugucuguggugggauacccauucuucagucgggaagacugaggcccaagaccuuucagagccucagagaaggaauccagcuccuuuaagaccuuggagggaucuuugaaggccagaaucagcgaaggacagacuuuccaggagucucucagggaaaagaggggccucugauccugaggcagccccuucucugcaagcagcuuccaucuugcgcucacucccccuccccuugcgcccucccucucucccuucugcucaccugcagaauguucuguaggaaggagguggccuggaccagagccgccuccaggcuggcccgaaccuucugcucauuagccaguuccugcuguagccgcugcaaauccaccugcugcugcuccagcugcaggcucagcuggucucucuggcuccuggaccccaacugggaugagucaacagccuucccccuuccccaggacuggggccaccuggggccaggggcccugccauuucucuccaagcccacaggggcccccaucccgccccaagccucagccugucuggcaggcuccucuagagaggggaagucacuggccugggucgugggaucggaaagagcugggccagagcuuggccccagccugcacccgccgcccgccccuccgugggccauacgcacuucagugccugguuauccaccugcagcugcagggaucucugcuccaacuggcucagcaggaggcgcagcuccucggccuccuugguguccugcugcugcuccuggcacuucuuagucagcaugaggaugaucugcgggugcggacagguggccaugcccucagccugcccugucccccagcugcagacacagccaggccucccguguuccccuaugcagagcggccagugagcucuccagggcuggacucugcuuccauaaguuaugggggcuuuaaauaaauacaauccggagcuaggcccagcacccugcagcccccacaggaggcccaguccucucucugcugccucccucccuccugacuugacugccccugacucuaccccugcagggcccccagggcggccuccugccuugcaugccaaaugcccugugcugaggccugcaggcacaccuucugguggccucuuuugugccuggccaugaccuucuggguguucuccagcagcuccagcuguuugcacagauuguucugucuucccuugagcugcucauucuccugcagcagcuucaugccuugcugggagacccuggccaucugcaggguaaugccguuguucucuuugauggcccgcuugguugucucccacauccgguucguggucaccuuguggaacucauuggccacgagguucacgcgcuggaugaucucuuuccucagucuggccagaaaggugggaggggaaggggucagacagagcgggcacaagcccugggcacaccccuuugugagguucccagagcaccuagggcuguuaaacaccagcaugcucucucccugggaggguuggggcuaugggugggaggcuuucccuguagauccucuggaccuuuguaauugguaccauuucaauguacucccaccuguuaaguaacaugauuuaaucccaauaaguggcaaaaggaagcccugggagucuccaaugccagcgugaggacugcagcugggagcuuauuccuuuucucccaccccuccauaaucaccagcugggauuccaaggaguagcagguugucggggcggcggucaguuuccccaucuaaccccccaguuagaagcugaggccugaagacuaggauguucguagccccagggaugaagccuccaaaggccccaaagggugccccgcuugcccaccuguccuuguccagcaccgacuucuucuccagguuguaugcauagucccugaacucauucuccugcuuccgcaccugcuccuccagcaaugugaacuuguccgugaccuccucuuucugcagccggaacuccuccagggcugccagcuuccccccuggccgccacagcgcacaaggcccaaugaugggcugccucagaggacagggccuggcgaggaccuuaaagaugccccuuaggucccugucccuuccugugcgcccuguguggucucaguggggcaggucuaccaucccccaccuacccugccuggcccugucaccuuuacugccuucaucuggguugcccucccuccaccccuccaugaaucuuaugaaguuuuguucagguuccaccuccuccaagaagccuuccuugauacucucaugaaagcgacaguaaugacaacaacuguuuuguuuuuuuuuuuuuuuuugagacagggucuuccucugucacucaggcuggagugcaguggcacagucacagcucacugcagucucaaccucccagccucccaggcucaagagauccucccaccucagcuucccaaguagcugggacuacauaugugcaccaccacaccuggcuaauuuuuguauuuuuuugguagagauggagugucgcuauguugccuaggcuugucucaagcuccugggcucaagcaauccucccgccuuggccuccuaaagcacaggguuuuacaggcaugggccaccacgcccagccagcagcuggacuguauauauucucugggcuagguucuaaugccaucugacauuugagccucacaacccuugccaacugggggaccuuggucacgacacuucaucuuuugaggugcuuccuugucuacaaacugguugggggauguuuccagcuucguaggauugcugggacaauuaaggaagacagugugugccaagcagcauguggcuauuaucccuguuucccaggugagaaacagggucagugauagagcugggaugugugccugcaggcucaccagccaguccccuccucaccaaggaugauguucuccguggugagcugguccuuggucuccuggaacucguggcgcaccugggccagcugcgccucgaaggcauccuucuccaucucuuuggcuagcugcaaguucuggagcugcucguugaggucugugaucucauccaccugcugguugagcgugcgcuugaggaaggccacaaucuccuucuuguuauuggccagcugcucaaacuccuggcggaacaucuucuccugcacagccagcucaucccacuuccgcugguaccuggggcaggggcagagccgugguccaggggucaggcugggcaagccaggccucuggugcagcugggcccacucuccuggacucccugucccguaaaggggcauuugaguuuccuugugaucagaauccagccucaucucccacuaugccccuugguccgacagucaugaccacagccaaugccugugcuuagcauguuauuuucauuacaucacuagaauguaaacuccaugagggcagggccuuguuauguuuacaaguauguccccaacaccugugccuggcagauagcaggugugcaguguguuuguuaaaucauuacaacaaccuauaagaauguagguacuaugaugauuuuauaccuauuugacagaugaggaaacugaggcucagaaggauaaaggaacucugaguuuguaaguggcacagccaggacuugaaccugaaucagucugauccccagaagcaaggcucuuagccacaaugccugcugcagucggccagcucugcaucccuccauaacucuuccacacuuuccaaucccaagucuuuguaccuggcaucucccuuaccuuuuuccauccaguaaccuugguguuuucuccucaguggacccuucuuggcccugagccacauuuguggcccucucuuuggugcuccuguaaguuggcccuugucccacugaguggucaaaaccuaguaacaugucccucuccuccaccucuguauucccagggcuuggcaaauaguaagcacccaauaacucuguuaaauacauuugccuugaauauauucuaccugauaucucagcucaagggaaguuugugaauuucaagggaaguguguuaaucaguaucacauaaccaauuuagugguuuucaauggaguaacugaaguuacuugaaaaguuuuuuuuaauuaaauuaaauuaauuaauuaauuuuugaaauggagucucgaucugucacccagguuggagugcaguggcacgaucucggcucucugcaaccucugccucccagguucaagugauucuccugccucagccuccugaguagcugggauuacaggcgcccgccaccaugcccagcuaauuuuuguauuuuuaguagagacugggcuucaacauguuggucaggcuggucucgaacuccugaccucaugaucugcccaccuuggccucccaaagugcugggauuacaguccugagccacugugccuggccuggaaaguuguuuuacaucauaauuuaguugaccaacaucuuucaaauagugacugcacacagagcauuucaggggugggggcugaggaagcagucuugcauaggggagucaggaggccagggcucccaucuuggugccuccucuuccugggggugacuucccuucucugagccucagucuuccccaucugugcaauggggaugacaucaggaccucucuaguaagacugcugugaggacucagugagcaccagcccauggccugccuggcaccacgagggacucagcauuagcuguggucacccacagcaucagucaccuggggaagagcugccgccuacugguuugucuuuuaaggucacccugagacuggggcggugccucacaacggggaggaaacugguuguaacauaagaaaaugacgggcaggugaacauggcucugaaugaagaguuagaggaucuccccccagcacuaugucacacacaaaacuggcucuagaauagaaugucacagccauggagggggaaucaaccuuccccacuuauauuuggggaaacugaggcccagcauggagaaacaacugggcucaugugcugggugagucaguggggcacaggugccacugccaggaaguggaaguggggccuggggguccacccgccugccagagggcuguuuccacccuuucauaaagccugugaucccauggggcaggagugaggcagggggacguggggauugccugggguggggccacgagcuagcaucgugggcccaggguucuaggagcugggaagguggggaaauccauuuacccucaaaaucuugaaaccucccaaagguacguaugaggaaaugaggcuggggucgggauggggucuggacaucccaggggaggucagaacacaggccuaaggccccauggccaaaccugcaugggggccaccugggcaugggcuucugacccagggcaccagacuccugcccgccagcccacgcaccgggcuagccgguccuccaggucucggaucuggaugugguagaacuccuucaucuccuuggccagaggcggcuccacggccaccaccggcuccuucuugcccccuuucuucuugacuucaagcuccuugccugccuugcucacacucuuuuugggagccauggcugauggcaaccagggcuccaggccccaggaagaggccaggugguugcuaaggaagcuggucccguacauagcaacaggccgagggagugaggcugggcuuaaagggacccugcccucuucuugcugggugccgguaccaggucccacuccaaggcagauggcaucagugaggccccaggcccaggagucccaggccauggcaggcaggaugccuggcucccagggcaacuuuuugggcuucuggggacaacccucuuucucccacguggaaauaagcgccauggggaaaguucaugugggucagggcccuggaaaucgccauccuuuccuuugugcugaucagaagauggacgacacuaacccugggcacacaaagccuguucugcagcuguggccuggggugacaguguccuggcaugggugcauuggggcguccagcugauggggcccuggcuggcagcugggugccucuaugagcuccauccccagccccaaucucagccagccaugccugugugccugccuguguuccccaccagcccaggcacucacuccgugggacagcgggcagguccuuuccaucccugucaucccagggcuugucacuuagcaagagauggcuauagcaccacccugaaaaacucugacaauagccaaggggaauggcagugguacuucagcaaaugugguuucuuggagcaacuagauguugugaguuguaggacccuuggggcaggggcagggggaugaggagagcuuggggucacggugacgggucagaaacacagggaggugggggcauuuuuacuguuggugaugagaaaggucagagaagugauugguuggucaaaagugggcucacauuugggcucugucugaccuccaguggguccuugggccaauggccugaacccugcucugugaaagaguucacaagaccgcaucuguaaaguucccugugcagggauacgguccagggaugcugggggcacuuagugagugguggcccaugaagcucccgcccacuuugugugguaggcaggccugccuggaauuuccgacagcccuggaccucgccugugguggucugcccuucccagggugccuguucccugcaggcagggcagcccugggagggcacaaaugugacuggcagagggaagagacccccaugcuucugcacaggccucagccugagugcacuuacaagugagggagcucuggcugcccaggccuuguggggagagcggggaggccuggcccagugcccuuccagcucaaugcgauggcccugcuccugcuggacauugcccccucccccgccugaacagcugcucccacaggagccuaggcaggcaaaaauucccacagugcucccaguugaccgggggccuccccgugccucccccauuucuauucucuuuuccccaggcccauugcaggggguagcucugaauucccagcuuaauggggcccacagccccucgggcagccuggagcccacagagggugucagcuuggagaccugcccuccucgccuucaucagcaccaggauggcuuugucagcaccacguggcaagagggacgagcugaacuucuaggcagggaggggacgcugcaggguggagggagagcacuuucugggguuugcuuggagacucuccccaaagcucccuacuuuggaccauaggccgcuacuugccaugggggcacugucucauuaucgcuucuccagcugccuuccguagucuuggagacugaggcugaugggcccagagcugcuggagcugugagacacaaacccugcaggagcugggucuucugaggggagucaggcagugcacaaagccaugcagacugcagcaccggccaaggacaguggacaguggccuggggcacugucaccucugggagacuuuggagggaagaaaccuaggcccuggggaagcagggaggccaggcaucauuaaacaugcccuuggccaggugcacugguucaugccuauaaucccagcacuuugagaggccaaggugggaggaucacuuaaggccaggaguuaaagaccagccugggcaauauagcaagacccccaucucuaaaaaaaaaaaaaauuaaccaggccugguggcauccgccuguaguuccagcuacucaggaggcugaggugggaggacugcuugagcccaggaauucgaggcugcagugaguuaugaucaugccacagugucucuguucacgacgccaucuggucugaguuagguacaggccaauaaaagaggcaguuaaucuccaacaaggucagugauggggagggggaguucuggucucuggucuuuccucaucauuuacagaacgggaacaauggggaagaggguuaagcuccagucuaagaggcagaucugcagaacaggcuccaugacccacaucacagucgcauaucucucaaggcuuaaagugguuuugggguuccaacggcuuuuacauuuuuuuucuuuuucuuuucuuuuuuuuuuuuuuuuuugagacagugucucguucugucacauaggcuggagugcaguggcaccaucucggcucgcaaccucugccuccuggguucaagcgauucuccugccucagccucccgaguagcuggggacuacacgcacgcaccaccaugccuggcuaauuuuuuaauuuuuuuugguggagacggaguuucaucguguugcccaggguggucucaaacuccugaucucaagugaucugcccgccuuggccucccagagugcugggauuacaggcaugauccacugcacccagccagcuuuuaaauuuuauguacucucacauguuggauacccagcugguaucagagaauuggugugaaaaguaacaaauauuugguguuagaaaaacaccauuucucccccuaaccccccagcucugugucguggaaguuuuaccugggguguuaugcucuaggcagguguggucaaaaagacaggggcucuccucccagcuccuagucuggcucuucauuucgcccugggaggggaaggcugcuggccuuucucuacacagcaccccaccccucccugcccaucccuguguugcagaaucucuacugcaagcagguacagcagagaggacuuucccacaaggcccaccuggagcguggaagcucuucuccagguguggcagguugagaaugcuugggcccugccggcccaacuccagcuagcucauaggauggaggcuuuuucacaccaggcggggcgagaccagcugagaauaccaguggcugccacccccugguacccacuuauagagcagggugugacuuaggaaaaguaggucccucccccaguuugggugccguggcacguggguuuuugcuuuggggaaagaggcaggggaagaggacaaacaccucugucacucugccgaggggacucacuuuugucacagcuucaaaaaauccaugucuaaaggcugucagagacaaaauuacaaccaaucaguuuaaauagcguaauugacucuuucucuuucucucucuuucccucucucucuuucucuuucucuuucucucucucucucuuucuuucucuugcucugucgcccaggcuggagugcagugguaugaucucagcucacugcaaccuccaccuccuggauucaagugauucuccugccucagcuucccagguagaugggauuacaggugugcaccaccauacccagcuaauuuuuguauuuuuaguagagaugagguuucaccauguuggcuggucucgaacuccugaccucaggugaucugcccgccucagccucccaaagugcuaggauuacaggugugagccauagcaccuagccuuaauuggcuuuuauuuguuauucuagaauugggcaauagaaugagugucccgauuugcugaacagaggaggcugguuuuacagauggagaaggcugacaaagcagaaacagaacaaaaaguggauugguuauuucaaagugacuuucagcugugugcaguggcucacaccuguaaucccagcacuuugggaggccgaggcggguggaucaccugaggucaggagcucgagaccagccuggccaacauggcaaaacccugucucuacuaaaaauacaaaaaaaaaaaaaauuagccaggcgugguggcacaugccuguagucccagcuacuugggaggcugagguaggagaaucguuugaauccaggaggcagagguugcagugagcugagaucaugccauugcacuccagccuggacgacagagcaagacacucucucaagaaaaaaaaaaaagaaaaauaaugacaaacguuggcaaagcaugucacaacgucacaggcucaugucaaaagcccagcaccucacaccugaugaguucgcaacaaaugguuguggugaugauaaucaggaugaugaucugucaauuaagaugacacaaacaugcugguuuuuauuuguuuauuuguuuuuugagacagggucucacucugucucccaggccggagugcaguggcacaaccacaguucacugcagccuugaucuccugggcucaagugauuccccacucccaccuccacccaguaggagggacuacaggugcaugcaccaccuccggcuuuuuuuuuuuuuuuuuggagacggaaucuugcucugucacccaggcuggagugcaguggugcgaucuuggcucacugcaagcuccaccuccuggguucacgccauucuccugccucagccucccgaguagcugggacuacaggcgcccaucaccaugccugccuaauuuuuuguauuuuuaguagagacaggguuucaccguguuagccaggauggucuugaucuccugaccucgugauccgcccaccucggucucccaaagugcugggauuacaggcaugagccaccacgcccagccuaccucuggcuaauuuuuaaacaauuuguuuuuuagagacgggggucucccuguuuugcccaggcucgucucgaacuucugggcuccagugauccuccugcuucggccucucaaggugucgagauuacaggcaugagucaccaugcccaaccaaacauaccaauuuuuuuuuuuuuugagacagaguuucacucuuguugcccaggcuggagugcaauggugcgaucuuggcucacugcaaccucugccuacuagguucaagcaauucuccugcugcagccucccgaguagcugggauuauaggcaucugccaccacgcccgacuaauuuuguguuuucaguggagacaccgguauuucuccauguuggucaggcuggucuuaacuccugaccuuaagugauccgcccaccuuggccucccaaagugcugggauuacaggcgugagccaccgcucccggcccaaacaugccaauuuuuaaagauuucaaguagauugggcacuuuaccagggaaaugacuggaacguucagguucaucagcucugagaugaagagcacuuucuuuagcaggucagguacuccugauccuugggcuggagccugucuggcaaacagcugagucuugauuaagugccuucauucauucauucauucauucauucccuuucuuuauucaacuaauagaucccugcuccuaugcccuuauuaaagugaguggccccauguguguugggaaagacaucaaucagaugugaacacaaguagcagaauuacaccugugauuugguacuaugauacguuaacuugaaaaaaaucacaugauuuauaaauuugggaaaggagaggaggcuccuuuagaggaguuuacagccugcaagguggucaucccacaggcuaggaagcgugccuccagccaagaccagagacagguaggagaagggguugggguaggagcuuuaugcugaacggguuggcuaaacauacauauucagcagauuguaggaggggcuaugcauauucaugaaggugguuugacacaugcauauugaacaaacaugcauguaccauucgacccauguuuacuuugggguggagacuuggcauuuaaauauauuacaauuaggcccuauucguugaaagggcuuuucagaagaugagggcaugcaagugcucuguaaauuggccagagccaguucauagucuucuuaucuggagaaaguugcugaagucagccucuuguccaaugaaagcuguaguuauggcugguggaacagguggucagucccacagccucugggagcugggugaauuguaauuguuuuaauauugcuuaucuccaggccaucuagaacuuguuuagcugcuagagaaaaagaaaacuuguggcaaguguggagugugugacuuaauccucaccugccauggcccgagguccuguuuauaauuugauacuguauugccauagaagagucugcucugccagucuuauguucucuauuuuaacaugaaugcuggucgguuguuguuucuaaacuguaaaacggagaggcuucaugaggcaugucugacccccccaucucaucauggcugggaacuguuuuuaagguuuuucugggguuccuuagccaagggggacuccauucagucacugaagggcugauuucauuuuuaguugacagaggaaagguacagagagcuccaaaagcacaaggaggagccaggaacagcccccaucauggaggcgcuaggcuuggagaaggagaugcugcccauaaggggugugggugggagguggaaagacagcacagggccuaaagcaagaaaaacaacucagauuugaugaaggccagagaagcugcagcugagagaaggagggagcgggcaagagggggucagagagacagccugacacauaagcuuccuagagcagagaaggagcagugcaguauuugaucagcagcagaagcgcagguuccaaguugcuuuuuuauuugacuuuauuauuuuuuugagacagucuugcucugcugcccaggcuggagugcaccacaaccggcuaguuuuuguauuuuuaguagagacgggguuucaccguguuggccaggcuggucucgaacuccuggccucaagugaucugcccgccucagucucgggaggcauuuauauuauucccauuauauugaugggaaaauugagguuaaguaacuucuccaggucacacagggaagucaggagucaaaucccaggcucaacuccauagcccaucuggugaccauuaugcaauagacacugagaauuaaaagugccuguucuccuaggaagagacuguucugguaacagcuaacucccagaaccaguuuuuuuguuuuuuuuuuccccugauagcccauuuuauuuugcucagcacagucuuucauccuacuuuaggguaucacauggaaaaaauauggaacgcuucaccaaucugcgugucacugguuccaauuuuaguauucguacugccuaacccagcacccagauagaaugaccaacgcuucacaaccccgccucggaaagccagccaaucagcaaccgucuuacuccaggaacccccgccuccagggccagaggcgaccaaucccuaaacagcccggcuaguagacgcuuacuagccccggaagcccggccuccccaagcccagucccgaggccgcgucugauccgccgcgugaccgguguugggugucggccuuuuccuugcucacaguguuucggccucgagugucgguuccgcguugguugaggggagugcaggcggccgggcagaaggcgcccuggcggcaacuccggguggagucccacccuugccagagcgccagggguuccuugggcauuuuggcuucugugaaacaccaagaaguuguccuuggucggccgggcgcggugguucacaccuauaaugccagcacuuugggaggcggaagcuggcggaugacuugaggucaugaguucgagaccagucuggcaaacauggugaaacccuaucucuacuaaaaauacaaaaauuagccuguagucccagcuacuccagaggcuaaggagggaggaucgcuugaacccgggagggagagguugcagugaaccgagaucacaccgcugcacuccagccugggcgagacuccgucucaaaaaaaaaaaaaaaaaaaaaguuggucuugugggaagccgcugcugggacagggacagcuccaggggcggcuaauucaggaacuuuaacccaucccuuuauuuuuguuguuguuuuucuuagaaacagacaaggugguggauuccccauaccauuacacccuagauccagggauucuauauccacagggaggggcacacgugcuucagagagaauggguaggaauuugccccaaccauuuuuauuuuuugagacagggucucacucuguugcccaggcuggagugcuguggugcaaucauggcucgcugcagccuugaccuccugggcucaagcaagccucccaaguaguugggguuacaggcaugugccaccacgacuggcuaauuuuucuuuuucuuuuuuguagagaugaggucucacuguguugcccaggcuggccaugaacuccugggcucaagugaucugcucuccuuggccucucaaagugugggauuacaggcaugagccauugugcccggccuguuuuucguuuuucuaguagccauucuaauagguaugagguagugguuuugacuugcauuucaguugagcaucuuuuugugugcuuauuugccauuuguauaauuuauuuagagaaauggcuauucaaauccuuugcccauuuuuucugguuuugauuucauuuauuuuuaaauagauucggggucuugcuguguugcuuuggcuggucucaaacuccuggacucaaaccauccugccaccugagccucccaaguaguuaggacuacaggcacacgccaccaaacuucugcccauuuuuaagucagauuguuuuuuguuguugaguauaggaguucuugcaucuggauauuagccccuuaucagauaugugauuugcaaacaguuuuuucccacucugagacugccuuuuucacccugcagauuguguccuuggauuguagcuuuaaauuuugaaguagaacaguuuaccuauuuuuucuuguuuugucugugcuuuuggugucauccgagcaagcaauuuuaaugauaaacagagcaagcacuaucugagcacuuccccuucauaaagaggcagcgcucccuccaggaggagacucaaauucugcucagcaccauucagcccaguuguaagaaggagcgcauguguugacaguguccuuccacauagucugccacggacacuucccaccagccuugucaucuggugcuggaggucaacagcugcuguuuuuuguuuuuguuugagacagagucuugcucugucacccaggcuggagugcaguggugugaucuuggcuuaccacaaccucugcuucccggguucaagugauucuccugccucagucucccgaguagcugggauuacaggcacaagccaccaugcucagcuaauuuauguuuuuuuuuguagagaugggguuuuaccauguuggccaggcuggucuugaacuccugaccucaggcgauccgcccaccucggccucccaaagugcugggauuacaggugugagccacuacgcccggccagcagcagcugguuuuacaaacuucuugccaacagcuggugccacuuuuuacuccaaggagcguaacucagaucacugucucuguaguuuggguuucuucccaaccuugagcaauggaauucaucaguuucauucuagaaugucuucuuuagugcuuggucuggaaaacugggcuuggcuuauggacuagguuacugugcuucaguugaaauugauugaaauauuugauugaaguaacugaaauaacuaaaauauuucaguguguucauccacucugugacaauguucuuuuauaacagguaaugcacaggggaccaggcagguacaacucacuggcccaggaaaauccaauuuuuauuguaccacuuuauuuccacucuuuuucuucuuuuuugcugcuuguguaaaaucaucauccuugaagagucauuuguuccagccuauacagacucacacucuguauucacacuggaaucccacugucugcuuauaccgagaauguuuuguuuuuugagauggagucuugcucuguuccccaggcuggagugcaaugaauggcacaaucucaguucacugcaaccucugccucccggggucaagugauucuccugccucagccucccaaguaacugggauuacagguguccaccaccacgcccagcuaauuuuuuuuuauuuuuaguagagacgggguuucaccauguuggccaggcugguuucgaacuccugaccucaagugauccacccuccuuggccucccaaagugcugggauuaacagaugugagccuccgcacccggaugauaauguuuuucugauaguggagggcucuggagucagacggcuguguuuaaaucuagucucugccacguacuaacuggagggcccuagccaaguugcuuugucucuaugugguuuugcuuccccauguguaaauagggcuaauaauggcaccuaacuccuagaguuguugagaagauucagcaagucacauacaaagcacucagugccuggcacauaauaagugccauauauuauuuauuuacagacagggucuugcuguugucccagcuggagugcaguggcacaaucacagcucacugcagccucgaacuccugggcucaggugauccucccaccccagccuccugaguagcugggacuacaggcacaugccaccaugccaggguaauuuuuuaauuuuuuguagagacgguuucaccauguuguccaagcuggucucaaacuccugggcucaagugauccacccuccucagccucccaaaguguugggauuacaggcaugagccacugugccuggccuuaauauauaaccacaaucagaaugauugcauuaauacauuguugguuuuuuuuuauucaaugaaguacuuuuaagcccguggcucauuuggaauugaagauauaagacgacaauaauaaccaucccuuccccauggccagucacuauccugacuuugguauuugucauucccaugcauguuuucacacauuuacaacauauguauccaaauaagcaauauguggugcuuuuuaugagguuuugaagugccgugguuugccacgguuacuacgggacugaaugaaggaggaugaacgcagaaaugaaaacuuaaaagaaacuguuuuaaaagaaggggucgggggaagaagaagaggacucccugcuucuacugagcaaaagcagcagcucugagcuucuacagcccuuuguauuuacuggguagaaagagcagggaagaggagguaaugauuggucagcugcuuaauugaucacagguucacauuauugcuaacaggcuucagauguaccuaaucacaagaaaacugcgcuuagggaguggcugcccuccgcauuccuucugggcggcagaugcaguuugucaguuugccaacauucugcauuuaugagaacaguuugcuguuuacccauguagccuccaggauacugaguugaucacgacccucacucuuucagccugcaacauugaagcuuuauauaaaugcacuauccugucuguguccucccauaaugugcucuuuucacucauuguuaagugucugagaucuauucauguugacauaugcaacugugugucaugcauuuuuaacugcuuuaaacucaccauugggugaauacacaguuuaucuguucucuucuugaugagcauugggcuuuuuuaaauuuaugagacuauuuauucuuuucuccccaggcuuggcuuggacucaucgucaacagcagcagcaucaucaucaucaccaucaucaucaucaucaucaucaucaucaucaucaucaucaauggcugagcccucacugugcuuccugggagccgggcucagcuucccgccuccacgggcacuacaggagggaacaaagucaccugucaggaucauguggaaagaggccaaggguggauuuaacccagguaugcugaugcugaagucugugcuccuaaccacucuggccuucugcuuccuguacccagaagagauggaacccacaggccacugcuaaaagucuccaacgguguuaaauauccuuggaggagcagggaauuccaaacaacccaaagcaugcaacaccaacugagccauucuaaagccaggucugugagcugcagccaggcacugugccuuuccagaggcccugguccaggcugcgggacucagcagagacugcugggggccugugcacccaccucggaaugacaccaagcauuuguuccuggaauucccugcuccuccaaggauauuuaacaccguuggagacuuuuuagcaguggccuguggguuccaucucuucuggguaacacaggaggaccagggcuuuggccaagaaccuaaagagccacacucauuugcucuugggugguagugaagggguagaauggagagaggugacaggaagcugggacagaagacuucagaaacaaccagggagauacuagaaagccacucccaggagauuggagggacagaugaucccgggaagcagcaaacagugcugcuuuugcuuuaauguaaauuuggcuuagaacaauuuagaauuuuaaaaauuccagucuuggaucucguuccaaagccuucuguuugcuggugaacuaaugauaaagauaaugggggccagacacaguagcucacgccuguaaucccagcaguuugggaggcugaggcaggccaaucgcuugagccuaggaguucaagaccagccuggacaacacuccaucucuccagaaaaauacgaaagacuccaucucuccagaaaaauacaaaaauuagcugggcaugguggcacgugccugugguucugugguuccaguuacucgggaggcugaggugggaggauaaccugagcucgggaggucaaggcugcagugagccgugauuaggccauugcacuccagccugggcaagggagugagacccagucucaaaacaacaacaacaacaacaacaacaacaacaacaacaacaagacagaacaaugggugucaggggagugagcuuucugaauuucugcaucucucugagccucagcuuccucaucuguagaaugggagaggaucugccuaacagacaaguaugugaggggccuggcagggucagucaaugguuguucccuccuaaugaggcaugucucaccagacuauagcaggcugugguggugcaaauuccacuaacugcccuucaguugguagcuuucucagugcuauaaaggagaucaggaucagaaugagaaugaugggggaaaaagaaguagagacagaagucccuacaaagggucucacuccccggggcccagcauucuagcaaguuucccguguggccucgacccucacuuacggguccacucugagagcugggcccaccucacugcagucuucucaggucaggagcagguuccaagacaagcaggacacacaccgccuuccauccuggagagaaguucauuauacacguagggugggugguacggcagcaggagcagaggaggagaggaguaacgcuggugaagugaucucacugcaugcccuaaauacacaggcaccacaugauuggagagggagcaucugcaaagauggagcccugcagugccugcguuagaaaagcauucuaaggcugaggugggcgaaucaccugaggucaggaguucaagaucagccugaccaacguggcaaaacccugucucuacuaaaaauacaaaaauuagcuggacauggugguggcugccugcaaucccaacuacucggaggcugaggcaggagaaucacuugaaaccgggagacagagguugcagggagccgagacucgccacugcauacuccagccugggcaacagagugagacuccaucucaaaaaaaaaaaaaaaaaaaaggaaagaaagaaaagcauucuagauaaggagaaacacgguggaagaauggccucaucucuaggcagcacgcuguugcugcuaggggcccaagacaagcuccauggcuaguccccaguguaaggcggcuacagaucuaacgcaagcaacggggaccuggguccagaagacuccaugccacagccggagguggucgccuccucugcgaugaaccacugcaaaagcuuucuccuuccguugcccaaaggaaagccagacuggagcccccuggacaccgggaaggggugcugauuucuuuauuuauuagacucaagugcuuuaguacagaaugguacagagaugauauauguuugugcuucaguacuuucaaacacugagauucugauaauuuuaagguaaacaaguuucaagacagacuagcuuuuuuaaaauauccuuuugauaaauuauuuuuauauaaauaacagagaaagggaaaccaacaucuucgacaaacaagguccugaagcaugagcacuguuugguccgagggaggggacagaacaagcagcgggaguaagacgcccggcgcaggugccugcgguuccguccuaaggaaaucaggucguauaaguugggagggagacggggagagaucugacgacuaaucucagugcaaggggagauuucaaagccuugagaagagaacaccacaaugcagcgagcagagagggcggggagcaggcucugaaagggaggcggagguggcgccgagcucgcguacagcacuuugagaggacaucacuagacaaguaauacacacauggccugcaggaggucaagggcggcgagggggcugggcaggggacauuuuugugacuuccacuguuauuauauuucacgacaacagcagcagcacaaauggugugcucaccacuggagaaugagagcugcugagucuugaggauggcgagacagccuuccugcauuugcugcuuuaguuucugcuuuagagcuaaguuuuauacagagaauaaaaugaccaucuucucuuacaaacacgaugauguaugaccccacacaacacaagguauuaugaaguaucugaaacugaggauaaucugacugaagaugcuugccgagaggguacagggucugugugaguccaacgggccaagaaccuucuccacagccauagcccucuguucaggggccuccagaacccaucuguucugguccauuccugacccuugaacgaaggcggacuagggaaaaugagcuguugggaugaugccuggggacagaagggccugggccacaggcuccagacuaacuguuuuuccaaagagauggaggcuuccagcgggaguuugcuucucaccugucagggcacugugacuuagacuggaggacuucccucgggaucacagcacuguggacacaggcuggggagggggcagugacaggcuguggaggaggacgcuggccugacuucgugcagacaccccagccuccacccacagcugcacuaccggggguaugagacgcugggaaaggcaaagaggucuguuccaccuuggaccuccugagauauccugauugucaccucccagguuauuuggaugagagcaggcacugagggguagggacuggaaugaagauagcagauuaguccucagugugaaauacuccaagaacacagacaucucuaugauucucaacaaggacaggaacaaccccaaacaagguuuuaaaaacacccaaauuucuaccguuccauacccaagcaaugugcacgucacccaggguuauguacaaggucacaaaucuuaaauaacggggagaaggcguccauucauccuaacaguccagaaauuucuccugcugugcaccaauugcacaugagcuucucuuuuuaggauacauguauaagauacucuuuuuaaaaaacacaaugcauuauuuucuuuuguuucaaacaagaagagggcaucacugaacacgagaaugcagcggcaacagugccagccagggcgugcagggcuggggaggcaacagacgcaaaggaacugaggcgggcgguggugggaagcugcggagcgcugugggaugggggcguguuuuggaggggcgacuuauuuuuuuaacugcuuauuucuucaucuguuuuauucaguuucuucaguguguccagcaguuucuguggggugaggauguguguggauccuggaggaggcagagaagacagugagcuugccaguucugguuuccaacacuuccuuuccugcgcuucucgauucccagaucugcacccaccccccuccccaacccuggucuggguauaguggaagcagggaggggagucagaauugggguuggggucccgucgcaauaggccugggagauauuugggggcuguggauaaacaaaacacauccucuggcucaggcagggucccaggcugcaccaaggaacgagcugccucaccaucagggugcagagccaucugcaggugaugggcagcugcguuucuaauucacucuuaaacuccaggugaagccagggagagaaauuccaaacauggcaaggcagggaaaggcugaaaauggggccagaguugguagggggaccauguguggaaagcauggugccugggagaggaaguugauaggcaaagcccccugggagaauccacugaccucugggagccagccaguugguacugcccuggugggugggaccucaggugugagagggaaagggccaggggaccugaggccuuaccuugcagagaccgcguauuguaagagauuagaaaugcuugcaaaaauuuaagcuaauggaauuagauauacuucuacugcaaaaauaaaaauaaaaauaaaugaaagucuuugucauaaggagagagagagagaucuaguaagugcaguaaaaaaagaugcaugggucgugugguuuggacauggacuuaaacagaacagaggugaccgggguggugugugggugagcaugaggccugcacgcaugcagcagugugcuucaaagaaagguccuggugggagacaagaacugaacaaaagagacacguacuugaaaaugugccuc

SEQ ID NO: 13155 - RNA, 2090 nt, Homo sapiens
agagccccgcaaccagggagauugcagacugcggcgcugggcggcggacaccgaagcucuccucaucucccgagugauuucagggguucaggauccugauaaguccccgcccuggaagccaagccccgggaaggggaggagugagguggccccggcccagcagagcucagccuccggaaaacaggcgucuccuccccaggccaagccacugcgccuagucucccaggugggucucgcagccagggaccgcggcgcggcccggggcgggggaggaggacgcaggccaggaucucgcucgucacgacucacccaggaggguggggaggaggagggacugcaggaaaagggagcggagucugggcgcucaaggaauaaagacgaggaaggggagaggggacugaggggaagguaacgggggugaggaugggggugcgggggagggugacgggcugcaggggguagaggcgagaugaaggagagggacggguguugggggugaaagagggggaaggagggugggaugggggagaggcgggauggagagaguggggugagggagggguggaggaagggggaaggauggggcgaggggagagaaaugggggugaagggaagagagggagggagggauggaggggaaggaggaugcagggaaaagggagacagggaccgcgaggaaggaggauggcgagggaggagggcgggcugcagggggagggcuggggugaaacaugaggugagggaggggagagcggggcaagccuuccucucgcgcgggcggcgccugaauaacgggaccccacggaccaggagccucaggcccggggcgcagggccggcagcccgcucggaggccugggcgcugccggcaggggccgcgcggggcuccucgggagccgcaguccccgccugcuggaaggaucccggcuccacuuacucucuccgacaacagcuuugaggccaaugggggccauggcgcugcgcgagucucccggcuccgaucuccucgucccgcgacgccugcggaccccgccgccuccucaggugggcgcgcugggccagccgcagcucuccgccccgcagccgcgcuagggaccgacugacgcgcggacugggcgcgggggcgcggcgcgagccagagcgaggcugccccgccgccggcgcgcgcgggggcggggcaagccgggggcggggccucgcgccggccguuggcgucacccacucgccuccgccaaucgcacugcggcccggaggcucaaccccgccccccgagaugcggcugggcgccaggcggccgcuggcuggugcggagccgcgcccucccccucaccucacgcgccgcgcgcgcccggggcgcaggguacccaggccuccucuuucccgucggugcugggaucccuggccacaggcuaccgacgcgcuccaucugccugaaaccccgcucggguccugucuuuccucuuucugggagcuuccguuuuuuccugcccacggaaggagcuuggaggcgagaucucuuacuagcagcgcccacucccagccgcagcgaagccagggugaauccacccacagcaccucccugucgcuggguaccugcauucgugcauucaccaacacugaguucuugugucaaacuccgugccaagcaccucgcgggcaucaucucaucaaauccuccaaucacugggcauugcuuuuuauuuuguuuuguuuacacuccucuuagcucauaccuaugggcauuauuuuuaaucuccauuuuccgguggaaaaaccaagucucggagauauuggaaauagcacuagacuuaccuucaggcagcguagcauccguuagcuaauguucaguauucugucacuuuuauguguaagccguuauucuguccccuggagcuacgaccauguacaaggcagaaucucaucuugcuuaugggcgcucagaguuuagaaguuucuaagccccaaaucugauacgaauauacugugggaccgacucuggucucaguaucuccuuccuggaguccguauuuauuaaagcggucccaggucaguuuuugcucaacuuucuuuguuaauaggagauacugcuuu

SEQ ID NO: 13156 - RNA, 63874 nt, Homo sapiens
ggggcggggcggggcggggugggacgcggcgggcgcagggcagcgggcggggagggggcgggguuggccugcgggggcguggucugguggggcggagcggggcgccggggugcagggccgagggcagggagggggccaaggcggccggcuggagggacggggcccgaccgggagcggagccggagcggaagccgcagccgggcggcgggagcggcgggagcggcgggagcgggggaagcagggcgggccgggcuccauggcgccagcggcguccgccugagcagcgcgggcaacagcggcggcgucggccggaucgggccgcgacaccuccuggccaugggggacgugcuguccacgcaccuggacgacgcccggcgccagcacaucgcaggugagggucgcgccgcgccacgcgcgcccaggggccugccggaacccccggaccacgcccccgccccggccagcaguuggcgccggggccgggggcucgggggagucaggccgggccggugggagcugccagggagcgugccccgcguccgagcucguucccucugagccugggcgccccuucccgcgcucuucugagcgccaccuuucccggcucaaggggacucggaacuccuucucucccggaaccccuucggagcccgggcuuggcggacccccagcccacgaccccuggccgagcuggggcaggggucgcagccugcugcccacccuuggcuguccccgcccagaagcguugcaagcccauccgcuaccagcuuugggaucucccagacccagccagcucgcgcucaccuuccuccccagccgucccguccccagcuccgccgggccccagcccugguacacguggcggaggcuuccugaaggacgcgcccaugaaggcccgggacugauucuggggaguggggccagggaucgauggggcgccccggaggcggugggguugcauguccuuuggcgcagacagcaggcugccccugcuagcagcaggggcccagggaccggucaccagaguggggggcccucagggccagucgccagccccuucaacccuguucuucagccaacccuacucucagccuauuacugcacaguggccacuucucccagggacagcuguccccaaggcuccuggggaagccggagcugcagagggggccuggguuccuuuuccccacagacucuggagaacagugagauaggaugaggaucucggcugccugagaaacuccucucuggccgaucucuccuggcugguggagcugcccuggguggaaucccagcauuugcuucccagacaucuguccuguacaccuugguuuucuccuuuuugaaauggggucagugauuucuuccuuauuaaugaguuguugggaggcuuacgugaaguaacucauguggcuugcuuagcacagagccuggcauaggagaggcacuuguauguggggugacgguucaggugggucgccccucgcugucuagugggcccugagcaccgcguccgccugcacuuauuuuuguguccuguagaauuucaccaccguguucuccacgcucccuugagagcaggaagcccugagagcaguggccagguguccuuuaacuccaugucuccagggccgcacccaugcugggcaccagggaggugcuggggagaucugccaagugacuguggucccgggccaagucccaaggccagagucccucccuugugccaggccuggggcuggcugggcacaggggugacuggggugaugugaaaaugaaucggacccucucuagccucugaccagcgugggguuaaguccuggaaagccuccuuauccgaccaggccuggacugugggaggaggaagggccagggcggagucuuccuguccccucccugucgcagcaagcuccuggggcucuguaacagucccuccauucaggaccuccuguugaggccccucgaggggccuggguggggugugccuugcauucggugggguuuuuccucuccccauacucagugcugggccucccugucuucccgucuccugggcugagaauugccagcccacccucucuccccuggcauguuacaggggaggggacugagaccacagaaggugaaguguccuuuacuggagaggguuggauuuauuuucuggauaccaggcuggguggaagaaaguugugcccacucagagccugcuggucucucucuucuccacacuucagugcuauuuauaauccucuuuaaaugccucgaauuccugguccagacucaccugaggggaguuccugaugugggggggugggguguuggaagggggcagcggggaagccucccagucuccccagaggaagugagcugccuuugaaaucucugcuggaagggaaugagggcguguauuugccuccuccagugauccaggcacccuccucaccccacccaaggagcaguagguacucucaaagcuggcaauuaaaauuccagaacccucccuaccugaggccuuguucucugccccaguagaaaugucagaguuagagacaucccuucccacagugcucugaguucccaggccuguuaggguuccaagguuugaccugcagcuuugugcccgccccaagcaggugagcaggugaaugccagccugccugcaaguccuggcaaaggucaagcgugcucccggccacggugcuguuuugcugccacggcaccuuucauccugggauuucaaagccccuggcaagcagaggcuuguuuccacaccaggagccccacggggcugguggcaggaugacuccugccuccuuacacgaggcagugugccgugaggaagaaucccuggccugggaucugggaggccugaggauccuuggguaggccacuuccucucccugggucucaguuucccuaguugugaaccgaagugggugggccacucgauggcugaagucccuuucagcucugagggccuaacaaucccaaauuuuccccacaaaucucccccagacugaagccagcucaaggucccaguauaaugccugcaaccuuggaguaauaucuuuuuuuuuuugagacaaggucuugcucugucacccaggcuggagugcaguggcaucaucauagcuaauugcagccucgaccuccugggcucaagugauccucccaccucagccucccaaguagcugggacuacaggcaugcgccaccaugccgugcuaauuugugugugugugugugugugugugugugugugugagagagagagagagagacagggucucccuauguugcccagguuggucuugaacuccugggcucaaccaauccuccuuugggagccuuggccucccaaagugcuaggauuacaggugugaacuucccgcccaugaacuaacaucuuuuuuuuuuuuuuuuuuuuugagacagagucucacucucugucccaggcuggaguccaguggcacaaucucagcccacugcaaccuccaccuccuggguucaagugauucuccugcuucagcccucuguuacagguacacaccaccaugcuuggcugauuuugguauuucuaguagagacggggguuucaccauauuggucaggcuggucucgaacuccugaccucaggugauccacccuccucagccucccaaagugccaagauuauaggcgugagccaccacgcccagccaaaaauaauagcuuuauugaggcguaauucaccuaccauacaauucagccaccuaaaguguacacuucagcgguuuuuaguauauucacagaauugcgcaaccauugccaccaucaauguuggagcauuuucaucagcccggaaagaaauccucuacuccuuaguagucgcuccuguuuccuccuagucccuccuaaaucuaggcaaccacugaacauuuugucuaauugcaaaaguaaugugugcacaggccaggcgugguggcucacgccuguaaucucagcacuuugggaggcugaggagggcggauugcuugagcuggggaguucaagaccagcgugggcaacauggcaaagccccgucucuaguaaaaauacaaaaaauuagccgggcauugucguaugcgccugugguuccagcuaauugggaggcugaguuggaaggauugccugagcaaaaguaacacauguacaaacaauuuaggaggguaaaauaaaacaugaaaacacccuccaucuuucuccguuaaaucccacuucccagaagaagucacuuaaguguggugugucaccauuuccaaaccuaccucucucuguacaugcucauaauagcuugguuuauaaaaacagauuuuuuuuuuuuuuuugagauggcgucucacucaggcuggagugcaguggcaagaucucagcucacuacaaccuccgccucccagguucaagcaauucuccugccucagccuccugaguagcugggauuacaggcgugcaccaccaugcccggcuaauuuugguauuuuuaguagagacaggguuucaccauguuggccaggcuggucuugaacuccugaccucaggugauccacccaccucgaccucccaaaguucugggauuacaggcaugagccaccacgcccaaccuauaaaaagagauauuacucuaugcuucugugguuugauuuuuuucacuugguaaauugguggacaucuuucugugucagaacacacaagacuaccucauucuuuucuuggugaguucguuucugugcauggaugguuugucuacccagcccucugugaaugggcauuuggguuguuuccacuauuuugcuaguauucacagugcugcuugaaccugcugguacaaacccucuguaauauuccaguaucagagaggcccugaaauggaacuccugggucaccuuuuuuuuuuuuuuuugauacagagucucauuuuguugcccaggcuagaguucaguggcaugaucucggcucauugcaaccuccgccuccuggguucaagcaauucuccugucucagccuccugaguagcugggacuacaggugcccaccaccacaccuggcuaauuuuuguaucuuuaguagagaugggguuuuaccauauuggucaaguuggucucgaacucuugaccucaggugauacaucugccucagccugccaaauugcugagauuauaggcgugagccaccaugcccugccugggucaccuuuugauagauggacacauagccuuuaagaaggcagcaggcguuugacacucuccugcuaagauggaccuuagcauugagcauuuucauccuuuugacaaccagauaugagaagaagggugucuuaauuauuuauugagcaaaacaaauaaugcuucuuuccaaagugauuuuaaaaacuuaccucucugcugggcgcggugacucacgcuuguaauuccagcgcuuugggagacaggcaggcagaucaccugaggucaagaguuugagaccagccuggcaaacaugaugaaaccacgucucuacuaaaaaauuagccgggccugguggugcgugccuguagucccagcuacuugggaggcugcggcacaagaaucgcuugaacccgggagguggagguugcagugagacgagaucgcaccauugcacuccagccugggugacagagugagacucugucucaaaaaaaaaaaaaaucuaccucucaacauuugggaaguggcuguagaugccaagagugaagggauggagggguuccaccuucugccaccccucacccugcuguguggcuuccucuuugcuccccuggacuuugcagagagaccaggcuggccggaagcagugccugggccugggccgcugcccuuagccaagguccgggucagccccugggggcgaagugucuggggaugaugcugucucucuguugggucuuauauaacaugcuuuuguuggcuuugacccugccuuccccuccauccagccuccucuagucccccugacucuguuccuuuuccacugcuggggccugagugccggccucgccuacucagagcugcuccagccuccucggagccucuaguccuucccacacacgcugccaaagggaccuuucuaaacccacgcggggccauggcugcccucccugcuguccaaggagugaagcggaaaaacaggacuaggaaccacucacccgccguccugcgauaaccacuucauccucugggaguacuucccaucugugucgaucauuacacuuuaccgggaccaugacucaaguuugugucuugcuucuuucacuacaugaucuauaguaaacaucucucccaggucauuaaaaccucccuggaagcauccccaaaggcugcauuuuauuccauuugaggacagagggucacuuucccagcuuuuucccuaaugcuggacaugagguuguuucucacauguugguuuguaggggcaaacagagccacuguguguguuucuuuucuggcuccagucaacuucccugucgaagaccgauucaucucccagcccaacucuucccgugcucugcuuccgccaaccugggcauuuagagggaggcuccuuccugccaucucugagcaucguucggggcuagugggcuugaaggggcugccuguguacuggggacggggacugaugaccauggccucuggguguguggccauagagucuagccugcgguguguaggaauggauauauauuuucugucugaagacaugguugauagagcagggaggggcaguaaucaggcucggagugauaacuguaaacauuagcaacgguuuaacugagcacuugcuaugugccaagccuuccuuugucuguaucaucuuauugaauucccaccucaguggcaggccuggaucggauaguccaaggccuuagcuauuuaaaccacguucugcuauuaguaugucauccguggugcccagacugggcagggggacacugaaaaaggccuccaagagagguaagcuuucggaggcggggagaggaagugggaggaggagccgagugggaauagagcagcuugugucagucucccucccauagguugcacaaaucuaucccacccgucauuacucagucugagacucacagccucugaccagccccauucuccgucccugcgccccccuccuccuuccccgcgggcagagcucaugacucacugcaccccgggcuccugcaagcaucauccugcgguugcagaaauuccugcacugcuuuuuccuuccccugccccaccccauccacuucugugcuggaggaagaaggguauucuguagacgcugcugggcagagguuuaaggaaggaguccgggcagaugccuagguuuaaaacccgugaggguggagcaaagccauucucuucuccugguagaaucuuagggccugagucauggaaggguacaaucuuuugaucucaaaaauuuuaaaacuggaagaacaggaaguguccacccccugggacuggucccauuuuuuuggagcugggcugcuucuggcccacgaaggugaaggggccugccuggugacgugguggaugguaagccugaagaagcagggagcccagagguuuugggguaaggcuuugcagucagacuggguuugaguccuggcucugccacuggauggacugguguucgggggcaaguuagucaaccugucugagucuuagagcccuccuuacaugaggaugagaguucuggcaucucaagguaugaaggucaaguccccuggucagcgcagaacaguguuggugggaggugacaauaugugagugguagcuguuaugauugugacuuuauugagcuaacuugacacccagggagaugugucuggucugucuguggccucgugcauccccugcucccugccaugugcuccaggaaguugacaugacccacuccuuuccuaagcagcccuaaauaugagaaucuucuucccuuccaaggucagaggagcaccagccuauggcccuggaccccugggguauucagcgaguuccuggaggacggugggauggggcugugguuccagcaaggucagucacuccgcagcagcauccacucugugccuggcauuuggcagugcacagaggaaaaggguuagaagauggaugggaacaugcucccuccuugcccacccaugugucaagaacuagacuuguaagccuuaagccuggucccauugaccacuugcugugugacucuggacccaauggccaugccucucugugccuuuucucccugucugugaccucaaggccaguaucuacucuugggaauucucugccucugaaaacccuuuuguaggggucucaagaugccuuccaaaggcagggcugguggcuucuauguagaaauagaggugcaugccugugagaccaucaaggggugugaugagcucuggcccccaacacacguaguccuuauuucuuguaugaauucaaucaauaguuauugaacaccuucugugugcccggcgcugugcugggcaccagggacacgcagcuacacaaucacauggugucugccugugugugcuuccuggcuggcugucccuccucagggcaagcaauguucccaaagggaaaggccuuccuugggaagguguaagggagacuggccuggggugggccagccugcugggacucaggaugggggagguagagggaaacacaaaggcuggucuuggcgaggaagggccuuuguccuuagggucccagggaggccuuggaggcauuuucaggcagaaguggcaccggugggucagcugugagugaguguggaugggaggaggugaaccccauggugagagggacuggaccugcgugugugggggucgggugcaaugagggauauguguguacaggguggguggcguggccaggccucagugauggugcugugcagggcuggggcgagcugauguacgugacuguuggcuacagggaaaccugucuggauucuguagguuguuuuaucaaggcagaccuucaaccacuggucuugcagccucugcucccacuccucuagugacaggaaacucaguccuuucccaggcaacccugaaaaugagaaccuucuuccccuccaagggcagaguagaaagaggccgggagucagaggaccugguuugagaugcugucaggacugcccugucauuuggcagcugcccucccuucucuggaccucaaauuccucaucuguaaaguggacacagcaguaucccaggccccugaggcuguugugcagggucggugagaugauguggccuuagcucuuugugcuuagggagcaucggcuccugguucauccacuguuaccguucuaugugguucacauaggacauuggccaagggaggcccuccucuugcagaucagaagugccgggugugggucagggugcuggguagaggguccacgugcaggggugggggcccagggaguaacugggcauccaggaggggaggaagaaugaacugugguuugcaaagugcagaccccacuuucccaccugcccaucuguggccaagccaacugcagcugcuguccaucuuucccaugccccaugcugagcagaacuauuuguguccagccgaauuugugaagcuuagcaccuucuagaagaggagucccuugggaagaagcugcccacccacucgugcuccagucaccucugauuuauuccaccugccaggaaccacuggugggugcgggcuaggaggcaggcuccccaggaugggugccuggaggccucugacaagcccuuccuuuucucugugccuccuccucacuuugccuaucugugcaacgggcaugcacuuccagcugugaccccuuaggaaccugugggccuuaggcugcacugaaggcacagagcaggugcagcaccuccacauugcaggaggccaucuugccguugaaggaagagcuugcucugaaagcuguccuguuccuggccugagcugggaacuggggacaaagcagugacaugagcccugaucucauggaacucaugccagccaagaagguuccaucaagcuggaugugcuguggcucauguuacaaagcccguggaucuuuguuucccagaguguauguugguuucagcacucagucggcccaucucaagaggcagcgugucuggcuuugaccugguggcaguaugcuucugucacugaaagcuguguggccuucggcacacagcucuccuccuuggagguccaguugucgcuaagaugggauuggugcucccugccuuugggcugggugaagguucugggaggugcacugcgcaguuccuggccugugcagggugcucaguaaauggcaauugcguuuuagcugaauucuuagggaagcuguguguccuuugcccggccugucagagauuuaaggggugauucaggcaucuagaggaggagggagcugacaauugcacuucuguuuugcuuuuuguuuuugcuuuuuuugagagcaguauucucugggaggcgaaggguagaaaagagagcugaguuugagcuuuggggugggcaggccugaugggcuggggaaggugugugccucucacccuaccacaccuccccuagcccugccuugauuuuugaggugcugaugagaagugucugcuuuucuuuuucaggcccagacccuuccucguccuaguucuggaggaccccaugagcuccucuaaccaauccccuccuuuuucucaugccccaguaaacugaggcccaggaagaugaugggacaugccuaugcucucaggggcaccagagcuuggcuggaacccagggccuugaccccagcaugaagcuuuucccucuccgacuucguacucccaccccccgcacccgugcagggccccagacggcaagggauggugagggaaggaaugauugggccggguggggcugcagaacuuauaauuaugaaaacuggguaaacaaacaagcucucugggagagaagcaagcccugugcgggccucacagaugggccuguguccgaggagacagcccaggcccgucuaugcgcagacagugaggggcuguguuggacuuaaaaagccaaagccacacuccccucccacccccacuccuauauuucaggcugccaggaaaagaggagggggaaggggcagcccuuucuuccaaggagguaggggcugacccccuaggacucuccuggggucagcccuccuggcccagcuugggacagucacagcucacugugugaccuuggucaaggggcgucucuccucugggccucaguuccccaucucuagaguggaggucaccccaucucucaaggaggguggcaggauggggaaagauuugagccaacugguugaauacacugagcccuuucacucacccugacccgaggccaacugggaucucagaaacucuucauuucucucuggccagaggcaggggccccucuuggagcagaggagugacuuucucagugaccugagagccggccugguccugggaggccaaaccuccaauccuggccugacuuuagcaggcugcccagcucagcuuuccugucuuccugcugagauuguggcagaauccgagaggagcuguuucuggugccugcccugcaggcugggggcugggcagcuugcccugccuggaggcccccggguggagccuggcagacuuccugugcaauuggggcugagcccccgcccucccuccccucuuccugcaguccccuguguggcuucugggaguccagcucuguagaugggaggccgguccugcuucagaccucuguggccuugggugaacuccugccucuccuccaagccucaguuucccccaugguucaauggagggguuggauaagagccucugguaguagagugaccuugcuacuaaccaugugucacccuccuucagacugacccuuccaggcuguccugugcccucgaggucaagcccagacccugaaaugcccucacagaccaagcccugcagccaguagccccacuccugguaggcuggaucaggcucuuccucugagcucccacagccccuuggccacccguguguaccuguagcccuucucacaugguugugauucauuuuuguuuuugagacagggucuugcacuguugcccaggcuggagugcaguauugcaauuauagcuuacugcagccucaaccucccgggcuccggcaauccuucugccucagucuccccaguagcugggaccccaggugugcaccaccacauggggcuaauuuauuuuuauauuuuguauaggcagagucucccuguguuacccaggcuggucucaaacuccugagcuaagccauccuccugccuggccucccaaagugcugggauuacagguguuugagccaccacgcccagcccgugguugugauucuaauucccaucugugauaugaguaccugcgggcuaacucaccaugggcuccccugagguggacagguggccucacagcucagacuugcuccaccagcagcugaacaaguacccuaggucaggcuuuaugccuuaguuucauuggcuguaaaaugggcaugaugaugcuucuacuccacuggauuguaaagguuauuaaauuauguguguaaagcacaagaaaugcugaggagucaauaacuguaaugaacauuuauuagugcaaauuguuuuaguucccuagcaggaaugaaugaaugaaugaaugaaugaaugaaugaaugccauugcaagguccuacauccugggagcauggggaucccaaagcucucuggaugaagguccugguaggugcagaaugugugugugugugguugguggggguugguuacagaggggcagggcagaugugggaggggcuugggguggugacguacccccugcccuuguggaaggagugguuugggccccuccgugucucagacccgcaggcacgaagccauguggccauccacaacuuccuuccuccugccuguauuccucgaagcgugacucacuggcuuugagcccuucauucuuguccuugagccccgagggugaggcggguagagucuuucuuggaagggcggcucucucucuggguuccugucuauuccuggcccuucugcagcuucugagcaugacaggcagggauggaggggugcggguagggugggguggacaccugggcccugguccugguggccccacugaccccaugugugucaggcuuggggugggcacccacugagggcccacccagggcuuggaucugagcugguguggcugaaacagcccagucaagcucaccugggcccugccccuguagagcuccugucuggucaggagacacacagaacaacuaccacucagucauuaauuaaaaucauuaccggagggcgaauugcuauaaagaaauggccacucuucccugggagcucacguguccugggaucuccccagcagugccugugguuugcucuccugucacagaggaggaaacacagcccacugagugggaaagggagcaggcucagcucuggggcaaguccugugcccaccuggggccucaggaucucgucacccaucuuagaggugugcuguucacgugacccuccugccuuggccucccaaagugcugggauuacagacgugagcugccgcuccccacuagggaaugcuguucaggaggcccaggguccgccgcuggccccccaugguucugggugggcgggcuggcuucgggguuuuagccuggggacuguggaacugcagcgagagcuggguuuguugucuuuaaaucccuccuuugugugucccuagacagaaaccacugugacuaaaguauugggaucuucuaaaggcuaggcaggaaaugggggcugguaaggguggucgucccccuucccacucccuccaccaauacacaggacagcagaaagguggcccaaagcccugggagaaacccaccccaacauuucacaucuagaauguaccgcguuagguaacaaaaugguuacauuacagcaugggggauggaauggaaacaauguauuaacaggcauuguucaauggcauaauaugaagccauuaaaagugaugauucaguuuuguaugucugaaaguguguauguuuguauaggcauagaacaaaauaaggaaagaaauucaccaaaauauaaauagagguuauuuuggaguggugggauaauggauuauuuuaauuuuuuuauucucuccugauuuuuguuuuuuguuuuuuguuuuuuuacagugaguggauuaaaucaaaaagaauaaccugggugggugcagugguucaggccuguaaucccagcauuuugguggcucacgccuguaaucccagcacuuugggaggcugaggugggcagaucaccugaggucaggaguuugagaccagccuggccaacauggugaaacccccaccccccgucucuacuaaaaauacaaaaauuagccgggcaugggguugcacaccuguggucccagcuacucgagaggcugaggcaggaggauugcuuuaacuugggaggcugagauugcagugagccaagaucgugccauagcacuccagccugggugacagagcaagacccugucucaaaaagcaaaaaaaaaaaaaaaaaaaaaaagaaaaagaaaaagaaaagaauaacccuauugacuguauuuaguggaacaauuugauuccugucugacuucagaaucuaagccauucuggcccgacuggagccccaaggggguugcaagcacagggcaggcuccggagcggggaagagggaagagaaaauucuggaagagggguguuugagcucaaucuuggaggacaggagggauuuuuaaccagcagacuugggguaagggugaguggagggcauggccuggcauagacccuugcuuauccaaggcagggagcugagcacagccuugagugccaggcaaagggguuggggaauggagaguccuucccaugaacacuuguuagcuggacuuuagaaugaggacucaguuucugugaugagggcaaggagagcaacaaauuuguguuagguaggcucugucugugugcccagccucugagcccccaguggcugugagcagauaggacugugguaguuuagcccagagauggcagauggauuccacaaauaaagagucucucuccgugaugagugcugaaggccgggcgugggugggggcauugggguggugaggagugguuggguaccauccaacugggaaagccuaugacccaucagaccuccaguccggaggugucccugcuaaguaaaaaaaaauuagccaggcaugguggcacaagccuauagucccagcuacucuggaggcugaggugggaggauugcuugagcccaggagguugaggcugcaauuagcuggaucaugcuacggcucuccagccugggcaacugagcaagauagggcuccaggccagacagagcuccagguccccaggguaauaugcacaggaugcugguaccuggcauagaacuuggguggccagaagcaugcgcugcacgaggcugagcacgaagaccccauucugcuguguuuagggcuucccuuccgccugucuccaugaugaccucagcucucugcuuucccuuacccaucuguagcacagggaugguugcagcuaccuucaagaggguuguugugagcuucaugccagggccaccccugguaccuggcacacagcaaauacucaggaagaguuuccguccucgggguucaguccccagccagggaacuccuucccuccuggaggagccucagcagccugaacuugauggccaggaugguauuauaucagguugcuuggcggugagcucuggccucccccucagacccacuguggcucccaccuggcagcaucugccaaaggucagguucucacagcucuggagguuuggccuuucaacuuugagcuuccccagucuucccccuuuauuguuuuucaccuuuuauuauuauuguuacauaagcaauagcuaguggucaaagaaaauuagaaaauaacagauaaguaauaggaagaaaaugaaaaucaccgauaauccuaccacccagaaaagacuuucaggcaccuuccugauacauaauuuguucuucuaccuuaauagugaguagugggccuccuccuugugaauggauacagaauauuccauuauggcugagcaaggaggcuaaugccuguaaucccagcauuuugggaggcugagacaggcggaucaccugagguccggaguuggagaccagccuggccaacauagugaaacccugucucuacuuaaaauacaaaaauuagccaggcgugguggugguggacaccuguaaucucagcuacuugggaggcugaugcaggagaauugcuugaacccaggaggcagagguugcagugagcugagaucacaccacuauacuccagccugggugacagagcaagacucugucucaaaaaaaaaaaaaaaaaaaaaacgaauauuccauuacgccucaauagucuauauuuuaacuuacucagucaaagcccuauugccaggcaguuaggcuuuuucuauuuuucuuuuuuguuuguuuguuuuugagauggcaucuugcucuguugcccaggcuugagggcagugucaccaucauggccaauugcagccucaaucuccugggcucaagcaauccucccaccucaaccucccaaguagcugggacuacaggcuugugccaccaugccuggcuaauuuuuuaaaaaaauuuucguagagauggauucucacuuugucauccagacuggucugaaacuccuggccuuaagugauccuccugccucagccucccaaagugcugcgauuacaggcaugagccaugguguccggcucuauuuuuuguuguuguaaacagugcuguguuggaaagcuuaaaucaauuaaugggauugagccauugauuccgcaugguuugagagccaucucugcucagugucaggcugugugcugggacugggggugcuggguggggaggcggccaugguccucaaccucuuggggaccccugucuggggaagacaggcccagcauggcacgccagcagagguggggguuuagggcaucuuugggagccagggagcagccauaacccagaccuggagagucaugggaggcccagcugaggacaccugcagcuggugaccugaggguggggcaagcccugcaccugcugcuggcugagcucaugggaggggaccucucaggugagccacaaaggauacaggaggagagaguuucaggcagagggcaggucugcagaggcccagaguagacagagcaugggcauugagggaaccaaaacuucccagagaucggugcugugguucuugccagccuggcagcagcucccaugugcaugacacugugguaguucuuuucuuuuucuuucuuucuuucuuuuuuuuuuaagauggaguuuugcucuuguugcccaggcuggagugcagugacgugaucucagcucacugcaaccuccgccuccuggguucuagcaauucuccugccucagccucccaaguagcugagacuacaggcaugugcaccacgccuggcuaauuuuguauuuauuuauuuauuuauauuuuuauuuauuuauuuuugagacagagucucgcucuguugcccaggcuggagugcaguggcgcaaucucuacucacugcaaccucugccucuuggguucaagcgauucucgugccucagccucccaaguagcugggauuacaggugcccaccacuguacccagcuaauuuuuguguuuuuaguagagacgggguuucaccguguugcccaggccggucuugaacuccugaucucaggugaucugcccaucucagccucccaaagugcugggauuacaggugugagccacagcacccugccaauuuuguauuuuuaguagagacgggguuucacuauguuggccaggcuggucucgaacuccugaccucaggugauccacccaccuuggccuccuaaaguguugggauuacagacaugagccaccgcaccuagccgguaguuuuuuuucaaagugccguuccaucugucccuuugugcgguggggaucacuggcuucccuuuucuuaaugggaacacagaagcagagugacgugcgugccccagggaaguggcuggcggacccaggccuuucaccggcccagcacacgggacaggggguugaagugcaggauccgccagcucugguuucccggcucuuugcaggugcuggaucacuugacaggauccaagcaggaagaggacgcggaggaucugagcuuaggugaccgccuuaguuuccaugaggagguagugaccuuuucugcugcugauaugugaccuuggccuggcccagccccaaacccagcccuauauuugcaggaaggguccugccucuugggccauacugggauuggagaggcccugguuuauauggaccuugggggcugggaagugucuguccccaagcuggaguuaaccuuucugggaauaugccauccuccucuggugucuuaacaugacugggagacugaacugcagagcucuggucuaaugucacauagucaggggauaaauauuucugugcaaagugcugugcuagaugcugggcauauguuaugagugagacagacagggucccugcccuccuagggcaaauggagauggaacaaugaauuauuaaagcaaaguugugcuaaugacuaacaggggucugaccugugugagcgagcuggcaacagucagggacagugcuuuucagcacccuaggcuggcaguuaggacucaggucaguucuaucaaggcuuaauggugggcuccucugggcuucccaaugugucaggaaggagcguugucucaugucccagguggagggcaucagggcguugaggguccagcaccaugguguccagucccuucacgguacggggaggagacagggagccaggaaggguggggggcuuguccagggucacucagcagcagucagguacauggauuuggggcccagugcucuuagcccuguaucaccaccccauuucacuggccagugauggggagacacugaggcgguccccacucacccucaagggacucccccggggaagcagaccaagaccacagaggcuguuggcugcgcagggucucucagggcgcacaaauggggucacgcaggcaccugggacagagagugggaggcuggcggggcugggaggggagccguucucccaccuccccuucuggcccccucuggagccugaggacaccugcagcuggugaccugaggguggggcaagcccugcaccugcugcucgcugagcuuagaguacagaccaagggagucuuguuauuugaauaaacuuuccuucuauccauguaaagggucccuggcauuccaaucugggauuggguuuccucuggcccagcagcaagcacacgaguggauuuucauauuggcucaucuuucuuguucucuucuuccccuucuuucccucccuggcuuugagaaggcagaaucgccccuccccagucccacucacugagaggacccugcaagccagaagcugcaggcagcagcaugcaugugugugcacauguguaagugugcguaugugugugaguggaugcacggugugugaguguacaugugugugggcaugcacaugugugaaugugcgugugugugccugcacaugugagugcaugcgugugggcgugcaugugagugugugugcgugcaugugcaugcacaugugagugcauguguguggcaugcaugugagugugagugugcaugcgugugggcauacacgugugugugaauggugggugagcaggggucacgaggcaacuugggaagaaccugacuugggcuuagggaaaggauauuagcaguagagggugcuuggcugaugagaucugugggguuuguguauccgaguuuaguccuuuuccauugggguugggccauggugacuggcacuuauuagcuguuaguucuuauuggaacagaagcuggcauuuauugggcucuuccugggagucaggcagggugacaggugcaucucacacaucuuauuuaguccucacaccaacucuuggaggugggugcucuuugacccuccagccucugcuuacacaccuccagugaugaggccuucccuacccgccagggucccuuauccugggcaucugaggccguuagaaagcccuugcugggaucuugugugucuucuguggaugacuugagaaugggcucugcuuggcaauagggcguggcuacggcuggacuuccccagcgucuguuuuccagggaacuguccaacucuaagguuuggggagaggaacaaguccucccuccuuucccugagcagccccuaugugguacuuagcccgucacagcuucauucaucacauaccaagcaagucugaagcuuaauguugaaacccuagagguauuuucauuagcaucgaucuggaugucuuagucaaugcaauaagagaagagagaaaaaaagagaaguacaaaugcaagacagcgggaaagcccucauggaguucagggacuggugacaacaaagcacuguuggucuuuggacuucuccacccccuaaggcugccuacaggaagcagagucuuggagagaccagaacuugcccagggccacacgugaguuggcggcagagcuggacgaggacucagggcccuugauuuucccaaccagcaucucuggugauggaugcagcagcuaagggagaggcggcaaggccagaguguucuccaugccagugucacagagcaggggggcuguggucggucgagguucucaggggugcgguacguuuggguguuggcuuucagaagucuucauugauguuucuugcuccacuucuccuuccugaugaauuaaccugagagaugaggguccagaaagauuggaccccaagcaugucaccuuuuaaucucaugacccaccagcugagggaccagggaggugcuguuccagucacccuuugcugguucccauugcguggcgugaaacaugggacagagaacugccaugagcacugaugagagaugccacugggcacccugaccauuuauguccuggccaccaauacugggacagauggagcuccuucgagagguuccaucacugccauugauaacaccagcccacauuugcccaggcucuguggguuuauucauuucauugaauccuuaugacaccuugcaagaugggggaucguaaaguugcuggguuuuuuuuguuuguuuuuuuguuuuugagguggaguuucgcucuuguugcccaggcuggagugcaauggugcgaucucugcucacugcaaccuccaccucuaggguucaagcgauucuccugccucagccuccugaguagcuaggauuacaggcaugcgccaccacaccuggcuacuuuuguauauuuaguagaggcaggguuucuccauguuggucagguuggucucgaacucccgaccucagaugaucugcccaccuuggccucccaaagugcugggauuacaggcgugagccaccgugcccgguggugcuguuuuuuguuguuguuguuguuguuguguuuuuugagauggagucucgcucuguagcccaggcuggagugcaguggcgcgaucucagcucacugcaaccuccacuuccuagguucaagcgauucuccugccucaaccuuccgagcaguugggauuauaggcaugcgccaccaugccuagcuaauuuuuguauuuuuaguagagacgguguuucaccauguuggccaggcuggucucaaacuccugaccuuaggugaccucccaaagugcugggauuauaggcgugagccaccgcaccuggccagguugcuguuacucccauguuacagcugaggaaacagagguucagagagaauugagccauguguugcugaaaguccuauagccagcaaaggguggaguuaggauuugaacugagaucugguuccaggaccuugacacugcacuguugaaggguccuucuugaccuaggacgugcugauaaaucuuuguggaauggauuaacucuuucaugccuguccgaaucuuggccuuucucgggucuucugcuuggcacacacucccuucccgguguccucccuccccuagcagggacucuuugugucucagcugcuaccucccucugggaggcuuccgugacccugcaggcuuggucagucaccuuccugggcuccugugaccuccugugcuucucccaguuggggcuccuaguaauuguaguuuuuguugacaaucugccucccucauuaggguacucucuccugaguacccaguggccaggauugcugaaugaaugagugagagcaacauaaacccuuucuuggccaucgugaugaagccucagagccucgccugaacuuggugacucgccugacaucugccauuuuggcuuggcccgcgcuggcugauggaggacaugggaucugggcuggguccuguccucagcccugccccagugguugugaccugucugauggggcggggcugagugguugacacugcggacaucuugggggaagggcuugaccacaggcucuuccugcauaucucaagguccaacaccaggcuggacgcugaggggaacauuggugguggguucucaggcccagggcagguguccaggcccguggggggcaccugccaaugugcacgagccacagcagagcacccuggguucccaguccagccucggcccuggacgugacugagagaagggguaugaggagcaccuguggacaggcguggggaugcuccucuggggccugggcaguuuugacagguggcuggcuaaggcucaggcuccuguggggguggugaggaugacaagaaaggaaugaaggccagagacauuguggagaaaaagucaacaggaaagggugacuccaugugagaggaaaggagggucgugucuacacaaucacugucauagaucagccuccuccuugggcguggccuuggccagggggccgcaggauggcagccuugggugcccacccccuggaguguggguccugcucuggguggugacgcugcugggggccucggcacccccugggcugcccucccagcgaggaucuguguucccagacggcaggcaugccucauccugggcucccagaacaagcugccacugugggcugugggcuggggccgcugccaggcaggcgggguggggggcaggaggggaugagagggcuuuuguuuccuucuguuugugucaagaugggaauggacuuccucccaccaggcggccucgagguguaaaggaaagggcagccccagugggcggguuuugggucacccguuuuuuugggugcauuucucugggcucccgccucagccccgcccucuccucccagcccuccugccucaaagcucacccuuccccaccagaccuguuguggcccagcccugguuaaauauuugccaaccgagaagaguuuucaaggcagccuugugaaaaaccccagcugacuccuggcucuguugggccugaccugccucugugaugagacccagacggccugugcccucagacugagucccugcccaccauggccucccuggugaccuguuuggcgccugaggcugggugaccuaacacuuguucggcacuuguuuaucaagcaccccccugggccuggcgggagcugggugcuggggagacagcggagagcagucucaguccggggagcgucucagaugaggcauuaacugugguugaggggagugccggggagcaggccaggggcugugggaguggaggccagggaggcuguggagaccugggaggccgggacuugucuggagggaggguuccgaggagguggcacuugagccuggggaggagaaagaggaguuggccaggcacaagggguggacgcuaggagggcacuguagacgugggaccccaaggccagaggccagauuuccuccgcugaggaggaagcugaggggcugagguugcgguucgcuuggguucgcugggugugaaagccccauucaccuguuucuccccaagauggucucagaggagcugggacacuaacagggcaaugggacccugggcagcuuuuccccauuuccccagccucaguuuccccaucuguccaaaagauaguuuggacuugaucuuggaggucccuucccagguccaguggccucuuaggaguauguggcuggcccaugaaugagggaaugugccauggcagggauucuaccagcaccaaaggccaagauaacagccauggccgggugcgguggcucaugccuguaauccuagcacuucgggaggccgaggcggguggaucaccugaggucaggaauucgagaccagccugaccaacguggugaaaccccgucucuacuaaaaauacaaaaaucagcugggugugguggcacaugccuguaaucccagcugcuugggaggcugaggcaggagaauuguuugaaccugggaggcggagauugcagcgagcugagaucaugccacugcacuccagccugggcaacagaguggggacuccaucucaaaaaaaaaauuaauuaauuaauuaaaaaaauaaaagaaaaaaagaauaacagccaugugcccuuauaggguucaugcagcccuauccugguguuagcaacaaaagccaacaucuccugagugcucccugcccuagcaaccuugugagguggugguggaggacuaugacauuauacccauuuuacagauaaggaaacugaggcccagagaggcuguucugagcucaggguuugcuucuuguuuuaagcauggcuccagaaauacccgucucugugagaaacccacccuccucucccaaggccagcgccauguuagguaccagggauacggaagugaacaagauaccauuccaaccugggaagcugccagucgagcaaggaaugucccagcagagagucagcaaaugguucuagcucuucucucuuccagcacaguuugagcagcgaacagaagcaggcuugccuucacaucccaguuuugcucuucccuguguaguaucgggaaagucacuuaacuucucaggagccucagaucccuuauccauaaaguggguuuggcaguacgucccagugaggguuaaaugaaacaauguugacuauaauuuuuagcauauaugggaucugccucugugccuggcacagaacuaacuguuacaugcauuagcucauguugcaauuaugauuauaauuuucugcaaguggggaacugaagaacagugugauggaggagaggaugggugagcagggccuugaaagucuggcuaagauugugaacuguggaauugaagggaagggcgguccagccagaggacacaacauggaugaagauguggagguaggaaauguguaauggaggcgagagacgcccaggguguggggaugggaaggagagcggggcugagguugcggaucuuggaugugauucuguguaacaugcuugugggcuucagugugccaggccuguggugacaaguuaguccauagucucuuggggccaucagagcccagagagauccuuuacaaagugcuucaugcaaccaucuuccagauguuuccacagcccguggagucuagguucagccagccugggcucacaccccagcuuggauuuuggcucccugcuugacagccggcugaccugggacaaggcccuggaccuuccagccucugucuugaucgggggugauuccuguaccacuuccugcagcuguuguccgggucuaugucagauggcgugagguguccccagccagcgugacacccauuagcuucgggguaggagggcucccuaacuguucugugccuuuuuguuccugguguggagacagagccuuucucccugggccauuuugagagucgagaaugaucucgcacuggaagucccuagcugagggcuggcucacgcagggucacacggcugucauugucgggccuuggcgugcugagggaugcugucuuuaagggaagagguuuuuccuuguuaauaacuggccuuggggccaggcacaguggcucacgccuguaaccccagcacuuugggaggcugaggcggguggaucaccugaggucaggaguucgaggccagccuggccaacauggugaaacccccaucucuacuaaaaauacaaaaaauuagccaggugugauggugggugccuguaaucccagcuacuggggaggcugaggcagaagaauugcuugaaucugggaggcagagguugcagugagccaagaucgugccacugcacuccagccugggcaacagagccagacuccgucucaaaacaaaacaaaacaaaacuggccucagggaagagugacgcagccaagggccccuucagggcaccugaggccagcagggggggaaaugucgguggcagccaccuucccaaggaaggacagcacaguguacauuuccucauccccaggacccagccaagggccugcuccgaugucagccuccguuuccguggugaggaaucuccggggugugugggggcuuauugcucaguggcuucguggcucucuuuugggggugggucuggccugagauuggcacuucuggccuguugcugugggcuucccuuccuuuuccacugcgugccaggcccugccccaggagcaggggugcugccugugggagccacaugaggaacagaccuuuacccaccaggaggccagcggugggcugcgggaauagguggagggcucccacccagccuggggcuuuccaguugaaagacgcaugguggugggcugaggagugagcuuggcggaagacuguauuccggacauggggagcagccucugcgagaccccagaugacuugggccugcgggcaugguaaggagcucaguuccaucccagaggcaguaggagcuguaccacuggaagguuucugagccaggaaacguugggcaacuccccuguggccccugugugugggaaggaucagaggcagccaggauggaguaggcaggacuucaguggcugcggcgggcacaggacgggaguggccuggcuggggggcagugacuagaggcacaggcuggguggccacuugacuggccccugggugcuggggagccugccucacccuguugggcuugugcuagggggcagguagugguggggugggaaucccauaggcccuguuucucucaggcccagaaggggggucccaggggucugcuguuguaccccuucugccaaggauggcucauggagggacccugaauccgucccuugccuucucugguauggucccucuucuggacaggaauugauugggugggggacacucagcuguccuccuccuuccuggccugccagauucuggcugcuggcucaggcucuucucguggaugggcugcuggucccccuccugcuacuugauggagccugucauuaccccucccacccccaacuucccaccugauuacagguccugagcaggagcccugugucugcccuucccguggaggccacccacaggcuggugcugcggaggccagggugagaugguuuugcccaaacguugguucccuguucagaguucaugucauuuacaagcugugugucccuggagaagucccuuaaccucucugagccucaguguucucugggaagugaggacagugcgugaaauaaugagugugcaugugcagugccgugcugggcacagagguggugcugacaaguggcugcugcuauugugugucgauugugacaguagguggggggcaaguagaaaguagaaaggcccugagcgaggcacuggucuaugccaacccagcucuguuggaugugcuguguggcccuaggagagugucaccaccuuucuggaccccaagcucucccugcugucucaggcacaugauggagaugguggugcuugggacaacucugagaccugcgagaauggagucccugccccgacucugccucugcuggucccuggacuguaggguggguggggucggcaccccccucuuucccccaccuccccaugcuggaccugcucccuaugcccugggaaccaggcgggcagguucugagccugccccacccuacagggugcugcuaccugccugguuucagucggcaaaccucucagcccugaaacccugaaaccgggcugggccucgugggugaggugugucccuggagcccacuggagagaccggaugagccaggaacgggucuggcacagcgcccuccacuggggccaaaccagggcuggcgccggcgugcagcccccaugguggacaugagcuggauguggucgcagcuggagaugacucucuuccucuugggucccccguccguguggaacaggguuucaggcuuaggcaucaggucgggaccagggugcagauccuaccucugccucuucucagcagagugauuuggcagagguacccaguucucggucaccuggucugaaauguucugccaguaccaauaccaccuggcccgagguugaguugaagaaucgggggcacguguccaagcaaaaugcuuagcacaggagcggcacaugguggcuuuggggagcgucaugacaaggcaaagaaggaacuccuuagcuuggcauucgaggcccuccgggauacgccuuuuuagguccauuuucugagaaccccuggacuccuuccuccauucucagcucagcaagccuccucuccucucugagccucaguuccccuaucugcacagugggccugguaccccaucccccagcuccccaagccuccaggccacccuggggccuccccaguucuugcccagccucacuaucugcacaggaaguagcguggcccuuaacguugucaguuuggaaaaucagagauuaauuaacguuccggccgccuuggcugcuguuggagcuggucccagggugggccaggcugcaugcucagccucuguuucaagggccucacuguggguuagaggaaccuugacaagaggcacuucuuaggagcccccauuggugaagugcccccuucuugccaggguaaagggcuucaugcucaguagcccguuugucucauaacccauucaggcagauacuguugugccauuuugcagaggggaaaauaaaggcucagagaggagaagugccuuagccaaggccacacagcucauagguggcagagcugggacuuggacccagagccuguguguccauguagaaauggugcccuguuugcaggugauggggggugccuaguucuccccccggguccuuuugucuggcccgagggggcugugaucagcugcuggucagagcugacucaccagcagcucacaggaggggcugaggccagcaucccggucaguuccuggggccagggcagcacugauuagauugucguugagauuuucggucagcugagcugacagggacccacccucccauuuuaaaggugggaaaauuagggcccagugaggaugaagaaguaaggcuccagugggucggaugauucuccaccagcuccgacccgacaggggccaguggagcuggaaacccuagaccucagucccggcucugacaccugccagcuguugccucgggaaagucacuuugcccucugagccucgguuuccucgucuguaagaugaggauaguaaagccuuguguugccucauucuugggauugggcaagaccccagcaagagaguggaaaaccagggguuugaaagcggcauugcggguccucgugaggggucacugggaugagaggcuuugcgggguagggcucugugcaggcuuuggugggagacaagguccaaaacccaccucuuuccccuccguugugugucuuugagugagucagugagucucucugagccucacuuuucuuccuuucuuuuuuuuugacugacccaaauuagaucuuuauuguauuuuuccacauaucuaucauucccaaaagaucagucagcucgauccuuaauuuuucuuacuaugagaugucccuaauacacagucuuuguauaaauuauccauuuuaaguauauagugaauuccagaugugaucacaacugcauuucuuucuuuuuuuuuuuuuuuuugagauggagucucacugugucucccaggcuagaguacgauggcgcaaucucagcucacugcagccuccaucucccagguucaagcaauuauccugccucagucucccaaguagcugggauuacaggcgcccaccaccaugccuggcuaauuuuuguauuuuugguagagaugggguuucaccauguuggccaggcuggucucaaacuccugaccucaagugaucugccugccucggccucccaaagugcugggauuacaggcgugagccacugugcccggccgcacaacugcauuucuuuuuuuuuuuuuuuuucuuugagauggagucucacugugucucccagguuggaaugcaguggcgcgaucuuggcucacagcaaccucugccucucagauugaagugauucuccugccucagccuccugaguagcugggauugcaggcacgcaucaccaugccuggccacacaacugcguuucuaaauagccaugugacacucacugagugcuuccuggguggcagccgcuguguuuagccugagucucacuuuucuuaucugucagaugggauacuaauaccuguuaggauuaaacaggcuguggagcaugcaguaaguugucgguggauaggcaccuaucccuggcaaacucuggggauccaggggcagaguuaggaggacuggcuugugaggggguccuucucagucacccucaauaacccgauaggaugcagcccuuggagacaggguuccagucauauggggagcagagccccccugagauccacagagcacccccuuauucaaccaacuugcugaaaggguuggcucucagcuccacaacaaacccacaaguguguguugugaguuuugcccuggaccugcauccccaaaaguggccucuucagagguggaugcagcccaguacccauagagacaccagguggagacagaggccugggaugggaguggcuuccugaggucccugggcacagaucaggacucaacuccacucccagaauucacacacugcccucuugggcuaagaagggaaccgggaccccaacaggcaggcgccuuuugugacaaccucugugaggggccucggcagguuuuguggacugacagaguggccuuuccugagcuguuuaauuguucugagccucgguucauacagcuguaaagugaggguuguauuucccucugggccauuugaagaaugguguguguuggggcaaagaacaggugggcccugugucugaugggcgugggcuuaccuccugcuggcagaaagcgaaaagggggcaaccaacggcucugggcgccagcagaggcuaaggguuaugccaggggaucccagccacgguuaggcaggaccccccaucaaacgcagggaccugcugucccccuuggcuuccccgcaucugugaucuuuguuuguggaaggccucccaucauuaucauuauuauuuugugauucuugucccgguucuucagaaaacaaaucuuuauuggauuauuucaaacuauaaaaguuauacugcuaauaaacauuucaaacagucucuuaugacugcuguucucagcugaggacacugaugauuaacagugacguuuauggaggccuggagcugagcaccucaaacgcuauccgguccugcagagcucagagcucgggaacagcuucggagaggcccauuuacaaaugaagaaugugagucucugagagcuaggcgcuugcagggcuggcauauggcagggcggggacucugguccugacuucaagcuccucaccaggaggcugggcaccuggggccgcagggcaggcucugugaguccugccccacuccauucccugccuucucaccuagcagcaccuggggcagagucaaugcagggaggcagaauggaugagauaauguggaaagugacgaagcuggcacacaccuucacaccaccccaccccagccucucuguagcucacagaagcgagugauuucuaccaccagcuggagccccccaguuccugggcccaggaccugcgggccagcccugccucuguagaugggggcacagccaguuuccucucugcccucuaaggggagguagggggccuguggggcccuguagacaauggccagagcuaggaccaggaggguggcaugcagccgacuauggcucgaaccuaauugccuccaucuggcugugugaccucagcugagcugcucacccucucuggcucacauuccccuaacagggugguaagccugaguguuggaggcccuguccaacaucugccccaaauccguggcguguggugucuccagaggcugcggcaggaaauggaaagagcugcugugggcaaguauggaggaaagaggggugcccgggcucaggacccccacagacacccaggccgggacgccaugugggaauuugaguuguaaaauccugaagcaacaaugccgggggagagccacugcagggagcaagaaggaaaagugggguacuggguggggccugccuggacugcagccccagagcucagcagguaaggcgguggccaggcuggguccucuggcugagcccccaccagggcugcagugcucgccuggguccucuuccagcaggguccagccaggaaggcccugcaagcccuuuguccaggcuggcccccucccaaugcugcuggccuuuugggucccucuggccuccacaccugggguccccagcacccgaguccucaucuucugcgucucuggguuacuuccucuguacaaagcacguggcgguuccuuccaugcuggcugaggacaucucucaagaaugugcucggggcuaccccugccaaggagccauccguggcccuguuucccaugguccucccuuucuagcucucccguggucgccacccuucuucugagcggagcuggcuucccggugcugccugggcuccguccuuaagguccuuaaccccuugcuaaugcugucccccuaccugcagcauggcgcucccucaguacccccuccgaugccugccccacggccuucccuuguuuggacuuaguaacuauuuggcugcuggaccaaacccccacuauuccuccccuugccgacaucugcuugugccaggccuggugcccaggauccaguggugagcaaaaggagaccagaccccuccagcagaguuccuggcccucccuaccugacccauuuggcuccugaauucugagagcaagccuggauagugagcgacuccagccccaccuggggccaacgugacaaaccuagagggaacugcauccuggaccccuggcccuugccuggguccccucagcccgaggcccuaggccugugggcagcacugcgcugguccagggaccugaccuucagccuugaccuucagcucccacccugacaggcagcggggucccugcacucccaugucucccuuccucagagcuuccugcagcuuccucuccaguccacagccugcccaacuugggccuuaacugucccucggugggacaugccugggccuucuccuggcucagucuugcccucuuuuguccuccccagcccagcccaggggccuuucugaacccagcuccucccugccuggacaccauaucuggacugugcuguccgggcaguugagcacgggcugcggucaggcagaccuguguucgaguccucacagcaauggcagcucccuccagggccugcuccgugagggccaggguggcagacuccagcccuuugggaucugucugugggcugggugcacuggggcuggcugggggcccuggagccacggccaaaggaacccugagaccugcaggcccaagccugcccauccugccgaccacguugauagaaugccuguggggugcguggcuugacuccucaucccugaaauaggaaaacaacagcacuggcuuccugggguucucauggagauucucuggguucacauacguaaaaccugccguagcacggguuuaaugcucugcaagugguggccaugacgaugacaaccaugguaccgauguuauugucagcuuccauccucuuuucucuauuauccccgauguaugacucucuuccauuugcccccucucugccucaugauuuuucaaaacaauucccauggucucagagagaguucugguuguuuaugguuuuuaaaaaauaggcauucaaagcaaauuccucauuuguucuccccuuccuccccccaaacuggaaucuggacagacaugaccucacuccaggaaaggggaguacagggagggacagggucuguggagagggguuggggggcaucccuccacccccaucacugaggcagggcccggggugugggcagacacccaggaaggucacaugccugggacccugguuaugagcugugaggcauggugugugacaugcccuuucagcccuccucccaggccaccaccuccugguggggacccaggacugcaucccagcucuaccacccacuggcugugugaccuuaugccagugacuuaaccucccugggccucaguuaccuccucuguaaaguggggauaacacagguucucccucacagaacuauagagaggauggaaugaaaugucauccuagccaggugcccucgguaccuggagacuggccaugggaggggcagguuccugccagcuccuguuuugagaaaggaccaggucuuugaaaccuggaauccaagacugucagagauggcagggccuguccgucaucgaaugcagccucucagugcaugggggaaaccgaggcucagagaggggagccgcacagcgggccagcacaaaucccaguugggacgcgagcugcagcuucuuaggaccaggaagccucuccccucauggguccgagacccucucugggccuccuccuucaucugaacaugggggcacccaggagcacacgugcugagccugauguggccugggccugccuucaaggccauagcacucaccucuauucagaaaccgcgcagaagacagaagcaaauggccagugaaagcagaaagguuguucacuugguagaggcauuaauuuuagaauguuuauuuuuuauuaugaaaggaaucaugauuauaaaauaauucaaaugcuauaaaaggaaauaaaccaaaaaugaaguucacucuguacuccccacucccacaccagagguccugccuuccuagccuggcaugcugccuuccagaccuccuccacgcacccaagccuaaguaagcuauaugcacaaauaggaggaguuuugguuuuguuauguguguguugagacagggucucgcucugucgcccaggcuggagugcaguugcacgaucauagcucgcugcagccucgaccucccugggcuuaagugacccucccaccucagccuccugaauagcugggaauacaggcacacgccaccacaccuggcuaauuuuuguuuuguuuuguuuuguuuuuugagauggagucucgcucugucgcccaggcuggagugcaguggcacgaucucggcucacugcaagcuccgccucccggguucaugccauucuccugccucagccucccgaguagcugggacuacaggcgcccgccaccaugccuggcuaauuuuuucuauuuuuuaguagauacaggguuucaccguguuagccaggguggucucuaucuccugaccuugugaucugcccaccucggccucccaaagugcugggauuacaggccuaagccaccgugcccagccuuuuguuuuguuuuuuuaagauagagucuugcucugucacccaggaugggguguagugguacgaucuugguucauugcaaccucugccuccuggguucaagugauucuccugucucagccuccugaguagccgggauuacagguacccgccaccaugccuggcuaauuuuucuauuuuuaguagagaugggguuuugccauguuggccaggcuggucucgaacuccugaccucaggugaucugucuaccuuguccucccaaagugcugugaaccaccgcaccuggccagacuuuuguauuuuuuuguagggaugaggucuugcuguguugcucaggcuggucucaaacuccugggcucaagcgauccaccugccuuagucucccaaagugcugggauuauaggugugagccacugcaccuggccagaaagcgauuuuuuuuuuuuuaaaugagcugauagucaacaggugacucugucacuugcuuucuuuccuuaauggagcaugagcccuuuccguuuguuggcaccuauccggauaggucccuccauuuuuuuaaauuuuuuuauuauauggagucucgcucugucgcccaggcuggagugcaguggugcaaucucgacucacugaaaccuccgccuuccaccaaacuuccagguucaagugauucuccugccucagucuccugaguagcuggccuuacaggcgccugccaccaugcccugcugauuuuuguauuuuuaguagagacaggauuucgccauguuggccacauugggcuugaacuccugaccucaggugauccaccuaccuuggccuugaaaaguucugggagccaccaugccuggccccccuccaucuuuuuacuuuuuacugaccugggugaaugaaccaauguauaccgaucaucccuagagaucacauucagcugcuccccgcuauggccucagugcacauucgccuuuguguccugcgaaucguucuauggggguagauuccuagaggugggagcauccaaggacaggacacccacccuccgaaauggcuguccccauuccuggcgcccccagcucugagugacauggccuguuuuugcauguccccaccagugugacgacaggaaauggagucuugguucuguuugcauuuguuugauucucugucuauggccauuacccgcuuucccaucuggagguucaccuuuuccaaggcaguugguuuucacaggaaacgcggggcucuggccagaaaugcagcgcagaugagcgcgaggagccugugcaaacaauuccacaugcaggaauuuggggcuuugcagccacuccugccuaggggaaggaucgugaugcaucagcaucccugaggaccucaagcuccugcuuguccuucucuuccagaaaaaaccgggaagauccugacggaguuccuccaguucuaugaagaccaguauggcguggcucucuucaacagcaugcgccaugagauugagggcacggggcugccgcaggcccagcugcucuggcgcaaggugagaggugcugggagggcucggguauguucugcuacuucucgccauguggccucgggggagugaccuuacuuuucugggccucaguuucccauuguuacugugauggccucuaagggucuccccagcuucuuuuuuuaaaauuaauuauuuuuuucuuuuuugagacagagucucgcucugucacucaggcuggagugcaguggcacaaucucagcucacugcaaccuccgccucccagguucaaggcacucuccugacucagccucccgaguagcugggaccacaggcgugcaccaccaugcccggcuaaguuuuuguauuuuuaguagagaugggguuuuaccauguuggccaggcuggucucaaacuccugaccucaagccaucugacugccuuagccucccaaaaugcugggauuacaggcaggugugagccacuaugugcggcuuauucaauuuuuuuuuuuucagacugggucuugcuguugcccaggcuggagugcaguggcgcaaucaugccucacugcagccucaaccuuccuggcucaagugauccuuccaccucagucuccccaguuacugggacuacaggugcacaccaucacucuaggcuaauuuuugcauuuuuuguagagaugggguuuugcuguguugcccaggcuggucucaaacuccugggcucaagugauccuccagccucagcuccccaaaagugcugggauuacaggcgugagccaccaugccuagccuccuucccacuucugaauagguggguaacccaggucguguuguugagaccccuucagucaccgugggugacuccuccuagcucaccuccuccaccaucagagcuggggcucuagagucuggauagucuccaauucaaggcaagcuccuccaguaagagccucaguuuacucaucugucaaaugggaugagaacaccuccuucacagggugguugugccugaagcagggaaggcacugucacuggcuccaucaugaucugcuaugauauaaauaguaggaugcuguuugcuaaggacauauuuguugagugagagauuagaagcugccuggcuccagccugagggucagcgugggccagagggggcuggcaaagccuucugggaagaggaaccugugauugacucggacacggggccgggggcgggacucaagagauccucccaccuuggccucccaaagugcugggauuacaggccucagcugccgcaccuggccaaggcugagccuuuaaguggcucauucaggauggcggaggcuggaccagcccagggcccuuucugcugugacugcaacccgcccgguggagggaggucaggaccgugugucggagcugcucagagcaucaccuuugcuuuuugacccagaaaagguugccucuuccccagugucaugguaaccucuugacccuguggcagcagagcgucagaggggccugcuguggcccggccugggugucuggcaggugcguaucugugugguaggaaaggaaagaaaaggaggccuuggacgcagcccaggugagcggggccagaauggcuccccugucuggaaagaaaugucaugggcagcccaagucccuauaauccaagacaagugggcacuggcugagggcgugaagcauuuccucugcgugaggccucauuuaagucuggggaggcaggagugcauauuuauuuguagaaaaauagcaacauguaagcaaggagagugaaaugagaucacucacccacagucccugaaaagcaguauuuuuggucucauuuuggccacucaggaaaccgaucaucacaaugcaaaguuaugauaacaucauaauacuggaaauaauauuaaucaccaguggugaucaaaacaauagugguuuuuauuagaaacaauaauagaauacaaauaaaaauagugauaauaaugauaacguaauaauacaacagaaauaagaauaauaaaacagcaguugucuuuuuguuuguuuuugcuuuuucagagucucacucuguugcccaggcuggagugcaguggcacagucucggcucacugcaaccuccaccucccugguucaagcgauucucauaccucagcuuccccaguagcugggaucacaggcauccaccaccacaccccgcuaauuuuuuauauuuuuaguagagacaggguuucaccauguuggccaggcuggucucgaacuccugaccuuaggugauccaccugccucggccucccaaagugcugggauuacgggcgugagccacagcgcccggcuaaaacagcaguuaucuuaugccgguacuguuugcucagccccguggccccacucugagggaggggcuaugaugaugccugcaucacagauguagacauugaggcucagagauguggagcuacuuguccaggaucuggcagucgguggugccgacacaggaguuccaguuaucugaccuuggggccugugcugucucugaccgaggcauuggagagcuucgcagagucuaaaauauuuugccugggcugucgaguucuguuucauuuccugcaggccuuccaauugaacacgacucugccauuugaaagucuuaaaaauaaaacccaaacccacagccagccacccauucgagcuccccaggaucugggggcggacugggugguggggguuguugagccugccugggccacaagccugcuucugcacagccuccugcugggcugggacuggcccugucccggagugcccguccuugugucccggggcuccugcccuaagcagggaugaagaugaaaacuaggggccuuuugcuaggguguuaugagagcucugucugcucuuucuagaaaagacagggauuugagcugggugugggcaguuuauacauagacggcugagggcagcucugugacuugggcaaagcccacugugugugggggugguaggggaaccauuuucuuuuccuguaaauauuuuuauacccgguaggaagaagccugcagguccuauugugugagcacaaugggcucuccuucuccaggaguguuuuguguuuccccuugaagagcagcagggagggagcuggggagagggggacauggugaaggggguggagagacgggacugcagggaugggccagcgcagagccaggaagccaggaaggugcaggcaugauggcaaucacccuuucuccaugagugcaucugagaaauguuucuuuuugcaaaaggcaccuuauuuauuguagaacaaauagaauuugcagaggaacacuguacucuccuggguucccucccauccaagacgaagccucuuccacuguggucuaucuccuuccagaagcuuucuggugcuugucugcucaggacgccuugcaccuggccauagcuucgcuugggcccccaacccuaguuuaaagaucucccuucuccuuccccauccccagauaagucagucccugaggauuggaggucgucacagacgcugaguccuaccguaguggucauggcgguccugugcauuaugcaccugccugucaggugccaacucuuacuguucccauuuuacagaugaggaaacugaugcucaaagugacuagacacacugugagucaggcagagcuagggcuuuguaggaagguccgggcguuucugcagcccauguaggucacuagccugccaggacgcgggucagacaucaaacacccccagacagaggcccccuccauucccccuacuccuuuuuaggaaggcgucucaucagccaucagagcugacaggcucucuggagccaccuuguucaaguuaucauugcccugaggggaaacagaagccuagagcuggggagaggcuugcccaggcacuggggcccucgcaguucuggccugugggugugucccccgugcccggagcgaccucggggcaccagugcuguagcuguagguggguggggagcaaccaucuccccagacccuuccaagguagcggugacagcccaaggcugggauggagagggagagccuggcuguggccaggcccuacaucagugccuguccuggguucaaguccuggcaucaccacccugccuggaugcugggugagccccuccacggcuccgagucucgcuccuccucugcagaauggaugagaugcagcccggccucagaggccuugggaggacuuggggagacccaaaauggaggacaugcuaggcagggggugcgcacacaggcucugcuggcugggccaucagcuucauggggagcaccacccccccagaccugggccucacuccccacccgcuccugcccacaggugccacuggacgagcgcaucgucuucucggggaaccucuuccagcaccaggaggacagcaagaaguggagaaaccgcuucagccucgugccccacaacuacgggcuggugcucuacgaaaacaaagcggugaggccuggccccgggcgccacacugagccuccccgcuuucuccaugugugcccccucccccaacucggaaacuuaggccccagacgccaccgucacagccugcacgcggucaccagggccagagcaccaccucagccccuccccucccccaaacugggcugcccugggugcccucucuggacggcagcucauucuucaucucuggggaauaucgcugacuccuucugucccucauaaaccaacugucacucacuccuccccaucccuccuaaucucucuucagucccuccagcuggcuccagggcguuccuccugccaccuccuuccucacugggcuuccugccucuccuccgaccccucccacccucgacagccacagagagcuguuggaggcacaaucuggccauuccuugcgguggcuugccccugcccuacagguggguagguguccgagaaggacauccuaugggagcauugugccuuaucuuuucccugagcccucagggaagccccaccugguugagccacagaccugauuucuucaauugcucauuucuccagagcagccagaaggacaggccugggcccuguauuucacggaagaucaauguuagagcaacauaaagucaagagcaaccucgugccccagaguagugguucucaacugguagcacguccaaaucaccugaagggcuugcugaaagacacggugcugggcuuucccccagaguuugauucagguugggagccaagauuugcaucucuuuuuuuuuucuuuuuuuuuuuuuuuuugagaugaagucuagcucugucgccaggcuggagugcaguggcgccaucucagcucacugcaaccuccaccucccuggcucaagugauucuccugccucagccucaggaguagcugggacuacaggcgugcaccaccauucccagcuaauuuuuguauuuuuaguagagacugguuuucaccauguuggcccggauggucuugaucuccugaccucaugaucugcccaccucggccucccaaagugcugcgauuacaggcgugagccacugcacccggacuguaaagauuugcauuucuaguaaguucucgggugguguugaagaucagagaccauguuuugcaaaucagugcccuacagguucugagcuacuuucaggaacuguguuguauagugacaccuaguggcagggaguagcaugguagcccugcuguaugagcuauuccaucagaacugcuuugcccccugcuacugguguaaguuucuagaccuaauucuccagaggacgcuugugugaugcucagaaccuaggaaauuggugggggcaguucaggguaauggucaaauaccccaggcucuggagauagauagcccugguucauguccuacaucugcuacuucccaacugugugaaguugggggugauccaccuuuugaauugggaaaauucugugaaauuaagcaugcaaugcccuuagcacagggccugguauguaagaaaugcuuaacuaguggagcugcugggaacagaggcaauagcagcaguagaaacagaacaacaaccucggccaagcucgcugaguccuuguggugugccaggcacugcagauuaucucacucaguccucacauggcucugugaggcaggaaugguuauuacccugguuuuguuuuuauuuuaaaauguuuuccccauccugaauauucuugauucccugguuuuauagaugaagaagcugaaguuuaggcauuuaaggaauuuuauccucagcaucacacagacacuacccagugaagccaggaauugagcccagagcuggggucuagguugcuguggaugccacacugccccaaucaccaugauagugacauucuccccucuguuccucucuugccucuucuuccuuucccuucuccuccccacuuugggccacacugaguagggccuugaagccaggugggauuugggcuuggccgcaccuuaacccucagggacccucucucuugccucccucaggccuaugagcggcaggucccaccacgagccgucaucaacagugcaggcuacaaaauccucacguccguggaccaauaccuggagcucauuggcaacuccuuaccagguaaaggagcacccaucccaggccacaaugcccugcacaggcaucuggagcuggccaggggagggguggcccugagcccauugcuuucagccccauguuugcggagagaccaacuaggcuuagagcuguggauggagaccucauuguuugccuuucgcaucucccuaaguccuugagagccuccuggaagauguucagugaccuucccucguaaaccugugggucagcacuguguucgucaggaguuacucuucuuggcauccugcuuuugcuucaccuuggcugaaauucccuagaagccuuacgggaacaacauuggccucucugaugaucccugggaacuagagggcaggggacaugccugccuggggggcaggucaugccccagggacuugagaguagagucaugccuucauucuguggugauggagggccugggcauuccuggauucgagcggcauuccuggauuccagcagcauuccuggauuccagcgugacucuggcuuuguuucacugugucugcuugggcgagucacccccccuccccugaaucucagccucuucagugucuacaaagcacaggcacuaagaggacugcccucgggguguuguguggacccuggaggggcacaggccaacccagagccagggcagaaagaagaacuguuauugucauaucauuaacaacaguggcagggucacagcccaggaccaguuaucucgcuggaucuuacauauccuugagaaugaaauugaaggagggaaaaauuccuuuugcuguauuuugucccuccccacaugccucccucccccuguggacacuuaagccacacuuuggccuccacagccgaaaucugaagggaaacccaagaagguagugcuugacccuugaaccugggggcucugaccuuguguuguuugugcuuuacagaguuuaaaaccuaacccaagagugggguggaugugacuuauuacccacucuaagaaaugggucugcacggaugcuggacucagguuuugggcugaggagaacacagccagaaagaaggcugcucccacccccgccggcuugcuggucaccuugggacaggcuggccuucucugggccugagccugaccucagagcugaugccaagggaucaguucucugacauccucugguggagggcaaccacagagggcagcugcucaucaggcacugucuccacagggaccacggcaaagucgggcagugcccccauccucaagugccccacacaguucccgcucauccucuggcauccuuaugcgcgucacuacuacuucugcaugaugacagaagccgagcaggacaaguggcaggcugugcugcaggacugcauccggcacugcaacaauggugaguggccugugggugcagggucggugggagggaggggcaggaccuggguuauugcugaauggugacaccuaguggcugacuaugguguggcaacccugcucuacaggcuguucuaauuucccuucugggguuauaagaaaccauguaauaccacccuuagucuucuuucuugaugaaaacaguuuugugcugcucaggaaaaaaguaggaaauuauucacagaggggugugguuguugagcccuuggacccugagucacaaagucacaauccugauucugccauuuuccagcuacgugaccuuagggaacugacuuaccucuuggaggcucuguaaaguggggauaaugccuugugugucuuagggggguuaugaggauuuagagucuaccucaugcuugguaaagauuuuuuuuuuaauuuuauauauauauauauauauauauauauauauauauauauauauauauauauauauauauauuuuuuuuuuuuuuuuuuuuuuuuaaaaccaccaaccugcagggugauuuggaaacuucacugccucccucagggccucauugcucucaucuguaaacuuauggggugacucuuccagcucacucauuuauucaacaaacauuuuuagugucuacucugaggaggcccagauuuaggcacugggugugcaacaagggagcaagaaacauucccugcccuccuacaauuggcagucugguaggggagacagaugauagacagaugaggaugccagcacgauggcucacagcugugcugggugcuggguggagccaaccugggagccugaggguguguguguguugggggaggggucgaucagggcaggcucccuugaggagguuaugguucagcuucagcagagaccugaaggagaagucccagaccugaaggaggagaugccagaagucccagggccccucauauccugcauagaggagaggggaggaguguuccaggcagagguaggcagucagcaugaagggagacccacaggugguagggguaggcccggaggaggaacugcacgaggcccugaagcagggagggggugaccugaaauggggcuggaggggggccucuggggucaggucuggaaaagccuugaaggccucuaaggaauuugaacagaaaggcugaggauggucuuccaaggugagggugggucccugggggucuuucugccccuagggaaggaacaacccaguccuggacacugaacugcuuccaggugaucuggccugagggaagcuccugcccccgccccacccuugggcgcagugccacauggugcagagguggaagguugcaggggacggagugggcgccaauggccucugggcugcugccgugggacucagcucaccccaccccuccugcucgccucuccagagccaccucugcccugucuggaaucugccaagcaggaggaaccaggucuucaaucaggccagccccugccaccugggcccagcugcccacaaagggccuccuguucccaggucccggggacugugggcugggacuggguggaggcacucaaggcucuggcugccuggcccagggcccucccgccuccccagccccuggccuggugccaucucuccagguuuccaaggcuaacggcugaccuggccuggcagggugggugaccugcgccagauagggaaggggugggcacagaacaagguggggaagggccaccucagucccccaugugugcaguggggaugaugauaaacuugagcuugagagaugauugggaagagcuggucuggguggggcacuuggccgugggccuggcacgcacagugagcacucaguggggaggccaugggggaguucuugguucuaaggugcaguggaccagagggaggcccaggagagcugcugggccagggaaugaagggguguccugugccaggaagguguccugccggguggccccuucuccccagggcgggagcugacgaggcugguuucaggccuuccuuccacccugcggacugugagaaaguucucugcuuccuccgucuuggaggcugggcuuggaauuugugaagccuggaauugcucacuccgggggcugccaggaagugggggguggggggaaggaggccaacugggcggacaccagcggucccagggaccccuucacauccugcauuccuggagcagcuggggguggcaggaggcagcuggggcacuggcugugccggguccucaguguuggccuggggugcagaggucaaggcuucuuccugucugaccguggucccccucugucugcugccugggagugaggaaugcaguuuccuuucuuggaaggucuccaggucuggcuagagucagcugguccuggguucaagccccgcucugccauccacuagcugaguagccucgagcaguaacugccucucugagccucaguucuuucccugggaaaaguagggcacagugagcugaggauucaacgagcugaugugugugcagccucagccagggcuggggccucaguuucccaagacugccauaacaaauaccacagaccgggcagcuacacagcagaaauauguucucucccagcuggaggucugagucgagggcaaggugucagcagggcugguuucuccgagaccucucuccuuggcugguggccggccgccuucucccugaguccucacagggucaugccucugugugccuguguuuucucuucuuucaagaagaaauguacuuuucuuuuuuucuuuuucuuuuuucuucuuuuuugagacagaggcuugcucugucacccaggcuggagugcaguggcgcaaucucggcucacugcaaccuccgccucccagguucaagugauucuccugccucagccucccgaguagcugggacuacaggcgugugccaccacaccuggcuaauuuuuuguagccagaauggucuugaucuccugaucucgugauucugccgccucggccucccaaagugcugggauuacaggcgugagucacugugcccggccaaaauguacuauucuuuuaagggcacuaguuguauuggauuuggucccauccucauccccucuguuuaacuuaauucuuuaagacucuaggaccaagggcgggugcgguggcucaggccuguaaucccagugcuuugggaggcugagguggguggaucucuugaggucaagaguuugagaccaaccuggccaacauggugaaaacccaucucuacuaaaaauacaaaaauuagcuggacaugguggcgggugccuauagucccagcuacuugggagcugaagcgggagaauggcuugaaccugggaggcggaggcugcagugagccaagauugcaccacugaacuccagccugggcgacagaguaagacucuucucagaaaaaaaaaaaaaaaaaaaaaaaaaagacccuggguccaaauauaaucacguucugggguacuggggguuaggacuccagcauaugaauuugggggguguggagacacacuucagccccuaacagcuaggcucacgggaagagcucaggaggggugacccugaaacuugucacacucagcggcugggugugcagaaagagagaaucccaagggucaaggcuggcuggccucccucccgcugucccggcccucugccucaccuucucgccaccuggaaagcaggccugcccugcacaccugacuuggugcaugcaggaugaaaauucccucuccccgugggagugccugcagguaacgcacuguccagauuuuccagucaaaacuugguuucuaggaaaccaugcccuucugagaggcgggugggguggcggggggaccuccuucccuggcccaggugggcagcccccacccagggcucugcaugcugcuccagcuggaacaucccugcccugcuccugucacuccugccugacuucaggucucugaaaugcaggagugagacucccacaggcccccguccccauccaggcagcugcgcuguagggaugagggcugggccucccccugcucagcucccucccggcuccgacaggcagugauuucuguggucagcuggguguggggagaggagggacccagagaggggcuuuuucucugccgguggugacucagcccauagucauggcagugggagccuuagguuucugaugcacaggcuuccguuuccccuuccugggcuuuggggaugcgguggucagaggcacgcggccaggggagucugccugcugccuggcucgguggcguuugaccaccuucuuaccccaagucagauuuuguaacuuccugccaauugccucccgggcacugaaucuggagguccacgccucacucagggguuuaccuugcuggcguuugggccacugacagcaccaacagugacaaaaauucagaaaugguguucuucuagcuguuauuaauagcaaacucuuccauucuuuuuuuuuuuuuuuuuuuuuuuuuugagacagagucuuacucuguugcccaggcuagagugcaguggcgcaaucucggcucacugcaaccucugccuccuggguucaagcgauucuccugccucagucucccuaguagcugggauuacaggugccugccaccaugcccagcuaauuuuuguauuuuuaguagagaugggguuuugccauguuagccagacuggucucgaacuccugaccucaagugauuucccccaccucagccucccaaaguacugggauugcaggcaugagccaccacacccagcuucauucuuuaacaaaguuauucaagcaucugugccagguacugaccuggacuuagcaguaacaggacagaccccgggcccaguggggcaggcagcuggcuccucaguuauugauaaaaaguguggcgcagagcagugcuggacccugaucuccugucccuacacuguggcccagggagccccgcaguggaccugugaggccauuguuccauuguucagaagaggaaacaggccauuucggguucagugaucuagaaccaggcucugaaaccuauggccuaugggcccagaucagccaauugccuguuucugucaacaaaguuuauuggagcagaggcacgcucauuuguuucuggaugguccguggcuguuuuugugcugugacuguagaggcgagcauugcgggagggguuuuauggccugccgggcugagaauaucugcugccuagccuguuccaggcaaaguuugaagggcccugaucuagcaguaagggaggaacuggggcucgaacaagggucucugggugccucuagggccauucuggguggcugcuuaugggacgggagcuuuuaguccuggcucugccacucccugcucugugacccugggcccguggccuguccccuaacgguugucucuucaucuguaaucaucuguaaagcaauaaggugaaugauagugcccaggucuuggggugguugggaggauuucaggagcuaaggaggaggcaagggggcugccuugucacuguuggugguggggucauuacugcuuuugccuaucagauacaaccaugacugcucugaugacgaggaaagugagggucccagcugccccuccugaggugcaugccaugugugugggggggguuuuggucaguucucaguuggucuugguagaggccacugggccaucugcugaccuccucucucccuccgucuccugggcaggaaucccugaggacuccaagguagagggcccugcguucacagaugccauccgcauguaccgacaguccaaggagcuguacggcaccugggagaugcugugugggaacgaggugcaggugaggccagacgggcuggugaggaaaccucagaagucacccaaggacccagcaggggagggcagggggugggguacagagauggggcucuggggcgcugccgguuuggaaggagaugacaugcuuagauuuggacaagugcagggccagugcacguggagauacucgcugucuuauucaucacuuacugggcaucugagcaccuacccuggacgaggcacuggggugcagcugggaaugauguggacaaauuccuggcccucagggagcucuccguauagcaggagaaacagacauuuggcaaauaaauguacacuuccaugugcaggcaaagcagggagggaguaugguauucuagguagggaaggcagccugugcaaaggcccuggggcuggcccuugagucugaggauccuacaggacacccaggcagaugaguugggaccugugggaauggagcucaggagagagggcagcagggagggugaagcaaugggccagucgcggaggaggugggggcugcagcggccuggcuugugggaaugcagagagaaacaggccagcugagcgcucuccagccccuggccuggcuugugccuccucaaccuagauccugagcaaccuggugauggaggagcugggcccugagcugaaggcagagcucggcccgcggcugaaggggaaaccgcaggagcggcagcggcaguggauccaggugggugggccuggggcccuggagcggggacgggaccugcagcuggugcggugcccucagcccuggugccaauucagcugcucugcccacagaucucggacgccguguaccacaugguguacgagcaggccaaggcgcgcuucgaggaggugcuguccaaggugcagcaggugcagccggccaugcaggccgucauccgaacugacauggaccaaauuaucaccuccaaggagcaccuugccagcaagauccgagguaggcagccacccccgugcucgacgggcccuccaggggccaagguggacuuucuuuuuauuucaugauucauguaaauuucacagcaaugacuugcucauugaucauuuguaagaauuagagccaaaucugcacugugguacuccaaccccugugaguuguuuuguggcuauuauuucuauaagcccagaacuugaagagaaaaauuuuuguucuggagguucaagccuucuuuucaucucugacucgucacagauuuuuaccaugugucauuuuaaaguacauuuacguucagcaaguauagcuuucccaggucaguuuauucugucacccaggcuggaauguaguggugcgaucucagcucaccacaaccuccgccucccggauucaaacaauucuccugccucagccuccugaguagcugggacuacaggcacacgcgcgccaccaugcccggcuaacuuuuguguauuuaguagugaugggguuucaccauguuggccaggcugaucuugaacuccugaccucgugauccgcucaccuuggccucccaaaguccugggauuacaggcaugagccacugugcccagacuguacgccuuucucuucccagccagaugggauccuuucaccagcuugguccccauaacacaucugcagagcucaguuuuagcaauugucaguugcccaugggacguucuuuuuauuuuauuuuauuucauuuuauuuuauuugagacaggguuucacucugucgcccaggcugcagugcaauggcacgaccuuggcucacugcagucucuaccauccucccacuucaaccccccaaguagcugggacuacaggcaugugccaccacgcccagcacauuuuuguauuuuuuguagagacaggguuuugccauguugcccaggcuggucucaaaugccugagcucaagcaauccacccaccuuggcuucccaaagugcuaggauuacagaugugagcgacugugcccagccauuauuauuauuauuauuuugagauggagucuugaucuguugcccaggcuggagugcaguggcacaaucugggcucacugcaaccuugccucucggguucaagcaauucuccugccucagccccucaaguagcugggauuacaggcaccugcuaccaugcccagcuaauuuuuguauuuuuaguagagacaggguuuugccauguuggccaggcuggucuugaauucuuaaccucaagugauccaccugccucggccucccaaagugcugggauuacaggugugagccacugugccuggccuguuuuuuuuguuuguuuuuuuuuuuuuuuuuuugagacggagucucgcucugucgcccaggcuggagugcaguggcgugaucucggcucacugcaagcuccaccucccggguucacaccauucuccugccucagccuccugaguagcugggacuacaggcgcccgccaccaugccuaccuaauuuuuuguauuuuuuaguacagacaagguuucaccguguuagccaggauggucucgaucuccugaccucaugauccgcccaccucggcaucccaaaaugcugggauuauaggcgugagccaccgcgccuggccgcccggccuguuuuuuaagagacagagucucgcucugucuuccagguagagagcagugguacaaucaugguucacugcgugaccuccugagcucaaguaguccucccaccucagccuccugcguaacugggacuacaggugcaggccaccacgccuggcuaauuuuuaaauuguuuguagagaaaggggucuuggcugggcaaaacucuaucucuuuuaaaaauuuuugaaagagagagagagaagggggucuuacuguguugcccaggcuggucucgaacuccuggccucagacaauccuccugccucagccucccaaagcacugggauuacaggcaugaguggccgugccuggucuccuguagguuauucuuuacuagccagauccugaguauugguugacagcuggauaggacacugagcauugacauuucuuguguggaacaaagaacguuagcugggcugggauggggguggacaucuaaauauucuugagugaaaaugcuuuggucagaauguucuggagaugguccccacccaaaggaagaaggcuuuuacauaauuaugcagagccagccacacuauuccagagaggaucagcccaguuuuuguaaaaccaagaggcucauugaaucuacuaagguauuuuucauugcuguuguucuuuuuguucaaacgaagaagcaagacccauccuaaaggaguuuuugucuacuucuagcuaagcagaacacugcugacaccucugggcuggcaguuuucuuauuuuauuuuauuuucauuuucauuuuuaauuuuuguggguacauaguaggugugcauauuuaugggguacaugagauguuuugaucaggcaugcaauguguaauagucacaucaugggaaaugggguaucuauccccucaagcauuuauccuuuguguuacaaacaauccaaguauauucuuuuaguuuuuuuuuuuuuuuuuggacacagagucucacucuucuugcccaggcuggagugcaguggugccaucucagcucaccgcaaccccugccucccaggcucaagugauucuucugucucagccucccaaguagcugggauuacaggcacauaccaccacgcccggcuaauuuuuguauuuuuaguagaaaugggauuucaccauguuggccaggcuggucucaaacuccugacgucaagugaucuuccugccucggccucccaaagugcugggauuacaggccugagccacugcaccugugcagccucuuuuaguuacuuuuaaguguacaauuaaauuauuauugauuauagucacccuguugcgcuaucaaauacuagggcuuauucauucuguaaccagaaaggggucccgauccagaccccgagagaggguucuuggaucuugggcaagaaagaauucaaggugaguccauagaguuaaagcaaguuuauuaagaaagcgaaggaauaaaagaauggcuacugcguagacagagcacgagggcugcugguugcccauuuuuaugguuauuucugaugacaugcuaaacaagggguggauuauucaugccucccuuuuuagauagagcauauagggagacuuccugacguugccauggcaucuguaaccugucauggugcuggcgggaguguagcagugaggacgaccgaggucacucucaucaccaucuugguuuugguggguuuugggccaccuucuuuacugcaaccuguuuuaucagcauggucuuuaugaccuguaucuugugccgaccuaucucaucccaugacuuagaaugccuucaccgccuggcagugcagcccaguaggucucagccucauuuuacccagcuccuauuuaagauacaguugcucugauucaaaugccucugacauuucuacuuuuugugcccauuaaccauucccaucucccccucgcccucgacuacccucuccagccucuaguaaccaucuuucuacucuaucuccaugggcucaauugcuuuguuuucugcuuguuuauuugucuguuuuuaccuuuuuuauugcucccacaggggaggcccccuccaaaaugucaauuugcuuuaauuuuuagaucccacaaauaagugaggacaugugauauuugucuuucugugccuggcugaauauaaugaccuccagcuccaaccauguuguugcagaugacugaaacucguucuuuuuuacggcugaauaguaccccaucguguauauguaccgcauuuucuuuauccauucgucuguuauggacacuuagguugcuuccaaaucuugguuguugugaacagagccgcaacaaacacgggagugcagauaucgcugcgaugggcugauuuccuuuauuuggguauauacccagcagugggauugcuggauugugugguagcucuauuaguuuuuugaggaaccuccaaacuguucuccauagugguuguacucauuuacauucccacugugaacccugaaaauuugaggcaggucucaguuaaauuagaaaguugauuuugccaaguuggggacacgcacucgugacacagccucaggaggaacugaugacaugugcccagguggucagagcacagcuugguuuuauacauuuuagggaaaccugagccaucaaucaacauacguaaaaugggccgggcacagcagcucaagcuguaaucccagcacucugggaggccgaggcggguggaucacuugaggucaggaguucgagaccagccuggccaacauggugaaaccccgucucuauuaaaaauacaaagcuuagcuggaugugguggcgcaugccuguagucccagcugcucuaggaggcugaggcaugagaauugcuugaaccugggaggcagaggcugcagugagccgagaucgagccacuauacuccagccuggucaacagagugagacccugucucaaaaaaaaaaaaaaaauguaaaaugaacaugguucaguccggaaaggcgggagaacuugaaggaaaagcaggacaacucaaugcaggcaugaggcuuccaggucauaggaagaaaagagacaaauaguugcauucuuuugaguugaugauuagccucuccaaaggagggaagcagauaugcauuaaucucagugagcggaggggugacuuugaauagaacgggagguggguuugcuuuaagcaauucccagcuugacuuuucccuuuagcuucguaauucugggggccuaagauauuuuccuuucacaccaccagcaguguacggagguucccuuuucuccacauccucgcuagcauuuguuauuuucuuuuuuuuggauaaagccauuuuaacuggggugacguggcaucucauuguaguuuugauuugcaguucucugaucagugaugucaaguaccuuuucauaugccuguuuuggguugaguaccuuucauaugccuguuugccauuuauaugucuucuuuggggaaauauguauucaaaucuuuugcccauuuuuaauuggauuacuaggauuuuuuuccuauagacuuguuugagauccuuauauuuucugauuauuaaucucuugucagauggcaguuuucuuaguuuuuugccaucaugguuucagaaagaucagaguccaaucucagaacaccuugucauuuuuccugcauggauuucucaucuuuauccacuauuucucugaaaucauucagcuugcuaauguugcccccagugguuuuuuuuuuuaaauaauauuggccagguacgguggcucaugccuguaaucccagcacuugggaggccaaggcaggaggaucacuugagcccagggaguuugagaccagccuggauaacacagugagacucugccucuuaaaauaauaauaauaauaaaaguauugaugggggcugagcgcgguggcucacgccuauaaucccagcacuuugggaggccgaggugggcgggucaccugagaucaggaguuugagaccagccuggccaauauggugaaacccugucucuacuaaaaauacaaaaaaaaaucaccgggcaugguggugcacaccuguaaucccagcuacuugggaggcugaggcaugagaaucacuugaaccugggaggcagugguugcagugagcugagaucgugccauuacauuccagacugggcgacagcacgagacucugucucaaaaauuaauaacaauaauaauaugaugggaagagagaguugggagagggcugaaaaauuacuuuuugggcacugugcucauuacuugggugaugagaucaauccuacccaaaaccucagggucacacaauguacccauggaacaagccugcaguguacccccugcaucuaaaauaaaaguugaaauaaaaaugauaauaauauuaggaggcugaagugggaggauugcuugagcccaggaguuugaggcuacagugagcuuugauuauuccacugcacuccggccuggacaacagaguaagacccugucucaaauaaaauaauaauaggccgggcaugguggcucaugccuguaaucccagcacuuugggaggccgaggcggguggaucacgaggugaggaguuugagaccagccugaccaacauggugaaaccccgucucuacuaaaaauauaaaaauuagcugggcacaguggcacgcgccuguagucccagcuacucaggaggcugaggcaggagaauugcuugaaccugggagguggagguugcagugagcugagaucgcgccacugcacuccagccugggcgacagagcgagacuccgucucaaaaaaaauauaauaauaaugauaauaauaguaauacaguagccuccagcaccugggcucugggauggcugggaggugcuccuuggggagccccugcugacccggcucccucggggcacagccuucauccuccccaaggcagaggugugcgugcggaaccauguccagcccuacaucccauccauccuggaggcccugaugguccccaccagccagggcuucacugaggugcgagaugucuucuucaaggaggucacggacaugaaccugaacgucaucaacgagggcggcauugacaagcugggcgaggugaggccggcaccgccccuaggagggggucuccugagaguaggucuggucugucccagagggccccggcugcgugacuccgggcagccguuccccuccaaggccgucccuguagacggggaggggcugcuggggacuaggggcagaggcugugaggccagggcuguuggaguccucguggggccugcaguuugaggaaagagggaacauuagcucccggccaccagccuuuagaaaccaagaguggugcuaaaauagaaaagaauuuaacagaagagagggaaggagggaaggagaggaggggagagggaaggagggaaggagaggagggaaggagggaaggagaggagggaaggagggaaggagaggaggggagagggaagggcgggcuucagguggaguaaugagauugauaaggaagaauucacaagucacgcgcccuccaaauggagacagccguugcccuuacuugaccucaguuaucuggcucucggggugaacguccuuccacagucuccaucuugggcuggcugcccggagcccgcauaguugucagauugaauuuauccuguaucuuaguuuccuccuuuauacucugaaauggggaguccacagaccauaauaaucccagaaucugagaccuggagaggaccuuggagagcaggaaagcucucucccaauuuugaagcugaggaaacugaggcucagagagggugaaugacuugcccaaggucacccagcaccucagaagggaugagugccuucugccggcaccgaggcugccucuccacagcgcugugccacuggacugcgcccuccaugccuucagagccucaugcuucuguccugggcccuccuggguuuaccuuuguggccaugagcaccagguggccaucccugguagcaggcgccagccccagggccuggacuucgaggacccaggcaaaguguguggggggugcugccuggccacagggcggcccugcucagcccccgcggccccggccccugcaguacauggagaagcugucccggcuggcguaccacccccugaagaugcagagcugcuaugagaagauggagucgcugcgacuggacgggcugcagcagcgauuugauguguccagcacguccguguucaagcagcgagcccagauccacaugcgggagguagacccgaggcuacgacccccaccccacacccuguccacugccuuccacaggcccccucgcccagggggucccuucugcuccgucccgucaugccauagccacgcuugccuggcacgcucucuccuccucugcuuggaacaucugugccucugcccaccuggcuaauucugacucacuucccaggucucagcuuagagaccccuuccuccaggaagcucuccuugcgcccccaggccccuucccauauuuccuguugccuugaggcagggacuugcuccagcgugcagagcugugagugggcauagaccgcuugccauuccucccuggcaggccucgggguggggggcugguugaggaugaggaccccucagcggcacccaggaaggggcuguggucacccugggggcuucacauguccgcgguaugcccugcagcaaauggacaaugccguguauacguucgagacccuccugcaccaggagcuggggaaggggcccaccaaggaggagcugugcaaguccauccagcggguccuggagcgggugcugaaggugagcggccccacgcccugccccggaccguccuaggcgaggccgagccccgagccucauccccggccaccaccaggauugcugucccugcaaggaggcgccaugguccucuugugcggaugaggacucggaggcuugggucagaccacuggccucguccuacccucagggccaauggagcccacugaccugcagacccccgacccccuuguucccugcagaaauacgacuacgacagcagcucugugcggaagagguucuuccgggaggcgcugcugcagaucagcaucccguuccugcucaagaagcuggccccuaccugcaagucggugagcagcccccaccugcuccagccguuugggcccuaaguugggggauggagcccacaggccucccucuacccuuggcccugaccucucaucucugccgccccacccgggcaggagcugccccgguuccaggagcugaucuucgaggacuuugccagguucauccugguggaaaacacguacgaggagguggugcugcagaccgucaugaaggacauccugcagggugggugccgucccgggguggggacuguugccaggaggaugcugggggcgcagcugagaagugguggcagcugagggggucagcuaaggcucaaagaaaagcccagacuugcaccuggggucugggugaagcccacucuucgcuguguggccuccggagcagccuuagccuugcgucucugugcuuuaguuucuucucgcguccuuggcuuugcugggagggucagaggagugauuagaugacauguggucagcagccugggccuggagauagcaucacggccuugcugcuuucagcaacgaggccuggaaugagucacaucccaaccacagacccccaaggcgggaugagacgggucuucuuugagcagaguccagcacaggggcggcugugggaucagugcuguguccugacccuuccccuguggcccuguagcugugaaggaggccgcggugcagaggaagcacaaccucuaccgggacagcauggucaugcacaacagcgaccccaaccugcaccugcuggccgagggcgcccccaucgacuggggcgaggaguacagcaacagcggcgggggcggcagccccagccccagcaccccggagucagccacccucucggaaaagcgacggcgcgccaagcagguggucucugugguccaggaugaggagguggggcugcccuuugaggcuagcccugagucaccaccaccugcguccccggacggugucacugagauccgaggccugcuggcccaaggucugcggccugagagccccccaccagccggcccccugcucaacggggcccccgcuggggagaguccccagccuaaggccgcccccgaggccuccucgccgccugccucaccccuccagcaucuccugccuggaaaggcuguggaccuugggccccccaagcccagcgaccaggagacuggagagcagguguccagccccagcagccaccccgcccuccacaccaccaccgaggacagugcaggggugcagacugaguucuaggccagugggucccugacugcugcacauggcacaggccguucccuuccggacccaggcaggcucagcucuggggagggcacccuggucugugccuuguggguggaggcggggcagggcuguguggcaccgccagggagcgggcccaccugagucacuuuauuggguucagucaacacuuucuugcucccuguuuucucuucugugggaugaucucagaugcaggggcugguuuugggguuuuccugcuugugccaagggcuggacacugcuggggggcuggaaagccccucccuuccuguccuucuguggccuccauccccucaugggugcugccauccuuccuggagagagggaggugaaagcuggugugagcccaguggguucccgcccacucacccaggagcuggcugggccaggaccgggagagggagcacugcugcccuccuggcccugcuccuuccgcaguuagggguggaccgagccucgcuuuccccacuguucuggagggaaggggaaggagggggucuucaggcuggagccaggcugggggugcuggguggagagaugagauuuagggggugccucauggggugggcaggccuggggugaaaugagaaaggcccagaacgugcaggucugcggaggggaaguguccugagugaaggaggggacccccauccugggggaugcugggagugagugagugagauggcugagugaggguuauggggagccugagguuuuaugggccuguguauccccuucucccggccccagccugccucccuccugcccgccuggcccacaggucucccucuggucccugucccucuggugguuggggauggagcggcagcaagggguguaauggggcuggguucugucuucuacaggccaccccgagguccucagugguugccuggggagccggacggggcuccugagggguacagguugggugggcccucccugagggucuggggucaggcuuuggccucugcugccucucagucaccaagucaccucccucugaaaauccagucccuucuuuggauguccuugugagucacucugggccuggcugucgucccuccucagcuucuuguuccugggacaagggucaagccaggaugggcccaggccugggaucccccaccccaggacccccaggcccccuccccugcugcuuugcggggggcagggcagaaauggacuccuuuuggguccccgaggugggguccccucccagcccugcauccuccgugcccuagaccugcuccccagaggaggggccuugacccacaggacgugugguggcgccuggcacucagggacccccagcugccgcagcccuggucucuggcgcaucucuucccucuugucccgaagaucugcgccucuagugccuuuugagggguucccaucaucccucccugauauuguauugaaaauauuaugcacacuguucaugcuucuacuaaucaauaaacgcuuuauuuaaagccagu

SEQ ID NO: 13157 - RNA, 4108 nt, Homo sapiens
agguucugccacccugaccccacugaccaccccacaaaggagcuagcucccucaaggaagacgccacaccagaaaauccaccaguugucaaaugauccuuuauugaaauguuuuccuuugugcuuaacucugugggaaagaaaaaaaaaaucaguaaaaaguuuaaaaggauuaucccaccccaccaguaaccauuuccaaaacuucccagcuuaucucugugaauacacuggguggccccccuuucaccccuacuguaacaaugaaaaugucacuuacggcugggcauuccacagcaccacuguugaugucaucgaugaugucaugaggauggcggccaucaacauuacagcccacugacugggcaguccccaggaucucuuuaaugguuccuuuaaguaaagaaaugguggcauuggaggugcuggcucagucccucacaaucugcagauacuggggaauacugaagggguucauagcaggcaauggaaggaaugagguuccugcuccccuaauauagaauauagaguuccaucuaguuccauaacccggaaugcaaagcuuccauggguccuugaugcccagauuaaacacauccaauuuacgauccauccuuucagucccagaaaacugcaccccaucuugggucucacugagcacccuucaaguaagaagaauguuaucacucagugaaaaacacaacuacaguuauggcgguuacauguuguccugcucuuaccagagaguucucuggcuaaggaucggugccgcaucugucgagcaauguugacaaucucaucaaaagugauauucccacuguguuuaacugcagaagaggaaacagcaaaagcucuuuuaaagucugaagccaaagcagaucauguguccuucauuucauuucuaggcuguucccaugcuuucggcacagagucauccacaugaagaacaacccuguuuccuaagcugggguuuacuaucagcucaccacuggauugcaccagccaacagagaccuggucaggugcaguggcggguggcugagggcaaaaccaagccuucacaaaucugacauggcagaaacuguuuuagagaaaugacaagcuuaaauugccagggaguuaaacugcccaguaccugccaccuguauguggucuccugauuauaggucauuauugcugacaucuuccucccacaugcacugauuggggccugccccacacagggacuacauggcacuuuuuuuuuuuuuuuugagacggagucucacuguuacccaggcuggagugcaguggcacaaucuuggcucacugcuacaaccuccaccuccuggguucgagugauucuccugccucagccgucugaguagccaggucuacaggcgagcaccaccaggcuaauuuuguauuuuuugguggagaugggguuucaccauguuggccaggcuggucucgaacuccugaucucaacugauccacccgccucagccucccagugcugggauuacaggugugagccacccagcauacguggcacuuuuucauacuaccuggcucuagcagcccuaaccauaucaacacccaauacccaugucaaccccagguuuccuuuaagggaaaacacagccacauauaucaaacaucucacaaaccauuaccaaaaccaaacuagggaaaagacaacuuacuguuuuucuguuucuuucugucucuuggugguuccuugagggcuuugaugaucagggcagaggcagaaggcaccaccucaaucugcagaagagauuccugagugaauacuccaccuccagugaauacugccaugcacgcuggcucucaaaaaucauggccacacacuguccaagucuuugcccuagguccguacucuugacaaagccuccccaacaaggugaaaucacucucggcucaccacugguggcagaaauacucuucaggaaucccagaggguugcuaccuguccccccacccuccucucccgaaaccaagcacaagcaaauaccugggccugucuguucugaauggucaguuucacuguaauccucaggcccuuccagucacccguugccuuggcaaugucaucaccaacuuuuuuuggagacuagaaauaaaggcauguaaucaacaugguguccagaggugaaccacagccuugaaaccugcccaccacuucucacuuggcaacaaaggaagcuaucucaaguaccuaagggcaccuucucaaucagagcacagcuaucaccauagcauaaauuggggguugggguucuuguccagaacuguaaacugcagacuuggccacaauguaaccuagacccccuccuaagugcccaugugcuuaaggagggggauuuucagcccugcugacauuagaaucaccuaaggagcuuucaaaauacuaggcucccaugucagaccacccacguccaucuuccuggauggaggucugauuauuugcuacucugaaguucuccuccucuaguaauccuuagccucaacaggaggcuaagugucccuuaagugccagcuaacggccaaggaagaauaguuaagauacagguuaaaaaagaccaauggggaagagcauuuggggcaggggagcacugugcaaggauuaaauaaaggccuaaugaaauucagagaaauccaagaggacagaaugacggggaagccagcaguugcucagcaggcaugagacacagccugccacauuaacugcuagguuuacaucuacaacacagcuggaaacgcucacuggaucuucacccacaccccguuuaaucucccaacaacgccaugcccacuuccugacgaggaaauacagauguuggcugcccaaugucucuaagccaguccuaacuucaaaacucccccuugggcccaccccucagguacacuaaagcagcaguggagacacauggagcuaauuacaauuuaaaggcaccagguucgauuuuucacacacgaccuuccuaagguaccuaguacuuguucaguggcucaggccuacugagggugacaguccaagccacgagggcaccucuggcacaggcgugacuccacgagccggcgcuuaaagugaaacaaaugugaaaaaaaugccccuuggaggggauaacguaccagacccagggggccgaucuugggggccagggcagaaguggcaccgacuucaccuccggugcaccucagguauacugggggaaaagaagaguuagugucugugcagagggagccccgagccacagcccucucagcgucuuuccgggguuggacacgccacccucugccucuucucgaaacagcacagagcgcgaggcgggccacccgcuccucccucgggugugggcagcuccgaaacucacaccggggaggcguggagagagccccgucgcccgcuaacccaggccaauggggcgaaacgcccggagacaagccuuacccuagggcgugcgggcucccaagccgccacaggugguccaguccucccuccccaccuacacgugaagaagcuaaggcccagaaaggcugaggcuuggccggggcggcgcaacaccgggaaggucucugggaggcagcggcuuuaagagccccauacggggaaagcuuugcacgcgcggcagggccgagggaugcuccaucccgcagccccggccacaaccagagcacgcaccgacuuugaucucguuggggucgaacuucggcggcaugguggaggcggcuggugucggaugaacccggauucgggacgaccgaaggaaguugcaccuuggccuccuccgagccgaaagccgagaggccggaaaucgcgcggacaagccagauauaggcaggaaaacgcggcuaucgcgagaacugucgucacugcccggccuuccagagacgcccuugucgccauguuuguugugggcaggcgccugaggcugacggcuggcaagcagggcaccgcggugcgcugaagcuagagauuccgaaaggggguucggguaguucgcuccggagaagucugagaaggguggcuccggugaucccagcccuagcuguuucccauauuccuuuaucgugagugucaccccgguccccgucacccaaucccag

SEQ ID NO: 13158 - RNA, 10849 nt, Homo sapiens
uccauuaaagucaacagaacaaaagguguuuuuuuuuguuuuguuuuguuuuuuuuugcuguuuauuuuuuaaacucaacaagauuugauggcugaugacccagggaacugagcccaaggaaguagccagaaaugacuucucagugugaaggguaagcuuggcugaccaugagcaaguaaagccacaggguguccugggcagugaugggaauaaacccuuuucaaacugagcuugcacaaagcccagagacacugaccugauuuucugugucagucuuuauuuggcaaacaaauuuccuucccgauaaggcagccgcgugagaggagcgacugaaugcccagcacccaaccuccaaaagcaccuccagccagaagacaaagauccuagaggcccaccuccucuuccgcugcuuuagucuugcgcauggagggcugaccgcaggucugcaaagcucgaagguguuccugaguccucagagcagcagcaggagcuggaacaggaggcagugagccuccuagccccgggucaugggcuggagggagcaugacaggaaggagggacccugcagaccaaggcuccaaggggcuggauucuggcuccccuggggcaggcaggggcucugggcuugggcccagcuuggagucacaggcuugcuccauccccuagugaguggcugucaucgccccucaaaaugggcugugauuuguuccagagucuuuccuuuaguuucagggacacagaacaaagugaaaaggacacugaagaugcagaaagcggaggcaagccagaaggcuccauagggccugaggaccuccugcagagagaggaaaggccauggguggacgcggggagagaucaggaagccccacgcgaucacugagacagcucugccaccaggggguccaguccccugaccccagccugcccugcccaaggccacacccauuuuaucuccacccagcucugggacauggaggauagucuggcauccagucugguggcuugggccgagcacuguccaagauaccgaggucguauggcuggggaaacugaggcucacagcaaugaagugacugccucaaggccagagacccgcuauccagugacagcugggcuccuguuccaggucugacuccagggcccacagaccaacccuccacccucagcuuuggccccacccugaggcccccgguggguucuuucauagugugguggaaaugggugagacagggcaaagcgagcauggccccaggagcacauggggccuucagucagaaccugucccugccauccaccaccacugugaccucccacgugccagaacuaaaaaggugcuucucagcuccugguccucugggaccuggcgaucucucccuccucgaaggccuucucuuggccucuuggacauuuucucuccuaaaaaaggacuguuagguccuuugucaccuccuucuuggcuucuuuuccuccuuccuuugcugcgcauccccucccagcugcagcaaguaaucuccacccccaggcaucggccuggcccccucgaugugcuccccgggcaguccugccuaagcgggucccaagcucugcacagacuccaggcuggccccucaugacccgccccaccacauccuaacccagccccacugggguucauucucccaccacugccauggccuuucccguccuugucauaaaggggacccuguccaucuuguucauugcucucccuggcgccuugaaugggccuggacauggcacaugccaggagaccuggagggcacaaaugacugaacaaacaaccagaucaucuaccccagaacugucucucuguuggcugggaagccccgggacaggggccacaccugugccaguccauccgugagaaggcagcaacaggaugaacugaauuaaugcucccauccgucuuaagagcaagcugcuguuacucuccuccaguuucagccaaagaagcgggcucagagaagguaagcaucauacccaaggucacacagcaaggaaguagccaggguggggcugcagcccagcccugucaacucuucccauguaagaccuuaggcucaaggcccgcuuuccugacguucacuaaggggagaggccagcugugcugucugacugccaagacaggcagaggacucccaaggggucacagccuggguuccccaucuggccuagcccaucugccuccacgucgccuugcccaagauggccaguggcccaggcaugguggggcucaggcugcauguaaggccacgacccugggucuucugcaauacaagugguuuuagaaagugcuucucggcugacugcacgaacgcggugcugguggagccugcccucaccaugaggcugcugaacuccuuggucacgagaaaggccaugagccaguuggugaggacgcagaugccugucgccacgcccuugacaugcagagggaagaucucugacaugaggagccaggggaugggcccccagcccaccgcaaagccugugggagcgagacaggcaagacaggcaucaggguccgcagggcugggcuccucagcuugcugcagagccaagagacccagcuucccagccuguggggcuguggggucccggaucccaguguggucccaccagcuccaugcuuuccugccaaggccucggccagccucuucccuccucaggcacaggcucugucucugagauggggucacaacggggccugcucgagggcugcucaggggauuaagugaaaggaacgcagaggggccuaguuccacagcugcauguggucagagcuagaaaugcagagcuuggaacuuacgagaggagaggugaggcuggggaagaccccaccugccgggagccgccacagcagggccggggggaucaccucccacuccucgcccagccucccacaggcccccuuaccggcgaugaagaggcacaugcugcccacggccagccaggccagccccacgcuggcaucaacaggcugugcagagacaggcgccgagauggccacgugcgaggaguugccagggccacccugggucagcuugaaguaggcgccgaaggcacucgugcugaacaccaugaccacaccugcaggcgggagggcggcagugggcggggcacccggggaacggcccagggcgcagcagcauggccuggaugccucugagaggggcaggcccggcucccagagaacggccagcuugguguucuggcaccuuggccgcagaagcccugacuggguggcagccaccccgccuuggaccucagcgaacugcaaaaaguucccggagcagacccucugggccgaggaaaugggagguaccggcacagaagcagcagcgaguaacccucagccccgacggucgucuucgcagcagcugcuggguaccaaauguccgugggccgcagcucuugcugaaggccucacguggaucaccucccacuccucaaaauggugcugagggaggcacugccauuacccccacuucccagagggggagacugaggcucagagagguaaagucacuuguccaaaaggacccacaaacucuugagucacuucaccuuccuggcccucaguuuucccgucauaagcuggggcugugagagugccuucugguggguucaccacagagguuaaaggcguggugugggagugccacuggcauggacaggccugcagugagugcuuggugacaagcugcugucaaaucauggccgcauuaguccaugauguuugucaucacaaaugcucccuguccuccuccugcagugugguggccuuggcgaaggcccucccccgcauggcggggaggcugcacaggggugaacccucaccugacaagaccaggagcagccuccgcccugcucuguccaugaugagagccgccacagcugugaacagcaccuggaugacacccacgacgaccgaggccaggcugcuguccugggggagacagagcccaggcaggucaggugggccagcugagagcugggucccucccucuccaggccugugcuggauggcugggcccugggcuuggggaggaagcuccaucuaugugggggcuggacgaggcaggccaggcagggcccuuuuaccuugaacuuggccucuucaaagauggucucugcauagaacaugacggcguugacccccgacagcugcuggaaggccaucagggagacgccgaugaugaagggcuuguagaugccgggcugccgcagcagggccaggugaaagcucugcucugacggauacuggccaucaggauuucucucuccccucccgcaagcggccccccucugggggucuacuguccuaaggcuuggggagcgcugacucccacgucuuggcuccucaucccagcacccccuguguccucaggugugcagacaagucccagccuccccaugugucaggugagaugacccucaccugcccagggcacuuccugauaggugggggggagccacaaagagguaaucugggcaaagagcaagcugcugcccucaucccugccaccaccaacacauccagcaccugccucaggucugggccuggcccuagcuaagcaccuccuacagcccugacccuccccuccccacugaacccauccuccucgcugaccccacccuccccacugagccccccuccucccuaagccccgccuuccuuucccccacugagucccacccagcacugugaagcaggugcugacucccacaucacaggugaagagcuaaagcuuaggugaggggcagcgugggggcuucaaacccaugccugggugacucuaaaacccagacuuuuagcccucuacccugccuugcaacuccuuuguuaaauccaaguccucagcucugccucuguaucccccaccaggccuggccauucucuuccugggacaguaagggucaaagcucgggcuuugcuggugacuuuggaggccagggcccagcuccguggggcuccagcugucuuggccugcucaaagacaggacacacugggccuguccucgcugaggguggaggguggauaggcaccucccugucccccaccccccaaguguguggccuugggaacaggcugugcuacccucccgugacugcugucccacuccugucagcucugccuuccagccucucaccugcucagccccgaugggggggucuucccagcccugcucggagccccacaggaaccgcagggcggccauggccuccuggcgccugugcugagucagcaggaagcgcggggucucgggcaugaagcacaugagaagcagcaugagggaggggggcacgcagcccagcacagccagccagcgccacuccagcacccagccugcgggggguggguggaggaggcuggcgucagagccagggugagccagccugggccuugccagccucaaagacucagcuucagagauggggccucgcugccucugcacaucugcccucauguucgcuacugacauugccauuaucacaacuguucaugaaggcacauggcacgggccaaucacaccagcugcggaagcgacaguggguaugacaacgcggacauuacuaggcugcauccguucaacgaaacauuuauguagccacaaaaaugaaggaugaggugcuugcugcguguccgcaugguaugauguggcaccauuuguagaagaggugggggagggaggauaaauaugcaugucccucauaugaacagacucucugaaggcuaccaagaaacaggcaauggggacucccccagacaagaaagggacagaggcggaggaagcuuuucacuggacaucucuccacucuggcacuugaguguugagucauuugaaugcauuaucuauucaaaguauacaugaaaguagagaggugagaggauuuugcugucuugacguaugaagaacagcauaagugcagaauuaccuaguuuuauauaaaguuaaaagguucucuuacaaaggggcccuggaauaaaugagucuagggcauugcugcucuaauuacuaauuuuuccuaagcccaaggcuuacccaucccugguucccaguggaaaaauaccucuaagguagccaugaugucccuauuuuucuucugugcugggggugcagacaauuguucuaugaagucuagucguuggaacaugauugccccaaugugaagcaaacgugccaccaccaugucacuuuguggaguuaucagaguucacccaccccaguggaucgaaacucacagaaauugaucaggaaaggcaggagaagcaacaagcacauauuaagaugagcugaagauagugccacggguggguggacacccaguaccuguccccgaaaugaugaaugucaacaccugcacacagugggggcuuugguuuacucaggucucccaagguagccagaucgcuggcaggauucugaauuuguuagggugguuaaguggguaaaaaugaaacaccaaagaccuguguaucauccgcccugacgaugcagagggcuugugcccugggccaggccauagcccgucaggcccccgaggccuccuaccccgaugauccccaugguucucaagucaucccuugacaauucucauuuggaacccacuguuaggcacuuuucaugugucaauuaauuuaauggacagguacuggacuagaugagguuaugcccauuucaagacagagaaacugaggcuuucagaggugguaugacuuggccaaggucacacagcacguaggagaggcuauccccaaacucaggauggucagauuugaagccugcccuuguuuuuucuuucuuuuugagacagagucucacugugucgcccacacuggagugcaguggcgcgaucucagcucacugaaaccucagccuucuggguucaagcaauucuugugccucagccccccagguagcugggauuacaggugcccaccaccacgccuggcuaauuuuuguauuuuaaauagaaauggguuuucaccauguuggccaggcugaucucgaacuccugaccucaagugauccgcccaccucugccucccaaagugcugggauuacaggugugagccacugggucuggccucuaaagccuggccucuuucuaaugagaacacaccugucuccugaaguuucuucaugcuggcccagcuuugccccucgggguccccaggaccccggccuccuucacguugcaacucgccgacauggugaaucuggcacugacauucucaggggacuugcucagcccuuuacucgcccgggcugaagauuuuuacagggacccacccaccucuggagcccucugguuugucacugcacaguaagguacugaccuaagcagucagcccuucccacaccccuagagggggcuucaggaaagcugaggguaucaccuucuccagcugucccuggaacucagucauaagacacaccuaucggccgggcgcgguggcucacaccuguaaucccagcacuuugggaagcugagguuuggcgguucaugaggucaggagaucaagaccauccuggcuaacacggugaaacccccuuucuaccaaaaauacaaacaauuagccaggugugguggcacaugccuguagucccagcuacuugggaagcugagacaggagaaucgcuugaacccaggaggcagagguugcagagagccaccacugcacuccagccugggcgacagagcgggacucugucucaaaaaaaaaaaaaaaaagacucaccuaucccaaggucccaggaaggcgagccuggcauguugggcacuggcuaugugaccucagacaagucccuugaccucacugaaccucuguuuacacaucuguaaaauggccacaugaccacaaacaggaagcaagagauaaugacaacuauaccugccagguaggccaggaggaugccgacgacgaccauuagcugcacacaggagccgagcaacccccggacugcuggguaggcgauuucggagauguagaccugccagcaaucagaugaggauuuauggcugggcgcaguggcucaugccugcaaucccagcacucugggaggccgaggcgggcagaucaccagagguugggaguuugagacuggccugaccaacagggagaaaccccaucucuacuaaaaauacaaaauuagcugggccuaguggcacacaucuguaaucccagcuacucaggagguugagggaggagaaucacuugaacccuggagguggagguugcggugagccaagaucccaccauugcacuccagccugggcaacaagagcgaaacuccgaaauuuuuaaauaaaaauuaaaaaaaaaaaaaaaaagaugaggcuuuacucaggcuccaagaguucuuaaaauggaaaggucucagccauucagagcugaggaaaguccuugcaggggguuacggcaggcccugaagccccuuaguggaaccugccuaggugagcagagccauccccagguccccaccacugaaagaucuguggcagguguuuaaaggggauuaaggguaacggagagggcugcauaugaugacgagaggcggugggcacagagcuucucaagccuucguuuaaugugcacagacacccuggauaaaucauagauuccgaugcaguaggucuggacaggcgaaagauuccaccuuguuaaccagcuccacgugacgcccacccaggauccuagcccagggcccacgcuuugagugguggccuuggacuagaagcacgaacucucugccucggucacuaccaguggcugccacuagcucccuccugggcccacaggccaccaggcccucacccaugcaucuaagguuauuccauagcuuaggccccuaacacagguguguuucugcccaguuaaaaaaaccaaagacauaaaaggcccagcuucuuccccacccucuucugguccagcugcugcugccgguuagcaaacguuggugaaaugagcacccagggaggggccugaguggcugcuuucaaccucacuugggggagauauuguccaagcccauggcugggggcaguucaugggucaccaagcugucaggauccaguccucuacaagccaugccaggggcugucuauccaaagucccacugaauccugaccacuaccucaggggcuaaugccauaaucccuguuuuccagagaaggaaacugaggcccagggaggcacucugcucagguuaguggcagaaccaggauuugacccagauguucggggcucccaagugggcagccugggucaggagggggaaagggggaagauggggaagccagaggggcuggccugugagaagggaaggggaacacagaggccagcagccuuugccccaagagaaaucaggacaggaacuuccugcuaauugcagucauugacccgaagccagggaugaaaaccaaaauguagggagugggcuccuguggaucauccgcagguuugcagagcaaaagaggggcacggcuaagugggacaacccuggguuccugcaacugcuuccccucugacuagcuguggaccucgccugggcaaaggacuucaccuuuccgagacugcaugucaugaccucaguguaaaauggagagaacaguaggauccuucccagggucgacgggagggaccgcgagauaacgcagggacuucaagccuggcacccagaaggucccgccagggggagccgcgcccccaggccuggggagcgguuugucccacucccccucggucucaggccgcgagacaggacacucgagagacgggacacucaccggggccacuagggaggcaacaccgcaggccaggccggugaggaggcggccccccagcagcauccacacguccugggccgcggugaugacggcaaagccggccacgaagggcacggagcacagcaagaggcucagcuugcgcccggcgcgguccaccagccagccgcccagcacuccccccgccgcggcacccagggucacgacagccuggaggcgggcggcugcugaggagggggcgccgaagccgcagcccauccucccccuccacccacuccccgcgggcucagagguaaaagagccggggccccgcgcccgucccgaggggagggguagggggcugaggggcccggugcucgucccgaggggaggggugggggcugaggggcucgaugcccgucccgagggaagggauggggggcagagaggcccaaugccugucucguggggaaaggugguggcggcggggcccgaugccugucccgaggggaaggguggggggcggagggucccgaugcccgucccgagaggagggcguggggucccagggcgggaggagcgagcccggggccucaccccgaaccaggaggcggcggcgucguccaggcgcggggccgggggcgcggcgcgcugcaggcuagggauggccggggagcuguagccgagcgcgaagccgaagcugagugggcccagggcagcggcgaaggcggcgaggaagacgcggcggccgcggggcgcgcuggggggacagggccgagggugagcggagcggacgcggaggggcgggagggcgaggccgcauccgggcccggguuccccggagcucaccugccgccaggaggccccagaagcggcuggguuuccucuggguccucgggcgucaugucggcggccaacgccgaucggccagcucuggcgccugaaccgccacgggcccugcgagugcggcccgcaccggccucucgcagccaaugggcggcggggggugggggacggugcugggcgggaucggaaccgcagagcaggagcagccaaua

SEQ ID NO: 13159 - RNA, 10849 nt, Homo sapiens
uauuggcugcuccugcucugcgguuccgaucccgcccagcaccgucccccaccccccgccgcccauuggcugcgagaggccggugcgggccgcacucgcagggcccguggcgguucaggcgccagagcuggccgaucggcguuggccgccgacaugacgcccgaggacccagaggaaacccagccgcuucuggggccuccuggcggcaggugagcuccggggaacccgggcccggaugcggccucgcccucccgccccuccgcguccgcuccgcucacccucggcccuguccccccagcgcgccccgcggccgccgcgucuuccucgccgccuucgccgcugcccugggcccacucagcuucggcuucgcgcucggcuacagcuccccggccaucccuagccugcagcgcgccgcgcccccggccccgcgccuggacgacgccgccgccuccugguucggggugaggccccgggcucgcuccucccgcccugggaccccacgcccuccucucgggacgggcaucgggacccuccgccccccacccuuccccucgggacaggcaucgggccccgccgccaccaccuuuccccacgagacaggcauugggccucucugccccccaucccuucccucgggacgggcaucgagccccucagcccccaccccuccccucgggacgagcaccgggccccucagcccccuaccccuccccucgggacgggcgcggggccccggcucuuuuaccucugagcccgcggggaguggguggagggggaggaugggcugcggcuucggcgcccccuccucagcagccgcccgccuccaggcugucgugacccugggugccgcggcggggggagugcugggcggcuggcugguggaccgcgccgggcgcaagcugagccucuugcugugcuccgugcccuucguggccggcuuugccgucaucaccgcggcccaggacguguggaugcugcuggggggccgccuccucaccggccuggccugcgguguugccucccuaguggccccggugagugucccgucucucgaguguccugucucgcggccugagaccgagggggagugggacaaaccgcuccccaggccugggggcgcggcucccccuggcgggaccuucugggugccaggcuugaagucccugcguuaucucgcggucccucccgucgacccugggaaggauccuacuguucucuccauuuuacacugaggucaugacaugcagucucggaaaggugaaguccuuugcccaggcgagguccacagcuagucagaggggaagcaguugcaggaacccaggguugucccacuuagccgugccccucuuuugcucugcaaaccugcggaugauccacaggagcccacucccuacauuuugguuuucaucccuggcuucgggucaaugacugcaauuagcaggaaguuccuguccugauuucucuuggggcaaaggcugcuggccucuguguuccccuucccuucucacaggccagccccucuggcuuccccaucuucccccuuucccccuccugacccaggcugcccacuugggagccccgaacaucugggucaaauccugguucugccacuaaccugagcagagugccucccugggccucaguuuccuucucuggaaaacagggauuauggcauuagccccugagguaguggucaggauucagugggacuuuggauagacagccccuggcauggcuuguagaggacuggauccugacagcuuggugacccaugaacugcccccagccaugggcuuggacaauaucucccccaagugagguugaaagcagccacucaggccccucccugggugcucauuucaccaacguuugcuaaccggcagcagcagcuggaccagaagaggguggggaagaagcugggccuuuuaugucuuugguuuuuuuaacugggcagaaacacaccuguguuaggggccuaagcuauggaauaaccuuagaugcaugggugagggccugguggccugugggcccaggagggagcuaguggcagccacugguagugaccgaggcagagaguucgugcuucuaguccaaggccaccacucaaagcgugggcccugggcuaggauccugggugggcgucacguggagcugguuaacaagguggaaucuuucgccuguccagaccuacugcaucggaaucuaugauuuauccagggugucugugcacauuaaacgaaggcuugagaagcucugugcccaccgccucucgucaucauaugcagcccucuccguuacccuuaauccccuuuaaacaccugccacagaucuuucagugguggggaccuggggauggcucugcucaccuaggcagguuccacuaaggggcuucagggccugccguaacccccugcaaggacuuuccucagcucugaauggcugagaccuuuccauuuuaagaacucuuggagccugaguaaagccucaucuuuuuuuuuuuuuuuuuaauuuuuauuuaaaaauuucggaguuucgcucuuguugcccaggcuggagugcaauggugggaucuuggcucaccgcaaccuccaccuccaggguucaagugauucuccucccucaaccuccugaguagcugggauuacagaugugugccacuaggcccagcuaauuuuguauuuuuaguagagaugggguuucucccuguuggucaggccagucucaaacucccaaccucuggugaucugcccgccucggccucccagagugcugggauugcaggcaugagccacugcgcccagccauaaauccucaucugauugcuggcaggucuacaucuccgaaaucgccuacccagcaguccggggguugcucggcuccugugugcagcuaauggucgucgucggcauccuccuggccuaccuggcagguauaguugucauuaucucuugcuuccuguuuguggucauguggccauuuuacagauguguaaacagagguucagugaggucaagggacuugucugaggucacauagccagugcccaacaugccaggcucgccuuccugggaccuugggauaggugagucuuuuuuuuuuuuuuuuugagacagagucccgcucugucgcccaggcuggagugcagugguggcucucugcaaccucugccuccuggguucaagcgauucuccugucucagcuucccaaguagcugggacuacaggcaugugccaccacaccuggcuaauuguuuguauuuuugguagaaaggggguuucaccguguuagccaggauggucuugaucuccugaccucaugaaccgccaaaccucagcuucccaaagugcugggauuacaggugugagccaccgcgcccggccgauaggugugucuuaugacugaguuccagggacagcuggagaaggugauacccucagcuuuccugaagcccccucuaggggugugggaagggcugacugcuuaggucaguaccuuacugugcagugacaaaccagagggcuccagaggugggugggucccuguaaaaaucuucagcccgggcgaguaaagggcugagcaaguccccugagaaugucagugccagauucaccaugucggcgaguugcaacgugaaggaggccgggguccuggggaccccgaggggcaaagcugggccagcaugaagaaacuucaggagacagguguguucucauuagaaagaggccaggcuuuagaggccagacccaguggcucacaccuguaaucccagcacuuugggaggcagaggugggcggaucacuugaggucaggaguucgagaucagccuggccaacauggugaaaacccauuucuauuuaaaauacaaaaauuagccaggcgugguggugggcaccuguaaucccagcuaccuggggggcugaggcacaagaauugcuugaacccagaaggcugagguuucagugagcugagaucgcgccacugcacuccagugugggcgacacagugagacucugucucaaaaagaaagaaaaaacaagggcaggcuucaaaucugaccauccugaguuuggggauagccucuccuacgugcugugugaccuuggccaagucauaccaccucugaaagccucaguuucucugucuugaaaugggcauaaccucaucuaguccaguaccuguccauuaaauuaauugacacaugaaaagugccuaacaguggguuccaaaugagaauugucaagggaugacuugagaaccauggggaucaucgggguaggaggccucgggggccugacgggcuauggccuggcccagggcacaagcccucugcaucgucagggcggaugauacacaggucuuugguguuucauuuuuacccacuuaaccacccuaacaaauucagaauccugccagcgaucuggcuaccuugggagaccugaguaaaccaaagcccccacugugugcagguguugacauucaucauuucggggacagguacuggguguccacccacccguggcacuaucuucagcucaucuuaauaugugcuuguugcuucuccugccuuuccugaucaauuucugugaguuucgauccacuggggugggugaacucugauaacuccacaaagugacauggugguggcacguuugcuucacauuggggcaaucauguuccaacgacuagacuucauagaacaauugucugcacccccagcacagaagaaaaauagggacaucauggcuaccuuagagguauuuuuccacugggaaccagggauggguaagccuugggcuuaggaaaaauuaguaauuagagcagcaaugcccuagacucauuuauuccagggccccuuuguaagagaaccuuuuaacuuuauauaaaacuagguaauucugcacuuaugcuguucuucauacgucaagacagcaaaauccucucaccucucuacuuucauguauacuuugaauagauaaugcauucaaaugacucaacacucaagugccagaguggagagauguccagugaaaagcuuccuccgccucugucccuuucuugucugggggaguccccauugccuguuucuugguagccuucagagagucuguucauaugagggacaugcauauuuauccucccucccccaccucuucuacaaauggugccacaucauaccaugcggacacgcagcaagcaccucauccuucauuuuuguggcuacauaaauguuucguugaacggaugcagccuaguaauguccgcguugucauacccacugucgcuuccgcagcuggugugauuggcccgugccaugugccuucaugaacaguugugauaauggcaaugucaguagcgaacaugagggcagaugugcagaggcagcgaggccccaucucugaagcugagucuuugaggcuggcaaggcccaggcuggcucacccuggcucugacgccagccuccuccacccaccccccgcaggcugggugcuggaguggcgcuggcuggcugugcugggcugcgugccccccucccucaugcugcuucucaugugcuucaugcccgagaccccgcgcuuccugcugacucagcacaggcgccaggaggccauggccgcccugcgguuccuguggggcuccgagcagggcugggaagacccccccaucggggcugagcaggugagaggcuggaaggcagagcugacaggagugggacagcagucacgggaggguagcacagccuguucccaaggccacacacuuggggggugggggacagggaggugccuauccacccuccacccucagcgaggacaggcccaguguguccugucuuugagcaggccaagacagcuggagccccacggagcugggcccuggccuccaaagucaccagcaaagcccgagcuuugacccuuacugucccaggaagagaauggccaggccuggugggggauacagaggcagagcugaggacuuggauuuaacaaaggaguugcaaggcaggguagagggcuaaaagucuggguuuuagagucacccaggcauggguuugaagcccccacgcugccccucaccuaagcuuuagcucuucaccugugaugugggagucagcaccugcuucacagugcugggugggacucagugggggaaaggaaggcggggcuuagggaggaggggggcucaguggggaggguggggucagcgaggaggauggguucaguggggaggggagggucagggcuguaggaggugcuuagcuagggccaggcccagaccugaggcaggugcuggauguguuggugguggcagggaugagggcagcagcuugcucuuugcccagauuaccucuuuguggcucccccccaccuaucaggaagugcccugggcaggugagggucaucucaccugacacauggggaggcugggacuugucugcacaccugaggacacagggggugcugggaugaggagccaagacgugggagucagcgcuccccaagccuuaggacaguagacccccagaggggggccgcuugcgggaggggagagagaaauccugauggccaguauccgucagagcagagcuuucaccuggcccugcugcggcagcccggcaucuacaagcccuucaucaucggcgucucccugauggccuuccagcagcugucgggggucaacgccgucauguucuaugcagagaccaucuuugaagaggccaaguucaagguaaaagggcccugccuggccugccucguccagcccccacauagauggagcuuccuccccaagcccagggcccagccauccagcacaggccuggagagggagggacccagcucucagcuggcccaccugaccugccugggcucugucucccccaggacagcagccuggccucggucgucgugggugucauccaggugcuguucacagcuguggcggcucucaucauggacagagcagggcggaggcugcuccuggucuugucaggugaggguucaccccugugcagccuccccgccaugcgggggagggccuucgccaaggccaccacacugcaggaggaggacagggagcauuugugaugacaaacaucauggacuaaugcggccaugauuugacagcagcuugucaccaagcacucacugcaggccuguccaugccaguggcacucccacaccacgccuuuaaccucuguggugaacccaccagaaggcacucucacagccccagcuuaugacgggaaaacugagggccaggaaggugaagugacucaagaguuuguggguccuuuuggacaagugacuuuaccucucugagccucagucucccccucugggaaguggggguaauggcagugccucccucagcaccauuuugaggagugggaggugauccacgugaggccuucagcaagagcugcggcccacggacauuugguacccagcagcugcugcgaagacgaccgucggggcugaggguuacucgcugcugcuucugugccgguaccucccauuuccucggcccagagggucugcuccgggaacuuuuugcaguucgcugagguccaaggcgggguggcugccacccagucagggcuucugcggccaaggugccagaacaccaagcuggccguucucugggagccgggccugccccucucagaggcauccaggccaugcugcugcgcccugggccguuccccgggugccccgcccacugccgcccucccgccugcagguguggucaugguguucagcacgagugccuucggcgccuacuucaagcugacccaggguggcccuggcaacuccucgcacguggccaucucggcgccugucucugcacagccuguugaugccagcguggggcuggccuggcuggccgugggcagcaugugccucuucaucgccgguaagggggccugugggaggcugggcgaggagugggaggugauccccccggcccugcuguggcggcucccggcagguggggucuuccccagccucaccucuccucucguaaguuccaagcucugcauuucuagcucugaccacaugcagcuguggaacuaggccccucugcguuccuuucacuuaauccccugagcagcccucgagcaggccccguugugaccccaucucagagacagagccugugccugaggagggaagaggcuggccgaggccuuggcaggaaagcauggagcuggugggaccacacugggauccgggaccccacagccccacaggcugggaagcugggucucuuggcucugcagcaagcugaggagcccagcccugcggacccugaugccugucuugccugucucgcucccacaggcuuugcggugggcugggggcccauccccuggcuccucaugucagagaucuucccucugcaugucaagggcguggcgacaggcaucugcguccucaccaacuggcucauggccuuucucgugaccaaggaguucagcagccucauggugagggcaggcuccaccagcaccgcguucgugcagucagccgagaagcacuuucuaaaaccacuuguauugcagaagacccagggucguggccuuacaugcagccugagccccaccaugccugggccacuggccaucuugggcaaggcgacguggaggcagaugggcuaggccagauggggaacccaggcugugaccccuugggaguccucugccugucuuggcagucagacagcacagcuggccucuccccuuagugaacgucaggaaagcgggccuugagccuaaggucuuacaugggaagaguugacagggcugggcugcagccccacccuggcuacuuccuugcugugugaccuuggguaugaugcuuaccuucucugagcccgcuucuuuggcugaaacuggaggagaguaacagcagcuugcucuuaagacggaugggagcauuaauucaguucauccuguugcugccuucucacggauggacuggcacagguguggccccugucccggggcuucccagccaacagagagacaguucugggguagaugaucugguuguuuguucagucauuugugcccuccaggucuccuggcaugugccauguccaggcccauucaaggcgccagggagagcaaugaacaagauggacaggguccccuuuaugacaaggacgggaaaggccauggcaguggugggagaaugaaccccaguggggcuggguuaggaugugguggggcgggucaugaggggccagccuggagucugugcagagcuugggacccgcuuaggcaggacugcccggggagcacaucgagggggccaggccgaugccuggggguggagauuacuugcugcagcugggaggggaugcgcagcaaaggaaggaggaaaagaagccaagaaggaggugacaaaggaccuaacaguccuuuuuuaggagagaaaauguccaagaggccaagagaaggccuucgaggagggagagaucgccaggucccagaggaccaggagcugagaagcaccuuuuuaguucuggcacgugggaggucacaguggugguggauggcagggacagguucugacugaaggccccaugugcuccuggggccaugcucgcuuugcccugucucacccauuuccaccacacuaugaaagaacccaccgggggccucaggguggggccaaagcugaggguggaggguuggucugugggcccuggagucagaccuggaacaggagcccagcugucacuggauagcgggucucuggccuugaggcagucacuucauugcugugagccucaguuuccccagccauacgaccucgguaucuuggacagugcucggcccaagccaccagacuggaugccagacuauccuccaugucccagagcuggguggagauaaaauggguguggccuugggcagggcaggcuggggucaggggacuggacccccugguggcagagcugucucagugaucgcguggggcuuccugaucucuccccgcguccacccauggccuuuccucucucugcaggagguccucaggcccuauggagccuucuggcuugccuccgcuuucugcaucuucaguguccuuuucacuuuguucugugucccugaaacuaaaggaaagacucuggaacaaaucacagcccauuuugaggggcgaugacagccacucacuaggggauggagcaagccugugacuccaagcugggcccaagcccagagccccugccugccccaggggagccagaauccagccccuuggagccuuggucugcagggucccuccuuccugucaugcucccuccagcccaugacccggggcuaggaggcucacugccuccuguuccagcuccugcugcugcucugaggacucaggaacaccuucgagcuuugcagaccugcggucagcccuccaugcgcaagacuaaagcagcggaagaggaggugggccucuaggaucuuugucuucuggcuggaggugcuuuuggagguugggugcugggcauucagucgcuccucucacgcggcugccuuaucgggaaggaaauuuguuugccaaauaaagacugacacagaaaaucaggucagugucucugggcuuugugcaagcucaguuugaaaaggguuuauucccaucacugcccaggacacccuguggcuuuacuugcucauggucagccaagcuuacccuucacacugagaagucauuucuggcuacuuccuugggcucaguucccugggucaucagccaucaaaucuuguugaguuuaaaaaauaaacagcaaaaaaaaacaaaacaaaacaaaaaaaaacaccuuuuguucuguugacuuuaaugga

SEQ ID NO: 13160 - RNA, 35478 nt, Homo sapiens
cgggcggcccgccucugucuggggcugaggggaggcccggagccuuucuggggccugggggauccucuugcacugguggguggagagaagcgccugcagccaaccagggucaggcugugcucacaguuuccucuggcggcauguaaaggcuccacaaaggaguugggaguucaaaugaggcugcugcggacggccugaggauggaccccaagcccuggaccugccgagcguggcacugaggcagcggcugacgcuacugugagggaaagaagguugugagcagccccgcaggaccccuggccagcccuggccccagccucugccggagcccucuguggaggcagagccaguggagcccagugaggcagggcugcuuggcagccaccggccugcaacucaggaaccccuccagaggccauggacaggcugccccgcugacggccagggugaagcaugugaggagccgccccggagccaagcaggagggaagagguaaggggccagcucugcggccaugagaggcaggggcgagaggcagccgcuggccccguggcuagggcuuccagaacccugacccuccagcugggggugugugcugcuggaucucagagggucacucccugcuaucgcuuggagccaaacgaggcauguccggggcagaaccuguggacauuuggugguguuugggggcacaugaucaugggcuggcaucucgaggacuucaugaguaagccucacucuccucuuuuggacaaagagccuuuggggugccggccggcagcucccggcacggcagagcagcugggagugugcguguguguaggugugugcuuagagggcagcguacugaagagcugcagaaggcagggguggcccaaggacuuggguagucacuuugaagcuuuggauuccuaugcccccaggccgggacaaugugaggcaaaggcaagcgcugugcugaggcgcugggagccccugcucggagaguuacaggagcugggcugccucugcucacacccuccagcuggcgaggagagcagaggcacccagcacgggaacggacgcaucacccaggggcugcugcacuggaugguaccccgggucuccaacugaguggauguggccaagauacagggaggaugcggcuucccugguacccccgcaaggggacagcaggggcuccacauaccaagucgccugaaagcacucaguauuagauaacauuuccaaacaaauucuucacugauccuucccuucuccuucuaugauaugugugucaugggucagcucuugccucugcuguaggauuaugagagcucccagaggccaguucaguuacuuggaaaagcaucuccuuucaccccacucucuggggaaaauugagaaugccacuuccaaagccggccaaaugcuccccacauguauuuuuccaaauggaggcagaguagggcaguccucaugagcuggcuucaaaucccagcucuucuaccuacuagccaauggcucuggcagaacacuuagccuuucuaaaccucaguuuucuuaucugugaaaugggauaauacugcccaggugguaacaauggccagagaguaacagcuaacacuuauauugcacuuacucuaugccagacucaacuuguagaauccucaugaccacccuauagcacaggcauuauuauucaucccuguuuuauaggugaggaaacugagguaaaguaaugugcccauggcuacauggcuaguaagugccaggaccaggacuugaacccagugguguggcuccggagccacucaaccacacccuacugcuuucuaggagaaagcuaggcgcccaugccuaggaaggccuuggcuuagugccuggugcacagcaaacccugagcaaaccuuggucacugaugauuacaaaccacaacaaucaggacuggcacagagggaagggaagagcagagacacgaauucuuuuuuuuuuuuuuugagauggagucucgcucugucacccaggcuggagugcaguggcaugaucucggcucacugcaaacuccgccugcuggguucacgccauucuccugccucagccucccgaguagcuggggcuacaggugcccaccaccacgcccagcuaauuuuguguguguguauuuucaguagagacggguuucaccacguuagccaggauggucucgaucuccugaccucgugauccgcccaccucggccucccgaagugcugggauugcaggcgugagccacugcacccggccagagacccaaauucuuucccuguucuggacauauccugcuaggguuuucagaaaaucccacgagacagagauaauacuguggcuacuaucacugcccacacuggagggcuuuccaggagccugaggagaggggggcuuuaugucugggguuuggguuuggggccaccugcagcaugccugcauccuagaaguccauacuaagaaaaagugcagacauauuaacaaaaggaucuaauaccaaccuuacaggaggaagggcauccugcuucccacaugggcacugccugucugccuauugaucuccccagcagaaccauaguggauaagaaaaugcagcuaccuuagugcugugggaagcucacaaaaucaggaggauccauagucagguuugccccggaguugcagaggaagaggcaaggaauggccaucaccaagucuggcacuaugguggccaugucugguggaucuuacaccagacaacacugauacaucuuagcccaggagaggagcuucugugcuguggcccccugagguuccagugggcucccugcacgcuuggaagcauuuugaaaaggugacaucaaguauuugcuucucuagcacaaggccucuggggcuacugaagccacagguuucccugcuccagccuggaaccaugguggcucacugucuucucugggcagcuuaggaugagcagaggcucugacugacuucaugagcuuggcaaaaaaaaugggacuacuuacuacuaaugaggcagucuggguggaacagacaaaaauguguaacgcacaugguccagcaggggacuacauguuauugcugaagcucacgggcagagcaaauaagcuguuccuccaucuggcccuccaucccccagugauuuaggaaguacccacugggcuaaauaaggcauauacauuaugucauuucauccucaccacaacccuagaagguagguucuaguuuuagcaucccauuuuacagaugggaaaacuaagucucgagagguuaacuugcccaaagucacacaguuaugugauuaugugggacuggaacccagcucugucuggcuccaaagccccugacuuccucucacuucagugccuuguuuagacaccucaacuucucuuauccugacugucacugggucccugcccagugucgucaguagccacaucugcuuugguugcuguccuaucgaaugcugcaccaaccccucugaaaaccauggacuuacucaacuuuagcgcaucccuugcucuucauggaagccuacuucugaggcaaaauaggcaugacuguuacucuuagagaugagccucagcacaguuaugaggguaccuguuaugugguaauauggucagugacaagaggaacugagcuucgaaaccagguuggcugacuuguuccacgugccugggugcucugcgauacugucucaccacaucagcaccaggaaacucuguccccagcucagugggggcagagccucagggaaacacugguccaugugacuaagauacuauugaugcgcuuucuacauccguacuuggaggcuccuuuaggacugaagaaucagagcucagguccucaucacccacacugggccacacacgagcaauuucugagaaaacaucagggagauggcaauggguagcuacaauagaacaaacauaacagacagcagcccugccaaagcagguacauucagcaacuggccucucugaaucacagcccauuuaaucuggaauggucucaacugacagcaggcagaugggggaggggcucugcuucauagagcccacagcccagcaggacugggcagacaguaaauaaucacacaaacacacaacugugugaaagcuguaaagagguggcacaaggagcuaagaggguccucaagguggguggugcuguccccgucuuacagaaguggaaacugggggucagggugcagcaccucucccacggucucuccaugcaugggccaaaaagcaaagauugaaacccagaccugugcugguuccaccccagccugcugccauccuggacaaccacacuguggaaaucucaagaaagaaucaauucauugaauagcauuucuuuuuugugaauuuauauaaaacaccccaaauagaagaguuauucagccacaggcagcuuggaguuuguggugauacacuggucacgucagaagccucauucuggggguaguuucuaugacaaaacuguguucuuucacauggacugugagccauaugacugaguucauaacaguguuggggguuacaacguuacgauggccugucacauguacacaucaaucacaagccacauuuuggucccaggaauguuaaaauguuggguguggcaggagaaucccuugaacccgggaggcggagguugcagugagcugagaucgcgccacugcacuccagucuggugauagagcaagacuccaucucaaaaauaaaaaauaaaauguuggguguggggagccaggccucucacaacugaacuauugugucaguccauucucugcugaaaucagccugucuggggccagcagccccagagccucagcaacccccugcugccuaguuguccagacaggcaguaccaagaccaccaaggaaaagcccagaauggacucuguucuuaucuucaagagaugccugaggaccugcccagcuccaagaauccuuaaaguccugccugagguggucccacuccaaccuccaugagggaaaggcugugucugucucaguuacugccgaaucucuaauacccacucagggccagguagaaaagauaucuguggaaugaaugaaucaaugaagcaagccucaggcccaggcucucaagcaaacaagcuucucuaccccagggugccacaccauuccucucucuguuguccagccaagggcuuuucugaggcuaggucaggugccccacagccccccaaguuucccuaucugggcauggaucucuuugcauuacaaaugccuagucucugucucaccuacuaccguggaccccuugaggguaaggaccucacccaccuuguuccuguucuaccuccagccgcuggcacaguggcuggaagaggagaacuuauugggaaauacauuauacaaaugaaguucuugaauuccuauuuaguaaccuaggugccauccuggauacucaguagucagaggaggaaucugcccuggcccugcuuuuuaaagaagcuguagucaggagggagauaaccagaugacugcaaucugagucuuggguguugaguuggaagcagccacagcugcacuugugagcugaaggagggagggaagaccucacugaauggauggcuucauggugaggucaacuuaggaagacaggcaggcaucagccaggacagugggggaagguacucgaggcaggaagcacagcacaugcaaaggcagggaggcaugacaacacaaggucuguuuuuaagcaggacgcugacaugaucagaugugggugucagacagacagcccuggagcugcaugcaguguagacugcaggggagagagcacccaaaggcagggaggccaauuaggauuguguggguaagaaaccuggcccuggguuagacaaaucuguuacugggcccagcuccaccacuugguagcacugugccccuggacaaguggcuucaucccuuaccuuuguuugcucaucugugaaaugaggauagucauagccccugccucaaagagcuaccgggaucagugaggcagacacaaacauugguugucccaguguuugaggaacaaguccauccaaacagccaagguggcccuggugccaacuucucagccugguccagaaaagcagccccaggcaaggccuggacuucccaagaaagucacccuggggcagugcuguccacccagcccuugacuucucccucuugucuagggcuuucccaguuguagggcuccagagcacacuaggcacugccggaaaugcagcagccaacucagaagcuggacucugaaauggcuucugcagacucuuccccgccucugcucuguuggccaaggcuccuggcacagaggccucagugcacagacuuugggggaaucucaaaaugguucccaaauaacgcacugugaaaaaguaacagcaguguccuugucccccggaaaaggcaaccagcucccccacucccuaaccacaucccccucuacccuaugaucucauggugugaccacaacccgccuccuccaugaacucuuccuggagccagcaauucaccaauggcaggagcacaagagcccaaagcaucaggcagauucgaacccccagugcuacuccuccaggcaaaucugucuuacccugcuucucugacucauggcucccaucacccaugacagguaguagcaaugcacaauggcuagcugcaugggaaggcuaaaugggugggugauggagggcuggauggauggauaaaugguucauucaauggucuuaugagagcugaacuagaaggguuugggaauugacuccagacuccccaggugccuucugguggggaaucauucauagcauccucagccaggaggggagggcagcuggagaucuggauaugcccucccuggccuccgggcugauggugaaucauccaggacaaacaaugcacaguccuuucaccagguucuccaaggugagggugucacugcucaucccagaugcccauuuuggggucuuaccacuugcgugaucaagcagcucuuuccaacauccaacaaaacacacccuugugcugaccugaaagcuauuucuacuuauucagucaacagugaguaacaugcaagcugcaucucagccauuaaacaaacaagcaccuuuuauucauacugguugaagagacaaucuugaugcaaggcaggguuuggaccuagcaguugacagcuaaaucccaguugugauauuuacuuccaagugaucuugaacaagcgaccuaaccuuucuagacuuggguuuccucuacugccaaaugcagauauaauaccuuucucuuagguaaugggaucauauaguuuguugcucagucaggacaauauugagagugaaaagggggugcuauuaauaacuacauaagaccgcaaccagcauggcgaaacccugucucuacuaaaaauacaaaaauuagccagguguggugacaggcaccuguaauccuagcugcucaggagguugaggcaggagaacugcuugaaagcgggaggcagagguugcagugagcugagauggugccauugcacuccagccugggugacaagagcgaaacuccaucucaaaauaauaauaauaauaauaauaauuacguaagacaacagaccucaacuggggccaaccaggauguaugguccccuacucauagagcuauuaagagccaaugagauagaguacagcugggcacccaaauucacaacaaacgacagccauuauuagcaauacuacuggucaccugaucagcugggccuuuuccuucaucuggaucccucccacaucuuggauuaccaacugguuuggauacuucccuaccagcacaccauacauuucaacagcuuaguaggaacaccugcuagcuaauguugauguuuucaucugucuucuguccugaugauaguuucacaaacuugauucaugcucagguccaccagacucacucaagcacagcucaggcuucuagcuucccagaaccccgacgucaggggccagcuggcaguuccagauucccugacugccuuggcagaggcccgcuucucaggccuccugcagugcugggaugccucuuauggcguggacccauuauuggccuucaucugugaucacagaccaaugggcagugcugaccagaggacggguggugagggggugguucuguaaguccuccaggcaggacuacaaccuggacugaugaugaaucaacuccugagauccggauuuaauuuggaggcuucccugggaucugcaggccuaaugacggcaagagcacuccugucgucguccugccuagagggucagagaacaaccucuuuuggguuuccagucacuuuggcacuuugguuucucuuuauucacaguaugguaucuuuggggguuauuuugggaucuguuaguggcucuacuacuuauuaauuugugauuugggcaaaugacucacgauccucaaaucucaauaguuuccucaacugcaaauagggauaaaugucagcuuugcuguuagccuuaaaaguaucuuugugggcaucagaaaauugcuacaauauaaauauaaaaaacauaaagacuaugaaugugaguuguguccccuagaguagcacagugcucaaguggggccaccaugcauggcggcccucaaauaacaggccgccuuccgagggcuguugggaagauuaagugagauaauguauauaaagugcuugagccauagugacaauuuauuguuguuauucuuuuaauugcuggaacuuuucucauuucuaaccuuuggggugaacucaaaagaggaucccaggccggcagcuucugcugcagggcagaacacacagcuccaucugaugaaaaugacagcucuucccacaaaguggccccuugcuugggcuguggcaccacaguggugagagggaugcggacacaugauguguggccccaccacaucaggccaagcggggacauucagaggcagcccaccggagacugggugggacccaagcccuggagaggcugccucccaguguacaaaggcugucacguggcacagucacaccagccucacuuguggggagggaaaacccaugcgugauggaaacuccucacaauacaauguggaaaagcaauuuuaagaaucguuuuuauuuuaauucugaagccaaggaaaacaguuggauuugcuuuucuuuguuggacacaggaaaaaagugaggagcaucacuuugauuggaguugaguucuucuucaguccuaagauggcuggaaugccggggugggggugggggguguuacuucucuugagauacaaugaguugaauaaauaucaagagagcaaaaguaaacaaacuuauuacugcccauuaagagccgccaaacuggcaaaaaacugcuggggggaggggaggaauugggguuggagucuuggacuccaaggaaaauaaaugacucugaggcucaaagagaagcccaaggagcauggcccuugguaucagguugacccaaguccuaggcucagucaccuuuggcuguuaucugccguguguuccugggcaaaucacugagccuguuuggguugcaaugucuccguugauaaaacaggggugaauaacaacccaccggauuaccugggacaauguaugucaggcgcccagcacagugcccuguuccuucccuuccuuccuguaacccaaucaguucugagucacccccacuaagccuaggccccacagagguguaacaguaggacucagaaucaauguaguuacaagaggucccacugcucgcaacaugaccucaaagucagcuaccccuacaccuuuuugagcuucaguuuccucagccuagaaaugggcauaacacuaguaagucacucugaguguuggaaugauuagaugagagaauguugaugugaagggucuggaagcccuaaagcccugugcaagcauuagucaaggagauggugugagugcuuggcacacugccuggcccacacccagcauccucacuguuguugguuuuguuucagcuuuguuguucuugcuaucguauugcuaacacauuauuccaaucucccgcuucugaugcacuuccaugcugcucaccuagugugcaagguggguuggaucaucccauuucacagaaaagacucagccuuugaggucucaagugcaauggcaagaacucugucggggagcugugagagcccauguuugggagaggauagaacucaaccauaaauagugcaaaucaaaucuggagguccaggaaggcuuggaaaccaaccuugucuugcagccagguugccuccugggccucuggcaguuucuuggccacaguggagcccugcgcccacaugggcacagagaggugucugucacccacugccucaggugagcagccugaagaaggcguuggcccagcaggccugcccuagcccagggucgggggcggcuccuccccauuguucuggggugggugugaccacuagcacaggggcagccaaagcaccguuggaaacgaggcaaacacuuccaaacucagcuggguuuccacugacgucacugcagccccaccuccuagcagagcccaaaccagaagcucccacacaccuuucucugccuagccucagagaggccugagcaggccauaggaaucaugcuugggcuuugucauuuaaguggaaaacagcucagcaaggccccagggagcacagggucucuuuuguaacugcucacuggcugguccaagguggagcccagacccaggguccucacuggagaagcccccaaagggguucagggaggacaaaaucuuuagguccugugucauacuuguuauuuuagcacagauuaaugugaaaucagaaaguagugaugcuaauacccuuuuacuaguaaaaaccagauuaaauacaugccugugucaucguuaagaguuagcagguuccaauccagcagaccaggguugagcccugguucugccaccuucuagcuuucugauuuugggcaagucacucagccucacugagucucaguuuccucaccuguaaaauguaaacagcaacaguaucuaccuuaaaaggagauuaugagaacacgggaaacuggaaaacacuugcaaaauguuuaguccagggucagguauauagcggaccuuggucaauggauguuauuaauaaauacacacauaggcccuccucugcgcagcucugaccuccucaggcagucacuuguccaugggaucccugccccaaucuaucccucuuuccagcacucccagcugcucagcagcuguuggcaggugugucuugucauuccaucaacaaauauuuauugagcuccuauguauuucaggccacgugguaggcacugcacauggagcagugaccaacacaaacaccucccuaccaucaugcagcuugcauucaagggaacggggaggagacagcguguaucuuauggugauaaggacacuggagggggaauguggugaggucacaaucuuaaaucagcagggagggucuaacugagaaggugguauuucagcaaagauugaaagagguaagggaacaaacaacgaagaagggggcagggaccagcaaguauaaaggcccugaguccuaacugugcuuagaacacuugacagacaaccaaaaggucaaccaggugguuggaggagaugaucguaggggagaggggucagagaugagaccagggaggaagugggggccagaucauagagugccuuggagacccacuagcuuuuccuccaagauggugagccacugggggguuuugaauagaagagugaccccguuugacuuuuuaaaaaggaccacucuggcugugaaguugaggacagaagguaggaugggcaaggcuggggcagggaggcuaguuaggaaauuacuccaauaguccagguaaaugaugcagguggguugcaacagggugguggcagggagguggggagacacaggacucuaagaauauuucuggcaucguaauuuggcggugaauuagaugugggguaugaaagaaagaaaggcgucuaggaugacuucaagacuuucggccugagcaaccagaguggacauuuaugaacacaggaaaaacugggaugaacagguuggguuggagauacggggaaaaacgaguucauuucuggaugaguugagauaccuagcagauagucaaguggaaaugucaaaaaagcagcuguauguaugagucuagaguccuggggagaguuccagaaauaaaugcggauguaaucaguacuugagggugaucaccaacgugaccucuggaugagaugacuaagguaaagaaaauucugaggacugaguuuuggguccccucaacaguagagaaaggacaggaauaugaggaugaaccagcacaggcucugaggaggaacagccggcaagacaggaggcaggguggcgcucuggaaaggaaggucaagaagggagcccaacuguaucccacagugugagagggaaaauauuaaugaggaucaagaaccagcccuuccaucuggcaaacagacaggggauccugucuagggcaaccuagaaugaaggggagcgggcaaagccugaugagggugggcucaagagagaccaggaagagaggaacuuucuggaaauggugagugcaggcaucucuuuggaggcuuugcuaaaaaggggagcagagaaaugcaacaagagcugcagaggggaugugaggucaagagaggguuuuaaguugagagaaaaaaccguaugauuauaggaaaaccauccugauguuggggagacggugaggacugcuggagcaaggcccucgagugggcaagagaagggaucuagcacguguccuccccucccucuuggcccauuuaacuccuacucauuccucaagggucaguguaaagggcacuuucucagggaagcauuccugacccucuaggucaauucccuguaauacuccuuuacagcaugugacaguugugcuuucuggcauuugggaauggcauaaugaugugaaagccccaugagggcagggacuggcuccauccuguugguagcuguaucccuagccacuagcaugcuguccagcaaaucacagguguucaaucaacaucuggugaaaggaugaaugguccaagaauagaagugaagcaaaucuggagacacauucuguguucugcucccuucuaacuuaaucacguugcaguggucaggacugugcugucacuggcuacugcaaauauuuggauucagaagagcucaguuguuuguuccuguuuuggcucuguagcuuagcuaacacagugaccagagccacguaacuggacacauccuuccacugauauuguccacuaaacccugaauguauuccauaacaugucuaacgauucauuuguuuaucaaauauuugcccaaagugcaauauccugggaauacaggguugaaucagacagacgacaugcccucauggaguuagaauccaacagagaagaucaaacagaacugcuauucagcacagcggugauggguauuacaaggggaaaguucagggggugugaaaguauagaauagggagacucaacagucugaggaaccaaagguagcagaagagagagaccagaaaacccucccucugccuccccuccccagccugaagcugccuggauacgauucucaggcucuaggccaggaguucagcaagggggcugcgggcauuggagcuggcucugggaguagcagggccauggccuccugccuucagaugcccugagacccucccucuucccuucuaccucugcuggggcuugccugucuccucuugcuuccagaauggcugccuguucucugacuccaagagaauauaacccagcauccugaagcagaguuuuuggaaagcucugccugccuggcgagaaggcugggaucacugauggcacagggcacugacaguggugggaccaucacugauucuccccucuguuuacuuucaggcuuucauagauucuauucacaaagaauaaccaccauuuugcaaggaccaugaggccacugugcgugacaugcugguggcucggacugcuggcugccaugggagcuguugcaggccaggaggacgguuuugagggcacugaggagggcucgccaagagaguucauuuaccuaaacagguacaagcgggcgggcgagucccaggacaagugcaccuacaccuucauugugccccagcagcgggucacgggugccaucugcgucaacuccaaggagccugaggugcuucuggagaaccgagugcauaagcaggagcuagagcugcucaacaaugagcugcucaagcagaagcggcagaucgagacgcugcagcagcugguggagguggacggcggcauugugagcgaggugaagcugcugcgcaaggagagccgcaacaugaacucgcgggucacgcagcucuacaugcagcuccugcacgagaucauccgcaagcgggacaacgcguuggagcucucccagcuggagaacaggauccugaaccagacagccgacaugcugcagcuggccagcaaguacaaggaccuggagcacaaguaccagcaccuggccacacuggcccacaaccaaucagagaucaucgcgcagcuugaggagcacugccagagggugcccucggccaggcccgucccccagccaccccccgcugccccgccccgggucuaccaaccacccaccuacaaccgcaucaucaaccagaucucuaccaacgagauccagagugaccagaaccugaaggugcugccacccccucugcccacuaugcccacucucaccagccucccaucuuccaccgacaagccgucggguaagugcuucugggaucguguuacaugugggucucagagccaggcaccaggcuucccuuggcuguguccacaaauggggaaaagccauggccaguugaagccaggccaaagacaugcacaaucccccagcaaucccuugggcugagcugcuggagccagcagggugacggguggcaggggaaccacauuccuuagauggauccucaaagauauuaccaaaaaauggaguuucagaagagggcaaacacucucugguuucugacaggaaagaacccagagccuguaguuuucuaggcucugcaugagaucccguguguuggcagauagaagagaaugucucuccugcagcucaugcacugugccuggcacaggguuggccuucuguaaauguucaccaaauaaacaaugggccaaaagaaaagaaaguauuacccauguuaagaauaugauaaacacauuguaggggcugggcaugggaaggaguccuuccuaaagcccacacacuuccuagagucugcugcugucuagaauuuucaaugaugcuuccauaugcucuuacauacacguuucaucuuaaaauacagcaauucuccgaauaccguuaugggggaggaaugggauugcuggcagguuuuaaagcuuaaccaagauacuggcaccggacauuuccauguauguuacauaauuaacuccuggagcuccuugcggacaggaugaauaacuugcuaauaggcuuaggauguucaggcuagauuugcauucaggucuuuucacuuuaaaucucuggcugacuucucuaugcucuaggacucuaggaaucaucauuucuggaagaagcaggccagaggcuccccugucagaaugucagcacacauccaguccccugaagcucagccccuuguucauccagaacaccugagccuucccagugggcugccauaugagaacuauauucaucucugcauaaaugaaccauguaucuacuccaagucagugcuuucgguaccauuucauuguauaggcagggagagauuuuuacugaaaauauccugcuuuacacuuauuucacacuuuuaaaaauaaccaccaguacugggaauagcagcuucuugcuaauuccaaagaggggcugaaccugagugcaggaggguggccagugcagaggacaagggcagcauuguuuucagauggggugggugaggugagcuaaaugcaaagugagcauccacugcagcaccucaaaggaaagaccuggccugggugcaggauugagagcaggcgcuuuggaguaggcuggcuuggauuuaaauccgguuuccaccacugauuagcucugggacauuaggcaagucacuuugucccccugaggcucgguuuccucaucuguuaauugaggauagauuaaaauagugccugucacuuuaggaaacgaaauacugcaaaaaacauguuuagcacaaugcuggguccacgguaaacuacaagccuccuuugaucuaggucuuuucaucuuaaaacaaggagacugaaauaaacagucccuuuuuuagcucuggcguuccaucuguacacgugucugcuuuaaaucagaagcucugaaagagagggcaggguguguuaauuugucuugauagaauaccgagaggguaaaacgugcccuugggcaccaaacaaaggcucaguugaauguuguuauaacccugacuggagacaggcuggacucaaugguuacucaacagaucuccucuggccuaagugucucugguuucuaacucaaaacauuucaggacauuccugggcuugaacuaagcuggcagauacauaguauaggaauaagaccuggguuugcauccaugcucuaccccuugguuagcuguucgcucaugagauaguuauuuaacucuucugagccucaauuuucuccucuguaaaauggggacaagggucauaaccucacaguguuaugcuguggauacaauacaaucaagcaugaaacauuaugucauguaguaaagccaacauuugcugagccccuacuacaugcuagucgcagcacuagacuuggggaaguaggugacaauuguggucccugaccuccagaaacucagucugggguagacggcaggugcaugaaugcaucugggauccguccaaugcccaugauuucuagucccuaacaucagcacaucagaucugacaauggauuucucugggagggaguauccgucgaggccaaaauuucuaaaaucaggaaugcagugaaaacugggcugucugaucacuguggugauacccuggugugcuaagugcccugggggacaguaagguggcaugacuaauucugccuagagggaagggagagauuagauagacguggcacuucuuuguugcaucuugaaggauuuguaagauuuuaccaggcagaccugggaguugggaacccaagugacuagugggucccugauggagaugagucugugcaagggcccaggggcacaguucuauuccuggcaccucaaaugguucaaucuccugcuucuuuguguucacaacccagugugggcuguguguauccaaguguccugcacucgcccgucuuuugucucccacuuaagaaagcacgccgucaugggagggaauggcagugauuucaucacagagauaacuggaaugcauuagaauuuauccuucuuuguuacgcaaggauccccaaauguugguacuugcucauuaccaguagauuucuugugacccaucucaccacugagcucccacacaaggcgcugccagcugggauugagugccuagcuguggaagaugaauggguagacagagcccaggaagagagcagcugggggaggguccugcccucuccugguguugaggacuaaacugggaggaaaaaacagauggucucucugcacggaacagucagggcauccaaugagcagagaacauucuuaucaggucuguucagagagcuuggggcagguucuuauccuggaagacaaaacacucuucugugcucuuacccaacagauccuuuguucuuagggacaucacuuagccagaaauaccuuugcaauuaaacaccuuugcauccgagccuuggcagcuuccaaaccuuucacucagcagccucagagccaugugcucuuuucuucgucugcccacagcaugcccuuccccaggggacuaagggagccauggcugcuuaucugaagcuguaccacaagccuguucccagccuuacugagacaguaacaggguggucccaggccaggauggccuacugagagccugagugaggaggcacaggcagcuccuggcuucccuggcuccucaccugggcuuuguccugugucucucaggucuggccagacccaaaggcauuuugauuaggaugauucugugaugaggccugggccaaauggcccuaucugugguccucugccccaccuauccugcugcugcuauuagaagaggaaggcuccaggggucauucucuaagaggcaaaggauagagcaggcaccuggguucugggaggccugguacuguuucucaggccacccaaggcagagccacacauuugccagcccuccugcacagugcccaucccagagacugaucagggaggaaaggacagcgccaacagcagcugccacagacgggcuuugucagaaacuaaucuuuaaagaccaaaaggagugagcacuuuuagcuguuuucucuccugagaaagagaauacaaccaguucacuuuauuucucaaugagugaagaagaaggggccauaaaaccaugaaauacuggaacuauuaggggccucucagauccccuagcauggccuuccuguaacagagccuguugguggcagagcagagaucgacccugggacuuguaccuugcaggauauugagguucauagaggucaaguaacuuagccaaggguacacagcuaguaaguggcuuggccaaggcucaaaccaaaguauguuuuaacuacucuggauauugcacacuuccacgggaaggcuggaggggaacugguguaaaaaucaccccgugaaugucugauuuggccccagcugccacagggaccugaccuucuaucucuacuuccugaccuucuagcucuacuuccugguaccacguuccaaacaguuccuuaaaaugagcucugggaacaaaggugguagauuuguuauuagaacaugguuccaaugacacaaaacacugucgcuaccaacccaccaacaucaugcucccccucccuaggccuagcaggaaccagccaagcuccccaguagaaaguacaacgugcaccugacucccagcaaauggacccaacugaagucuaauuuuuaauuuuuaucaaaucuggacauauccucugggguuccuucuacucagcauuucaauguauagcuaagucuuucaacauauagcuaagugugaaguucugauuucuuuaaauguuagcccugacuguauaaaugucaguagacaugaccuucccuugggaccacaugaggagguccccacauugcuucacugacaagagugcuagcaggaagccaccccaucucacaacagaugggcuauugggcuauggccaggauggcauggacaacuugaacaagaguguuuuccuagauggauuuuccaccuguauuuuauuccacccuauaagguaggaaauacguacacgauugugguuccccagcacaaugguauguuuuaaaacagagaaauauaugauguuguagcucccauucuuucuggaggucaagcaagcaaccaggugaaaaggugucaacccauguguggcugggucagcuucaguaggcugggcauccaggcccaagcacugcagagagguggagaagcacaggguguguguggugaugguggcgagugagggugacucugcccauccugagucagccuucaaggucacagaggcugagggaaaagcccacacaggucuccugccuccagagcgugugcuguuuccacuguacaauacuuucuuuuauucuaaaagguuuuguuaaacaaaauaagauuucaaauucaguacaaacuacauaauccagugauuucucaaagagcacucuuugcuagcuucuuccuaaacaaaaucuacucuaggaagauggcccaccuggaugaugguuccaggagggccagcucccuuauugcuuugcuuucucuuccuccucuucugguaccuuggggaacugaucacaaagagccuuuugagggugauggaaagcuaccccuccauuccucaggcaguuuuccaaagaugacacuuggcuaaaugcucaggguauuuacagucauaggagauaaacuaucaacuuguuacuguuaaaaaaaucuugagaucugggaucuugaugccugaaaaucccaagauugguacuuggcaaacugaaagaaaucuagaaaacccuagagaucaggcaucuguggccagcuaacuggucauacaaauggauuguuguggugaacuuguauaguauuaauccugagaugcugucccccuccacccccacccccacaaaaaaaauaaauaaaguaguauuaaguuagccucauacaaaugcuggcaccaugcuccuggacuucucagccuccauaacugugagccaaauaaacuuccuuucuuuauaaauuacccagucuaugcuauucuguuauagcagcagaaaauggacuauguucagucuuguaaaaguaaugaaguauauacuuccagugguuuauacccacaucagugaaggaugcaggcagcagagaccucuugaugggaacacuggagaugaucuuuccuacuauccccgcaucaccacugccucaacuucggcucucccuggcaugaaucuggucaaagauuaugcugaaaauaagccugaugguccucaucuuauaucucaagaugagccuguggaacuacagggccuggaguauuuaugugauccuuuguuuaaaaaaaaauaaguuacuuuucccugauauuuuugaauacaguaagucaaaacuacuauacacacagagaaaaaucuugcuaagacaauuuguuuacguuauaaaugcaacagcuccuaaauguugaaauuaaguaucuuagaugguaugucuagaguaggguccaaaugaacaaaaaauccacucaucuggcaccaucccagacauaaugugcagagagaccacuacaaacuguccaggcuuucccacaaagcagguuuccuuugccaggguuuggucuggauguggauuaucaucuguuguggggucucucuuuccagauggauuuauuauuauugguucucagcuggaaagcacagaaugaagguagcaaaggggaugcagcucaggauggugaaggauggagggugaaggauggagggucaaggauagaggauugaaggauggagggaggcacacagagcauugagggacucauggagugagccugcaaggguuccugccugaaaggagcccacagucuuauggggacacagauccccaacaauccuaauguggugugauaacugcagcacagaagguggaccugaguucuaaucccagauccuccacuuuccagucaugugauccucuugagcccuggcuuucucacaggugcaggggcuuaugaggaugaaaugaaacggugugcaaagcacauggcaggugaaaggcucuagauacaugaucaucaccauucuuaccuuauuccaguagagauaaauauacaaagcauuuugggaacacugaaaaggauaaaguagcuuuccugggguuggggaaagcuuccugaaggaggugaugaggaagguaagggccuuguggugcucucagaaccaccaccagugauagucaagaaaucaugaagacaagucuuggugccagacaaauguccugcuuucagaaaaagaaugcauaccagaaaucacauacaacuggcuuguggugaagccccaguaaaauuauagaaaagaguacacaaaggguucgugagcauuuggaagauuaaaaggucaccaaugaaagccgacauagguucuuaaagaagaaaccaaugaagcugaucccuuccuuggaaaggguuaauacacucgccaacuaugggacugcuaccuguccauaucuguggauuguagucaugggucugauaaguucuuccaugaugugccugcaggacagcaccacagucucugacagagccauggccacucucauuagugugccuguggaacccuggggcacugcccaccucuacaucagagaccucccucacccaggaagccuuggguacaacuggccacugcccccagggagccaaggugagcugcucaccucuguacacagugagaccacuaaagccccuucuaaacucuuuuuuaaaaugucuuuaaagccccuguuucuccuccugcccaacagcgcugguggaaaccuaagagcgacgcaaugcuuuggacaguggccucuggaaaguagugcugcaaugucuguuucucccgaggucaaaugagcagaaacaggaccuuuauaagcccuuucugggcccuaagagcucuuacuugagaggccucaggcuguaucacaugcauugaaaugaccuaccucacacauuuaauagaauuuuuacuggaacaauuuugaaaggauuuaauacuuuugcuuuuaaaauuauuuggcuaagaguaacucaauuaauuuaugguuggaucucauuucucaguaaacaucaagcauauucaggaauucuugggaagugaaaaaaaucuaaccuacaaguuguuuucaaaaguaguaacauuuucaugaagacaaaauuuaacaauuaaugaacuugacaagaugucacacuuuguaguaauuuaauuacauacaauaaauuuugauuuugcaguuuucuuuucauauuuuagagccaguaagucuuuuuaggccucaaacauuuucaucaacuccugaaacacucauuggccccaggcaccaugcccaucguuugagggcuaaagcggccugaaagcaggcacaagcauuuggaccuuuucccuggaaugaucagaaaugacaugugugauaucaacucugagguucugcaggaacugaaaugccuuugggaccauacaagcuauuccuguguuuagguuauuguuuuguacucugguucgcugaaaagcagugauugacauagaauauauauacauccauaaccagaaucuuauuuugccaagccucuggauaaaugagauucgaagacccccaauaacugcuucucacuguagccaccccucacaccccaucccccgacccugugugucuguucuccugcccucauggggugcccagugaguccugaugcuggccugggugggacucucaccuaagcaggccacgugccguggcacucagaugcauuaauuuggguaggaaauugcagauccaauuucaacaguuagucauuucuccuguuagaaaaauguuucagggagugguaagaagacuuuuuggagacagaccaucagugagaguaacugaaaacagcauacaguucucaugaaaagcagacugcaucuuagugauaucacagaagccucucccuagugccugcguauggacuaaaauauucacaggagcaacuucccagaaccaagagccccccagaacauuucccacaggccacaggguccucugaguggccuaagguggucaaauucugacaccuggggcuggacucaggggauaaaaaggacugucaggcugcuggccagccaugggguccagucccgcugugggcaggaaggacucugcuccuccccccacaccucaggcacgucagagagaagaggcaucccucuugcccacggaggccucacugcuuagcucccagccucaaggucagauauucacggagccauguuuuccuaguaagaggggcacugcacugagagcugaugcaguuugugagcccauuucuccacuagggccuggacggguaaaucaggcugaugcuggucugccccagacccacagagagagaacuggaaauaggaaguuaugcuugccuggccuaggugccgguucuaacucagcuugaccagaaaggcccuguguugggaguagcaagcacuguaucagccaucaaucaaguggguccugguuuccugggaggccaugguccuugugugccuaaucccugucaagaaccccagagaggaggaaggaagcacccaaagcugaucaccuccaacacuuaccaggguauggcagugggguccgggcugagaccuguguacuugguacuccccuacuugcugaugucccuccucuggaggccuccugaccccagacccugugugccuacccauccuuguugcuucuucagggaaccacacagacucggcucagccacggggcugcauuucucuucacguggaacauuuggccacagcucccccaagaauguaaauguggucuuuauagagaugaggucgcagcacucgcuccacucugagcccaggugcugccgaguuaguguuggccugaugcucugggcagagcugcccucucagaaggggcgccaaguuaaacaccgcuagguacucugcacugguccaaagggagcgcuuugcccacugcacguugaaaacucaguuucauugacaaaaaagauuuccauucuucaugucaauauaucuuuguggccuucuccacugaaauucugacuuaaaaauacauggaaaacaucuacugguaaauaucuuacauuuagucuuguauugaaaagcaaauauaguaacguguguggaggaggaauuaguugggggggugaacaacuucaaaaaugucagcuuucaucuaucaaaggaaacagaaagggauaaucuucacagagcaccugccccagcuggcucccaugcuggccgcucuuggguucaugacauccucagaauagcuauggucucuucccauuucacagaagaagaaauugaggcucaaugaggacacugcccaaagucacacugugcauaggugaggccaucgagauuggagccaagggcuccugacuccaaguguggagucucccuccagcccucgcuuccucagccaggucuuccuccaucgaggccagacccuugccuggcccccuacgagggcauuauuuauauggaacagcuauagauuuuucacaguauuauuuauauguuacaguuguggauuucucaucaaaguaggauguuuugucucugcuauuuuaaaggagccacauaauuuuacugcugacaauuuuucaauguuaacucuuuuucugacuaauuuucauccaucagugauguuucugaccuuugccacuggugccuuuaaugugugaaaaggaaauguguuugaaugcaggagauuucacagaggucuacuaaggguucuaagggaaauuguguuugaauuuguguuuuugauggaagcuaauggggccugauugucaugugaaauuccguguacagacacauaugcacauuuuuuguaacagcagaaaauacuaaacauuucuacacaauuugauaccuacucgauuauucuagaaagccuuaaaagaauuaccccguuugccuuuuuuaaaaaaagaaaaacuucuucuacaucauaacagacacuacaaucguugaaaaaugggcaaagaacaccaaaagguaaauacggaagaaaaaaaucauuaaagauuuuuaaaaguuuuacaccucgacaaagaacuguaaauuuuuauguuuuauuuuuuucgcuggcugacuggcaaagauuaacauuaguucuaaggacacagagcuaagucagcauggaucccucauucuugaguucguucugguugggggaaaagaaguagugugugagcucugcacacccccugggugcauacaccugcuguguccuuuacccaccagguaaccuugaggggcuccucuaaugaccacagggucugcuuuccuaccucacaggagugucaggagggucaccuguggaaauacguggcuaggaccauaggaaaugcucaguacacacuggcuauuauuauuacuacuucagucacuacucuuagagcaaggaguuuauaaccugggacuuugggaauccauuaccuucugaaacuguauacagaauugugugagucugugcauuuuucugaauaaaggaucuagaaccauccccaaauucuuaaagggacuaguagccccaaaacauuuaaaaacacuugccuuuaaaaagagcccuugguggaaaugccaaagguaaaacugagaucauucauggcgcccacaaaggcagccccagcuggagccacgaggccaacugccacucucccagcagccuccacagccucucccuacguggcgccuccuucaaaggcagccuuuaccucugacaauucugcagcaguccuggcagcugugcaguaagaggcugggcugcucgcucucagugggcguuauuuugcaggcuucugccggaucuuccgucaccagcauucacaucgaacggccucuccugugcugcugacuugguaaggagcugggaggccucccacgcccaccggcgcucugcuccagcuguuggggacagacucccauucucugccuccaucccuggggcuucagcuaaacacaaccaaaaccuuuuucuccuucacaaaugcucuuucuggaggucuagccuccccuucccugggaaggauacugagggaguggugggggaaaggcaggaaguggcacuggcaaaggaagcagcugcuugugccccaucugcuacccugggguggggagcauuggguccugccccaucccuuagagaagaggccuggcaaaaagguaaaugggugagaagauccuuccuccccagaagaugaagggagaagccccugaguuaagugucagcacccaaaccaaucuuucuuaucggggcaauacugggcagugggaagcaaggaaugagcaagacagccccugccuucccgucagguucuagguggaugaaugcucaaacacaaggcuucuuccucaggaacagcccaccugagaugucuaacagagaccagaaaccuaaaucuuucugguuuauaacuauuacgugugaacuaguugagcccaaacaccagccaggaaggaaucugagaagugugaccuguaccagaaaagcugaguauaccugucacugaugggcaccucccuucaacucacacagaaagagaaaggacaggagucuacaggaauucaaguggggaggagguagugaggucagcuccucccuugcagggcgucagagcggccccacccugcccugagcuuccgcugcccagcaccgcaucugcagaggcugggacucaauacacaguuguugaauaaacauacaaauugauagaaaacauacaaugguacuuucuuagcacuuuuguccuuaaccagucucauuguggggauuuuuauuuauuuauuuuuuugagacggagucuugucuugcucugccacucaggcuggagugcaguggggccaucucagcucacugcaaccuccaccuccuggauucaagggauucuccugccucacccucccggguagcugggaucacaggugcgugccaccacacacggcuaauuuuuuguauuuuuaguagagacaggguuucaccauguuagccaggauggucucgaucuccugacuuugugaucugccugccucagccucccaaagugcugggauuacaggcgugagccaccgugcccggcccuaugaggaauauuuugaagagacugaagcaaaaugugauuuucuuucuuucagccauuuucaucugaauggcuaggccuugaccuucuaaagcuuccucagaucaaugagaaaggccccagccuguccagacccuuggugacucaaguuuguaccuucuugcugaugugaccaacaauggaacauaagaaacugccuggggagggcagaguugaugggcagggguggggagggcuaaaagaccagugguauaacacccauuccuucugacugggcugcccaagcucagugcagucacaaagaaucacagaacccucuggucucaguuucagaagagagccauggauugggcuguauccuggacaucauccuuuaaguuuaugagccugcaaggaggaccucagaaugcgugagugccaagcaucuggcccucacugagcuuccuuuggaaaacacacagauucagcugaaagggaaccuggcccccuaaaaacacacuugaagagcagugaaugaauugcagaaauaucccaaagucucuggcuacauggccaaauucugggcauggccuaggccccugugacuguggaaguucauuuaguaaaagcugcagcagucaucacgaagcacugucacuggaagggcagacguggagucagaauugaagggugccaacuguacuuggcccccagaaacaguaauccaguggaacugaguuuccuugcagaagcaaagccaucagagccugcaggcacugacugauguugccacguuuaguagguccacaucucuuuuuccuaauauaaugaacacgaaaaagaucacuccagcaacuucccccaaaugaucucaguaauccugacaacacuauaugagggaaaucugaucuuccuucuacaaucagaagaaacugggggcugggagaaugaagaagucugccaaaagucaaacugugaggcgggugagaggagaaagugagcuuggaguaugggcauccugaccccugguccgaggcucuugucuuuauaauuacuuauuaaacucgcaaaacaaaaauugguuaccucagaccgugggccuguggcucccagcuggagccucaacagagguugugccugcuuggggugcagcugggggugcggccuggugacaggcaggucugugauguauaugcaugucuguguccccaggcccauggagagacugccugcaggcccuggaggauggccacgacaccagcuccaucuaccuggugaagccggagaacaccaaccgccucaugcagguguggugcgaccagagacacgaccccgggggcuggaccgucauccagagacgccuggauggcucuguuaacuucuucaggaacugggagacguacaaggugagacucggcaggggaugucugugcugcccacaaggugacuggcccaccccaagagaggccugagcaaccaauagaagagcccacucagagguacaugcugaccaagcccaggccugugcggccccaacaacacauauaccugaggcgagaaggaugcagacagggccauuuugcaaacccaccagggguagugaggaccagcgccuccucugccugcugcuagaaacugcugcaggacaagagucaguagaccagaccaccacagccccacaggacagggugagaguuuagaaacgcugguaugggggcccaggggugaggagcauuucacucccaagugggguuuccauggggaaagacccgcucucaaagcccagaaggcgcaagucccaagaggcucccaguuccugggagaaucccccaaaaaguccugguagggaguuguggcaaugcucaaguccuaauuccaggcucauccucugggcucccugguucccagggaguugaaaugcucaucuguguagcagggaaaguugccaggacucagucauacaucguucuucccccucuaaacagagguaguacuaaggaaggcaagaguggcucuguuugcugagugcccaacccgugccagcaccaugcuaagggcuuucgugcauuauuuuguuuaaucucguaucaaccuccugagggagguucuguuauggacccagcuuacagaugaaaguguggaguaauuugcucaggguugcaaagccaggaauuggcccaguagugacugcagcugaggccucugacacugaagcucacaaacuaccugaagccaugaugccuugcacacauggcucugccaugccccuucuugagucuccuguccugguugucccccaccccaccuccugaacagccugugucucugcuuuuuucuccucuuccaccuacauuaggagcgggagacuccuccuuucuuagaggcaauacagugcaaugauuaagacuggguucuugguucaaauccugguucacccucaggcauucugagacccugagccucucugggccucaguucauccauacuagggaggauaaugauagcacuuaguucuucgaguugacaugaggauuaguaaaacaaccuauguaaaguucuuaaaacagugccagcacaucacaagcgcucaauacuaaauaauuauuguauuaaugaaucaccgauucccaagacuuuaguggccguaacucagcugcugaccccaaaaccacaugcaaaaaaaaacaauaaccacaaaaccacuggguuuuagaccuagaggggagcgccgguggaugggacacaugcgucacagcucacacccgucuggugcguuacagcuuacacgugacccucacacacagcucaucuccagagaaggaggugaagcucagugaaggucagagauuugucugaggaaugccugcugcgugccuacuuagugccaggcccuccaccugccacagcacacguguuccugcagcaagccuguggggaagguaauauagccucccugauguaagaacaaggaaucugggguucacaugaugccuggcacaggguaggcacucuacauauuuuugaauaaugugugagucauggagagauuaagagguggaguaggggucugaaccaggucugcuucaugcucugcuuguuucccaggccccucuauccagggcugagugucugacagccaagccugcuggcugcaggugcugcaggcuccacauuaacacucuccuggguuuuccccagcaaggguuugggaacauugacggcgaauacuggcugggccuggagaacauuuacuggcugacgaaccaaggcaacuacaaacuccuggugaccauggaggacugguccggccgcaaagucuuugcagaauacgccaguuuccgccuggaaccugagagcgaguauuauaagcugcggcuggggcgcuaccauggcaaugcgggugacuccuuuacauggcacaacggcaagcaguucaccacccuggacagagaucaugaugucuacacagguaggaaaaguggagucaaacccaggugcaggguagggaaaagaggucaaccagagccagagccccugacuccagggcuuggaaacgggaagaucccagggugagaagcagcugggccaagcugccugacccuguuaccacccccugagggucccuucuccugcccacagguccccuucacaaagcugggucacaguggcauuuacaaauuaagaaaaaaaaaaugggauggggcgagacauaaagagguauacaaaucacacguaccagggccagcuggggccaaugcagaaagacauguguugggcuguggccucaccacuucugucccaggcaccugguauagagcuaaccaacugcguaggcucugggccacacaccugggcuccagugcuggccccaccuccuaccagccauguguccuugggcauacugcuaaaucuccgugggucucaguuucugcaucuggaaguaaggacaagaacuacauugcagaguagggagaaggguagagagaauguaccuaaagugcuuugucuaggauuuggcacauagcgagggcuccauacaaacuggcuuucuucauggucacuguuacugcauguaaugcuagugcagugcugagaggaagcuauuaagaggaaagcagauaggagagagaaagugauuugucuaagaucacaugcuucaaaucuaggucuuuacuaagaagucuuuauuaaacaaaaaacaagagaaaaaaacagaaaaucagaagaaacagagauauggucuggcccugaguccagauaucagccucccacacaguuaaugccuccccagggccaacacccaguuucuugagaugaaggccucucagucugccaugcuccucccugaggcuggcaccaccugacggccgaugcugccuccaggcucaggcugucugcucucaagggcaaacccaguccccuccugccuccauuuccuauguggucuuggucagaaggcuacucccucccacuugagaagcgagcucucaagacuguccuacaaauggccuguacuucaggcaggcccuggaaccuacauacuaagguggaggggauccucaugccagguccccauagcagccacauucugaaggguaauucucccaacaucaggggacaggagggacaugaccugcccaucccuguaucacacagacaccucuguccgcccacugacacugaacuggccuggcccgaaggggcccuggaagaggaacaggcccucauucugaagcaguaggggcugccgaggcuucuagaagagcagggcagaaggauaaccuucagagcuggucagacccugggacacaggggcugcuacagccuuucuggagggccaccuccuuagggagcggaaaguguauucuaugauccaaacucagaucuagccagcagcaaaaucaguagcuggcaagguccuugucccuggaggugugugggaccuccgcuggcaaagaggaggcugguuauggcgugcccaaggaucucccugcuauaccaguccaacacugccacuuggucccuguggccuggaaucauggcccagagggacccccagaaaaacucugggaaaaccuggcuccaccuccccucuugcuuucugccucagacugagugcgaccuccucaccucaucccacggccucggccaccugcucuguugggcccuccaacccacaauucugacuggagcagccccuccccugaguacgggguccccuugccaggcccagucaggaaaguggggaccccccuucacuaagagcaaugcuggcagauaguggcccccuguccuccugccacagagugcacugccccugcaugcccgcgcacaccuucccacaguuuuuacuguuguucugaacugcuuguccuuggcagcaaaauucagcaugaugugauaaugccaagaguuuuauggaaauaucuuuccuuugugaaguaauacaaaaaauuguuuggauggaauacaagcuggggaggacuggaggagcauuucuucuuaaacacuuucuuugucauucuuuaaagacuccugauccaacaguuucaacucaaaaauuccuaagaaaaagcuuuucucccuccccgcccaccucaggccaucuccauuuccuaucagaacacaagguguggaguucccuuggggccuccuuugcacccagcccugggcuaggugucaaguacgcauccucauucaauccucagagccgcccugugcggcaggcgucauuuuuauucucauuuuacagaugaggauacaguggcugggagaggucaagucacuugucugagaucacacagcuaguuaguuacaaagcugagccucaaaggcgggccugaagcauggccucucaccacccauggagacggguccaccuuucaagcguucuugcuccagaugccucccagagagggcuuugccgaaagcccugagcacuauggacgcaaguagaauggccuccucccagacacccucucacugccuucucucuugcaggaaacugugcccacuaccagaagggaggcuggugguauaacgccugugcccacuccaaccucaacggggucugguaccgcgggggccauuaccggagccgcuaccaggacggagucuacugggcugaguuccgaggaggcucuuacucacucaagaaaguggugaugaugauccgaccgaaccccaacaccuuccacuaagccagcucccccuccugaccucucguggccauugccaggagcccacccuggucacgcuggccacagcacaaagaacaacuccucaccaguucauccugaggcugggaggaccgggaugcuggauucuguuuuccgaagucacugcagcggaugauggaacugaaucgauacgguguuuucugucccuccuacuuuccuucacaccagacagccccucaugucuccaggacaggacaggacuacagacaacucuuucuuuaaauaaauuaagucucuacaauaaaaacacaacugcaaaguaccuucauaauauacauguguaugagccucccuugugcacguauguguauaccacauauauaugcauuuagauauacaucacaugugauauaucuagauccauauauagguuugccuuagauaccuaaauacacauauauucaguucucagauguugaagcugucaccagcagcuuugcucuuaggagaaaagcauuucauuaguguuguauuacuugagucuaaggguagaucacagacuguguggucucaacugaaaggaucacccuuggcaucugugugccuggauucuuccagaaugucuacaaugcuaaucucucacauagagguucccagcuucuuaagaaccccuuuuggcaccuaaucaaauuucaaaaucccuccccccacauuuucauacuuuuccccauucucaggacuuuucaccauccaucacccacuuaucccuucauuugacaccauucauuaagugccuucugugugucagucccuggccacucacugcaguucaaggcccccuuuccgcucugcuguacuccucgccuaccuacuccuugccuuuucugucgcacagccccuucuuuccaggcgagauuccucagcuucugaguaggaaacacuccgggcuccagguuucugguugggaagggaaggccaggccaaaagcuccaccggccguauagauaauguacucgcaguuuuguaucuuccauucauacuuuaaccuacaggucauuugagucuucacacaaauaauaaccuaucuggccaggagaauuaucucagaacagaagucaucagaucaucagagcccccagauggcuacagaccagagauuccacgcucucaggcugacuagaguccgcaucucaucuccaaacuacacuucccuggagaacaagugccacaaaaaugaaaacaggccacuucucaggaguugaauaaucaggggucaccggaccccuugguugaugcacugcagcaugguggcuuucugaguccuguuggccaccaagugucagccucagcacucccgggacuauugccaagaaggggcaagggaugagucaagaaggugagacccuucccggugggcacgugggccaggcugugugagauguuggauguuugguacuguccaugucugggugugugccuauuaccucagcauuucucacaaaguguaccauguagcauguuuuguguauauaaaagggaggguuuuuuuaaaaauauauucccagauuauccuuguaaugacacgaaucugcaauaaaagccaucagugcuauuuggauguaucuacacuc

SEQ ID NO: 13161 - RNA, 35478 nt, Homo sapiens
gaguguagauacauccaaauagcacugauggcuuuuauugcagauucgugucauuacaaggauaaucugggaauauauuuuuaaaaaaacccucccuuuuauauacacaaaacaugcuacaugguacacuuugugagaaaugcugagguaauaggcacacacccagacauggacaguaccaaacauccaacaucucacacagccuggcccacgugcccaccgggaagggucucaccuucuugacucaucccuugccccuucuuggcaauagucccgggagugcugaggcugacacuugguggccaacaggacucagaaagccaccaugcugcagugcaucaaccaagggguccggugaccccugauuauucaacuccugagaaguggccuguuuucauuuuuguggcacuuguucuccagggaaguguaguuuggagaugagaugcggacucuagucagccugagagcguggaaucucuggucuguagccaucugggggcucugaugaucugaugacuucuguucugagauaauucuccuggccagauagguuauuauuugugugaagacucaaaugaccuguagguuaaaguaugaauggaagauacaaaacugcgaguacauuaucuauacggccgguggagcuuuuggccuggccuucccuucccaaccagaaaccuggagcccggaguguuuccuacucagaagcugaggaaucucgccuggaaagaaggggcugugcgacagaaaaggcaaggaguagguaggcgaggaguacagcagagcggaaagggggccuugaacugcagugaguggccagggacugacacacagaaggcacuuaaugaauggugucaaaugaagggauaagugggugauggauggugaaaaguccugagaauggggaaaaguaugaaaauguggggggagggauuuugaaauuugauuaggugccaaaagggguucuuaagaagcugggaaccucuaugugagagauuagcauuguagacauucuggaagaauccaggcacacagaugccaagggugauccuuucaguugagaccacacagucugugaucuacccuuagacucaaguaauacaacacuaaugaaaugcuuuucuccuaagagcaaagcugcuggugacagcuucaacaucugagaacugaauauauguguauuuagguaucuaaggcaaaccuauauauggaucuagauauaucacaugugauguauaucuaaaugcauauauaugugguauacacauacgugcacaagggaggcucauacacauguauauuaugaagguacuuugcaguuguguuuuuauuguagagacuuaauuuauuuaaagaaagaguugucuguaguccuguccuguccuggagacaugaggggcugucuggugugaaggaaaguaggagggacagaaaacaccguaucgauucaguuccaucauccgcugcagugacuucggaaaacagaauccagcaucccgguccucccagccucaggaugaacuggugaggaguuguucuuugugcuguggccagcgugaccagggugggcuccuggcaauggccacgagaggucaggagggggagcuggcuuaguggaagguguugggguucggucggaucaucaucaccacuuucuugagugaguaagagccuccucggaacucagcccaguagacuccguccugguagcggcuccgguaauggcccccgcgguaccagaccccguugagguuggagugggcacaggcguuauaccaccagccucccuucugguagugggcacaguuuccugcaagagagaaggcagugagagggugucugggaggaggccauucuacuugcguccauagugcucagggcuuucggcaaagcccucucugggaggcaucuggagcaagaacgcuugaaagguggacccgucuccauggguggugagaggccaugcuucaggcccgccuuugaggcucagcuuuguaacuaacuagcugugugaucucagacaagugacuugaccucucccagccacuguauccucaucuguaaaaugagaauaaaaaugacgccugccgcacagggcggcucugaggauugaaugaggaugcguacuugacaccuagcccagggcugggugcaaaggaggccccaagggaacuccacaccuuguguucugauaggaaauggagauggccugaggugggcggggagggagaaaagcuuuuucuuaggaauuuuugaguugaaacuguuggaucaggagucuuuaaagaaugacaaagaaaguguuuaagaagaaaugcuccuccaguccuccccagcuuguauuccauccaaacaauuuuuuguauuacuucacaaaggaaagauauuuccauaaaacucuuggcauuaucacaucaugcugaauuuugcugccaaggacaagcaguucagaacaacaguaaaaacugugggaaggugugcgcgggcaugcaggggcagugcacucuguggcaggaggacagggggccacuaucugccagcauugcucuuagugaagggggguccccacuuuccugacugggccuggcaaggggaccccguacucaggggaggggcugcuccagucagaauuguggguuggagggcccaacagagcagguggccgaggccgugggaugaggugaggaggucgcacucagucugaggcagaaagcaagaggggagguggagccagguuuucccagaguuuuucugggggucccucugggccaugauuccaggccacagggaccaaguggcaguguuggacugguauagcagggagauccuugggcacgccauaaccagccuccucuuugccagcggaggucccacacaccuccagggacaaggaccuugccagcuacugauuuugcugcuggcuagaucugaguuuggaucauagaauacacuuuccgcucccuaaggagguggcccuccagaaaggcuguagcagccccugugucccagggucugaccagcucugaagguuauccuucugcccugcucuucuagaagccucggcagccccuacugcuucagaaugagggccuguuccucuuccagggccccuucgggccaggccaguucagugucagugggcggacagaggugucugugugauacagggaugggcaggucaugucccuccuguccccugauguugggagaauuacccuucagaauguggcugcuauggggaccuggcaugaggauccccuccaccuuaguauguagguuccagggccugccugaaguacaggccauuuguaggacagucuugagagcucgcuucucaagugggagggaguagccuucugaccaagaccacauaggaaauggaggcaggaggggacuggguuugcccuugagagcagacagccugagccuggaggcagcaucggccgucagguggugccagccucagggaggagcauggcagacugagaggccuucaucucaagaaacuggguguuggcccuggggaggcauuaacugugugggaggcugauaucuggacucagggccagaccauaucucuguuucuucugauuuucuguuuuuuucucuuguuuuuuguuuaauaaagacuucuuaguaaagaccuagauuugaagcaugugaucuuagacaaaucacuuucucucuccuaucugcuuuccucuuaauagcuuccucucagcacugcacuagcauuacaugcaguaacagugaccaugaagaaagccaguuuguauggagcccucgcuaugugccaaauccuagacaaagcacuuuagguacauucucucuacccuucucccuacucugcaauguaguucuuguccuuacuuccagaugcagaaacugagacccacggagauuuagcaguaugcccaaggacacauggcugguaggagguggggccagcacuggagcccagguguguggcccagagccuacgcaguugguuagcucuauaccaggugccugggacagaaguggugaggccacagcccaacacaugucuuucugcauuggccccagcuggcccugguacgugugauuuguauaccucuuuaugucucgccccaucccauuuuuuuuuucuuaauuuguaaaugccacugugacccagcuuugugaaggggaccugugggcaggagaagggacccucagggggugguaacagggucaggcagcuuggcccagcugcuucucacccugggaucuucccguuuccaagcccuggagucaggggcucuggcucugguugaccucuuuucccuacccugcaccuggguuugacuccacuuuuccuaccuguguagacaucaugaucucuguccaggguggugaacugcuugccguugugccauguaaaggagucacccgcauugccaugguagcgccccagccgcagcuuauaauacucgcucucagguuccaggcggaaacuggcguauucugcaaagacuuugcggccggaccaguccuccauggucaccaggaguuuguaguugccuugguucgucagccaguaaauguucuccaggcccagccaguauucgccgucaauguucccaaacccuugcuggggaaaacccaggagaguguuaauguggagccugcagcaccugcagccagcaggcuuggcugucagacacucagcccuggauagaggggccugggaaacaagcagagcaugaagcagaccugguucagaccccuacuccaccucuuaaucucuccaugacucacacauuauucaaaaauauguagagugccuacccugugccaggcaucaugugaaccccagauuccuuguucuuacaucagggaggcuauauuaccuuccccacaggcuugcugcaggaacacgugugcuguggcagguggagggccuggcacuaaguaggcacgcagcaggcauuccucagacaaaucucugaccuucacugagcuucaccuccuucucuggagaugagcugugugugagggucacguguaagcuguaacgcaccagacgggugugagcugugacgcaugugucccauccaccggcgcuccccucuaggucuaaaacccagugguuuugugguuauuguuuuuuuuugcaugugguuuuggggucagcagcugaguuacggccacuaaagucuugggaaucggugauucauuaauacaauaauuauuuaguauugagcgcuugugaugugcuggcacuguuuuaagaacuuuacauagguuguuuuacuaauccucaugucaacucgaagaacuaagugcuaucauuauccucccuaguauggaugaacugaggcccagagaggcucagggucucagaaugccugagggugaaccaggauuugaaccaagaacccagucuuaaucauugcacuguauugccucuaagaaaggaggagucucccgcuccuaauguagguggaagaggagaaaaaagcagagacacaggcuguucaggagguggggugggggacaaccaggacaggagacucaagaaggggcauggcagagccaugugugcaaggcaucauggcuucagguaguuugugagcuucagugucagaggccucagcugcagucacuacugggccaauuccuggcuuugcaacccugagcaaauuacuccacacuuucaucuguaagcuggguccauaacagaaccucccucaggagguugauacgagauuaaacaaaauaaugcacgaaagcccuuagcauggugcuggcacggguugggcacucagcaaacagagccacucuugccuuccuuaguacuaccucuguuuagagggggaagaacgauguaugacugaguccuggcaacuuucccugcuacacagaugagcauuucaacucccugggaaccagggagcccagaggaugagccuggaauuaggacuugagcauugccacaacucccuaccaggacuuuuugggggauucucccaggaacugggagccucuugggacuugcgccuucugggcuuugagagcgggucuuuccccauggaaaccccacuugggagugaaaugcuccucaccccugggcccccauaccagcguuucuaaacucucacccuguccuguggggcugugguggucuggucuacugacucuuguccugcagcaguuucuagcagcaggcagaggaggcgcugguccucacuaccccugguggguuugcaaaauggcccugucugcauccuucucgccucagguauauguguuguuggggccgcacaggccugggcuuggucagcauguaccucugagugggcucuucuauugguugcucaggccucucuuggggugggccagucaccuugugggcagcacagacauccccugccgagucucaccuuguacgucucccaguuccugaagaaguuaacagagccauccaggcgucucuggaugacgguccagcccccggggucgugucucuggucgcaccacaccugcaugaggcgguugguguucuccggcuucaccagguagauggagcuggugucguggccauccuccagggccugcaggcagucucuccaugggccuggggacacagacaugcauauacaucacagaccugccugucaccaggccgcacccccagcugcaccccaagcaggcacaaccucuguugaggcuccagcugggagccacaggcccacggucugagguaaccaauuuuuguuuugcgaguuuaauaaguaauuauaaagacaagagccucggaccaggggucaggaugcccauacuccaagcucacuuucuccucucacccgccucacaguuugacuuuuggcagacuucuucauucucccagcccccaguuucuucugauuguagaaggaagaucagauuucccucauauaguguugucaggauuacugagaucauuugggggaaguugcuggagugaucuuuuucguguucauuauauuaggaaaaagagauguggaccuacuaaacguggcaacaucagucagugccugcaggcucugauggcuuugcuucugcaaggaaacucaguuccacuggauuacuguuucugggggccaaguacaguuggcacccuucaauucugacuccacgucugcccuuccagugacagugcuucgugaugacugcugcagcuuuuacuaaaugaacuuccacagucacaggggccuaggccaugcccagaauuuggccauguagccagagacuuugggauauuucugcaauucauucacugcucuucaaguguguuuuuagggggccagguucccuuucagcugaaucuguguguuuuccaaaggaagcucagugagggccagaugcuuggcacucacgcauucugagguccuccuugcaggcucauaaacuuaaaggaugauguccaggauacagcccaauccauggcucucuucugaaacugagaccagaggguucugugauucuuugugacugcacugagcuugggcagcccagucagaaggaauggguguuauaccacuggucuuuuagcccuccccaccccugcccaucaacucugcccuccccaggcaguuucuuauguuccauuguuggucacaucagcaagaagguacaaacuugagucaccaagggucuggacaggcuggggccuuucucauugaucugaggaagcuuuagaaggucaaggccuagccauucagaugaaaauggcugaaagaaagaaaaucacauuuugcuucagucucuucaaaauauuccucauagggccgggcacgguggcucacgccuguaaucccagcacuuugggaggcugaggcaggcagaucacaaagucaggagaucgagaccauccuggcuaacauggugaaacccugucucuacuaaaaauacaaaaaauuagccgugugugguggcacgcaccugugaucccagcuacccgggagggugaggcaggagaaucccuugaauccaggagguggagguugcagugagcugagauggccccacugcacuccagccugaguggcagagcaagacaagacuccgucucaaaaaaauaaauaaauaaaaauccccacaaugagacugguuaaggacaaaagugcuaagaaaguaccauuguauguuuucuaucaauuuguauguuuauucaacaacuguguauugagucccagccucugcagaugcggugcugggcagcggaagcucagggcaggguggggccgcucugacgcccugcaagggaggagcugaccucacuaccuccuccccacuugaauuccuguagacuccuguccuuucucuuucugugugaguugaagggaggugcccaucagugacagguauacucagcuuuucugguacaggucacacuucucagauuccuuccuggcugguguuugggcucaacuaguucacacguaauaguuauaaaccagaaagauuuagguuucuggucucuguuagacaucucaggugggcuguuccugaggaagaagccuuguguuugagcauucauccaccuagaaccugacgggaaggcaggggcugucuugcucauuccuugcuucccacugcccaguauugccccgauaagaaagauugguuugggugcugacacuuaacucaggggcuucucccuucaucuucuggggaggaaggaucuucucacccauuuaccuuuuugccaggccucuucucuaagggauggggcaggacccaaugcuccccaccccaggguagcagauggggcacaagcagcugcuuccuuugccagugccacuuccugccuuucccccaccacucccucaguauccuucccagggaaggggaggcuagaccuccagaaagagcauuugugaaggagaaaaagguuuugguuguguuuagcugaagccccagggauggaggcagagaaugggagucuguccccaacagcuggagcagagcgccggugggcgugggaggccucccagcuccuuaccaagucagcagcacaggagaggccguucgaugugaaugcuggugacggaagauccggcagaagccugcaaaauaacgcccacugagagcgagcagcccagccucuuacugcacagcugccaggacugcugcagaauugucagagguaaaggcugccuuugaaggaggcgccacguagggagaggcuguggaggcugcugggagaguggcaguuggccucguggcuccagcuggggcugccuuugugggcgccaugaaugaucucaguuuuaccuuuggcauuuccaccaagggcucuuuuuaaaggcaaguguuuuuaaauguuuuggggcuacuagucccuuuaagaauuuggggaugguucuagauccuuuauucagaaaaaugcacagacucacacaauucuguauacaguuucagaagguaauggauucccaaagucccagguuauaaacuccuugcucuaagaguagugacugaaguaguaauaauaauagccaguguguacugagcauuuccuaugguccuagccacguauuuccacaggugacccuccugacacuccugugagguaggaaagcagacccuguggucauuagaggagccccucaagguuaccugguggguaaaggacacagcagguguaugcacccagggggugugcagagcucacacacuacuucuuuucccccaaccagaacgaacucaagaaugagggauccaugcugacuuagcucuguguccuuagaacuaauguuaaucuuugccagucagccagcgaaaaaaauaaaacauaaaaauuuacaguucuuugucgagguguaaaacuuuuaaaaaucuuuaaugauuuuuuucuuccguauuuaccuuuugguguucuuugcccauuuuucaacgauuguagugucuguuaugauguagaagaaguuuuucuuuuuuuaaaaaaggcaaacgggguaauucuuuuaaggcuuucuagaauaaucgaguagguaucaaauuguguagaaauguuuaguauuuucugcuguuacaaaaaaugugcauaugugucuguacacggaauuucacaugacaaucaggccccauuagcuuccaucaaaaacacaaauucaaacacaauuucccuuagaacccuuaguagaccucugugaaaucuccugcauucaaacacauuuccuuuucacacauuaaaggcaccaguggcaaaggucagaaacaucacugauggaugaaaauuagucagaaaaagaguuaacauugaaaaauugucagcaguaaaauuauguggcuccuuuaaaauagcagagacaaaacauccuacuuugaugagaaauccacaacuguaacauauaaauaauacugugaaaaaucuauagcuguuccauauaaauaaugcccucguagggggccaggcaagggucuggccucgauggaggaagaccuggcugaggaagcgagggcuggagggagacuccacacuuggagucaggagcccuuggcuccaaucucgauggccucaccuaugcacagugugacuuugggcaguguccucauugagccucaauuucuucuucugugaaaugggaagagaccauagcuauucugaggaugucaugaacccaagagcggccagcaugggagccagcuggggcaggugcucugugaagauuaucccuuucuguuuccuuugauagaugaaagcugacauuuuugaaguuguucacccccccaacuaauuccuccuccacacacguuacuauauuugcuuuucaauacaagacuaaauguaagauauuuaccaguagauguuuuccauguauuuuuaagucagaauuucaguggagaaggccacaaagauauauugacaugaagaauggaaaucuuuuuugucaaugaaacugaguuuucaacgugcagugggcaaagcgcucccuuuggaccagugcagaguaccuagcgguguuuaacuuggcgccccuucugagagggcagcucugcccagagcaucaggccaacacuaacucggcagcaccugggcucagaguggagcgagugcugcgaccucaucucuauaaagaccacauuuacauucuugggggagcuguggccaaauguuccacgugaagagaaaugcagccccguggcugagccgagucugugugguucccugaagaagcaacaaggauggguaggcacacagggucuggggucaggaggccuccagaggagggacaucagcaaguaggggaguaccaaguacacaggucucagcccggaccccacugccauacccugguaaguguuggaggugaucagcuuugggugcuuccuuccuccucucugggguucuugacagggauuaggcacacaaggaccauggccucccaggaaaccaggacccacuugauugauggcugauacagugcuugcuacucccaacacagggccuuucuggucaagcugaguuagaaccggcaccuaggccaggcaagcauaacuuccuauuuccaguucucucucugugggucuggggcagaccagcaucagccugauuuacccguccaggcccuaguggagaaaugggcucacaaacugcaucagcucucagugcagugccccucuuacuaggaaaacauggcuccgugaauaucugaccuugaggcugggagcuaagcagugaggccuccgugggcaagagggaugccucuucucucugacgugccugagguguggggggaggagcagaguccuuccugcccacagcgggacuggaccccauggcuggccagcagccugacaguccuuuuuauccccugaguccagccccaggugucagaauuugaccaccuuaggccacucagaggacccuguggccugugggaaauguucuggggggcucuugguucugggaaguugcuccugugaauauuuuaguccauacgcaggcacuagggagaggcuucugugauaucacuaagaugcagucugcuuuucaugagaacuguaugcuguuuucaguuacucucacugauggucugucuccaaaaagucuucuuaccacucccugaaacauuuuucuaacaggagaaaugacuaacuguugaaauuggaucugcaauuuccuacccaaauuaaugcaucugagugccacggcacguggccugcuuaggugagagucccacccaggccagcaucaggacucacugggcaccccaugagggcaggagaacagacacacagggucgggggauggggugugagggguggcuacagugagaagcaguuauugggggucuucgaaucucauuuauccagaggcuuggcaaaauaagauucugguuauggauguauauauauucuaugucaaucacugcuuuucagcgaaccagaguacaaaacaauaaccuaaacacaggaauagcuuguauggucccaaaggcauuucaguuccugcagaaccucagaguugauaucacacaugucauuucugaucauuccagggaaaagguccaaaugcuugugccugcuuucaggccgcuuuagcccucaaacgaugggcauggugccuggggccaaugaguguuucaggaguugaugaaaauguuugaggccuaaaaagacuuacuggcucuaaaauaugaaaagaaaacugcaaaaucaaaauuuauuguauguaauuaaauuacuacaaagugugacaucuugucaaguucauuaauuguuaaauuuugucuucaugaaaauguuacuacuuuugaaaacaacuuguagguuagauuuuuuucacuucccaagaauuccugaauaugcuugauguuuacugagaaaugagauccaaccauaaauuaauugaguuacucuuagccaaauaauuuuaaaagcaaaaguauuaaauccuuucaaaauuguuccaguaaaaauucuauuaaaugugugagguaggucauuucaaugcaugugauacagccugaggccucucaaguaagagcucuuagggcccagaaagggcuuauaaagguccuguuucugcucauuugaccucgggagaaacagacauugcagcacuacuuuccagaggccacuguccaaagcauugcgucgcucuuagguuuccaccagcgcuguugggcaggaggagaaacaggggcuuuaaagacauuuuaaaaaagaguuuagaaggggcuuuaguggucucacuguguacagaggugagcagcucaccuuggcucccugggggcaguggccaguuguacccaaggcuuccugggugagggaggucucugauguagaggugggcagugccccaggguuccacaggcacacuaaugagaguggccauggcucugucagagacuguggugcuguccugcaggcacaucauggaagaacuuaucagacccaugacuacaauccacagauauggacagguagcagucccauaguuggcgaguguauuaacccuuuccaaggaagggaucagcuucauugguuucuucuuuaagaaccuaugucggcuuucauuggugaccuuuuaaucuuccaaaugcucacgaacccuuuguguacucuuuucuauaauuuuacuggggcuucaccacaagccaguuguaugugauuucugguaugcauucuuuuucugaaagcaggacauuugucuggcaccaagacuugucuucaugauuucuugacuaucacugguggugguucugagagcaccacaaggcccuuaccuuccucaucaccuccuucaggaagcuuuccccaaccccaggaaagcuacuuuauccuuuucaguguucccaaaaugcuuuguauauuuaucucuacuggaauaagguaagaauggugaugaucauguaucuagagccuuucaccugccaugugcuuugcacaccguuucauuucauccucauaagccccugcaccugugagaaagccagggcucaagaggaucacaugacuggaaaguggaggaucugggauuagaacucagguccaccuucugugcugcaguuaucacaccacauuaggauuguuggggaucuguguccccauaagacugugggcuccuuucaggcaggaacccuugcaggcucacuccaugagucccucaaugcucugugugccucccuccauccuucaauccucuauccuugacccuccauccuucacccuccauccuucaccauccugagcugcauccccuuugcuaccuucauucugugcuuuccagcugagaaccaauaauaauaaauccaucuggaaagagagaccccacaacagaugauaauccacauccagaccaaacccuggcaaaggaaaccugcuuugugggaaagccuggacaguuuguaguggucucucugcacauuaugucugggauggugccagaugaguggauuuuuuguucauuuggacccuacucuagacauaccaucuaagauacuuaauuucaacauuuaggagcuguugcauuuauaacguaaacaaauugucuuagcaagauuuuucucuguguguauaguaguuuugacuuacuguauucaaaaauaucagggaaaaguaacuuauuuuuuuuuaaacaaaggaucacauaaauacuccaggcccuguaguuccacaggcucaucuugagauauaagaugaggaccaucaggcuuauuuucagcauaaucuuugaccagauucaugccagggagagccgaaguugaggcaguggugaugcggggauaguaggaaagaucaucuccaguguucccaucaagaggucucugcugccugcauccuucacugauguggguauaaaccacuggaaguauauacuucauuacuuuuacaagacugaacauaguccauuuucugcugcuauaacagaauagcauagacuggguaauuuauaaagaaaggaaguuuauuuggcucacaguuauggaggcugagaaguccaggagcauggugccagcauuuguaugaggcuaacuuaauacuacuuuauuuauuuuuuuuguggggguggggguggagggggacagcaucucaggauuaauacuauacaaguucaccacaacaauccauuuguaugaccaguuagcuggccacagaugccugaucucuaggguuuucuagauuucuuucaguuugccaaguaccaaucuugggauuuucaggcaucaagaucccagaucucaagauuuuuuuaacaguaacaaguugauaguuuaucuccuaugacuguaaauacccugagcauuuagccaagugucaucuuuggaaaacugccugaggaauggagggguagcuuuccaucacccucaaaaggcucuuugugaucaguuccccaagguaccagaagaggaggaagagaaagcaaagcaauaagggagcuggcccuccuggaaccaucauccaggugggccaucuuccuagaguagauuuuguuuaggaagaagcuagcaaagagugcucuuugagaaaucacuggauuauguaguuuguacugaauuugaaaucuuauuuuguuuaacaaaaccuuuuagaauaaaagaaaguauuguacaguggaaacagcacacgcucuggaggcaggagaccugugugggcuuuucccucagccucugugaccuugaaggcugacucaggaugggcagagucacccucacucgccaccaucaccacacacacccugugcuucuccaccucucugcagugcuugggccuggaugcccagccuacugaagcugacccagccacacauggguugacaccuuuucaccugguugcuugcuugaccuccagaaagaaugggagcuacaacaucauauauuucucuguuuuaaaacauaccauugugcuggggaaccacaaucguguacguauuuccuaccuuauaggguggaauaaaauacagguggaaaauccaucuaggaaaacacucuuguucaaguuguccaugccauccuggccauagcccaauagcccaucuguugugagaugggguggcuuccugcuagcacucuugucagugaagcaauguggggaccuccucauguggucccaagggaaggucaugucuacugacauuuauacagucagggcuaacauuuaaagaaaucagaacuucacacuuagcuauauguugaaagacuuagcuauacauugaaaugcugaguagaaggaaccccagaggauauguccagauuugauaaaaauuaaaaauuagacuucaguuggguccauuugcugggagucaggugcacguuguacuuucuacuggggagcuuggcugguuccugcuaggccuagggagggggagcaugauguugguggguugguagcgacaguguuuugugucauuggaaccauguucuaauaacaaaucuaccaccuuuguucccagagcucauuuuaaggaacuguuuggaacgugguaccaggaaguagagcuagaaggucaggaaguagagauagaaggucaggucccuguggcagcuggggccaaaucagacauucacggggugauuuuuacaccaguuccccuccagccuucccguggaagugugcaauauccagaguaguuaaaacauacuuugguuugagccuuggccaagccacuuacuagcuguguacccuuggcuaaguuacuugaccucuaugaaccucaauauccugcaagguacaagucccagggucgaucucugcucugccaccaacaggcucuguuacaggaaggccaugcuaggggaucugagaggccccuaauaguuccaguauuucaugguuuuauggccccuucuucuucacucauugagaaauaaagugaacugguuguauucucuuucucaggagagaaaacagcuaaaagugcucacuccuuuuggucuuuaaagauuaguuucugacaaagcccgucuguggcagcugcuguuggcgcuguccuuuccucccugaucagucucugggaugggcacugugcaggagggcuggcaaauguguggcucugccuuggguggccugagaaacaguaccaggccucccagaacccaggugccugcucuauccuuugccucuuagagaaugaccccuggagccuuccucuucuaauagcagcagcaggauagguggggcagaggaccacagauagggccauuuggcccaggccucaucacagaaucauccuaaucaaaaugccuuugggucuggccagaccugagagacacaggacaaagcccaggugaggagccagggaagccaggagcugccugugccuccucacucaggcucucaguaggccauccuggccugggaccacccuguuacugucucaguaaggcugggaacaggcuugugguacagcuucagauaagcagccauggcucccuuaguccccuggggaagggcaugcugugggcagacgaagaaaagagcacauggcucugaggcugcugagugaaagguuuggaagcugccaaggcucggaugcaaagguguuuaauugcaaagguauuucuggcuaagugaugucccuaagaacaaaggaucuguuggguaagagcacagaagaguguuuugucuuccaggauaagaaccugccccaagcucucugaacagaccugauaagaauguucucugcucauuggaugcccugacuguuccgugcagagagaccaucuguuuuuuccucccaguuuaguccucaacaccaggagagggcaggacccucccccagcugcucucuuccugggcucugucuacccauucaucuuccacagcuaggcacucaaucccagcuggcagcgccuugugugggagcucaguggugagaugggucacaagaaaucuacugguaaugagcaaguaccaacauuuggggauccuugcguaacaaagaaggauaaauucuaaugcauuccaguuaucucugugaugaaaucacugccauucccucccaugacggcgugcuuucuuaagugggagacaaaagacgggcgagugcaggacacuuggauacacacagcccacacuggguugugaacacaaagaagcaggagauugaaccauuugaggugccaggaauagaacugugccccugggcccuugcacagacucaucuccaucagggacccacuagucacuuggguucccaacucccaggucugccugguaaaaucuuacaaauccuucaagaugcaacaaagaagugccacgucuaucuaaucucucccuucccucuaggcagaauuagucaugccaccuuacugucccccagggcacuuagcacaccaggguaucaccacagugaucagacagcccaguuuucacugcauuccugauuuuagaaauuuuggccucgacggauacucccucccagagaaauccauugucagaucugaugugcugauguuagggacuagaaaucaugggcauuggacggaucccagaugcauucaugcaccugccgucuaccccagacugaguuucuggaggucagggaccacaauugucaccuacuuccccaagucuagugcugcgacuagcauguaguaggggcucagcaaauguuggcuuuacuacaugacauaauguuucaugcuugauuguauuguauccacagcauaacacugugagguuaugacccuuguccccauuuuacagaggagaaaauugaggcucagaagaguuaaauaacuaucucaugagcgaacagcuaaccaagggguagagcauggaugcaaacccaggucuuauuccuauacuauguaucugccagcuuaguucaagcccaggaauguccugaaauguuuugaguuagaaaccagagacacuuaggccagaggagaucuguugaguaaccauugaguccagccugucuccagucaggguuauaacaacauucaacugagccuuuguuuggugcccaagggcacguuuuacccucucgguauucuaucaagacaaauuaacacacccugcccucucuuucagagcuucugauuuaaagcagacacguguacagauggaacgccagagcuaaaaaagggacuguuuauuucagucuccuuguuuuaagaugaaaagaccuagaucaaaggaggcuuguaguuuaccguggacccagcauugugcuaaacauguuuuuugcaguauuucguuuccuaaagugacaggcacuauuuuaaucuauccucaauuaacagaugaggaaaccgagccucagggggacaaagugacuugccuaaugucccagagcuaaucagugguggaaaccggauuuaaauccaagccagccuacuccaaagcgccugcucucaauccugcacccaggccaggucuuuccuuugaggugcugcaguggaugcucacuuugcauuuagcucaccucacccaccccaucugaaaacaaugcugcccuuguccucugcacuggccacccuccugcacucagguucagccccucuuuggaauuagcaagaagcugcuauucccaguacuggugguuauuuuuaaaagugugaaauaaguguaaagcaggauauuuucaguaaaaaucucucccugccuauacaaugaaaugguaccgaaagcacugacuuggaguagauacaugguucauuuaugcagagaugaauauaguucucauauggcagcccacugggaaggcucagguguucuggaugaacaaggggcugagcuucaggggacuggaugugugcugacauucugacaggggagccucuggccugcuucuuccagaaaugaugauuccuagaguccuagagcauagagaagucagccagagauuuaaagugaaaagaccugaaugcaaaucuagccugaacauccuaagccuauuagcaaguuauucauccuguccgcaaggagcuccaggaguuaauuauguaacauacauggaaauguccggugccaguaucuugguuaagcuuuaaaaccugccagcaaucccauuccucccccauaacgguauucggagaauugcuguauuuuaagaugaaacguguauguaagagcauauggaagcaucauugaaaauucuagacagcagcagacucuaggaagugugugggcuuuaggaaggacuccuucccaugcccagccccuacaauguguuuaucauauucuuaacauggguaauacuuucuuuucuuuuggcccauuguuuauuuggugaacauuuacagaaggccaacccugugccaggcacagugcaugagcugcaggagagacauucucuucuaucugccaacacacgggaucucaugcagagccuagaaaacuacaggcucuggguucuuuccugucagaaaccagagaguguuugcccucuucugaaacuccauuuuuugguaauaucuuugaggauccaucuaaggaaugugguuccccugccacccgucacccugcuggcuccagcagcucagcccaagggauugcugggggauugugcaugucuuuggccuggcuucaacuggccauggcuuuuccccauuuguggacacagccaagggaagccuggugccuggcucugagacccacauguaacacgaucccagaagcacuuacccgacggcuugucgguggaagaugggaggcuggugagagugggcauagugggcagaggggguggcagcaccuucagguucuggucacucuggaucucguugguagagaucugguugaugaugcgguuguaggugggugguugguagacccggggcggggcagcgggggguggcugggggacgggccuggccgagggcacccucuggcagugcuccucaagcugcgcgaugaucucugauugguugugggccaguguggccaggugcugguacuugugcuccagguccuuguacuugcuggccagcugcagcaugucggcugucugguucaggauccuguucuccagcugggagagcuccaacgcguugucccgcuugcggaugaucucgugcaggagcugcauguagagcugcgugacccgcgaguucauguugcggcucuccuugcgcagcagcuucaccucgcucacaaugccgccguccaccuccaccagcugcugcagcgucucgaucugccgcuucugcuugagcagcucauuguugagcagcucuagcuccugcuuaugcacucgguucuccagaagcaccucaggcuccuuggaguugacgcagauggcacccgugacccgcugcuggggcacaaugaagguguaggugcacuuguccugggacucgcccgcccgcuuguaccuguuuagguaaaugaacucucuuggcgagcccuccucagugcccucaaaaccguccuccuggccugcaacagcucccauggcagccagcaguccgagccaccagcaugucacgcacaguggccucaugguccuugcaaaauggugguuauucuuugugaauagaaucuaugaaagccugaaaguaaacagaggggagaaucagugauggucccaccacugucagugcccugugccaucagugaucccagccuucucgccaggcaggcagagcuuuccaaaaacucugcuucaggaugcuggguuauauucucuuggagucagagaacaggcagccauucuggaagcaagaggagacaggcaagccccagcagagguagaagggaagagggagggucucagggcaucugaaggcaggaggccauggcccugcuacucccagagccagcuccaaugcccgcagcccccuugcugaacuccuggccuagagccugagaaucguauccaggcagcuucaggcuggggaggggaggcagagggaggguuuucuggucucucucuucugcuaccuuugguuccucagacuguugagucucccuauucuauacuuucacacccccugaacuuuccccuuguaauacccaucaccgcugugcugaauagcaguucuguuugaucuucucuguuggauucuaacuccaugagggcaugucgucugucugauucaacccuguauucccaggauauugcacuuugggcaaauauuugauaaacaaaugaaucguuagacauguuauggaauacauucaggguuuaguggacaauaucaguggaaggauguguccaguuacguggcucuggucacuguguuagcuaagcuacagagccaaaacaggaacaaacaacugagcucuucugaauccaaauauuugcaguagccagugacagcacaguccugaccacugcaacgugauuaaguuagaagggagcagaacacagaaugugucuccagauuugcuucacuucuauucuuggaccauucauccuuucaccagauguugauugaacaccugugauuugcuggacagcaugcuaguggcuagggauacagcuaccaacaggauggagccagucccugcccucauggggcuuucacaucauuaugccauucccaaaugccagaaagcacaacugucacaugcuguaaaggaguauuacagggaauugaccuagagggucaggaaugcuucccugagaaagugcccuuuacacugacccuugaggaaugaguaggaguuaaaugggccaagagggaggggaggacacgugcuagaucccuucucuugcccacucgagggccuugcuccagcaguccucaccgucuccccaacaucaggaugguuuuccuauaaucauacgguuuuuucucucaacuuaaaacccucucuugaccucacauccccucugcagcucuuguugcauuucucugcuccccuuuuuagcaaagccuccaaagagaugccugcacucaccauuuccagaaaguuccucucuuccuggucucucuugagcccacccucaucaggcuuugcccgcuccccuucauucuagguugcccuagacaggauccccugucuguuugccagauggaagggcugguucuugauccucauuaauauuuucccucucacacugugggauacaguugggcucccuucuugaccuuccuuuccagagcgccacccugccuccugucuugccggcuguuccuccucagagccugugcugguucauccucauauuccuguccuuucucuacuguugaggggacccaaaacucaguccucagaauuuucuuuaccuuagucaucucauccagaggucacguuggugaucacccucaaguacugauuacauccgcauuuauuucuggaacucuccccaggacucuagacucauacauacagcugcuuuuuugacauuuccacuugacuaucugcuagguaucucaacucauccagaaaugaacucguuuuuccccguaucuccaacccaaccuguucaucccaguuuuuccuguguucauaaauguccacucugguugcucaggccgaaagucuugaagucauccuagacgccuuucuuucuuucauaccccacaucuaauucaccgccaaauuacgaugccagaaauauucuuagaguccugugucuccccaccucccugccaccacccuguugcaacccaccugcaucauuuaccuggacuauuggaguaauuuccuaacuagccucccugccccagccuugcccauccuaccuucuguccucaacuucacagccagagugguccuuuuuaaaaagucaaacggggucacucuucuauucaaaaccccccaguggcucaccaucuuggaggaaaagcuagugggucuccaaggcacucuaugaucuggcccccacuuccucccuggucucaucucugaccccucuccccuacgaucaucuccuccaaccaccugguugaccuuuugguugucugucaaguguucuaagcacaguuaggacucagggccuuuauacuugcuggucccugcccccuucuucguuguuuguucccuuaccucuuucaaucuuugcugaaauaccaccuucucaguuagacccucccugcugauuuaagauugugaccucaccacauucccccuccaguguccuuaucaccauaagauacacgcugucuccuccccguucccuugaaugcaagcugcaugaugguagggagguguuuguguuggucacugcuccaugugcagugccuaccacguggccugaaauacauaggagcucaauaaauauuuguugauggaaugacaagacacaccugccaacagcugcugagcagcugggagugcuggaaagagggauagauuggggcagggaucccauggacaagugacugccugaggaggucagagcugcgcagaggagggccuauguguguauuuauuaauaacauccauugaccaagguccgcuauauaccugacccuggacuaaacauuuugcaaguguuuuccaguuucccguguucucauaaucuccuuuuaagguagauacuguugcuguuuacauuuuacaggugaggaaacugagacucagugaggcugagugacuugcccaaaaucagaaagcuagaagguggcagaaccagggcucaacccuggucugcuggauuggaaccugcuaacucuuaacgaugacacaggcauguauuuaaucugguuuuuacuaguaaaaggguauuagcaucacuacuuucugauuucacauuaaucugugcuaaaauaacaaguaugacacaggaccuaaagauuuuguccucccugaaccccuuugggggcuucuccagugaggacccugggucugggcuccaccuuggaccagccagugagcaguuacaaaagagacccugugcucccuggggccuugcugagcuguuuuccacuuaaaugacaaagcccaagcaugauuccuauggccugcucaggccucucugaggcuaggcagagaaaggugugugggagcuucugguuugggcucugcuaggagguggggcugcagugacgucaguggaaacccagcugaguuuggaaguguuugccucguuuccaacggugcuuuggcugccccugugcuaguggucacacccaccccagaacaauggggaggagccgcccccgacccugggcuagggcaggccugcugggccaacgccuucuucaggcugcucaccugaggcagugggugacagacaccucucugugcccaugugggcgcagggcuccacuguggccaagaaacugccagaggcccaggaggcaaccuggcugcaagacaagguugguuuccaagccuuccuggaccuccagauuugauuugcacuauuuaugguugaguucuauccucucccaaacaugggcucucacagcuccccgacagaguucuugccauugcacuugagaccucaaaggcugagucuuuucugugaaaugggaugauccaacccaccuugcacacuaggugagcagcauggaagugcaucagaagcgggagauuggaauaauguguuagcaauacgauagcaagaacaacaaagcugaaacaaaaccaacaacagugaggaugcugggugugggccaggcagugugccaagcacucacaccaucuccuugacuaaugcuugcacagggcuuuagggcuuccagacccuucacaucaacauucucucaucuaaucauuccaacacucagagugacuuacuaguguuaugcccauuucuaggcugaggaaacugaagcucaaaaagguguagggguagcugacuuugaggucauguugcgagcagugggaccucuuguaacuacauugauucugaguccuacuguuacaccucuguggggccuaggcuuagugggggugacucagaacugauuggguuacaggaaggaagggaaggaacagggcacugugcugggcgccugacauacauugucccagguaauccgguggguuguuauucaccccuguuuuaucaacggagacauugcaacccaaacaggcucagugauuugcccaggaacacacggcagauaacagccaaaggugacugagccuaggacuugggucaaccugauaccaagggccaugcuccuugggcuucucuuugagccucagagucauuuauuuuccuuggaguccaagacuccaaccccaauuccuccccuccccccagcaguuuuuugccaguuuggcggcucuuaaugggcaguaauaaguuuguuuacuuuugcucucuugauauuuauucaacucauuguaucucaagagaaguaacaccccccacccccaccccggcauuccagccaucuuaggacugaagaagaacucaacuccaaucaaagugaugcuccucacuuuuuuccuguguccaacaaagaaaagcaaauccaacuguuuuccuuggcuucagaauuaaaauaaaaacgauucuuaaaauugcuuuuccacauuguauugugaggaguuuccaucacgcauggguuuucccuccccacaagugaggcuggugugacugugccacgugacagccuuuguacacugggaggcagccucuccagggcuugggucccacccagucuccggugggcugccucugaauguccccgcuuggccugaugugguggggccacacaucauguguccgcaucccucucaccacuguggugccacagcccaagcaaggggccacuuugugggaagagcugucauuuucaucagauggagcuguguguucugcccugcagcagaagcugccggccugggauccucuuuugaguucaccccaaagguuagaaaugagaaaaguuccagcaauuaaaagaauaacaacaauaaauugucacuauggcucaagcacuuuauauacauuaucucacuuaaucuucccaacagcccucggaaggcggccuguuauuugagggccgccaugcaugguggccccacuugagcacugugcuacucuaggggacacaacucacauucauagucuuuauguuuuuuauauuuauauuguagcaauuuucugaugcccacaaagauacuuuuaaggcuaacagcaaagcugacauuuaucccuauuugcaguugaggaaacuauugagauuugaggaucgugagucauuugcccaaaucacaaauuaauaaguaguagagccacuaacagaucccaaaauaacccccaaagauaccauacugugaauaaagagaaaccaaagugccaaagugacuggaaacccaaaagagguuguucucugacccucuaggcaggacgacgacaggagugcucuugccgucauuaggccugcagaucccagggaagccuccaaauuaaauccggaucucaggaguugauucaucaucaguccagguuguaguccugccuggaggacuuacagaaccacccccucaccacccguccucuggucagcacugcccauuggucugugaucacagaugaaggccaauaauggguccacgccauaagaggcaucccagcacugcaggaggccugagaagcgggccucugccaaggcagucagggaaucuggaacugccagcuggccccugacgucgggguucugggaagcuagaagccugagcugugcuugagugagucugguggaccugagcaugaaucaaguuugugaaacuaucaucaggacagaagacagaugaaaacaucaacauuagcuagcagguguuccuacuaagcuguugaaauguauggugugcugguagggaaguauccaaaccaguugguaauccaagaugugggagggauccagaugaaggaaaaggcccagcugaucaggugaccaguaguauugcuaauaauggcugucguuuguugugaauuugggugcccagcuguacucuaucucauuggcucuuaauagcucuaugaguaggggaccauacauccugguuggccccaguugaggucuguugucuuacguaauuauuauuauuauuauuauuauuuugagauggaguuucgcucuugucacccaggcuggagugcaauggcaccaucucagcucacugcaaccucugccucccgcuuucaagcaguucuccugccucaaccuccugagcagcuaggauuacaggugccugucaccacaccuggcuaauuuuuguauuuuuaguagagacaggguuucgccaugcugguugcggucuuauguaguuauuaauagcacccccuuuucacucucaauauuguccugacugagcaacaaacuauaugaucccauuaccuaagagaaagguauuauaucugcauuuggcaguagaggaaacccaagucuagaaagguuaggucgcuuguucaagaucacuuggaaguaaauaucacaacugggauuuagcugucaacugcuagguccaaacccugccuugcaucaagauugucucuucaaccaguaugaauaaaaggugcuuguuuguuuaauggcugagaugcagcuugcauguuacucacuguugacugaauaaguagaaauagcuuucaggucagcacaaggguguguuuuguuggauguuggaaagagcugcuugaucacgcaagugguaagaccccaaaaugggcaucugggaugagcagugacacccucaccuuggagaaccuggugaaaggacugugcauuguuuguccuggaugauucaccaucagcccggaggccagggagggcauauccagaucuccagcugcccuccccuccuggcugaggaugcuaugaaugauuccccaccagaaggcaccuggggagucuggagucaauucccaaacccuucuaguucagcucucauaagaccauugaaugaaccauuuauccauccauccagcccuccaucacccacccauuuagccuucccaugcagcuagccauugugcauugcuacuaccugucaugggugaugggagccaugagucagagaagcaggguaagacagauuugccuggaggaguagcacuggggguucgaaucugccugaugcuuugggcucuugugcuccugccauuggugaauugcuggcuccaggaagaguucauggaggaggcggguuguggucacaccaugagaucauaggguagagggggaugugguuagggagugggggagcugguugccuuuuccgggggacaaggacacugcuguuacuuuuucacagugcguuauuugggaaccauuuugagauucccccaaagucugugcacugaggccucugugccaggagccuuggccaacagagcagaggcggggaagagucugcagaagccauuucagaguccagcuucugaguuggcugcugcauuuccggcagugccuagugugcucuggagcccuacaacugggaaagcccuagacaagagggagaagucaagggcuggguggacagcacugccccagggugacuuucuugggaaguccaggccuugccuggggcugcuuuucuggaccaggcugagaaguuggcaccagggccaccuuggcuguuuggauggacuuguuccucaaacacugggacaaccaauguuugugucugccucacugaucccgguagcucuuugaggcaggggcuaugacuauccucauuucacagaugagcaaacaaagguaagggaugaagccacuuguccaggggcacagugcuaccaagugguggagcugggcccaguaacagauuugucuaacccagggccagguuucuuacccacacaauccuaauuggccucccugccuuugggugcucucuccccugcagucuacacugcaugcagcuccagggcugucugucugacacccacaucugaucaugucagcguccugcuuaaaaacagaccuuguguugucaugccucccugccuuugcaugugcugugcuuccugccucgaguaccuucccccacuguccuggcugaugccugccugucuuccuaaguugaccucaccaugaagccauccauucagugaggucuucccucccuccuucagcucacaagugcagcuguggcugcuuccaacucaacacccaagacucagauugcagucaucugguuaucucccuccugacuacagcuucuuuaaaaagcagggccagggcagauuccuccucugacuacugaguauccaggauggcaccuagguuacuaaauaggaauucaagaacuucauuuguauaauguauuucccaauaaguucuccucuuccagccacugugccagcggcuggagguagaacaggaacaaggugggugagguccuuacccucaagggguccacgguaguaggugagacagagacuaggcauuuguaaugcaaagagauccaugcccagauagggaaacuuggggggcuguggggcaccugaccuagccucagaaaagcccuuggcuggacaacagagagaggaaugguguggcacccugggguagagaagcuuguuugcuugagagccugggccugaggcuugcuucauugauucauucauuccacagauaucuuuucuaccuggcccugaguggguauuagagauucggcaguaacugagacagacacagccuuucccucauggagguuggagugggaccaccucaggcaggacuuuaaggauucuuggagcugggcagguccucaggcaucucuugaagauaagaacagaguccauucugggcuuuuccuugguggucuugguacugccugucuggacaacuaggcagcaggggguugcugaggcucuggggcugcuggccccagacaggcugauuucagcagagaauggacugacacaauaguucaguugugagaggccuggcuccccacacccaacauuuuauuuuuuauuuuugagauggagucuugcucuaucaccagacuggagugcaguggcgcgaucucagcucacugcaaccuccgccucccggguucaagggauucuccugccacacccaacauuuuaacauuccugggaccaaaauguggcuugugauugauguguacaugugacaggccaucguaacguuguaacccccaacacuguuaugaacucagucauauggcucacaguccaugugaaagaacacaguuuugucauagaaacuacccccagaaugaggcuucugacgugaccaguguaucaccacaaacuccaagcugccuguggcugaauaacucuucuauuugggguguuuuauauaaauucacaaaaaagaaaugcuauucaaugaauugauucuuucuugagauuuccacagugugguuguccaggauggcagcaggcugggguggaaccagcacaggucuggguuucaaucuuugcuuuuuggcccaugcauggagagaccgugggagaggugcugcacccugacccccaguuuccacuucuguaagacggggacagcaccacccaccuugaggacccucuuagcuccuugugccaccucuuuacagcuuucacacaguuguguguuugugugauuauuuacugucugcccaguccugcugggcugugggcucuaugaagcagagccccucccccaucugccugcugucaguugagaccauuccagauuaaaugggcugugauucagagaggccaguugcugaauguaccugcuuuggcagggcugcugucuguuauguuuguucuauuguagcuacccauugccaucucccugauguuuucucagaaauugcucguguguggcccagugugggugaugaggaccugagcucugauucuucaguccuaaaggagccuccaaguacggauguagaaagcgcaucaauaguaucuuagucacauggaccaguguuucccugaggcucugcccccacugagcuggggacagaguuuccuggugcugauguggugagacaguaucgcagagcacccaggcacguggaacaagucagccaaccugguuucgaagcucaguuccucuugucacugaccauauuaccacauaacagguacccucauaacugugcugaggcucaucucuaagaguaacagucaugccuauuuugccucagaaguaggcuuccaugaagagcaagggaugcgcuaaaguugaguaaguccaugguuuucagagggguuggugcagcauucgauaggacagcaaccaaagcagauguggcuacugacgacacugggcagggacccagugacagucaggauaagagaaguugaggugucuaaacaaggcacugaagugagaggaagucaggggcuuuggagccagacagagcuggguuccagucccacauaaucacauaacugugugacuuugggcaaguuaaccucucgagacuuaguuuucccaucuguaaaaugggaugcuaaaacuagaaccuaccuucuaggguuguggugaggaugaaaugacauaauguauaugccuuauuuagcccaguggguacuuccuaaaucacugggggauggagggccagauggaggaacagcuuauuugcucugcccgugagcuucagcaauaacauguaguccccugcuggaccaugugcguuacacauuuuugucuguuccacccagacugccucauuaguaguaaguagucccauuuuuuuugccaagcucaugaagucagucagagccucugcucauccuaagcugcccagagaagacagugagccaccaugguuccaggcuggagcagggaaaccuguggcuucaguagccccagaggccuugugcuagagaagcaaauacuugaugucaccuuuucaaaaugcuuccaagcgugcagggagcccacuggaaccucagggggccacagcacagaagcuccucuccugggcuaagauguaucaguguugucugguguaagauccaccagacauggccaccauagugccagacuuggugauggccauuccuugccucuuccucugcaacuccggggcaaaccugacuauggauccuccugauuuugugagcuucccacagcacuaagguagcugcauuuucuuauccacuaugguucugcuggggagaucaauaggcagacaggcagugcccaugugggaagcaggaugcccuuccuccuguaagguugguauuagauccuuuuguuaauaugucugcacuuuuucuuaguauggacuucuaggaugcaggcaugcugcagguggccccaaacccaaaccccagacauaaagccccccucuccucaggcuccuggaaagcccuccagugugggcagugauaguagccacaguauuaucucugucucgugggauuuucugaaaacccuagcaggauauguccagaacagggaaagaauuugggucucuggccgggugcaguggcucacgccugcaaucccagcacuucgggaggccgaggugggcggaucacgaggucaggagaucgagaccauccuggcuaacguggugaaacccgucucuacugaaaauacacacacacaaaauuagcugggcgugguggugggcaccuguagccccagcuacucgggaggcugaggcaggagaauggcgugaacccagcaggcggaguuugcagugagccgagaucaugccacugcacuccagccugggugacagagcgagacuccaucucaaaaaaaaaaaaaaagaauucgugucucugcucuucccuucccucugugccaguccugauuguugugguuuguaaucaucagugaccaagguuugcucaggguuugcugugcaccaggcacuaagccaaggccuuccuaggcaugggcgccuagcuuucuccuagaaagcaguagggugugguugaguggcuccggagccacaccacuggguucaaguccugguccuggcacuuacuagccauguagccaugggcacauuacuuuaccucaguuuccucaccuauaaaacagggaugaauaauaaugccugugcuauaggguggucaugaggauucuacaaguugagucuggcauagaguaagugcaauauaaguguuagcuguuacucucuggccauuguuaccaccugggcaguauuaucccauuucacagauaagaaaacugagguuuagaaaggcuaaguguucugccagagccauuggcuaguagguagaagagcugggauuugaagccagcucaugaggacugcccuacucugccuccauuuggaaaaauacauguggggagcauuuggccggcuuuggaaguggcauucucaauuuuccccagagaguggggugaaaggagaugcuuuuccaaguaacugaacuggccucugggagcucucauaauccuacagcagaggcaagagcugacccaugacacacauaucauagaaggagaagggaaggaucagugaagaauuuguuuggaaauguuaucuaauacugagugcuuucaggcgacuugguauguggagccccugcuguccccuugcggggguaccagggaagccgcauccucccuguaucuuggccacauccacucaguuggagacccgggguaccauccagugcagcagccccugggugaugcguccguucccgugcugggugccucugcucuccucgccagcuggagggugugagcagaggcagcccagcuccuguaacucuccgagcaggggcucccagcgccucagcacagcgcuugccuuugccucacauugucccggccugggggcauaggaauccaaagcuucaaagugacuacccaaguccuugggccaccccugccuucugcagcucuucaguacgcugcccucuaagcacacaccuacacacacgcacacucccagcugcucugccgugccgggagcugccggccggcaccccaaaggcucuuuguccaaaagaggagagugaggcuuacucaugaaguccucgagaugccagcccaugaucaugugcccccaaacaccaccaaauguccacagguucugccccggacaugccucguuuggcuccaagcgauagcagggagugacccucugagauccagcagcacacacccccagcuggagggucaggguucuggaagcccuagccacggggccagcggcugccucucgccccugccucucauggccgcagagcuggccccuuaccucuucccuccugcuuggcuccggggcggcuccucacaugcuucacccuggccgucagcggggcagccuguccauggccucuggagggguuccugaguugcaggccgguggcugccaagcagcccugccucacugggcuccacuggcucugccuccacagagggcuccggcagaggcuggggccagggcuggccagggguccugcggggcugcucacaaccuucuuucccucacaguagcgucagccgcugccucagugccacgcucggcagguccagggcuugggguccauccucaggccguccgcagcagccucauuugaacucccaacuccuuuguggagccuuuacaugccgccagaggaaacugugagcacagccugacccugguuggcugcaggcgcuucucuccacccaccagugcaagaggaucccccaggccccagaaaggcuccgggccuccccucagccccagacagaggcgggccgcccg

SEQ ID NO: 13162 - RNA, 5768 nt, Homo sapiens
gcacaucaaaugcauguauuugcacaaacacucauaaaaacuuuaccagacaccaaauaauuacaggaaggggcgaaccuucaauccaccaagccacagcauuuugaaguggauuuaagauaaagaucaaauaggaugggcacuggccccagccucacaucgggcccccuuccccagacacgggcccaugagauagagaccagggaacuuucuggguuuugggacucuguguucaauucauagaaaaugucuuucugcaaguuauucuuagugucuucauguggcuuuuaugguuucaaauacgauccugggucuucucugcucucacugugguccucagcuggggaagcucccgguuccagacaggcugcagaaauaauccagcccauccauuuggcaagaaagccaaagauucuugaagaaaauaaauuuuaaaauaugugacaucuugagaaucccacgugguugcuuuugauguaaugggcuaacgccccuaauucuguguccccgccaggguccagcucugagcagcuacuugcaggcccaggcucuagagcagggccaguggcaaaggcugugccgggccucuaggcacugccuggaggucuccugcgcccagcucacaccuuccuggagcuaagcuucgccugcccuggaggaagguacgcaggugagcccagggggucuguuugcccucaagcccugguugaaggagaagcagggagcuguguucuccccaagucuugguagcauggccccucuuccauccaauuauuaugacuacuugagauggagucuugcucugucacccaggcuggagugcaguggugcaauuucgguucacugcaaccuccaccucccggauucaagugguucuccugccucagcuucccaaauagcuaggauuacagacacgugccaccaugcccagcuaauuuuuguauuuuuaguaaagaugggguuucaccauguuggccagguuggucuugaacuccugaccucgugauccaccagccucacccucccaaaguguccauccaauuauuuaccaaauauguauagaggccugguaggugcuggguguuguggugagcacuuauguuucagccucucgacaacccugugggacaaaugaggaagcugaggugcagagaguagggcaggaccuuccugaggucccauggccagauccugaaccagaucuggguggcuccccaagaucugcucuugaccacuccuagccacugcgagaccucagcacugggccaccccgccagggcaccgucucccucagagcuccagucccgagagcugacagcagccugggcucuaagggagcaccgucuccugacccaauguggaggaaucccaugacuaaagacccagaccuugugcuggaaagucaugggucuguggccagagccccuacccacugaaggggaagcuacaggaaggacuuaggggcuuugcuggggcuggcugucuccccacugcacacagacacacacacuugcaugcagccucagagccccagcucugccucaccagcaaauucugccacaaauccugucucccugcagccccucucccaucaggcuggaaaaccccaaugggagagagaaccaguucccagcccugauucaaaggaccccagcugggcgccaucacuuuacuccugugugugggccuccaccuggguucaaggucgcugugaggucucccaccggcacagcaagaccacagacauuugcaccgcucugcggcaagguggcuguguuacucugugacgaucacacacggccaucucuagcugagaagggccugacccuuuggcccaugugcccugggguccagccccgcugggguccaaaaagcauaacauggucacugcuggcuggaaaguuuccagcacucagucucuggguguucccgcuccacuuccggagucagugugguucucccaggacccuagacccggggccaccucccaggaauaucagcccccaaccuggcccacugcuugggcggcucugguccccccaaucuggccgccugucaaggaucugaggcuuggcagggcugauggcgccgggacagcgugggacggcccaggcucucugcagcccugguucuccgggcagaguggaauagagacacucgcagcuccugguccuugccuucccacuccuccgaacccggccaggacugcacccugcgcugccccagauccgugccuccagcuggaaugguaaacugggagggggcaguguggcucuggcucuggucagaagcacaaaacaauccagacagcccggagcgggauggacagggcuggguggggugggggagggcagcucauagagccgugcucgagggaggcggguagcgcagaggagagggugcaaggcccuaagaagaggagcggggggacuagggcggggcucaauggagcuggggcguccgcagacuggaaggagccgggacccccgcuccagagccucccuuuccauucucgcuucuuccagugauuccgagcccccgacucagucuuucccccagguagagagaauccgaggcuguuucugccgcugaaaucugagcgggagagcaucccgaagccgccugcguggagcgagcagcccccgcgucaugggccagaggcgcccgggagaaucugcgggucacggaucacacccgcaggggccuggcggagcaaggugccguucgccgccugcgggcaggagccggcucugggccucggccccugcugugccguccagucggccgcuucuucgcuucuucggcaagggaagcgguggagaggcgcgggagccccgauugugcuggagagaucugggaccccugcgcgucugcgugcgaaggacccgagaccggccaacucagcugggagcacgggacacgaggagugaggacaaagggcaaggaacggggccuauagggaggguguguguguguguguguguguguguguguguguguguguguguguguguguguguguguguagggggaaugaauggacagcggggaaggcaugcagaggggcccaagggguguggacucagcagccccaccccagaccagagaaggcagccaggcucuggcguccaccgagccagcgccccuaucugggcgcgggccgcauggcggcagaccacccuauauccgccuugguggcgugggauaugacuggcaggagcgcggaagaggcgcugagaaugcaugcgcacccggacagaccagacgcggcacggaggggguacuucccacaaguccuccugccuugagaccaggccuucgagugguccggggaaugcgccucugggcacagccagcggccccagaucggcacuggacgccaacccgaguuagagaagccugggagacuggaucgcaggggcccucauucagccaaggagggggaaaggagagcuguaggguaggagaggccaggcacagggaagguggggaggggauggagccuugcgccaggaguugggggugcagggccugugacgagagaguauuaccaugugcacccugaaggagagggagagggucugggccuggaacgaggacucucgccugcaggcagucgcccagccccgguugcagggauggaccgcgaccagcagagggcagaaagugccugguccgcccgccggccccgagccgcgcuccgcgccucgggacucuggcucugugcgccgaagccuugcccgcccggcuucucccugcagcagccgcgcccccgccccagaugcccggagaaggcggcucaggcccagcccaacuucgcggguccaggccugggguuuccaggucaagcaaagaggggaccgagaugugggagagaaacuccacauugacuguccacucuccccgaccuagccacacaaaggcgccuagaaauacacgaaggcacaaagccccccaccacacacaaacacacacacacacacacacgcuaggagacacgcgagcacacagaagcauucagaaccccggagauaagcacagauacgcaaagcugacagagacacccauacagaaaaggaucgcagacacaacacagaggcugagacacgcacaaagacuuaggcccccgcaugaaaugaugcggacacacaccccagacacaggcacgaaggacccacacauucacauacacacgggugcaggggacucagacacagauccacagauucaccccugggagucuggaagguugcagggacacacauaccgugugugcagagccaaggagcacacggaggcaagagccgcagaggcgggggcccgacacgcacagacacacacagauacccaccgacacacacgcagguaggguagggcgggagccucuaauccuccacaaagccgggccccuccgcggggccccgcggcgcagggggccacuucugaccaagccucccgcagguuccaaauccgauccgcccuuucgccuccagcgaggucaggggacccgccccccaugcccuccgcccccgcccggcuccgcgccgcugccucgcuccgggaggggccggggccgccccgcagcggaucgcggggggucagcccgccgcuaccccgggccgcaaccgccccccugcuccccggugagccgcgcgucgguggggaccacgggccgcagacagccgguccgacgcuguggccucucgcaccggacgcgggugccaggcccggcuggcgcggaagucggcagcuccaucucgccagcuuucgcgucccguugccgagguccacuuugcccaggcuggcuagagcacuguccuugauccgcgcgucccagcgaccccuggccgggcacccgacccgccaaaggaccccgaucuuggcagccaaccuaauuucuucagagccgcuacccuggggccaccacucccuccuagcgccccucacugcaaacccuaggaggcccgggucuugcccacugcuccugccccugcccggggaccccuuuuccagccuuaguuguccucuaaacucucggucgccugaacccaggccugaccuuccuugucgucccagugucccccauucucgaucccggggccccaaccucccaucggcucagucccccgcccaaucucugccaggcccggagcuuucccagaccccucacccacacuccaggcucacuccccguuccugggccugggccccccuugcacgaguccagggccagccguccucgccuucugcccgcccccguccuucguuccugggagccggcccucuccgcggaccaagcggccccgagcaggcgccgccgcccgggggacuccgacucagcccccgcgaccuaccucggccgacagucggggguucccaagcggccacucccggccggcgccguccccuggcggagccgccgcgcucccugccguccgcgcagucuggccucgcucggggccacuccucguagcgcuggagcuuuacaaaauauuaauaauaaagaaggcagaggagaaaaaagaaagccuucgcuccccaacucccaaaucaauuuuucaaggggguggagcagagggauuuguuucgaagacgaucaaaacuucugcgaggggcccgcggggcggccgggccggggagccggggccugagcucggggccaggcgcggcgcggggcgcgggccaggggcgcggagccccggggcgcgcgggggggcgggacggcacuauuugacguggagccggcggcgcaucccggcgcagggaua

SEQ ID NO: 13163 - RNA, 2357 nt, Homo sapiens
uauauacccucccccagccccgucguggaggccgccgauuggugaaggcccugcucguuggaggccguucauuggcccaggccaccaagcuggccgccgccgauucgaagcggcccccuccgcaauaaacgucacugcuccgccccccccagcugauucauuggcugcuauucguuucuaacguucaccaaugguagauaacauccgccccauccgcuggucccauugguucagcagcugucuaucucuccugcgacuucugaccccgaggcauuuccgcugguaaccgcacaagucccgccuucacucccggcccuagggggucggaguagguccagcaggagugaccccccggggcugugggaucugaaacuuuuucuucucuacugcuuguucucccuuccuccaucccucaccccgaagcgggaagcagcuuucucuucccagcuuccauccagucucugaguagaccagucgcagcuuagaugcugggaucgccucagaacacauuucuuugcccuucacggccacuaccgguauugggguaugcgagucucagggccguucguugcucacaggucgagcuggucuggacucuguucgaccacgaaucaugacuccuuccugccaguuauguccccuccgcacccuugcccagccauuuuaccaggccucuccacauugcgcugccccacgguaagucgcaggacaagcccggccaaaggaauugccuccagcucugaguccccucccuacuguggcaacccacuccagugccagcccucccacacuggaugucuaauuuuucuagcuugccacccuuuacuuuccccuccgcugcccauccuuucccucuggggcaaagguuaucauuuacggggcuuucuccauccuuuauuguugauacuuuucuaccuucauuccaggaaaaggucugauguacacgcagacaacacauuugauaggcgaaaaucgucuugauaaugccuuauucuuauauaacauccuguugcaaaaaauaauagagaccacuauuugcugaaagccuaccguggauuaagcauuguucagugugcuuuucaugugucauuuagucuugacaguucaauacucgguaggcauuucccguuuuccagaugaggacauugaaacugaaaaagauuaaauaacuaaacaagucacagagcuggugagugauggaguuaggauugauaaccagguggaguucacucuauugccaauacuuuuuuuuuuuucaagacggaguaucacucugucacgcccaggcuggaguucaguagugcaaucucagcucacugcaaccuccgcuuccgggguucaagcgauucuccugccucagccuccugaguagcugggauuacaggcacgcaccaccaugccuggcuaauuuuuuuuuuuuuuuuuuuguggagaugagguuucaccauuuuagccaggcugguuucgaacucccaaccucaagcgaucugcccaccucggccucccaaagugcugggauuacaggugugagacacugugccugaucucuuaacuuuaaaacaaaaaauucaucuguggccgggcgugguggcucacgccuguaaucccaacacuuugggaggccgaggugggcggaucacggggucaggagaucaagaccauccgggguaacacgaugaaaccccaucucuauaaaaauccaaaaauuagcugggcgugguggugcaugccuguagucccagcuacucgggaggcugaggcaggagaaucgcuugaacccgggagguggagguugcagugagccgagaucacgucacuacacuccagccugggcagcagagcuagacuccaucucaaaaaaaaaaaaaaaauucauuuguuugaggaauguuuuuggaggaccuacuauggaaagggcaaagcucugauaugaaauauuugagauucauggguauacuguguccagauaccacuaaaacauccuaaacacacuuuauuaagauguugagccugugacucaguacucaagaauuuucuuuuuccuuagugcuucucaaagguuagacuggugacucaagaguugacucuguucacuacagagguugcaucaugcaucucuuucagcagggcuuguaauccugcggcaacauugacccuucuuuggcuugcaucaguccagcauuaagauagaaaucaucauuugaccacauuacagcuucuuucauuucaaucaaauguuuuuauagugcaguccauuuccauuaaaaaaaaaaacucuccauuucagccuuauccuugauuaacagaguaacguuuuguaacucuccuuuuuguaaaauuuagaaaagcgauacaug

SEQ ID NO: 13164 - RNA, 1108 nt, Homo sapiens
uaggugacuuucugcagacuucggacucaccagugguguuucauucuauuuaaugucauccuauuucaugccuugcuuuuugggacugacuuuguggaggaauacuuucugcauucuuugccuuauauagaugugaaaguucuugaaauuaagaauaaggcaagaaaauugaacaucgaaccccuaagaaguaaucucuccaaauauuauguccugagccagucagaaauauguaaagggaagaacauuuuuuugcugucucuuaucuucaguagcccaggaaauggaacaagacgggaccucauuaggaaaacuuggggcaaugugaccaguguccaagggcaucccauucucacacuguuugcucugggaaugccuguuucgguaacuacccagaaagagaucaacaaagaauccuguaagaauaaugauauaauugaaggaaucuucuuggacaguucugagaaccaaacccugaagaucauugcaaugauacagugggcuguggcuuucugcccuaaugcccuguucauucucaagguggaugaagagacguuugucaaucuaccaagcuugguagacuaucuucucaaucugaaagaacaccuagaagauaucuauguaggaagaguucuucaucagguuacacccaauagagauccucagaacagagacuuugucccucuuagugaguacccagaaaaauacuacccagauuacugcaguggugaggccuuuauaaugucccaagauguggcucgaaugauguaugugguuuucaaagaaguacccaugauggugccagcugauguguuuguaggaauuugugcuaaguucauuggccuuauacccauccacagcucaagguuuucugggaaaaggcacauuagauacaacagauguugcuauaaguucauuuuuacauccucagaaauugcagauccugaaaugccccuagcauggaaggaaauuaaugauggaaaagaauguacacuguuugagacauccuaugagcucauuuccugcaaacuucugacguaccuugacagcuuuaaacguuuucacauggggaccauaaaaaacaaucucauguauuuugcugauuagg

SEQ ID NO: 13165 - RNA, 28858 nt, Homo sapiens
ucacuuucccuaauaucaauaaaucuuaaacccaccuguuuugcagacacuaagauuuuuuuuaacuucuucauuagcucuagggaaauaugcaucauucacacauccucccacaguuuccagcaagcuuaagaguggcugauuuuauaucacccaucaccucuuuuaucacuaccaaagcaucggcaauauuguacuguugccaugcuucuuucagaguaaggugaggguuuuuucaauacagucagcaaaguggucaaacauaugcuugauuauguucaaaugcuucaguuauacccugacccaagggcugaagaaagcuagggccuuccugagggagaaacacaguaucaacauuagaaugaacaaagaauaaugaaucugggugauugggaccucuguccacaguuagcaacauucugauuuccagauuuuuuuuguuaaaugacuucggauuugauggauaaaaaaauuguaaaacuaauccaaaaaguggcaguggugauucugggugugauuacaagaaaacaggaaggcguuuaucucuaaaagacaagugggguguuagagucuuuguaaagcagcagugguuuuaucauuuugucaccugaggcacugccacaaaaaaaugagggaaauccuguccuuagcuuccucuaagcuuuccagauuuuugucuuuugccccaaaaguaggaaggcaugcacugcaaaagaugggucaucuccuuggcguugaagaccuguugaggcacaaagccucucuccaguugcuuggaauacucgauacccacucaggauuuaaggguccuuccuccccaucaacuucguauguugcaaaacagcagcgauuuuuaaaguucucaaaccaucccuugcucgcaugauacuuauuuggguuguccuccccagauguuucccauugguucccuguagauguauuuggccugguugcagagggccuuccgggucagaugccgcccucugucaucuggccuuccaccuaaaagguuaacugggucuccaccuucacgauguuuacauuacaggggaauacacagcagcuuagagcagaugggcgaccaacucuccacgcuggucuuucuugguuuccugaggguaguggaggacaagaggggaaagcagggucuugcucugucgcccaggcuggagugcaguggcacaaucaccgcucacugaagccucgaccuccuagacuuaggggacccucccgcuucagccucccgaguagcugggacuacaggugcgugccaccacaccgcacuaauuuuuuuccuuuuuuuuuuuuuuucuuuuugguagagacggguuucucacuauguugcccaggcuggucucgaacucccgggcucaagcgauccucccgccgcggccucccaaagcgcugggauuacagguacggccacugcgaccagcugcuucuccuugguggacugaucaacaccaacaaggcggcgcacgucccuauuacucacgccuucgucaggcuccuggagaauauucauccagucuuccagaggcaugacgcuccgccuccucuugacagguggcuggcccaggaucaagauuccccuccaggccaccgcuccaccuggggaggccucagccgcggccguagccgcgguggccuccauaacggcugcagucguccccgccuagagccugguuuuggagccucgaggacgccgacgaggcuguuuaacuucccgugaguccccacccucgccgcuccgcuggccgggaauuuggcaaggcuuugcccuacgcgguaaacacguaagccuacuggccuccgcauuucccugagcagcgaccuagaugacgccagacugagggagccgcaaccacuggcuacaguugacacggcccuaacggaggcuucucgcgaggcuuggcagccccauagccaucucagggacaaggaggcugugaucagaucucgcgagguucaggaaagcgccccgggaacugggccgcugggccagccccugcgucggggggcaagauggcagcccaggcuuuggcgcugcugagagagguagcgaggcuggaagcgccgcuggaggagcuacgcgcgcuucacuccgugcugcaggcagugccgcucaacgagcuucgccagcaagcggcggagcugcgccucggcccgcucuucucccugcuuaacgagaaccauaggugagaggaccccgggggcuugagccgaggagaggggcaccccuaaauauggacaugagagugguugagggcaagaacagcgcuuuucccagucacaggggagguggaaaguagccgaaauuugcagagaaggaaggauccuggguucagaggcaggagaugggguucagguucagccucugagagugccccaggguguuuucucccgucgccuggccucgcugccucugagcagugaggcacugccuucuucaucaaauagaaauuaaaggaggaaagcaaagcuguccacuuacaaggagcauuccacaucucuuuguacagguucuugauuuguuuccccuucuaaaaggauccuauccuggcaauguggcaagaaccaucagcauuuuaaauucacaugcuuuuucauccagucauucuuguuaaaaaaauuuaaugcaaguauacgcgcacaaaaugugcaguuacuuuguucuuucgaacccgaggcuggaaucgccccaaaagcagcggcaagagaguucccacgagggagugcuucaaaccuucccgagauguggcugguugggaugacagaaaaagaagcacugaaugccaaggcgaucaguccaaaagcguuuagggggaaaccugcagagggcugcagaaauugucaagacggacaccgggagaaagguguuccuggguauguccgcagugagggggucaggguauggaguucagaugagaguuuaaaggaauuuggcucaggguugaggccaguuucuuccaguguuuugggcaacaaccuagguaccuuuaucaggccugugaauguucaaggccccugguuuauggucaagccugcuagggaaaccugccgcuggcuaggucagagagcaaucaaggcacucugauuuuccaucaggacagagaaagaaagggggcgacuggaggacccuacaacauuauaugcaagaauauaacauaucguguguggcaccagaacacuagaaacaaucuaaauauccguuaacagaggauuccaaauuaugcgcuauuacucuguaacacugugcaguuauuuaaguuauugagguagauguauauauauguauguggacauggaaagaucucuguguuuuguuuuguuuuguuuuguuuguuuguuuguuuucagacgagucucgcucugucucccagguuggagugcaguggcgcgaucucggcucacugcaaccuccgccucccugauucacgccauucuccugccucagccugccgaguaccugggacuacaggcgcccgccaccacgcccggcuaauuuuuuguauuuuuaguagagacgggguuucaccauguuagccaggauggucucgaucuacggaccucgugauccgcccgccucggccucccaaagugcugggauuacaggcgugagccacugcgcccggccaaucucuguguuguugaaugaaaaagaaaaucgcaggguauaucaaucuauaauuuuaaccuguaauuuuuaaaaaggauuacaaucuucccaacccccacaggcauguaaaacuuguauaacauugcaaauaucugcaaagguacaccagaaacuauuaauagggaagugggucugaaaauaguaggacaacuuuuauuuuugauuuuuuacacauccguaguguuugauuaaaaacacuuuguaggcccggugcaguggcucacgccuguauucccaacacuuugggaggcugaggcgggcagaucaccaggucaagagaucgagaccauccuggccaacauggugaaacuccgucucuacuaaaaauacaaaaguuaggccaggcacgguggcucacgccuguaaucccagcacuuugggaggccgaggcggguggaucacaaggucaagaguucgagaccaacccggccaacauagugaaacccugucucuacuaaaaauacaaaaauuagccgggcaugguggcacgugccuguagucccagcuacucuggaggcugaggcaggagaaucucuugaaccugggaggcagagguugcggugagacgagaucgcuccacugcacuucagccugggcaacagagugagauuccgucucaaaaaaaaaaaaaaaaaagcaaaaauuagcugggcuugguagcgcacaccuguagucccagcuaguugggaggcugaggcaggacaaucacuugaaccugagagguggagguugcagugagccaagauugcaccacugcacuccagccuggcaacacagugagacuccaucucaagauaauaauaauaauauaauaauaauaauaaaaacacuuuguagaccgggagcaguggcucacacguguaauccuaacacuuugggaggcugaggcggguggaucgcuugagcuuuggaguuugagaccagccugagcaacauggugaaacccugucucuacaaaacaaaacaaaaaauuaacugggcgugcgugccuauagucccagcuacuuagagggcugagggggaggaucccuugagcccaggaggcagagguugcagugagccaagauugcaccacugcacuccagccugggugacagagugaggcccuuuuuuuuuuuuuuuuuuuuuugagacggguucucguucuguugcccaggcuggagugcaguggcaggauguaagcucacuguaaccucgccucccagguugaagcaauucuccugccucagccuccugaguagcugggacuauaggcacgugccaccaccacaacgcccagcuaauuuuuuguguuuuuaauagagaugcaguuucaccauguuggccaggcuggugucgaacuccugaccucaagugaucugccuugccugccucggccucccaaagugcugggauuacaggcaugagccacugcgcccagccaagacucugucuaaaaaaaaaaaaaaaaaaaaaaagauuaaaaaaacauuuuauaauucuuaccuggauucuggggaaaaaaaggaaaaaaaaaccacuuuguauuugauaauuugaucauuuaaaagaguuuugaaauguuugugaucaaagacuuucaagugaccuuacuacuugaaaagauuaugaaccacugaaucaacaguggaugauuucagagcgcuuucuuggcucugaccuucuaagauuccuuccuuuucuguaaguguucuccauucaugaugucuaucaguuaacauuauuugggucugccuaugaaaugucucuuauuugucuccucuuuaauucaagcccucauuuuuucccuauugcuaggucuguaguguuagucugacuucuccuuaccucugaaauuccuuuucuagcaaauuccuuuucuagcaaauuccuucccaccuuguaaccccagugagcauacaucucgagucagcuggugcuaaucuuuuccgugguuucccauugccuguagugaguuuuuagaaugccauuugggcccuuuacaguauauuuccauccuacuuuuccaaccucacuuuuuuccuccacuccacuucuuuucaucugcuccagcuaccauguggcacccuuauuuuuccuuaagccugacuugcacuuuccuaacuuuacucauaccagccuuucuaacugaaauacuuugcugucuguccauauucuguccauccuuuuaggcccacuaaagagccaucuccuccaaaauauuuuucucaauuauuccaguugcaaaugacugcuccuuagaucugcuaaaggacauuauuguuauuucuguuaaugauaauugacacuauuaccuauguuauaguucucugugugucuauuuccaguuuguaaauucuuugaaggcagugaccgcauuuuguucaugucugcaucccucuuagggcccagcacauaaugcaguauacgcccaauuaaauuugagacucacagaguuuagaguggccaccuuguccaaccucuccuauuagagaugaagagacuuccagaggucauaccgcaaguugacagcagagaugcaguaggaacugaagugaggcagaauuugaggauucagguccauggggaagauaguuugcugaaugaaggagcagugcuuuagggaacaauuuuaauggaauuuaaagacagaauaauucagaacuggauacauaguagauaccaacugcaccuugugggaauaauucucuggauaguaucuggcagucuucagauacuuugcuguuauccuggcuaaaccacauaaguuguuguguguugguucacaaucugaucuugcagauguaaguuagaaucuugacaguuuuuuuugagagaguuuaaguccuaagauuacugcuuuagaacaugaaaaucaaacaagacuaauuuuaagcauuaacucuuuggcucguuggcaaagaagggucacauaggaucugaaauuugugcacugugcaguuuaacguaccacuacuuuuuuuuaaacagcuuucaaagguauaauuuauauacaaugaacugcacuuaauaaaacguacaaguuggcaaguuuugacauauguauauacccaugaaaccaucgccacaauuaagauagugaauguaucuuucacucccagaggcucccucauaccccuugcuaaucucucccuguuucaaccagucaaccacugaucugcuuucucucacuguagaugaacuugcccuuuauuuuggccagacauggggggaagggaucauacaaauggagucauacauuauguauucuuuuguuugguuuccuucacauagcauaguuauuuugagauuuaucuauguggcaugaauaaauaguucauuccuuuuuauuguugaguguaaguccauuguaugaauguacuacaguuuuuuauccauuccccuguuggugaacauuugagauuugaauuguuuucuguuuggagauauuacaaaugacagugccgugagcauucauguacaagucuuuacauaaaaauauucuuucuuuucucuuugaguaaauagcuaggaaugaaauggcuagaugguaugguagguguauauuuaacuuuuuaagcaacuggcaaacuguuuuccaaagugguuauaguauuuuacauuucuaccagcaguguaugagaguagaucauagaccuaaauauaaaaccuaaaacuacaaaacuucuagaagaaaacaggaaaaaaaaauguaugacuuugaguuaaacagacuucuuuaauaugacaccaaaagcaugaucuauacaagaauaaauugagcugggugugguggcucaugccuguggucccagcuauucaggaggcugagguggaggcuacagugaccugugauugcuccacuacaccagccugggugacagagagagcuugucuaaaaaaaagaacaaagugauacaaaguagaauuaaucaaaauuaaacauucgguucuucaggcuaggugguggcuaacgccuguaaucccagcacuuuggaaggcugaggugggcggaucaugaggucaggaguuucagaccagccugaccaacauggugaaacccugucucuacuaaaaauacaaaaauuggcugggcgcgguggcuaacgccuguaaucccagcauuuugggaggccaaggugggcagaucacgaggucaggagauagagaccauccuggcuaacacagugaaaccccaucucuacuaaaaauaccaaaaauuagccaggcauaguggcaggcaccuguagucccagcuacucgggaggcugaggcaggagaaucgcuugaaccugggaggcagagguugcagugagccaagaucgcaccacugcacucuagccugggcaacagagugagacucagucucaaaaaaaaaaaaaaaaaucgguucuucgaagguuacauacaguuaagagaaugaaaagaaaagucacaaauggagaaaaaucuuugugaagaauauaucugauaaaagacuucuuuucagaauauguaaggagcuuucaaaacuaaauagcaagaaaauaaauaacccaauuaaaacaugggccaaagauuugaacaagaaguacagauggggccaggcaugguggcucacaccuguaaucccagcacuuugggaggccaaggcagguggaucaccugaggucaggaauucgaggccagccuggccaaccuggugaaaccccaucucuacuaaaaauacaaaaauuagcugggcuugguggcagacaccugugaucccagcuacucgggaggcugaggcaggagaaucacuugaacccaggagguggagguugcagugagccaagaucacgccaucgcacuccagccugggcaacagagcgagacuccaucucaaaaaaaaaaaaaaaaaguacagaugauaaauaugcacguagaaagauauucaacauuaaauagggaaauacaaauuaaaauuacagugagauucuacugcacacuauuagauuggcuaaaauuuuaaaaggcacagaagcaaugcaacccacaugugcaaccaaagugucuaugaagggaugaauggauaaacaaaaugggguauauacauaugaugggauauuguacaucuugccucaaaaagaaaggaaauucugacagaugaacuuugaagacguugugcuaaaugaaauaaaccagacacaaaaggauaaauguuguaugcuuuuacuuacauaccuagaguagucaaaucuagagagacagaaaguggaauggugguugccaggugcuuggggaggggagaauagggaguguucaauggaugcagaguuucugguugggaagaggaaaauguucuggagauggacgauggugauggcuggacaacaaagugaauguacuuauucccacagaacugugcguuuaagagugguuaaaaugguaaauuuuaccuguaaucacauuuuuuuuuuaaaaggaaaagaaaaccauacuuguaaguauccucauuccuccucuuccccguuccuccagccucuggcaaccaggaaucuacuuuauuuuauuuuauuuuuuuuuuuugagacagaguuucguucuugucgccuaggcuggagugcgauggcgcuaucucgacucacugcaacugccgccuccuggguucaagcgauucuccugccucagccuccugaaguaggugggauuacaggcgcccacuaccacacccagcuaauuuuuuuuguauuuuuaguugagaugggguuucaccauguuggccagucuggucuugaacuccugaccucaggugacccaccugcuauggccucccaaagugcugggauuacaggcgugagucaccgagccuagcggaaucuacuuucuauauggauucgucuauucuggacauuucauauaaacagaaucauucucaaaaggaagccuuuugugucuggcuuauuucacuuagcauaauauuuuaaagguuuauucauauugugauauguaucauuacuucauugcuuuuuauggcugaauaauauucauuauaugcacauaacacauguuuauccuuucaucacuugguggacauuuggauuguuuccacugcugugaacauuuguguacaaguuuugugaaaauagcauguuuucaauuaucuuugguauaaaaacauucuuaauacuaccuuagguucaauuaugcaaagugaaauuccugaauuaaaagaguauguucauuuuuaaggcuuuucauuuguaucauguaguuaccuacccaaaagguuguaucaguugaauuguguacuacuacuaacaauauauuagcccauuuauuuguagugucuauuaagagacaagaaaauuguucugaaaacaucuucuguaucuaccacugguagucaucaguuucucuuacauaguucuucccucuucucucuauccucacugcugcuccccugguuuacuccuucaucaccucucaccauuuacugccuuguaauugaaaauucuuccccuaacacuggugcagagugaauucuauaagucagaucucgucauuuuacuucuuuaagaccacuuauggccugccauugauuuucuggaagaagucuaaauuccaagcaugacauaaaauaccuguuagaaucuggcuucugugcaucuuuucaguuucaguucuuguccuucaccucacccuuuuaccuucucaccaccucucucccauucugaccccaaucauaccaaacuacuuguuccuugaaaguauaauacuaugucuuauuccucucugccuuuucaugugcugcuacucccucuaccuagaacacuuuucuucuggauaacuccuacuuuuucuuaaaauuuaguuuagauguuacccuucugggaagccuucccuguacccucuguucuuuuuuaagcuccuauaguuucuagucuuagcccauagcguuuauuuaucuggauuacaguugccuuuuuuuucuguaucuuucauuguauugagcuccuuaagacuagagaauauaucgggccaggcacggugucucacaccuguaaucccagcacuuugggaggcugaggugggagaaucacaaggucaggagaucgagaucaucauggcuaacacagugaaacccccgucucugcuaaaaauacaaaaaguuagccgggugugguggcaugcaccuguagucccagcuacucgggaggcugaggcaggggaauuguuugaacccaggaggcggagguugcagugagcagagaucgugccacuguacuccagccugggcaacagagcgagacucugucucaaaaaaaaaaaaaaaaaaaaaaggccaggugcgguggcccaagccuguaaucccagcauuuugggaggccgaggcagguggaucaccugaggucaggaguucgagaccagccuggccaacauggugaaaccucgucucuaaaaauacaaaaauuaucccagcaugguggcaggccccuguaaucccagcuacucgggaggcugaggcaggagaauugcuugaaccugggagguggagguugcagugagccaagaucaggccauugcacuccagccugggcgacagagcaaaacuccaccucaaaaaaaaaaaaaaaaaaaaaaaagaagacuagagugcauaucuuauucuucucuguugccccagcacaggcaaugcgcauaauagguacuuagcaaauguuuaguaggugagugaaagcugcuguuucaaaaagaagucuguguggaggagacgcugacgcaagcuucagcuauuauuagguuguuacuuccuaccugggcaggauaugaacuaauaagauuuaugaugucuccuucagggaaaagacuacuuuguguguauccauucuggagagauugcuccaagcuauggaaccgguucacguggcccggaaccucaggguugaccugcagaggggacuaauucacccugaugauucuguaaaaauccucacucuuucccagguaugaaauucuacuaggaaccgacauugaccaccugcucugggccagguucugcacugggacagaaagaugaagaaagcacaguauuucucucucuccuucccucuuccuucucccccucuccucugcucccucuuucccccuaggaaauguguggucuauuccaaugugcauagcuaacuauaaccugggagauacaagcuaaagaaagaaguuccauuaaguaccaucuaaaucauucauuaaucagauacugacugaguuccuuuuacaugccaggcauggugccauaugcuguuagaguuaccaagauaaacaaaacugauuacuuuccuucaaggagcuccuaguguaaagaaaaagauuccuauguguucaaauagcucucugccauuuuagauucuuuacacuggaugaaccaaaugcuauuguaaaggucacuaaaccaacaauuaagacaguaacucuuaucauccugguaaccaaagcauccuugcuauuugagugaagagcugcugcuaaggauuaucuuguugaaauguuaggagcuaaacaguuacucaguagauacugaacuacuguuuuuccuuuucuguguuuauucagcaaaaaagggcgcugggcacaguggcucacgccuguaaucccagcacuuugggaagccaaggcaggcggaucaccugaggucaggaguucaagaccagccuggccaacauggugaaacccugucucuacacaaauacagaaauuagcugggcaugauggcaggugccuguaaucccagcuacucaggagccugaggugggagaaucguuugaacccaggaggcagagguuguagugagcugagaucgcgccacugcacuccagccugggcgaaagagugagacuccaucucaaaaaaaaaaaaaaaaaaaaagguugggggaaagggggaagauaucaguuuauucacuggccauuuauaugccagacacuguagcaggugcuuugccuguucggucucauuuaaucuucguaacuauccuggaauuaaauauuguguucccauuuuacggauaagaaauggggcuaaaauuugugcaaggucaguguagcuaaacauagagcuggguuuguauuguuuucacucacugaacuaucuuaccucuuuacccacuuucuuuuuucuuuccuuucaaagaugugacuauaccauauguguguuugacugaaugaauuuaggucauuuugauuuuuuaaugaauugauauauagcugugaucacuaacuccuaaaauaacugugcacuaaggaaauuggaccaucguguguuuaccguauguugcccuacuuuagaagaguguuucugauuguuuuucuuucagauuggaagaauuguugaaaauucugaugcuguuacugagauucuaaauaaugcugaauuacuaaaacaaauuguuuauugcauugguggagagaaucuaucuguagcaaaagcggugagucuacuagaaucauugacuuaaaugugcagagacaucggugucccaaaagauaaagaaaggccuucugaauugagaggugaagguuuagaauggaugauuugcguaauggaauuuacaacuucauauggauuguguaaaauaaaugguugucaaguaaauacuaguaaaccccuuucauuuucuaggauauacauaucuacaguauccaucauaauucuaugggggauaccuugcgucuuuuccaauuauaaauaauagcuaaaacaugggcaaggugcauuccaugcacuauuuuuacaucacucuuaugaaguagauaauaaccugcauuuugggaauguaagagauauuuucuuucguuauaaggcuaucaaaucccugucaagaauaucacuaacccaagcuggacuggaggcuuuauuugaaagcaaucugcuggaugauuugaaaaguguaaugaaaacaaaugacauuguucgauacaggguguaugagguaagauaaaaagcacacuuucucaugcuuacaaagcagaaugcaguuuggcuuaugcugaaaagcaagauggcucauuaaguauauaaucuguguuuggcccuacaguaggugcugggaauauaaggaugcauucccagccuaguaugugagacagucauaaaaaauacuuacagcccagcucuaugggaggcaagggcaggaggaccccuugaggccaggaguuucagaccagccugggcaacauagugagaccccaucucuacaacgauuuuaaaaauuagcugugcauggugguaugugcaugucgucccagcuacucaggagguugaagugggaggaucaacugagcccagaaaguugaagcagcagugagccgugguugcacuacugcacuccagccuggccaacagagcaagacccuuuuuauauauauauauauauuuacagugcaauauaauuacuaugauagagaagauauugaaaccagacuugaaaaaauuuguaguaguaauaagaaauggcccuuauuuguaccagcuuuguacuaagcacuaugcuaaaauacucacauauauuaucuuuaauucuuacaguaaacuuuguauguuguuaucauuaaccucauauugauggagcaauugauccaagaccacacaguuaauagggugcauguuugaaauagaauccucuauagucuaauuccaucuucagaacacuuucuuacuuugcaugucaugauaccauacuaugcugcuuuuccuucuaccucucaguuucuucucagccuccuggcucauuauccuccguugaaucuuuaauuguuggaguugaugaaaacagaguuccaagcccugcuuucacgguacucuacucauuccuaggcaguuuuacucacuuaugauuucacuucccaucagugaugaugccucucagauguaaacuuccaacugagaccuuucuucugagcucgaaccuucaugcucaacugcuuacucacucuuggccccuuggguauauucuaggccacucaaacucaugcugaaaucaaauuccugaucuuccuuauccacccuaucccccuaauaaaaaauaagacaacaaacuggcugugucucacagucugcuuaguuggguauuagaccuuggcucauucugaggccuguuuuccuugccacauauccauucggucaucauauuuuguugauuuuauuuaaaccccugcauuucucuucauuaguacagcuucuaccacccuagacuaacuuacuggugucacucaccugggcuacuauauuugcauccaaacuggucuccacucauccauuuuuaucaucccuagucuaucuucucaugcagucagaauggucuuuuaaaaguccaaaucugauugugucauuucucugcuuaaaacccuucagugucuuccuauaucucucaguaagaccucagaacauacuugcugaaugagugagugaaugacugacugacugacugacaggaugccugaaugagugaaugguuuuauaaucuguuuguuguggcugauucaggcuuuuguacccugauugaugauugcuugggcgggaaagugcugauacaccuagauauaauggaacauuucugugccaagguggcagggcaugguggcucaugccuguaaucucaacacuucaggaggccagggcgggcagaucacuugagggcaggaguucaagacaagccuggccaacauagcaaaaccccaucgcuacuaaaaauacaaaacaauuagccaggugugguggugcaugccuguaaucccagcuacuggggaggcugaggcacgagaaucgcuugaacucaagaggcagagguugcagugagcugagaucacgccacugcacuccagccuaggugacagagugagacucugucucaaaaauaauaauaauaauaaucugugccaaaguaauuucuuaugcguucacugaaguuuuucuacuuaaagagacaaauaauggauuuuuuaaaacucauuuauaaaaaguaccuaguccuacauuuaacuuaaaaugagaucuaucaggcguagggcugauuugaccuuuuucuuuuuucuguguuuuuuuuuuuauuucagcuaauuauagagauuucuuccgugucaccagaaucuuuaaacuacuguaccacaaguggauugguaacccagcuccugagagagcugacuggugaggauguguuggucagguguguugacugaguucuuaaagugaaauauccucuuuugaagggcugggaaacaaccuugggacaucugugauuuucucuauuagagacuuugcccagguugcaaucucaugacugauguguguccugaaggagggaucuuuagaaaauuguucaaguuacaucgugacaacauacuggaacuugggaaagccccacaugacaauucagcuacuuucaagugacucuguuccaugucccuaggccugugugcucuuaaaaaguugcaaucaugugguaacugccauuuugaauuacuaauauuuuaucauauucauuuauuuuggcauuguuaaauagcaacacuauggcaugauagaaaaaacaugggcuaggccgggugcgguggcucacgccuguaaucccagcacuuugggaggcugaggugggcgauucaugaggucaggaguucaagaccagccuggccaacauagugaaacccugucccuacuaaaaauacaaaaauuagcuggguaugguggcaugugccuauauucccagcuacucaggaggcugaggaaggagaauugcuugaaccugggagguggagguugcaccacuguacuccagccugggcaacagaguaagacucugucucaaaaaaaaaaaaaaaaaagaauaugagcuuuucaaaaugaggaagacuuggcuugcaugccucucuacuauuuauuagcuguuuggccuuggacagauaauuauaagcuuucuacaucucaguuuccucaucucucagaacaguaacuaaaaaagauauugugccaggugcaguggcucacagccuguaaucccagcacuuugggaggcugaggcggauggauuaccugaggucaggaauucaggaccagccuggccaauacggugaaacccugucucuacuaaaaaaauacaaaaaauuagcugggcgugguggugggugccuguaauccuagcuacugggaaggcugagacaagagaauugcuuaaacccgggaggugaagauugcagggagccaagaucgugccauugcacuccagccugggcaacaagagcaaaacuccgucucaaaaaaaauaaaaagauauuguaagaauuaagcuaauugaccauagaaagcaguacaauggcugacauagguucucaaagaaauguuaauuccagucucuuccacccgcuauucccuaaauccccuuuaauaucugccaaauguucuuuuguugauauuccacaguuuacuaauaccuccucacuguugaacaguugauuugcuucaaguauuuugcuguuaugauagcauuauaguuaucuuuguguauauagguuuugauuuuucuuaucuuaaaugauuuucugauuguccuguguucuuuaaacauggcugaauuuauuaaacccauaugaguaaaucagucacuaguuacauugcuucagugcauuugagugucucaaccuaaugagacaauuaauuuuguuaauuauuuuuuagcauuguaucaaauuuugugacauagaaaaaaaccuguaaauggucagucaaaacaguuuaggaucaaccaccaacuaaauaaauuuuuuaguuauuuucuuugaucaugguuggauaugagaugauaccaaagaauuauuguuaauuucuuaauauguggcaguggcauuauaauuguguaaggaaacauauguguuuuguagagaugcauacuaaaguaugcagggguaaauggcagggugacuaggauuugcuuuaaaauaguucagcaaaaaguagggaaaagagaugaaauaaguaaagcaaaaucuucauaaccauaaaaucagguuauguguauaugggggcuuauuguauucucauuacuuuuguguaugauauuucaaaauaaaacacaaauuuagaaaauauuuuaggaagcagcuagguuauaguggaaacaauaguggacuucaaaucagaaggucaagauuuaaaucuaaacucugccuauaauaacaauaugauuacagagaagucacugcaaauuucuaggccuuagggcuucaugugaaaagaggagccaagauuauugaccuuucgaaugugauaagaagaauuaaauaagauaaccuguaugagagcaauuuauaaacuaugcaaauccugugcaaaaucuccuuguuuuuguccuucugacauuuuagagccaccuguauagaaauggugacaucacuggcauauacucaucaugggcgacaauaucuugcucaagaaggaguaauugaccaaauuucuaauauaauuguuggggcagauucagacccuuucucuagcuucuaucugccagguaaggaacacugaugccuauggaaaugauggugcguguuuuauuucugaguuaucucugacaucaggggguugggguagggaguggacagggauuguuuuccuuuagagcugauuuccuuaaugagcugauuucguuuagaagauaucuagagcaaccaaguucaaauucaacagcacauuaaaagggucauccacccugaugaagugggauuuauccuauggaugcagggaggguucagcauauacaaaucaauaaauaagauauacuauguuaacagaauaaagacagcaaccaaguaaugcgggaaaagcauuucacaaauuucaccuuucuuuuaugauaaaaacucuuaacaaauaaaguauagaaggaaucuaucucaacacaauaaaggccauguaugacaaacccacagcuaacauacucagcggugaaaaguugaaagcguuccucuaagaucaggaacaaggccgggcgcaguggcucaugccuguaaucccaacacucugggaggccaaggcaggcagaucaugaggucaggugaucgagaccauccuggcuaacacagugaaaccccaucucaacuaaaaauacaaaaaauuagccgggcaugguggugggugccgguagucccagcuacucaggaggcugaggcaggagaauccuuugaaccugggagguggagauugcagugagccaggaucgcgccacugcacuccagccuggacaacagagugagacuccaucucaaaaaaaaaaaaaaaaaaagaucaggacaaggaugcccacaauuaccacuucuauucagcaaaguacaagaaguuauagccagagcaauuaggcaagauaaauaaauaaaaggcauccaaaucggaaagaaagaagugaaaauuucccuguuugcaagugauguaauguuuuauuaauauauagaauaaaguuuccaccaaaaaacuguuagaaugaauaaauaaauucaauaaagcugcaggauacaaaaucagugcauaaaaauccguagcauuucuauacacuaacagugaacucugaaaaaguaaucaaagauacauucccauuuacaauagcauucaaaaaaaauuaaauauuuaugaauaaauuuaaggaggugaaagaucuguacacugaaaacuauaaaaacugaugaaggaaauugaagaagacacaaauaaauggaaagguauccuauguucauggauuggaaggauuaauauuauuaaaauguucaugcugcccaaagcacuauauagauucagugcauucccuccaaaauuuuuaaauuuaaugacauuuuucacgaaagcagaaaaaauaauuuuuaaauauacauauuucagaauacauuguucacaauaaagauauaugauuuuuugucaguuaaaaguuaauuuuuuuaaaaagauaccuauagccucuuauugagguggaaucuguugcucuuggagcuacguacuguugacuuugguuuucuggaaacaucagugcuauuuagaacauuaggauauuuuucuuuuugaauaucaacaaaaacauaaauaaaaauacuaguaaugacauuuacaguauguuucacagauuaaucacaucucugagugggagucuuuaucuguuguaggaucuacucuugccauucuauucuggguuuugguugauuagucuuucuugaacacuuccagaaauuggagauguaugccugccuuagguagccuagcuuauuuuauuaaugaacauauccauuuaaaaauuucuuccugguaaugagucuaaacuugccuuccuguaauuuguauccacugguccuuuuucuuuguucucccucuugcauaugccaguacuucaauagcuggucccagcuccauugacgcccucucucaggaucacacaucacagguccuucagaaucuccuaauggucucucugaucuccaggcaacacacuacucuaaccuuucuaugcuuuucuggccugcaguucauuucuguuccugugaagucauagagcccgcaauucaugcugucuuguuccccuauuaaaauauauuuuuguaaaucucuuuaggauucgugaaguuuuuuggaaaccuggcugucauggauaguccucaacagaucugugagcguuauccuaucuuuguggaaaaagucuuugaaaugauagaaagucaggaccccacuaugauugguguagcuguagacacaguuggaaucuugggauccaauguugaaggaaaacagguuuuacagaaaacagguugguaugacuuggcccuguucagggauaucuuaaucuuugacagggguucaauauguaaguucauuugcugguggguuaacuacauuguagaaacuauuuuauggguggcagucuuguuaaccaugaccuuguacucaugucugaaaaucuaauaauuauuacggaaaaccuuuuuuuuuuuuuuuuugacuuuucacugguuuagguuuucauugguuuagguuucuaccaaucgauuucaaccaaacauuguuuccuguuuccccucuaugaugucuucuuugacuagauuucaugguacaaagaccacgggcuagagucagaaaggucuggauucauguccuuggguuuucuauucuuuuuuuuuuuuuuuuuuuuuuuaagagauugagagugucucucuguuacccaggcuggccccgaacucccgggcucaagcaauccuccugccucauccucuugauuggcugggucuacagguccacaccauuguauccagcccugacuuugcuuuuugaacuucauuuacucacuucacuuuucuaggccucauuuucuucauuuauaaaaauggcauaacaacugcuucucaggguuguugugaauauuuaugaaauuuugagaaaggaaaauaaaaguuuguuauaagauuucauguuaagagauacuuuuggcauguuaagagauacaaugguucaugccuguaauccagcacuuugggaggcuaagguggguggguugccugagcucaggaguucaagaccaggcugggcaacauggcaaaauccuaucucuacucaagaauacaaaaauuaaccaggcaugguacugcacaacuguagucccagcuacuugagaagcugaggaaggagaaucucuugaaccuggcagguggagguugcagugagcugagaucaugccacuacacuccagccugggugacagagugaaauucuaucucaaaaaaaaaaaaaaaaaaagaggccagguaugguggcucaugccuguaaucccagcauuuugggaggccaaagcagguggaucacuugaggucaggagcucgagaccagccuggccaacauggugaaacccugucucuacuaaaaguacaaaaaucagccaagcgugguggugcaugccugcagucccagcuacucgggaggcugaggcaggagaauggcaugaacacaggagguaaagguugcagugagccgagaucacaccacugcacuccagccugggcgacagugcgagacucuguaaaaaaaaaaaaaaagaaagaaagaaagauacuuuuauggaacauccaugaggaucaacagcacaacaaauuuuacacacaaaauaauaugcagcccaauuauuaaaauucuugagacacauauguugaaaauuaucucaccuguaaucccagcacuucaggaggccaaggcgggaggaucguuugagcccaggaauucaagaccagcuucgucaacaacaacaacaaaaaaaauuagccagcugugguggugcaugccuauagucccagccacucgggaggcugaggugggagaaucauuugagcccaggaggugaaggcuguagugagccuugaucacucaguugcacugcagccuaggugacagagugagaccccaucucaaaaaaaaaauuuaaaaagaggccaggcgagguggcucaugccuguaaucccaacacuuugggaggccaagguggguagauuaccugaggucaagaguucgagaccagccuggccaacauggucucuacuaaaaauacaaaaauuagcuaggugugauggcaggcgccuguaaucccagcuacucgggagguugaggcaggagaaucgcuugaaccugggccgugagucgagauugcgccauugcacuccagccugggugacacagcaagacuccaucucaaaaaaauaaaaauuagaaaauagaaaaagaaaaaaagaaaauuaauacgcuguuguguaucacagcuaauauuuuuguuauaugucguuuucuaagugcuuuuaccuaugacaaucguuuuacaguccugcaaagaacauacauugucauuuucauuuuccagauaagguagaugaaacuuagaggaguuaagaaaauuucuaaggucauacaaauuauggcagcugcuacucaaguccagguccuuugauuccaguuuuauaacuuugccuuauauaugcuguguugcguguaauuauguguucuaggccugucacugguucucugacuacaugcuuauuuuuguauugguuuagguugguagaggucauaguguaugagagcauacuuuaaaaaaaucucauuuuucacuucauauccauuaggauggcuauuacuuuaaaaaaaaacccauaaaauaauaaguguuaggauguggagaaauuguaacccuuguacauuuuauauuuccuucauccagcagcuccacuuucagguauauaccaaaaaaaauugaaagcagagacucaaacaaauguuuguacagucauguucauagcagcguuauucacaauaaccaaaaaaaggugcaagcaacccaauguucauugauagaugaaucaauaaacaaaaugugguauauacauacaauugaauauuacucagccuuuaaaaagaaugagauucuggcacaugcuacagcauggaggaagccugcgccacugauaacauuaugcuaagugaaguaagccaaacacauaaggacagauauuguaugauuccacuuagaugagaugccuaaaagaguccaguucacaggagguagaauagugguuggcaggggaugaggguagagaagaaagggaauuauuguuugauggauacagaguuucaguuuggguugaugaaaaaguucuagagauggaugguuaugaugguugcccaacagugugaauguacuuaauagcacugaacuauacacuaaaaaugguuaaaaugguaaauuuuauguuguguauauuuuaccauaauaaagaagaaucucacuguuauccuucaaaggaacucgcuuugaacgcuugcuuaugagaauaggacaucaaucaaagaaugccccaguggagcuaaaaauuagauguuuggaugcaauuucaucucuucuguacuuaccaguaaguagguagggaaauaaugaaggacagugggauauguuugggagaauaaaucuguaugaaucaacaugauaaaugugaugaaguaaauacaagaagauaacccucauuauaugacuagugacauuuuuaauuuaaaauggaaucauagaguguuagaacugaagagacucuagagacugcuuaaucaaccacauucaaagaaaacugggaaaggucugggcuggauuugagaaagaguccuccagacuuagccaguuucacacaacaaauuaaugacagagugccaucagcacucaggugucugacuucuaaauaagugcuuuucuccagaucaguuaacuuuugaugagauuuuccuuuucuuuccuguagccugagcagcagacugaugaccuucugaggaugacagaauccugguuuucuucuuuaucucgggauccacuggagcucuuccguggcauuaguagucagcccuucccugaacuacacugugcugccuuaaaaguguuuacgguagguauucacuuccauagguccuucugggacccugccagcucaacacuugaguacuuaacagugagccagagccugugccaucucuggggaugcacaagugcauaguauaguuucuaccuucugcuaccuuagagacuaaguaaggagacagauguguaaacagauuguuucaguaaaagauauuaggugcuguuugagguuugaacaggaugcuaugggaucacacaguuaauuccagacuuuuuaucugccauccucuauuaaccuagcccuggucuuccuaauccuuauuucccgugcagaaaauaaggcuucuggcaccuaaugcuccagugguaccaaacuguuuguuuugugucucuggaccuuugcuggggucuccguaucuaacacucuuccuuaacuuugcuucuuaaccucuuacucacucgucaaggacuaacuccuugucuucagcacacuuugcccagauugacaagguugaguuaaacaauguugguucucauauguugcauuuauuuauucagcaaauauuuguugaguuuccguuuuugcucagugaagggcauacaacagugaagaaaauauauaaagaccuuccuuucauguaguuuccugucuauugaaggagccaggcaguaaauauaauuguacaguuacuuauauaauuacagcugugguaaggauuauaccuuuguguucuauuuguuauauuauuuugcaaauguuuauuuaucgacuugucuuaccuauuaaguagaguuggcugagagcaggaagcauaucugauuuaucuuuguagccccagcauagcaagauaguaaucgcuuuaguaaucauaucaauaaugggaucucagacagcauacauggccuagacugggagggaauaaggaaaauggcagggacaaaagagggaaggcuuccugaggaugcgauacaggaucugggucuugaaggauacagguauuccuauaaucuucagaaacauuuuuuuuuuugagacagagucucgcucugucgcccaggcuggaaugcaguggcgugaucuuggcucacugcaagcaccaccucccggguucacgccauucuccugccucagccucccgagcagcuagccuacgggcgcccaccaccaugcccgacuaauuucuuuuuguauuucuaguagagacgggguuucacuguguuagccaggauggucucgaucuccugaccuugugauccgcccgccucggccucccagagugcugggauuacaggcgugagccaccgcgccuagccagaaacauuucuuuaagacugcuucacccuuguaaauggucauuguaugagauggccauuuuggauccugcuuaguauuuucauuauuaguuuauuuugguuuugcucuucuaccuuauccugugcuuagcugguuccauuguagaaauaauuuucuauuuacugguugggauaacuauuuuuauuucugccuacuuucaugcuugguugugaagcaggccaaaguuucucaaacauuaaucuuaggaaucuuauuaaaauguagauucuaauucaguaguuguggggcagagccugggauccugaaagucuaacaagcucgcagguguugcugaugcuacuugucuguggaacacauuuugagaggaaaaaacuaggccauaaacuuguuacuucuuuuucauuaaaacguaauagguuuugaaaaacuuaaucuuaaaauuuggaaaagacuuagaaguagaauuuuuuaaaaucacagaaaguucuaccuuuugguguauuuccuuuuaguuuuuguauuaguguguguuuauuuuuggugaaauauuucaaauauaguuguaucuugcuaccucugcccaguccuauuccccuuccucuguucuuagauaaaaucacuaucacaaagucagggcccauaaaugauuucauauuucuacuacauauuguguguauccuuaaauaaaacacaguauuuuagauauucauaaacuuuguaagugguaucaugcuguuuguaucauuccauuagguuggugcaaaaguaauugcaguuuuugcuuuuuuuuuuuuucucuucaauguuacguuuuuuuaaaauuugucuauguuaaaagaggcaguuagaaaguugguauuucauugaauagccacaauauaucauucuccuauaaaugaagauuuagauaguaucuuacaaaugauaccacaaugaacauucuugaaaauguuugugcacuauaugaguaucuugagguuagucuuuucuacuuuaguuuuuauuuuuccacuguuguaaucaugcauuguuuauaauuugaaucugcuuuuuuuauauaacagguuuaccuguaucauuuccuauuuuuuguaaacauuauuguuaauguuuauuuuuauugcuauauaccauaauuuacuuaaccauucucccauuauuagauauuuauauuguaacuuucacacuauuaugaacauuuuuguauacaaagauuuuucauauuuaagauuauuuuauuaaguuagauucucaggaaggaauuuacuuagacaaaagguaacauuuuuaaaguucauguugccagauuucuuuguaaauauugugccaucccauuaacaaacaacuuccacucaggggaauuguauucuuucugccuuccauuucaggccauugcaaaccaacccugggcucagaaacuuauguuuaacaguccagguuuuguagaauaugugguggaccggucuguggagcaugacaaagcuucaaaggaugccaaauaugaacuagugaaagcacuugccaauuccaagacaauugcagaaaucuuugggaacccaaauuauuugaggcucagaacuuaccugagugaagggccauacuaugugaaaccuguuuccacgacagcaguagaaggagccgaaugauuucuucuagagcucauguagaggaccacguuuugaccaaaacuucuccuaaggcauuugacuccaucuauauuucacaaaagagacuuccuuuccccaagaauuaucauggaaugucagauguuacuuuguuaccaacacuguuauauuucuacauugaaaugcaaaguggaacuaggaguuuggaaugcauuaagagcagacaagcuuggucauaauagauccaguguuuuucagauuccuuucacugccuuaaucuuugcaacaggguggaaguuuuuuucuucccucaaaauuuucauggacaugcaaucuuaucuaaaagccugcuucagggcugggcgcgguggcuaacaccuauaauucccagcacuuugggaggccaagaugggcaaaucacuugagucuaggaguucaagaccagccuggccaauauggcaaaacccugucucuacuaaaaauauaaaaucagccaggcaugguggcgcacaccuauaaucucagcuacucaggaggcugaggcacgagaaucgcuugagccugggaggcagagguugcagugagcugagaucuugccacugcacaccagccugggcaacacagcaagacucugucucaaaaauaaaugaauaaaauaaaaaccugccaccaaauuauuucuggauucucuucacuaucuuuuuuuuucuuuuugguccuuuuuccauuucugauuccacuuucaaagucuuggauauauucuuugaaaaaugaguaguauggaauauuaagauuauguuccuuauacucagaauacuuuuuaugagcucucuuguuuuuuuguuacuauuauuccuuugaaaaaaagacaaaauaucuaaaaaauguuuauaguguucauguaauuuuuuuugcuguuuaccaaugaacuuugcccuguugugguuuugggggaucagaaggauuccuaaacugucauuucauuuauugguaggucaugauugcugaggguuuugcuuuggauuuuucauaccuauaaagucaaucuugaguugaucagagaaagggaaacuuacuccuaauaaacagacucagaacagaagggacauaugcauaaaucaggauaccaucucauuaauuuacaaaggauaaucuuucuuuucauugacaacaccuacacccaccuguuuuccaguguucuucucucuaaacagcaaagccaaagcacucugcacaccaaaucaccuguucagagguuuaugcaugagcauauuucuuuuaggccguggugaaguugauaaaccaccccugcuuuguaacaaaauuauuuuaaagugacuggaauuaucuaguccccagauugaucaucuccccuggcaacgugacucuguuuuuuguguguguuuccaugcugacuaguccccuacuguuaauaucacuacuaauuaggcuauaaccaggucuuuccuggccugagaaauauucucuuaaaaugaccuuuguuuuaaucucauucaugauguugauuuuuuuucaauguggugcaauauauacaauaaaauuugucauaacuauuuuaaguguacaguucaguauauuacauauguucauaaguuguacaaccaucaccaccauccaucuucagaauuauuuucaucuuauacaauugaaacuguauucauuaaacaauaacugucuauucccucuuuuccccagccucuggcaaccaccauucugcuucaugacauugauuuuauucacuuaacaucagauuuuggggggaugcccucucuccuauguauggucuacacauucugauuuuuuuuuuagauugaauaaaauuuguaaau

SEQ ID NO: 13166 - RNA, 1807 nt, Homo sapiens
aguaggcuuacguguuuaccgcguagggcaaagccuugccaaauucccggccagcggagcggcgaggguggggacucacgggaaguuaaacagccucgucggcguccucgaggcuccaaaaccaggcucuaggcggggacgacugcagccguuauggaggccaccgcggcuacggccgcggcugaggccuccccagguggagcgguggccuggaggggaaucuugauccugggccagccaccugucaagaggaggcggagcgucaugccucuggaagacuggaugaauauucuccaggagccugacgaaggcgugaguaauagggacgugcgccgccuuguugguguugaucaguccaccaaggagaagcagcuggucgcaguggccguaccuguaaucccagcgcuuugggaggccgcggcgggaggaucgcuugagcccgggaguucgagaccagccugggcaacauagugagaaacccgucucuaccaaaaagaaaaaaaaaaaaaaaggaaaaaaauuagugcggugugguggcacgcaccuguagucccagcuacucgggaggcugaagcgggaggguccccuaagucuaggaggucgaggcuucagugagcggugauugugccacugcacuccagccugggcgacagagcaagacccugcuuuccccucuuguccuccacuacccucaggaaaccaagaaagaccagcguggagaguuggucgcccaucugcucuaagcugcuguguauuccccuguaauguaaacaucgugaagguggagacccaguuaaccuuuuagguggaaggccagaugacagagggcggcaucugacccggaaggcccucugcaaccaggccaaauacaucuacagggaaccaaugggaaacaucuggggaggacaacccaaauaaguaucaugcgagcaagggaugguuugagaacuuuaaaaaucgcugcuguuuugcaacauacgaaguugauggggaggaaggacccuuaaauccugaguggguaucgaguauuccaagcaacuggagagaggcuuugugccucaacaggucuucaacgccaaggagaugacccaucuuuugcagugcaugccuuccuacuuuuggggcaaaagacaaaaaucuggaaagcuuagaggaagcuaaggacaggauuucccucauuuuuuuguggcagugccucaggugacaaaaugauaaaaccacugcugcuuuacaaagacucuaacaccccacuugucuuuuagagauaaacgccuuccuguuuucuuguaaucacacccagaaucaccacugccacuuuuuggauuaguuuuacaauuuuuuuauccaucaaauccgaagucauuuaacaaaaaaaaucuggaaaucagaauguugcuaacuguggacagaggucccaaucacccagauucauuauucuuuguucauucuaauguugauacuguguuucucccucaggaaggcccuagcuuucuucagcccuugggucaggguauaacugaagcauuugaacauaaucaagcauauguuugaccacuuugcugacuguauugaaaaaacccucaccuuacucugaaagaagcauggcaacaguacaauauugccgaugcuuugguagugauaaaagaggugaugggugauauaaaaucagccacucuuaagcuugcuggaaacugugggaggaugugugaaugaugcauauuucccuagagcuaaugaagaaguuaaaaaaaaucuuagugucugcaaaacagguggguuuaagauuuauugauauuagggaaaguga

SEQ ID NO: 13167 - RNA, 31228 nt, Homo sapiens
cgauugggggcggggcggcaaucugggucuugugccucuggcuccucagggcauucccggcggcuccggguuuggcaacgaggacgggggagugcgacugcgucucgggcagcauggccgagaagcggcacacacgggacuccgaagcccagcggcuccccgacuccuucaagggugagucccgcguccccugacccucccccguggaccgagcccccgcccgcagcgugcgcuccgaggucugacagccgggcuccuggccagucuccgcugcuucgggcugggcgagaucucaaagccgcggcuccucccuaguaaacugagcaucacgaacccuguuuggcagacugaggucacgauggagggguggcgggcugccaacggcacguuucccaucgcacgggcccugguuaucucgcggccgccagaugccaagccccaugccagggcugcacuaucucgugucacgcacgcggacuaggaaacgcagagggaacuggcagccagcgaggcggggaccgggaccccacaucucacccuuugcccacuccccuucuuucccgacucacucucucgaaggccgccuccuccacccagcccuggccuggccccagggugaacccccuccucccccaaucccaccucccgaaacuuagaccgauuugcagaaggaagaagucucucuggcuuucuucuuaccucucuuucuagcuccacuuucugccccauuuuucccccuccgcuuuccucugcguuuuggagaacucuccuucccggcuuuuguuccucgccaggaacccugaguucucccacccucacccccacccucccuucccagucuucaaggcaggagcuguaaguggcucagucucguuccccuguggaggaacugguacucuggggaggggguuccaauaaagagagaugguggaccucucaggaguccugguacccacucaggagcucuuagugauccagaggaauuacaguguuucuaaagauggaauuucaggcaggauggcagugaaagcaauuuagagggcugggugguccuuuccaggaccccucaaagaacaugacauuggagucaucuauucugauuauuuguaaagccagcuuuauccacagcaucuuagcuauaaguuccauuucccuuguccagggaucccuguguucaguuccuucccaggagcaucaaaggaauuacagaaaucuuuauuccucacuuuuugucuacuaauaacguugcagguuaucuucccaaauggagaguguaacagggaggaguugaugagaauaauggcaaccacaacaacaaaaauugaaacuaaauaggucaggcuccguaucacuuuuuuuuuuuuuuuugagacggaguuucgcuuuucuugcccaggcuggagugugaucuccgcucacugcaaccuccgccucccgaguucaagugauucuccugccucauccucccaaguagcugggauuacaggcgugcaccaccaugcccagcugauuuuguauuuuuuguagauacaggguuucaccauguuggucaggcuggucucaaacuccugaccucaagugauccacacgccucggccucccaaagugcugggauuacaggcaugagccaccgcgacccccccagugccacguauuuuauguauauauuauuuuauugaaucuucacaacagaugaugugguagguauucuuauccccauauuauacuugaugaaacugauagucaaagaaguuaaauuacuuaaagucacuuaguuuguauuuaaaucuagauuugacugauucuaaaacuugaauagggaaaaaaugggugguaacugccucuucgauaguuaguugucuuuuccuagauaaaaagguggguauuagcaugcauuccucaauacccugaccuccuggugggaaacugcaguggcaaaucugcuuggaguucuuugagaaucaacaugaucuuuguacuuaauguuuauuuacagacaaguggucauagaugaguuuuuaacuuccaguuuuuuuccuugguucuacacuuaacuacuguuuagacagaaaucuuucaagaucuaaugaaaaccaccacuuccucucaaaaauuagacauacaaauaaaauuuugcauagucuguguuuuuuuaauguaaaccuaacaaauuugacgcuacuaggaaagguauugcuggaauuuauuaaauagagguuauugaaugcuuucccugugccaaaagacaguuuaagugcuuuacaaacauuaucuaauugcauucuguaacagcucuacaaggaaaaagucauuauucaccauuucacaauaaggauacugcggcucacauggcaaaaucacaguuucuaaaauuuucagcccuguuucaaaccccggcuaucugauuuucugaaucauuuucccuaucccagagauggauaccaaaauguagaaccuugucuaacuucaguacuuuacuuaaguugagagacaauaaacaaaaaaagccuggaggaacacagcuucagugaugacuuccagaaggcugcuugugaaagaagcaguggaauuuuaaaagccuaaacucugccucuuugucuuuacugagaauuaguccuagguagguaaauagcaccaggccuagggcaagacuaguuuuucuuaaaggcgaugcauucacuuuguaaugaaauaaugcaaguaauugcaaagaauguaucacuguaauuaagagccaugucaacaaauaaaacccuuugggagacugauuguuuauuucaguuguuauagccaaucagauuggagagaacuuuguaacuucuucaauaauuaaucugaguuauuccaucaguggucauaaauuaacuuauggaagaccaagucuacaaaacuggcauauuuauucaugauuaaauagauuuuuggugccauuugaugguauaaauuuuaccuaguaaaagacagucacugauuccuagucaucuuugagggaaaaaaaagauguugauaaagugauacagauggaauucaaaaucaguuuuuuuaagaaggcauggaaaagcaauuuccugaaaacuauuguaacuacaaaaaaagugaauacccuuucccugcgucugccugguauccugugcauaucucuaucauaauguuuauuacauaacauauuuaucaguuugacucaucuguccccuccccucccauaauuaaacuacacuuuuucuuuuugagaccgggucuugcucuguugcccaggcuggagugcaauggugcagucauagcucacuguagccucaagugauccucccaccucagccccucgaguagcugggacuacagguaugcaccaccacacccagcuaauuuuuuuuuuuuuuuuaacucagggucucacuauguugcccaggcuggucucgaacuccuggacucaagcgaucccacuuuacccucccagagugcugggacaacaggcaugagcuaccaagccuggccuuuagaccacacuuuugaaaauagagauuguguccuucuucacuguaguagcccaguaucaaguacauaguagguauacaaaaacauuuguucaaagaaaaaggaagcaggcagggagauaaaaaucccccuggaguaaauaacauuguuaaguguuugccuuagccuuauguugguggagcaguuuuucuguuuaccauuuauuuuauuaaguuuguuauaacuuaagcuguugauuuuagggcauggccauuauguuuauuauauauuauuacagauagacuauuugucuggguuuauauuaucaauaaaaggauuauaauugccaagauaauauauuguccuuaauaagaaaucuccuuuuauuuauuaaagcauggaaagagaaguuuagaggucaugguuaguagaaagaaggaagugugugucaauagauaauuuucuauugacacacacuuguugauaauuaaaauagaucauuucaauuaaaauaauuuucuauugacacacacuuguugcuacauucuuuuuuaaucuuucucugucugcugggacuacuaaagaaacuugaacuccaagcauuuggccucacauuucagaagauuauccuugaagauacaaccaauaaaguccuaaagucucagacaaugaaaacuauacugaacuugugguccaguuaaagugagcacuaugguaagguaguagaauauagugaaaugagaguggaauuuauaauuaaaagauuuagguugagaucacccuaccaucacuuaagagauuuguaugaaggaugguccaagaacauuuagaacucugacuuacugccccaaguguagucuguuucuccuccagagauagaguccccaagcagauuguuaguugauauuuucuccauagugcccagaucccaaaagguaauucacuucauaaaaaguuucuuccucuaaacuuaucaauagugaucuuaaaguugugguaauaauaauggcuacugcuuguugaauacuuccuaagugucaagcccuuuacauauuuucucguuuuaucuccacaacaacugagugaaauaaauacuguucuuuuccccauuuuacugauaagaaaauuuagugguagauuuggaaucuaacaccaaaaaugcaagcuuuuagccacugcuuagcuguuaaucacagugaagaacugagaacuuuaucaucuaguuuucuucugcuuccauuucccauuuuuaaaugaaaacgauguuacccuccaaagacuuauaugagaaaaacuuaauugugaauaauuuuaagauguccaaguaaaagagcugggaaaaaaaaaaaaaaccuaaaaagugggaggguuuuuguucuguuuucauguauuucaggccuagaugaaauuuaauuaacuuaauacccauuaugaaauuguuuuucucuccaauuuuccugaacauaaauguuuuggugcuuccagacaugggccauguucagcccauucuucugcuuuccugaauucucuaacgucaugguuggaaaaggucugauuuuuuuuuuaaaaagaaaauacuugaggaaagcaguugacaacugcuugggcaggagaugguucuguacuguaucccaggauccugucugcuguuucaguuugucuuaugugagaggcagucuuuuuuuuuucuuuuccccaaaaaaacaacacacucaacucauccagcaacuauuuaacaaauguuuuuugaguaccuguuauauacacuaagugucuuccauauuagcuuauuuacucaucacacuaaccugaggagguacucuuauuagcccuauguuucaauggguagacugaggcacaguugaauaauaagguacuuucucaagaucacacagcuaguaaguggcagagccaucugugaaccuauuaugcuauacuguuuucauaaaaccaaaaucucaugaagacacacaacugaauagaauaauuacaagugugauaaauguuguuuuaaaaggguaaagggcuauugcagcauuauuuuagacugagagguccaaauuuaaaauuauugcuguugcucucaccuauuuuuuuccucuuguauggccugaaacauuugaaugcaggaaaacuacagaaaauccuuaaaauauuuaggaaauaagacauuuaugcuuauuuacuuuccuuauucuuuuugagcuaagcaaagaauaacuguuauugcaaaucuuucuuagaaguauuaguccauuuguuuuccuuaguauuucacaguaaacacauuuuaagcuuuguaauucaaaccacauagugcuucaucaguaucaguucuuuuggucuagcauuuauaacuauagauggauuuuaauagggaggaaaaguuacagucuucacucaugguuuuuaacuugauaccaucuggccuguagcuacucuagccccaagaauaauuucuucucuagagauuuaaggauaagggcauucgaacaacuaagccgugccuaauuaaaauacuaauuugaaaggcaggcuauaaugugugugugcuuguuugcuuugaaaucuucugccuuaaaugaauugcaaguuuugaucucuaaugaaacacuaucauuuuuuaacauacguuuaucgagacgcuaccaugugguaaacucugccucuuucucacuucuagcuuuuuuaaucuaucucucuuuguaggauucugucuucauuuuuguuucucccauuuuuacuccuucuauuucucuuauuuuccuucgcuucugcuauguccuucccuucuuugucuuuuucuccuaaaauuccagucauuugaaaaacuuaguuauaguaaaaauuugauuaauugaagaggaauuuauauucacuuacucuaccugcccuuuugcuuauuuucaccaggaguuuuuguuuaucaggccuuauaaaggccuugcuucaaaauaagcaaaagggagaaacugagaagcugggaaauguacccuuauuugaauagcuggaagaaagaucaaaugcauuauuuaauuuaugcaagucuuccuccucaaauaaauaguuggcugacauaaaacaggaacagcguguaacagcccauuguccaaaucuagcugacucuguuucuguaugucccacaaguuaugaaauagcucuuauauuuuuaaaugauuuuaaaaaggcaaaagaauacuuuuucauuacacaugaaaauuaugugaaauucagauuuauguccauaaguuuuauuggaacagcugugcuguuuauguagguacuaucuauggcuucuuuugcacugcaaaaguagaguugaguaguugcaacagacugcaaagcccaaaauauuuaguuccugguucuuuacaggaaaaguuugccaauccugacaaagaaucacugaugaagaaucauaguggccaaaaguaacacuuaauccugaauacauauguuuuuaagaagaaaguucaaaaauugccaagacuuuucaauuuggccuacuguuaccccuaaaaagugcugcugcaacugaauagcauguguuuuugagacuaaacuuccagccuuucugucuugccccauccaggcaggacugcucucaucaauuuacaacaugaaguguuuuauuugcacucugugaaggcagaaggaaaaaaguguccguuaaaaaguggcaguuuagguauuucaguaauuccuuagcccauccuuucuuauuguguaggauaaugcuuaugacucacagucagauucucagcagaggaaauccaguuaucuguugaacuuuacaauaauaaaaucucagugaugaguggauuuauuacuccacaugauuuccaguagugcuaagguuaauagaucugaaaguaaaucagcugauggggaacggggacaacuacagcccucuggacuaaucagccuguguugucaucuuggaaagaauguuuaacugccuuuccagaaacuuacccaacaaaaauuacuacacaacaaauuucauuuguuucaugguuugcuugguuuucuuuuguuucuuccuacaaggucuuuagccuuauuacuuuagaacuucaggaggcauauuuuaacaccuacuucacagauuuuuguaaacauuauaaauacucauguauguaaggaggagcuacauguggcuaacaugucauaggaauucauaaaugguaguuauuaggaguaguaacaaaagauaccuucagaaugagagaauuuuaagaguuguauaauuucaucuuuucagaaaaauuaacuuacacaggaaauaagcagguacagaaacacugcuaaauauauauucaaugcagcaguuucuaagugagaaauuuggacacaacagauuucaucauauaaaauggaauuaauuaauuaaucuuuaauaaugauaaagaauaugugcugauaugaaaaaauguucauaacauggaugggagggagaagauuuuaaaucacuguguauaccauucuuucauuauugaaaaaauacaggcuagaaaagguuuaaaagacguauaucaaggcaaaaaacauccagagauaaaguauagauaauguuucuguuuguugagcuaucauuucuaauuuuuauaguaacuuuugcuuuuaaaguaaaaaagcaauuuuagaaaauguaugugaguuuccuggagguaagcccaacuugaauguucaauacaaaaauucaaauguacaggcuuauguccauauucagacccuucuuugauuaguuaaaaguuuauucuacugccauuuugguaauaaaagaaaaaaaaauacucuaaaccaggaguccccaacucccaggccacagacggaucagaucagcaacauuagauucucauaagagcacaaacccuauugugaacugcacauaugagggaucuagguuguguauuccuuaugagaaccuaaugucugaugaucugugguggaacaguuucaucccaaaaccauguuccccaacccuuuccuguggaaaaauugucuuccacgaaacuggucccuggugccaaaaagguuggggaccauugcucuaaacuauggcaaaguaguauuuacaaccaaguaucauaggaucccuaauuuuuaggaacauucucaaccagcaaaauacccacaaguggccgggugcauuggcucacgccuguaaucccagcacuuugggaggccgaggccggaggaucacgaggucaggagaucaagaccauccuggcuaacacggugaaacuccgucucuacuaaaaauacaaaaaauuagccaggcaugguggugggcaccuguagucccagcuacuggggaggcugaggcaagagaauggcgugaacccagggggcagagcuugcagugagccgagaucucgccacugcacuccagccugggcgacagagugagauuacaucuaaaaaaaaaaaaaaaaaaaaaaaaaaaguccacaaguguauuaaccaaaauaucacuauuugucccuuuccccauaaaacugguaggaaggauucaguccuaaaguaauacaugggaaacuugaaggaaaugaauuuccugagauuuuagugagugagaauuucuuuucucuuauucccagaagugguagaugacuaaggguucauuuauaagccugcuagaguuuaagccucaccucugagcuaugcauuuauagcacaacaugcuauaaauagacacagcuggaauuaagagggcuuccucuguaaaaacaucagauuucagucucagaacucuagugaugcauucccaacuuagauacuguguaccuuuuugagggguaaccagguggggaagaauuuugagaggugaagguaggauacuuucauuuuaaagucauuagaaaaauaugaaagugccauuuucccaguguauacacugauuauuucuagccaagcauuugauaugugaaagaccaaauccaguuuucaaaauguguacuuaauuccuuguuccuggugauuugcaaucccauauacacaucugggguucucaaaaacacaaugugacaugggaacugacacaaaaaaaacugggcugaacuuuuuggcuuguccucauguagaucauaaaugaacuuuuugagagucuuugaaugucccagccuagccagacugggggcagguaugaagcaaauggcaaauuaaauuguuuaagaggcuuuugaucaaaaaggguaaaugcuauuuucccauuuuucuucaugaagauacaaacacuuaaguaaaauagaaggauuacagaaaacuaucaucuacauuuacugaucauuuuaucuguauucuacaaggccagccuaauaaucuuuacuuuccaccgguaaggaaacuaagguucaaagagguaaagaucaugcaacuaagaaguaucagaagugaaauucaaacauaguuacuccucguucucagggaaucucaguguaauaagggauauaaaugcacaagaaauuaaaauauuagauuaaaaaauaauaaaagauuaaaauccuacauuggaaggucaauuaaaaauaaauaaaaaauaaaagauuagacaagauauaagugccauaagauaauuuucaaaaaaugcuaucgagauucaaaggaaagaaaaagacauaucuagcuagaaaacuugcugagaaguauuuuauuuuauaucuauucuacuaugcaggauacugugcuagacauugagaauauaaaagugaauaagcaacaucccugcccucagggaguuuuuacucuaguauguuaugggagacuuggacaguauuugaaaaggcaccaaaugcugucagauaaauaaguauuuguggucagucuguccuuguuuggaauucauuucacccuggaaaccuagaccugugucugucacagagccuugaaacuaucuuuugcuauaaauaggcauggcuggcauuaagaggacuuccucuguaaaaauaucagauuucauucucacaacuccagccaugcuuuucaguuuggauacugucuugagaaagugcucaaccacgaaaacauucuuaaugaggauuuuuuuuauugaggggugaauuuggaacacgggcuuuggaguaagaugacccauauuugagucccaggucuuccauugugugacuuugggaaaguuaaauguugcuuuagguaacucauuuguaaaagggauuuaaaaauacccucacagggcuguuguaagaguuaaaugagauacaugucuaaaguaacuuuaaaaaaugccugggguauacacaaccccucaaaacagccacuguugcuaugaucagucaugguaauacuagauaaagcuuucuucacaaacaguacuauggcccugcuuugaauauucucucaaugaauaugucuguacccccuaaauuauaacuuagaaaccuccaggauuacuuuagaucauuuuauuuaaguauacaugaagacauuuaccucacacuauaacacaggaucagaaaacuaccaagucacauacaacccaaguacucacuauauuucugauuuuucauccuauguuuuagagcacuugaccugggugccaacaugugucucucuucucccauguucccagccugaacacucugcuuauuucuuggccuccuauuuauuccaagccccaucuuacugccauuuugcccuuucuucugagcaguaacaugugccuggcauaccuuuucuccccucugucauuaaaauagcuccugaaaauacagcagaagccuuccaagugguugauaagaaaaccuacuauaucccuuggccuucucagucccuauguccucuacagaaagcaaaagcaaacuaaaaaugaggaugacacuugauacagaaaauaggaacacaacacugaggugaugggaguucccaggaugauagugaaagcaauugcagaaugauagccgugcacaccagaugaaggaaguccacacaaggcucugagagagaauucuuccagaagauaaaauugauaguauaccugaccucuuugagaggaaauuuaggcaauugauuuaagguuggaucaauaaguacguugaaaaccgaacaaagggaaaaaauaagacaguaauuccagaaaaaacaaaaauaguacaggaagagaaaaccagugauaccucacuacuuggcuuagcuuuaaauugcacuuacaaauucauaauauaaaaucucauauugaucuaaaugaaguuaugauguaauuauauuggaaagcuggguauaaguaugugguggggguaacggggaggaaagagaacuaaaucuuuuucuguaguagaaaguuaauaguccucaaaacugaaaaagcaagaaguaacaaaacaagcauuuccuuccuuccuuccuuccuuuucuuucuuucuuucuuuccucacuuuguuguccaggcugggguacaucacagcucacugcagccacgaacccccaggcucaagcaaucccccuauuucagucuccucaguagcugggacuacaggugugugccaccacacacagcuaauuuuuuuuaagaaguuucaaguagagaugggagucucacuagguugcccaugcuggucucaaacuccugagcucaagcaauccucccaucucggccucccaaagugcugggauuacaggcgugagccaccaugccuggcagaagcauauuauuauuauuauuuuuuuuuuuuuuaaaguagagacagagucucccuauguugcccaagcuagucucaaaccccugggcucaagggauccucccuccucagccucccaaagugcugggauuacaggugugaccccugcacccagcugcaaagcguauuauuuagaaauauggagguagauaucaaaauggucaaaauagcaaauguuuuugaggaggaggaaauuggaagaggugagcaugggaaugcccuuuuuuuguacuaaucauauagaaugguuugacuuuuuaaacuuuaugcaaguguaacuucaaaaacacaaaugcauaaccacgaaggccaaaaaagaaggugaaagagaauagcuacagggaagaaaaauagguuacacauuuuauuuauuuauuuauuuuuaaaaauaugauuuaaggccgggcgcaguggcuuaugccuguaaucccagcacuuuggaaggccauggugggcagaucacuugacgucaggaguucgaggccagccuggccaacauggugaaaccccaucuguacuaaauacaaaaaguagccgggugugguggcagguggcuguaaucccagcuacucaggagauugagacgggagaaucgcaugaucccaggagguggagguugcagugaggugagacugugcugcugcacuccagccugggcaacagagcaagacucugucucaaaaaauaaauaaauaaauauauauauauauaucauuuaaaaauaugguguguacacuaggaaaauuuucaaagaauauaccaaaauaccucugaauuuaaaguaauuuuucccuccuuuguuauacuucugugaauuuuuugcauuauuaccuuuguaaucagacggaaaagcuguugcauauuacaggaacaggaaacaauuagaaaugugagaggaaagccguguacaaagauguucacuacaacacuguuuauagcacuaagaaaucaaacaaccuguguaaucaggaagugggcaauaaaugaugcugcauaaaccuagugaaauauuuuacagguguaauuuuuaaaaagaggcucuaaacaacuuuauacucauaucauaugguuuucaccuuuauucguacuguacuccuagcuaaaaugcucuaaugccuuuucccucuuuccuuuuucuuuucuuuucuuuucuuuugacagauucuuccucuguugcccaggcuggagugcagugguacaaucuuggcucacugcaaccuccaccuccuggguucaugcaauucuccugccucagccuucccaguagcugggauuacaggcacucaccacaacgccuagcuaauuuuuguauuuuuaguagagacgggguuuuaucauguugaucaggcuggucuugaacucuugaccucaagugauccaccugucucggccucccaaagugcugggauuacaggcgugagccacgacgcccagccuccacuuucuuuucgucgauauuuucuuacuauuacauccuucaggaaacccucugacagccaccugaaucaccuccccgccccauuccuuucucaccuccauccuaacugcgugaguuaacucauucugugucuucaaaauauucugaacagauacucuauaucuguacuuaccaccuaauauuauaauuauguguuugucugacuuucccacuaaacuuuaacccugaaagcugggauugggucuuacucauuguuaucauuucaguacaaagcagagggccuaauaaauaguagaugcuuaauaaauguuugcugaauaaaguaaugaguaauguggaaauauacuuguguuaugacaucacauagauaagggaaaguaguacuuacacuucagggcuguaugaggauuagauggggaaauucauguaaaacagcugguguagugccaagcacauagguauucagcgaaugguaaggaugaagaugguggugauuaugcuaguaacaguugugagaguuguauauuuuuuguuuucaacagacagccccaguaagggccuuggaccuugcggauggauuuugguggcguucucauucuuauucaccguuauaacuuucccaaucucaauauggaugugcauaaagguaaagaacauuucauucacuucugggaaggggucaacuccuaccuccauaaaccuacuucgugugugccuguguguaugugagaaagaaacagacugucucucucucuuauaauucuuauuucuucaucuuucuuuggaaaauuuauucuucuacccaccuauuaaaauggaaccuuaaaacuucuuuucagccauugcccuuccccgugggcuaaaguaaguuucaccaucaaaaauuuccuggggccagggaugugagaugguucugagagaacaaguucuucagaguuaggaugauaggguuugacugcuggcuuuacuguuuauugugugaccuuugcuguuuccucaccuguaaaaugggagaaaguaacaguaccuacuucauaggaguguugcgaggauuaaaugaauuaugugucuaaauguacuuaucacaaugccuggcacgucauaaauacccucagugcucguuauuuuuucuacaaaguuguuaauacuuugauauaugacuauuauuuacauauuucuaagaagauaaaauaugcuccaagcauuuucagaucaauuuauucuuaagggaaucagaagaaaaacugugaagacuucagcuuuuuguguuucugaauuaacaaugcaugaguaauuuuuuuuuuuuuuuuugagccagagccuugcucugucgcccaggcuggagugcaguggcgcgaucucggcucacugcaaccuccgccucccagguucaagcgauucuucugccucagccucccguguagcugggauuauuauuauuauuauuauuuuuuuuuuuuuuuuuuugagacggagucaccuuguggcccaggcuggagugcaguggugcgaucucgguucaagugauucuccugucucauccucccuuguagcuuggauuauaggcacccaccaccauacccggauaauuuuuguauuuuuaguagaaacaggguuucaccauguuggccaggcuggucuugaacuccuaaccuccgugaucugcccaccucggccuuccaaaaugcugaaauuacaggcgugagccaccgugccuggccugcaugaguaacugaauaacaauguuaacagcugaggagugagguuauggauuuguuucuguauacuauucuguccuuccuaaauuuauacagugaauaucuauugcuuuuguaaucaguaagaaaauaauaaauaagcuuugagaagguaaacauuggacaugugauuuauagauaugaucugguucuaaagaaaaaagaugaggcaucuaaucuguuuagagcagaaauauauauuuaagaagccaugcauguauauauuuguacucuucauguuaaauuauuauucauguuuuuauucuagauuauaaaagaguaugaaagagccaucaucuuuagauugggucgcauuuuacaaggaggagccaaaggaccuggucaguacugggauucuagauuguuuaucugaaaacuaaaguucuuuuuauuuuuuuuauuuuuagguaguuguuuuuuuaaagacaggguuucauuccgucgcccaggcuggaguacaguggcaugcucaugucucacugcagccuugaacuccugaccucaagcaaucaucccaccccagcuucccaaagcacuaggauuacagacgugagccaccgugcccagucuaaaauuuuuuuauugacgugauuucccuuaugagggccucuucuacucugucuuagauaagaguucauguagcaggaguuguauaacaauagcagugguucuagccaaucuuuuguuacccuuuccuuccuacccuuccccuccccuucccauuugagcugauaagauuaccaccuaggccaagaacaguacagcuauacaaguuugagcaugagaaucucuaccaaagaaagacuuucagucauucauuuggcaaacuucaauuaagcuccuacuguguuccagguucugggaauucaagggagacuaaaacacagucccuacccucaaggaucuuccuaucuagugguaggaaccaacaaggaaacagauagcuacaauccuaugugauaaguauuaugaucaaguacucacagagagcugugagaaaagagaaaaccagagaaguguuacugaucugaacuagucguaggcugagucaaggcuuucuggaaguuacaucuugacugagucuugaggucugaaaagguguuaaccaacaggagguguuugcggcggaaauagcaacauacacaaagcaacaaagaggagaguauugcagauucaagaaacugcaaguagaucaguccagcaagagugcagggugugaagagagaggaaguggcugaagaggggaacaaaggcggguuaugcaggaccaugcgugggggaggguuuguauuuuaggggggauugcucggcuugcagcuuaggaaauagauuauaggagagaaacuacaaaaaauagaaagauggccugggaaacgauugcauuggucccaguggggcgguggggagaagagugauagcaacaguagauuaaggaaaugaacuccacagaccuuaguggagacagucaaaugugggaaguaagcaagaggaaucaaaguuaucauuccuggcuucuggcucauucacgaagaugaacuggugacuuuucaguucacuagguugauuuucuuaaaacugaauggagaagugaacugauuagguugcuggugucuguauaauguguguaucuuuguugcagguuuguuuuuuauucugccaugcacugacagcuucaucaaaguggacaugagaacuauuucauuugauauuccuccucaggagguaagguuuucuuugaauaacugagguaucauaugugaaagugcuuuacaaugagggacagaauaguuagaguguaggcuuuauuuauuuauuuauuuuaaauuuuuguuuguuuguuuguuuguuuuaauuggaaucuugcucugucacccaggcugaagugcaguagugugaucucagcucacugcaaccuccgccgccuggguucaagugauucucgugccucagccucccgaguagcugagacuauagaugugcgccaccacgcccggcuaauuuuuuuguauuuuuaguagacacgggauuuugccauguuggccaggcuggucucgaacuccugaccucaggugauccguucuggccuccuaaagugcugggauuacaggcaugagccaccguucccugccagagcacaggcuuuagaccuugacugccuucagcauuucuagcucagugaccuuaagcaaguucuuuaacuuuucugugccucaguuuccucauccagaaaauagacauuuguaauaguaagaacuacuguauaaggugguucugagaagugagauauaugugccaagugcuuagagcaauggcugacaaauaguaagugcuauauaaguucuuacuguuacuauuacaguuggcccuuugcaugcauggguuuugcauacagggauucagccaaccgcagacugaaaauauuaggaaaaaacuccacaaaguuccaaaaagcaaaacuugaauuugccaugcaucaagcauggcauugaauccacaugaauaaagugauguguagguauuguauuggauaauagaaguaaucuagagaugauuuaaaguguacaggaaaauguacauagauuauacgguuggcuccauggaucaaaaauauuuagggaaaaaagcaauugacaaugauacaauaauacaaauuuuuaaaaacgguguaguauagcaacuauuuauguaguauuuacauuguguuaaguauuauaaguacuucagaaaggauuuaauguauaaaggaggaugugcauaaguuauaugcaaauauugugccacuguauauaagagacuugagcauccuuggauuuugguauccucugaggguccuagaaucaaucucccacagauaccgaggaaugauuauuacaaaacauaguguaaugcuaauguaaguauaauaauaucaucauuguuauuacuaucaacauuuuuacuaccacauuucucuucuauggguuucugauagaaaacccuauuaguucauuauuuuuuuucuuaagguuuuauucuagauaaauugguuagaaaccaaagaauuagaaacugcuuguugggcauuuuagauaaaacauaauauuuuauacuagugauuauuuugugccuuuucaaacuacuucacaaguauuaucauagaugaaacucauggcagaaucccuagaaaguauauaguugcagugaaacaaaggaauuccuccagauuacaguggcagagccaagacuaaaauugagcucuucggauucuuuguauagugcuguuuuuuccacagcuccaugcuaaaugcauuguacaugagcucccucauagcccccgaaaaagugauggccauccugggaaccauguccuuaggagacuuaauaaccguugcauacagaaaaccugaaaacaucaugaagggggaaggacagaagaaugcugucaguguuuccuggccaaaggccagauacucagcauggugauggagccuggccauguugccuucucaugucacaaauaccagaaaccagcuuaggaacuuccuuguugguacugauccaagaaguggguggggucagacuuuauaauccacccaaaguuagugaugccaggaaucauuuugcccacauuuuacucauaagaacaagacugagaguaucacuguauucucuguguguuuucccaucgucuaaggaagauugagucucagaaggagcccuucaggguagcuggacauucuggcauuuuccacuauaaacauuacagacaucuggcagaguugcuguuuaagcuucugcuuuccaguggcccucuccuauucugcaagcugcugaaugcaaagcagauuggaacuuggcagcaauccuuuuucugauccccugugaaguuucugugaagggagauaaacccuugccgaugauaaacaguaggcagagaagcuguagcuuuagaaagaagcuguggcaaagucaaaguggcaagaauuugggaaugacacacauuuucccaucaugucaugggaaauaauuaguuuucauacaagaugguaauacacuguacauuuauuuauaaauccuccacuucucuuccauguuagaaguauuuugagauuacuaaaaaaggaucacugcuuugaugucuggcagggcuaaacagccauguuacaacauuguuauuauuaccuuccauuuucauagcuguuuacucuuucaaaagggcuucauucacaaguauguucuuauuugaucuucacagaaauuuggauagaauuaggcaguauuauuagcgccaucucacaaaugaggaaucuguuggucaaauggguuaaaaaccuugcuagaggccauccagggaccugaaggcagagaugggacucaguucaggucuccuaacucucacugcuguguuccucaucggucacuguucucaggaccacauuucaguucagcuccucucucauuuauugacuacccgcuauguuucaagcacucugccaguguuagaguuacaaagaauugcccugaagaaauucauagucuaagagagaaguagaaaugugaauaaauaaugucacuacaguaaggugcaguggaugugcaagggaagagugcuuaacucugccaaguaagccaagaaaguuucacagagagaaggacauuuaaaugaucaguagaaaggugccagccugauguuguuagugagagaggcuggaauucccaggcuggagcaaucuuccugccucagccuccugaguggcugaaacuacagguguaugccaucaugcccagcuggcuuguuuauuauuaucuaaauuaacuuauuacaguuaaucaagucaguguuuuauucaguaaaguuaccaccauuauccaagaugaaauaauaagacagcucuuacgugccaggaacuuuucugagcacuugaauguauuuaacgcauuaauucuagcaagaaugcaaaguagguacuauaauuaaucucuacuuuacaaaugagaaaacugagucccagugaguuuuaagugauggauguaacuauuuuccuggagccucucacucagauaacuucuuagcuuaaaacaaaaauaugucauguuuagcauuuuuauguagcaugcuguaaaauauguuuugaugcugaccuugcccuuuaaaaacauuccccaugcacuuuuuguuccaguaauauuguggaacuuguaguuuaucaaaccuugacucucuagugccucucucuugaauauucuuccacuccacccaacacccucagaaaaauuguauuccuuucuucaagauucaauucagguaucaccccugccacccacagcugccccuaagaguuuccuuugauucccuaaccuccuucaaaggaggaaccaaguuuuuuuccuaccuuaaucccugguaccuaguacagugccugcuguugagugauaucucaauauuauuuguaugauugaaugaauuaauggacuugaauaauuuauuuuauuaaauuuuaaaagauauaauuaacuuucugaugccuuacuaaagaaaaucagcuaguguuauaagauauucuguagaauaacauuccuuacaguuauguuaaaaaaaagucguugacagauguaaaauugcuuccuucaucuuguagauccucacaaaggauucagugacaauuagcguggaugguguggucuauuaccgcguucagaaugcaacccuggcuguggcaaauaucaccaacgcugacucagcaacccgucuuuuggcacaaacuacucugaggaauguucugggcaccaagaaucuuucucagauccucucugacagagaagaaauugcacacaacaugcagguggggaguacgucaaugcuguuaccccccagaagcugaaaaaugaagcaaagagucaaugguuguuugagaaccuuuuauuaauucaaguugugggggucugugaccguuuuuuuuucuucauaguaaaauuuuucaaauuuggcaggaggggacauuuuucacauuagcaguucaugaguucauaacacucaugcguacauuuuuuuaaaauuuucuucaguguguauuuuuuuccagaaucaguaauaaccuuuuuguuuagaacagaggcuauucugcaagauaguguagguauuccuaaagcuuuauucugugugugagucccaugaauuauaacuguugugcuuuccagucuuucuugaguaacagauauucaguuaagcauagcuuauucaaaaaagauaaagugcuauaacucuggauucuuauuauuuguauagacuucaucguggguaaaaucuaugauuguauuugauaugcacaacaaccuaugaaauagaugugugguuucauuccugacauucuaaagggaggaaguugaagcacaaaggaguaauaugacuuacacagagucacauuagcucaggaguuggcaaacuguagccuacaggcuguaguuuuuguaaguaaaguuugacuggaguauagccacagccauuuauuuauauauuauccauggcugcuuuugacuacaacagcuggguuaaauaguugagacagagacuacaaauaaacaaucacuauauggcccuuuuagaagaagcugcuaaccccugcauuagcuuguuagcaacagaaucaggaucagugagccagccccugcgucaccauucguuccaccgugggguaacugucucuccacaacucuccccagcaccuuaucuccuccaaaucccaaugaauacagccucugucagcaucugggcugggcugaggagauuuagcuugccuucucucuuccuaacagucuacucuggaugaugccacugaugccuggggaauaaagguggagcguguggaaauuaaggaugugaaacuaccugugcagcuccagagagcuauggcugcagaagcagaagcgucccgcgaggcccgcgccaagguaacuuuuuuuuuaaacuuguuuuucuuacugaguuuucucuuuuauuaauaauuauaaaaaaacguaaaacaugcuugcuguaaaaacuugaaauaaucuugaagugguaaaguuagaagugaaaacccuccccguaacuucaaaucauauucccccagaggucaccacuccuaacaguugaguguauuuggauuuuauuugaccagguuuuuggauuacuggcuuguuuguuuuacaaaaguaggguuauacugcacauguuguucugcgcucugcuuuuuucauuuaauauuaauaucuauggacguaucaguacauguagaguuaccucauucuuuuaugacuguguguaccauacuuauucucccgauuccauauuaaggucaaauuaacaguuccaacuucggagcaagugggucaucauuccauccauaccacccaucucuuacuuauuuuuggcuucuuuuuuguucuguuucuuuucucaggcucuuuuucccuuuuacuguuuccuauuccucauucucucuuuuccucuuguuuauauucucuuacuuugacaucugccuuuuuucuuccuucuuuucaucaucaucugccuaugucuuaacccugcauggguggcauggccccucugggaggcacugaggaaauauuuguuaaccuaaccuagaaaagaguaucuuuaaagaugauaauguguaaaauuucagggauaucucaccaaacccaaagguaggaaguaggggcaagucucaccaaaauuggaaccagaaggcaguucagggaacuagucauucccuuuccugugccacaucucacuguagauagcuugugguggagaaugucuagcucccagguuuagaugucugccaggugaacacuaaagaacacagaccagcccuaauuccacauucacagaagagacagucuuuuugguccaacuuuggucaaagugcaaagauagcauaauaauaugguuccacagcccuaugccugugaaugggcugaagaagaagagcaguuuucauaggaggaguugcuguggacuugacaaaucucccaagacacaaggagcaaaccaauuuguuguuagaaaauaguaguagcuggucaucacuggcugaccacagaacgcuguucuuuucuuaggaugcccuuuaagccacaaacuggucacuauaauuucuuagccagcaucaaauaggauaguagcucauuugacaugcgacuucagaauuuugcauuaaccaaaauguuuagguuuuccugguaugaugauuguugcuuugugaugauaaccugguaguacuacagaacccucuagugcuuucuuucaaaacuguuacguuuagaagauuaaauuauguuuacgauguuauuaaaugugcccuaucaucuccuuauuuugaaaauuaggaauugcuuuuaacuagaauauguuauuaggcaaaagccucauuuccaaaccagauugaauaguagaauguaccauacauauacuacguagaaugucagagcccaaaggauccucagagauuaucuuccauagguggcaaacacuuagcccagaugcuagcacuccauccugcuauucccaugcuaguaauuaaccacagcacuguuuuccucugagcuuagacuuggccucagaacccuucuauagcacucuggguaacaacccucaacugcuuagaguuagcucuaaaaaacaaaacuugaggccaagcacaguggcucacgucuguaaucccagcacuuugggaggcugagguggguggaucaccugaggugaggaguucaagaccagccuggccaccauggugaaaccccguccuuacuaaaaauacaaagaguagccugguguggugguaggcgccuguaaucccagcuacuggggaggcugagaaggagaauugcuugaacccuggagguggagguugcagugagcugagauugcgccacugcacuucagcccaggcgacagagcaagacuucuucucaaaaaaauuaaauuaaauaaaaaauuaauaauaauaaaaacuuaaaaaaaaaugaaacuuguuugccaucccacuauucaaaggaaaaauugaagcucugaaaaguuaagugacguccgcaaggucgcacaguugauuaguagcaguggaaauuagaauuccccucugcuccucauugccuccucuaguacugacuucccaggaugggcuaugagccucuuccauagcauucuuaagaguuuggaaagaaaauuucuaucuucccuuuauaacaguaagaaaagauagaagaaaccgcuuagaauucugaauugccaugcucccacuuggacggggcuguaggguuagucuagaagcagucucaugaaccugggcagugacugucuuggaguucacacauagaaucacaaugagccuagcccuucuguaaaauacaguaacccugcaacaaccauaggcuuauuguauugaaauucucauggaaaauaggggggucacaguuucuucaacaaauaaauugcacaggaaaggugagauagaguggaauaaucuaaagauuaagagacuuuauagaaaaauuccuuaggcuaauuagccaucggggaaaugcaaauucacauuauaagcggaugucacacuagacagcuaucagaauggccugaaaagaacggaaaagaaccaagugugggugagagaggaacuagaacucucauauucugcugguggcaguguaacuuaauacaaccacuguggaaaacagucuggcaaugucuauucauacugaacauuuguauacccuaugagccagcagcuccaacuccuaaguaugaaucuaacagaaaugcacucauauguuuaccaaaaggcauguacuagaauguucacagcagcacauugacccaaacuguagaauacccaaauguccauuccuagcugaaugaaugaagucugguuuauucacauguaggcauacuacauagcaaagagaaugaauguaagugcucacacacauaauuugagugaaagaagccggucacagaagaggacagauucuccuacguguuucucuguauguuagguuugguuuuuaaaguguuuagaccagcucuuaguggccugaaauguaauaucuuuuguguuugcaucagcuuuuauuuccuuuucauaacucucagaaaaacaccuggcacaugcuuuugggcucauguuucuggguguagaagucuauuaauugagaggauggagugcagaaauacagaucaccuuucucugccuuuuccucugcccagaccaccuggucugcagaagggacagguagcaccaauuucacauacaugaaaaugccagacuuuaaaaugauguucuauaaauaugaaauguugauugcuaugagauuacugcacauucgacaaaagccgugcacacccacaaauagcuugcuuugcucucuaagauccuaucaacggaguguacuuggccuguauuuagacaaagccggugguguuguuuacaucuuuggcagcuugcucaguguggcuuuucuaugaacaaaaugugugcccagcccggugggucuggcuucucagccaagcgauuguguauugauugguggugggaaaugagauaucuuuucaguugguccauguccaaagaaaaaagugccuaauuggacaucugagaugauauggaaaaaaugagagccugcugcucucauagcaggggauuucugauguauucucuguagugccuaccuuggaauacaguucugugguuuucuuugagcaaagcuggcacuugucccuucucacagaccuaggcaggacaugauguguggcuuugauaaauuaagguuuuuauccuauaagcuggauccuuucucucagugaguacuauauucuguauccuaucuccauuaauggcacuaaucuaugcaaccaaaaccuggaaaccugggucucagccugugucccccuuuccuccuccuaccuagucuccaaauuccacugauucgcccuccuucggggagggagaauagcuccccaaaccauuucauucucuguccccaccaccuaugaaucgcaccggccacucuaaagcaguuccacuagcagcuuucacugccuucucuucuaaccucagacaucugucagagagcuuuuucaaacuagaucugauggaguuuacuuaccugcuuaaaaucauucugcagcuucccauugccuacagaaugaagaccaaacacccuggcccucacugcccuucagaacccggccccauucaucccccaccuuuccccucuuccugccauaguauucagccauugacaguuuucuggaauauaccauuuuuauaccucaguaccguuucauguguucugcccaaaauauucuuccucaucuuuuucuaaacagcaaacauuuuaucauuuaauauucaacuucuauaaccucaccacgucacccucuggaaaaguugcuuucuucuguuugcuugcacugugccuuguacauaugucugucagcauuuaucacacuagaaugaaaugaucuacuuccaugucugccuucccuaccugaccaggagcugaagaaggcuagggauuccacucuauccuuagcuuuuccuacacagggcuuauuaacccuagaaggcccccaaauuuugcugugugagugaaugaaaucucacugggcauaagaccaucaccuccaauucugauauucauggaguauuauggaccauuaauuauucaagauucaagugaggauaauaaccuggagaaauuguacuuuuaaucuugauaauuauggugucuuaauaccuuuccuucuucuaggauuaugaauuaaaguaacuaccuugaaucuuuugugcauuaaagcauaguuggacccaaaaaucaggucuugucacuugccauuccucuauaauagcccccuuuauucauuuaacacuuuauauacuuucucugucuuccucacaagugguccucugaaguacauguuagucugcuuuaagaaugggaaacugagguucaggauguucaguaaccucucugaggacauucggcugguaaauguuagauuugggauuugaacucaaguccauuugacuccagaacuccuguucugucuacuacucgagugaucuucaaacuuuuuugccugugaaaccccuuacagaauuuagaaaaacuauaaaguccaucaaacauuuuaaaucggcauguaaaaauuuuucaucuugaauuuauguacuugccaagaauauaauuccuggcauguuguaaauauugacauuuuuaaauaaaacuguuaacaucauucuuuuaaauguacccaaugagaaauaauaaugauuuaguuauccauuaaaaauauguaaguaaacucuuaacagucaggagcuuuuuauuguuuuuuucuucuucuucuuaaaccuaaguuuuuuauugcaucuucacuuccgccagauucuuuuccuaacauacauuuugucaugaauuauuuuauuaacauacugcaacauauuuaguccauaaguuagaauuaauuuuuaaaaauuuccuguaacuaaaaacaagguucuacaaacauuucagaauuucuccuaaauaagaagucaauuuuuuuuuuuuuuuuugagacagauucucauucugucagccaagcuggagugcagcaguggcaugaucucggcucacugcaaccucccggguucgagcaauucuccugucucagccucccaaguagcuggguuuacaggugcuugccacaacgcccagcuaauuuuuguacuuuuaguagagauaggguuuugccauguuggccaggcuggucucgaacuccugaccucaagugaucugcccgccuuggccucccaaaguuuugggauuacaggugugagccacugcacccaguaccagaagucaauuuuuacuagaaaugcuugucuuuauaagaugaaugagaauuaaaucguacauguauagauggcuguuguuuaaugcuagaaugagacacgauucagcaucaauuuuauuccuauuuuucauuuuuauagcuauaaggacuuugaaaccuuauuuacauaaauaaguagauggaaauggaaguucuguuuaaaguaguaucauacaguucuuagcacuuugaauuuaugugcuaaaaaaaucauaucacagucuuucaucaaaaaauauuuauaaugaccugucagcuuucaguuuaguaagguacucaucagagaauuggaaaugcugcugacuugcaaaaggauuugccugcagucauuaaaguuacuugcuuucucaauccugcacaguauuuugaauuaucccuuuguuuguuacccuggaaaaugggagaaaggcuauaguaaaagagaaugucuugauccaggcacuagucaggcaagucaguuucagaaaaagaagcauauggaaacugaguauguagaaauugauuuucuuaaaacuacucuggcauacgcccuagaaaguuuuguggaccaccugagguauacauacccccgguugaagagugcuguguguccccaugagguuuucuccaguucaaccccuccuuucaccuguccauagguuauugcagccgaaggagaaaugaaugcauccagggcucugaaagaagccuccauggucaucacugaaucuccugcagcccuucagcuccgauaccugcagacacugaccaccauugcugcugagaaaaacucaacaauugucuucccucugcccauagauaugcugcaaggaaucauaggggcaaaacacagccaucuaggcuaguguagagaugagcgcuagccuuccaagcaugaagucggggaccaaauuagccuuuaacucauaaagagaggguagggcuuuucuuuuuccauaugucaauugugguguucccagaauguauagcaguuauaaaaauaggugaaagaauuguuagcuuguaaauacugagagauuggugauuuauauaagguaaucuguuagucuuaaaauaguuaaaaguuuguauuuuuagauuauuauguaguagguuagaucccucuuguuuugacuuccacugacucauucugaacccccuaagcacccaggccagaggcaagaaccugggcuguaacugccaccugacaccgcugacuggcuaaaugcuuugcagaaagugaugaccuuacaccacaaccagcuucuccaggucauaugugccuuaccuccagagagucuuuuuuuuuuuuuuucugagauggaguuucacucuuguugcccaggcuggagugcaauagcaugaucucggcucacugcaaccuccgccuccuggguucaagagauucuccugccucagccuccccaguagcugggauuacaggcucaugccaccaugcccagcuaauuuuuguauuauuauuauuguuuuuuaguagagacgggguuucaccauguuggccaggcuagucacgaacuccuaaccucaggugauccacccaccucugccucccaaagugcugggauuacaggcaugagcuaccacaccugguuuggagagucuuaauuaaggaaauuucccuaauguucauuuauuuucuaaauccagaccguguuucagaauaauccuuacuugagaguagccauuuucuugccuguacuugucagaacuagaggaaauagccaagacuaaugaaaaagauuacucuaacccuuaaaagacuuuuaaauucacuacuagaguggucauuuuaaaaauacauccauguuuuaacuuauuugagccuucuuuaugaguaaaugauuccuccuuguucugucuuucaaaccagcuaaauauuugucacaaaagugcuuuuuucucacuguugccuauuuucauauaucagguuuuaaauaguuuuaauuuuuuaauaaaauuuucucuacguucuauaugcaauuguuauauaucuauuugaauagcugaaggacuaaaauacuuuuuuaagagauaacuucaggaaaccauuauauuuuacuaucugcaugcuguuaacugugguacacugugaaauauguugauuacaaacccauucauuacauaguauaaggaauucacaguauauugacuauauagugucuaaugaucuugggcagauacugucaaacuuacaauaucuauauagauguaggucuuuuuaaauuuaccuagucauucuucuaucauguauauugaugcugaaagaggaacuggucagcuccucuggacaacaaauucuuagucuauaauauuaggagacaucuucuguuuugcaaaugucugugaaucugagcaaccuggcauucugcuuacuggccagaaagcuggcgggugacauuuguaacauuuccucuuugagacucugaguucaccuagagaagucuaagcauaacagcuuucuuucccagcacgagccuuuauagcucucuuuagcucaaccacucuguccauccagccaauggaugucccuuccccuguaccccaauuucaagcuuauuuuaggaagccuugaacuaccauguauccuggcuccuagcugaguuuauuagagguauggagcagugcaacuuaaacucaaguugcacuuacauuuugaauuuuaaaaugaugguuuuaucuguugugugaagugguucacccuugaggaccaggagccuccauauccugacugaaaaccuuuucugagacuuagaguaacagugcuuuugguuccuugaguucuccugucuccagauaccaaaugaccuugacuuuucugccuugugaauucguaguccaaucagcugaaauuaaaucacuugggagggacgcauagaaggagcucuaggaacacagugccagugcagaaguuucuccagguggccucccuuuccaacaauguacauaauaaaguguaugcacuuucacuaauauu

SEQ ID NO: 13168 - RNA, 10246 nt, Homo sapiens
aggauuuucuauugcagcagaccaugcuacgagugaaggauccuaagaagucacuggauuuuuauacuagaguucuuggaaugacguaagucaaguacuuauuggcaccuuaauguuuaaauauauagcuuugcaaaucuagagaguguuuucagacccaucuuaaaguuuguuucagaaguaacagaaguucuuuuggccaggagucugugauuaggccuggcuggacagggcuucucucguaaguucuuuuucuucucuaucccagccagccugaaagggcaaaacaagacacaaauaguugcauuuucuccagucugccuucucugagcgcucccagcuaaauccuuaauguguucagaccccuuuugauguucuggccacuuuuagccucuuguuuacuucagaaaaguuauagauaauaagaacuuacuacucagaaaaccaauggguuuacuuaaaacugaccaucuguucuauuuuucuaggcuguguuuucuuuugcucaacaggucauauccacugaucuugcaauccuaaagcauacuuauuuuucuaaagcauguuuauuuuucuuuuuuucuccagcuuuacugagguauauugagaaauaauuuugucauauuguugauuuguuucccuaaguuaugugagcauuuugcuuuugagcauauagauacaugaauaauaaaauaaucuuuaaauuuagugccuagauaacuuccauucacauugagagaaaaauuuaaguaauauaugucuauauuuagaaaauuugaccaguucagaaaaauacaaaaugaaaaguaauagcuucccuccccaaguucuucuccccagagauaacugcuguccaguuucuugugauuuuuuucuagaaaaagguauuaugaauauauuuaugacauauuuaaaggacaaaaugaaaacagauuuauugaacacuuuugccaggcacuucaaauguuauuuuguucagucuucacaccagucuuaggagguagcuuuuauccccauuucacagacggagaaaccaaagcuuaaugagaugaaguuacuagcuccaaaucccacaguuggcauauggcagggcuggaaccuguauccauugucugaugggcucuaauguagacuuccugugcagagcccccaaauaggguacaaguugacaguaagcuggaagauuugaacagcugagaaaagcaaguugcaacaguuucauuuccuucagucccaacugauugguccaugaggguuguguagucugcuuuaguaggugcagagauuguuuuucaugauuggaguauuugagguguuugauacuuuauuauaaacauguuagaguaaaucuuauuugugauaagucaaugcaaggaucuaagugggccaaggucuauuauauagcagugauaaugaaauaaaagauuggaagcagaacucuagaaacuuuccauuugcuauauggcaauaacagccauuugcucuuauugauuaugaacaaagucaucuuugaauaaucuaaagaaaaucauauaugcauucucaugccaccuuacuccuugccaaauaauccuauaccauuuaaagucauuuaagguucaggacuucaguuaucuuucuuaaaaccucaggauucauaauucauucacucucucucccaucagucucuucuacugucucuuuccccucagagaagcguaagucuucuuuguuccagaauauuucuugcccucugcuccuucgccuaccuccccauugucacugccaugcuugcuacuguuuuaccugcucaccugccauucucucuccccaguacaguguaauccagcugaugcuuccccacucugcugacauugcucucaugggaccuuuccauaucucaugaccuuuucuuagucuuaauacuguuugaccuuucuacaguaucugauacuguuagccaccuuacuguugacauucacgucuucugugauacuagucuguccuuccuccuucuuucuuaccaccuauccuuaauuuccuuuccuagauguuuuggcauaguaagaacucaauaaauguguuuauuuaacugaaugacauauuuauauauguguuuguauguguguauauauaugaaauagcaacaagguucuuuauauuuuucaguacaaauaaacacaguucucuuuuggagauagccguuucuauuuauuaacaaguaccauaauuucagcuaaauguuacuauauuuacagaauugaugaauuacagaaguuuucauuuuuguauuucaaauauuuacagaugcauuuuucaugauauuuuuucacugauuuuuccuccugcuuauuccauuaaaauaggcuuacuacauauagcucuucuuuuuaguaaaacuugaauauuaaguuauguugauuauaguaugaauuagccuuuccuguuguuaaugauucaggcuuguuguuuuuucauugcaggcuaauccaaaaaugugauuuucccauuaugaaguuuucacucuacuucuuggcuuaugaggauaaaaaugacaucccuaaagaaaaagaugaaaaaauagccugggcgcucuccagaaaagcuacacuugagcugacacagugaguaugaguuucuauauuuauauauauuauagauuuuuuaagguaguuuuuaaaaaucuuuuuuguuuuguuuacugaccaguauaauucaaaccagaucugccuaugacuucacauuuuuaauaauauauugaaguguuuuucaugcaucuuuugaucuuuguauuguucuugggcaaaugagauguguuuuuuuuagagacaggcucucugaagccucuaacuucuagguagucuuccugccucagccuccugagcaccuuggacuacacaugugugccaccacacccagcuaguuuuuguuuguuuguuuuugguagaggcauagaggcaaggucucacuauguugcccaggcuggucucaaacuccuggccucaagugauccgcccgccucggccucccagacugcugggauuauaagcaugagccaccacgccuggcccauuugucuuuuauuuuuauuuauuuauuuauuuauuuuuugagacagagucuugcucuguugcccaggcuggagugcaguggcgcgaucucggcucacugcaagcucugccucccggauucacuccauucuccugccucagccucccaaguagcugggacuacaggcgcccgccacuacgcccagcuaauuuuuuguauuuuuuguagagacgggguuucaccauguuagccaggauggucucgaucuccugaccucgugaucugucugccucggccgcccaaagugcugggauuacaggcgugacccaccacgcccggccuccauuugucuuuuagauaagagaauauaagacccugaaauuguaagauauuugccuguuugucucuaacuaauuuuuagguacuauaauuagucuuucagcauccaaaauuuuguucuuuuauuauuuugcuacauuuuggauccagaaaugugauaucauguguuccuuuaaaaauucuucaaaccauuuuguaauaauuaacauucaaauuugguauuuuuauaacuugagcacuuaaaaauguaggcaauuucuuuacauuguuuaucugcauacuuuaaaagagauugauuucagagugugugauuucgugugucccuugauucaaaauaaagcuuuggaaucaggcaggcuuagauaugagucugugacucuaaacaaguaaguggcaguuucaucaauagaauggagauguucacaccuagcccauggagcuguuuuaaggguuuaaaugaaauauaaaguacuuagcacaauaaaugagcauuauuauuauucuuauuauuguucuuguccaguaccuguauuuacugucucuuuagucucguuaaaaucauacuuuggccauuuguccuuucuauaguugaaaacuuaauauuuuuguagcagggguuaggccaauuauguaaaguagcauauaaacgugguaagauuucaaagauguuacuugcuuuucagaauaucuauucccuaggacauuguagcuauguuuuccuuccuuuuguagcaauuggggcacugaagaugaugagacccagaguuaccacaauggcaauucagacccucgaggauucgguaaguuugccuguuuuuaugugauauauguagauuugugugauuuuguauuauguauauaauuaugauuuuaauaaaccuaaaacauuaauguccuaauuaaguaugaucaauuuauuagagauaugauuauuuuuauuuuccacaaauaaucuuauuuaggaguuguuuaauuucagagucucgaucuaaaauuacacuuaccaucucaccaugauuuacuuuuaagucucagaauuaauuuccaguagacuuuuuuuuuuaaaaaagcuguaguuaauacuaaucccaguuucugcuagcacauacacuucugccuugaucuccagucucucaaucaagaugacaguauugcaggcuucagcuggcugcuauagucaaugccaaccacaaaccuauuaaguauuaguaaaugauuacuguuuuuuggugucgauuauucuuaacugauuagacuguauaugagcugauauugauuaauuuuaaauaauuuauaauucaaggcaacuaauuaacuacuuauacccagcccauuagaucuauauuuguucuuuaauguauuauagauuuugaaccuaccuaagucuguucccaagugccuuauguuuugaaauaaacaaguuuuggaaucuacuugugguacuuggacacccuguuauaauuauuucuuccuucucucugcuuuuuucgggggguaucacguaaggucauauuggaauugcuguuccugauguauacagugcuuguaaaagguuugaagaacugggagucaaauuugugaagaaaccugaugauggugagucuacuacuuacuguguucaggccugucuuuaguugauauuuacuaaccaccuacagaggccacuguuguaguaaaacccuuuuggcuacaaguaacagaagucuccacuucaaccagaguuuuaaaaaagagaaaugauuggaagaauaucuggguauuuuagggaacugaaagacagcaacuaggguggcuuuccaaggcacuagacacaggaccuggacagccaucaaaacccuacgcuuccucucccacugcccgaccccaccacuuucuuucauuggccaccagcuuucacuauuucaguguauaucuuuccgcccaaaaauaaguuccuuaaaguccauuuuaucugaugcucauauaaugacaccagcucucuuuaguuuauaaucacaugguauuucuuuuucaucuuuuauaaccuuuguauguccuuaaguuuuagguagguuuuuugaaauagccuacguauggauuuugcuggguuuacauguauuguuauuauuuuacuuagaucucuuucugaacuauuucaaauuaaaauugaaauauuaaauauuucagagucucaaucuaaacauuugaaauauuucacuguuuaauuucaauccuuuuuuaaaaaaauuaaaauacuuaauauccagugcugggcgugguggcucacaccugucaucccaacacuuugggaggccaaggcgggcggaucacgaggucaggagauccagaccaucugggcuaacauggugaaacccugucucuaccaaaaauagaaaaaauuagccaggcaugguggugggcgccuauaguccgccuacucaggaggcugaggcaggagaauugcuugaaccugggagguggagguugcagugagccaagaucgcaccacugcacuccagccugggcgacagagugagacuccgucacaaaaauauauauauauuuaauauccaaaucuucuccccaauaagaaaggaauuugcuucacucuguccucauugugucacuauuaccuagagugggauaguauugauuuuauuuuuuaaagauaauaauaaauauaucacgguguuugaucacuuuuucuucauauaucucuuguagugucuccuuugagacaggaucucacucucauccaggcuggggugcugcaauggcacugucauagcucacuauagccuugaaacuccugggcucaaacaauccucugccucagccuccuccuaaguagcuaggaccacaggcacaugccaccacacccagcuaauuguuuuauuuuuuuguagagaugaguuccugcuauguugcccagguuugucucaaacuccugagcucaagcgauucuuucaccuuggccucccaaagcacugggauuacaggcgugagccacuaugcccagccuuuuuagcaucuuuuggauuuuucuguucuuuuauuuaaauaccucaaccaaaauggucuuuaaagggguuuuguuuuuguuuuuugagacggaguuucgcucuuguugcccagguuggagugcaauggcacggucuuggcucaccgcaaccucugccuccuggguucaagugauucucuugccucagccucccgaguagcugggauuacaggcaugcaccaccgugccuggcuaauuuuguauuuuuaguagagacgggguuucuccauguuggucaggcuggucucaaaaucccaaccucaggugauccgccugccucagccucccaaagugcugggauuacagcuaugagccaccgcacccagcccuuuaaaggguuuuuaaggcaaaacuuuugagauucuguguaacugaggaugaugccuuuaugucugaaggacaguuuuauggaaaagccuagguuuaauuuccuucagucuugaaaauacucuucuauuuucuuuuugcauaugauguugcuguugaaaaaucugucaauucauguuccuuuguauauucuucuguuuuauucuagaagcuuuuuauauuauuucuuugucacugccugcauucugggagauuuccucaaacuggaauaccaauuagcuaauuuucucccaaauguaucuguucugauauuuaauucaucuauuuuguucuuaaacaccuguuauaauuuugaucucuaauuuucgcuuaguuugcuuaauauguucuuguucuuuuuuucauauugguaauauuucauauuguuuauuacuuuuuuuuuuuuuugagacagagucuugcucuguugcccaggcuagagugcaguggugugaucauagcucacugcaaccucaaacuccugggaucaaacaauaauccaccucagccuccugaguagcugggacuacaggcaaaugccaccauguauggcuaauuuuuuauuuuuuguagagacagggucuuacuauguaucucaggcuggucucaaacuccuggccucaagugauccuucugccucagccucccaaaguauugggauuacagaugugaaccaccacacccggccggucauuacuuuuacaugucuaaauaguccuugggucugggcaugguggcucaugccuguaauugcagcacuuugggaggccgaggcagaggauugggagguucgggaggaucacuugaggccagcaguucaaggcugcagugagcuaugauugugccauugcauuccagccugggugacauaggaagaccuuguuucuacaaaaagguuuuuuuuuaaauuaucugggcaugguggcacaugccuguagucuguaugccuagcuacucgggaggcugaggugggaggauugcuugggcccaggaguuggaggcugcagugagcuaugauccacuguacuucauuucaguauaaacgacagagcaagacccugucuccagaaaaaaaacaaaaauagcucuugguccauuauucuaauauuucuucuguuugaaucuacaguccauugcuuuggggguguuuuaugguuauguuucucaaauuauuauuuuuugccucugagcuuuuuuccccugcaacuguucgcuauucuaacacaucaagcagugugaauaggagaauggccagaucccuguccuuaacaacccacaugaucucaggacaaugggcuggauaagccuaggccagagauuccuaggcaccuagaaaugagacuuaaauuuauuucaccuuccacaaaacaccucuucagguuggaucuucccacuucaucccucagggaagaguauuaguaggagacacuuccgauaguguuauucccuagcccugggcguggagagagggcuggggagaucauucggcccuaccaguuuuucucaguuucucacaagcacaaggcuccugcacugcccuuguuuacugguaaggacaucugaacaagcgagagggcaggugccgaugcacacagcagugagggaggagcaagagcaaaacucuguucucucgcagccauuaugcacugccuucugguccaggccagaacuaccaccucccacacagcccaaguuaaaacagucacccggccccauccucacccauucuccccagcugucaccagccggguuucuuucuuucuuuccuuuucuuuucuuuucuuuucuuuuccuuuucuuuuccuuccuuccuuccuuccucucucucccucccuccuuccuuccuucucucuuucucucuuucucuuucucuuucucuuucucucuuucuuucuuuuuccugcauuuuccaucuauguuccucuaggauugaucuuggagaaaggaggcagagauaagagucaaaccaauucaacauaaugguccccaaauaaauuucugaggucauauuuuuccauuuaagcaaacagcucugacauacuagacucucaaucucaguuuugaauuccugggagaaagacucucgcagagcuuggguugccuaggauaguauuuaaaaggguuuguaugacccaagcaucugggucuuuugguuguggggguaagccaugcuaccagcucccuucagcaccucccuauuuucuuuuucuucuuuaaaauaagacaauuucuguaacuacugaacugguagugugguaucaugaaggugaggcaaaugccugauaccuaaaagaugcagccagucccacaguuuauuucaggagggcugguauuugcaaugugugcaagauaacauuuuagucauuaugaaaaguaugacuuuucauacuuuucugacaauaagaauuuuuaaaauuuaaaacuguaaacaaaauaauguacuucauuaaaaugcaaaguaaaucuuuaauuaauaaaaguuuuuaaggccaggugcagugguuugugcuuguaaucccaccacuuugggaggcaaggcaggaggauugcuugaggccaggaguuugauagcagccugggcaguacauugagaucccgccucuacaaaaucaaaaaauuagccaggcaagguggugcgugccugucgccccagcuacuuggcaggcugagcucaggaggucaagccugccuugggccaugaucaucccaugcacuccagccugacauucagagcaagaccuugucucaaagaaagaaaaacauuuuuaugguguuuucuuuuuuagucuuuucaauaaugaaaauuuucauuuuacagguaaaaugaaaggccuggcauuuauucaagauccugauggcuacuggauugaaauuuugaauccuaacaaaauggcaaccuuaauguagugcugugagaauucuccuuugagauuucagaagaaaggaaacaaugugauucaagauauuuacauaccagaagcaucuaggacugauggaucacugucccgauucaaauuauucuucaguccauuuccccuuccuauuucagcuguuccuuuucaccuaacuguucagucauucugguuuucaagcagugcuuuaucucauguccuugaauauaguuguguaacuuuauuuuuuagguaauaauuagaacaguucccuucagaggcugcauuugccuucuucugccaccuaaauauuacuucccuucaaaucugccuuugaaucaucauuuuuaaaaaaaaauuaacauguuuuuguuguaguuaucuucugggguuucaauuccucagaaacaacuuuuuucacaacggaaaggaaagaacacuaguguucuuucaguaaaguacaaaguguuuauuuuacaaaagaguagguacucuugagagcaauucaaaucaugcugacaaggauacugauagaaaaagugauuucuucuuauuauaaaguacauuuaaaguucaagga

SEQ ID NO: 13169 - RNA, 437 nt, Homo sapiens
uaauauccucaacucgagugggaaucuauagggggcuuacccaugcccaugacuuccccaucccaucgggagcucccugagaacagggaaaagugccuccccucuuaucugggggcgcucaaaggaccagcagaggguuucuucagcggaacacucucugcuccccuagggccugggcugcucacauccaucgcacugaggagggucccauccauugcacugaggagggucccauccauugcacugaggagggucccacuggggggcuccuccuccguccuaucgagaguuaucccagcgaguguuggcggggacugagccuccugcuugagguaguuguuuuuacucccaguccccaggcucacgagccccacgcgcgcucaaucugcccucccgcuucuccucgccacuccgaguucugcgcccucgagauccag

SEQ ID NO: 13170 - RNA, 26393 nt, Homo sapiens
gggccucuccaaguuugucgggaccuucuuccgaggcagcggcggcagcagccagggaggccggggcugcgcgcgggccgggggcgggggcugaggccgggcccggggcggcggggccggcgccucggcucuccuccugcuccugcagcagccucugcucccacugcggcuguggucccccucggcgcagcucuccgcgcugcgcgcccgcugagcccgagguuccccggcccauguacuggaagcaugagaacgccgccccggcguugcccgagggcugccggcugccggccgagggcggccccgccaccgaccaggugagccggcgaacgacugggugagcggcccgggccggggucgggcaggguccgggacccagccgggccgagcaggguggcgggcgguugcaggaaggagggguacgagggugcgccugugagugugugcuugugagugugggagcgcgcgcgcgagcggggggggggggucgcggaaagcgggaacacauuaugcaaauguuggaggaauuucucaaaaagcgauuuaguaaagacacaggcgaaucaagaggaggcgaggccgguauuguccgucugaauaggcgcugauagcgccgaugcgccggggguugugccggcgcagcgcugagaaucccgacgcggggccgguacccggcgcgccgaggggcuggagggugcuuuuuccuccccuugagcgccucucuuuucucuuuuuggucccguuucgccccgaucucgcucucuuuuugcuccggguuucccuccgacuggcccucgaaaggcgccugaauccgugucaauauagcugcuucaauuucgccgcgcgugucaggcgggcgggcgggcgggugcucaccgcgcucgggguuuucuuuucuucaaccacccuccgccccucacccaucucuuuuuuauuuucuuucuuucucucuuuucuccuuuuugcauuuugugccgagaggagaagggagcgaggaaggggaguggggugggggggcggguggagagagaaaaaauucgauuuuuaauuacuaccauuaaaaaaucaaauuugcaauucuuugggcggccugauggaucucacugauugacaguuggaauugacacucuggcuaccucuuaucuugggcauucacgacaauuucuaauugcagguaguuugugugugugugcgcguguuuuucuuccccccucagaggcuuggauugcaagggaacuaagcgauuacuucaagagccacggguuaagugcagggagagggggagagagagggaaaaaauccaauccaaauucaaauugcuucauuagagagacaccgcuuuuguggggaagggcuuuaaaugcccacuacaaaguuaggacucauuguucggcgccgguuuauauaacaggcgcggggaggcgcugggcucaggcugugcggagccaguucagcagccgccgccgccugcguucccucccccccucccccaggugauggcccagccaggguccggcugcaaagcgaccacccgcugucuugaagggaccgcgccgcccgccauggugaguccguuuggcccugccugcggugcccaguccuccagcggcccggcccuggggaccuggccagguuuuccggccacgaacugcugcucacgcucugggggacucccggcgggcgccgccccucucugagccucgguuuuccggcagggaauguuggcuuuaaccgcucccagcacccagaaugcgcguguuaaaaguuggggccgucccuuccucuccaauaggcccuuccaucccuguccuucagucuacggcgcauuguccuggggagauuucguugucaauuggugcucgggggccccagauuugucuccaaggcagccccaacucugggugcccggaucagcgcuccucuccuucucucccccgccgcaggcucagucugacgccgaggcccuggcaggagcucuggacaaggacgagggucaggccuccccauguacgcccagcacgccaucugucugcucaccgcccucugccgccuccuccgugccgucugcaggcaagaacaucugcuccagcugcggccucgagauccuggaccgauaucugcucaaggugagacagggguagguguugcgugcguguugucggggcgugggacgcagcgcaggagacugcagggaagcaccgcagguccucuuacuuccaaauccuggcuccacugcugcccgacugcgaagcuuugggcaagacuuagggucugccugagcccccggguuccgucugaaaaauaagaagaguuuauuuccauuucccugagucucaguauuacgggagaaaaauaggggaaucgcaugcaccuucugagcuucagcgccucugacuguaaaugagaccgggaaggcuggggcccggagugaaagaggcccgcgcugagccgaccuccguccccgccccguccccaggucaacaaccucaucuggcacgugcggugccucgagugcuccgugugucgcacgucgcugaggcagcagaacagcugcuacaucaagaacaaggagaucuucugcaagauggacuacuucagguaggcugcggccgccgagccagcagugucgccgagggcaggccccgggcgcauucggaggccacuuuugcggcguguggucucuccuccagaaccccggcgucccgagugcacuuccggcgcgcagcgcugguccaaccugccggcgcucagcggcgcgaacccagagcuccaggcagcgcgccagugccugcacagguuugcgccccggaucugccuucgguccucgcgguccauuggguuucgguaucgucucuggcucugucucggguccugccuaagucucaggcuucaguucugaccucgagcgccucgguggagcucugagguccccauuucuggcccggacccacucggaucccagccgucguccggcugcauuuccagugcguucgggcuucgaguuccaacccuacucggacgucauucaugguggggucucucgcgggcuggacgcugagcugggcuucggacucuugcccuggcucugacccucgcuccgcucuggguucgagucugguccagcccaaagcaccagcgccgcaaccgucucagauccgaucccauacccaagcgccucguccugaaccccaaccucugucuccggcuccaucucaacucauuccccggcgucacuggagugucgcauucugagccuggggucaugcgcaggcccccagcgccuguuccagucccagcuucgcuguuguuuuggcccgacuuuggccucuccagggucuaggccuugccuuuaggccgccaggaugggaagugggagaacugggcacccggagcccugagugggauuaccccgggcugcgcucucccuacugcaggccgcguccagcagccgagagcagccaggcgcauccuccuguccugccgcgucuuggccacucgccugggccucgcuucuagccaugaagcccggaccugaccugauuauggggucgaggucacugcagggucauggccuugucugcugaucccagugggaggcaucaacuggccugaggcuuggaccaccaggccuauaggaucagaggagaaugguggagaaucacuuccugagagggaugcuuguucccaagugcuuucucaaaaaguggagaaagcugcuucccuauaacuacccuccaacccacagacaucuuuccuauccuugcacaggaagacgucauggcuucagucuuccuggccagaccccugcccuagaaagagccucugggagucagggaauaugguggaaggcgaucuccuccugugcacuggcauugagccuccagcgaucuggaaagagaagaucuugagucuagggggagguuggcagcauuuggggcaaggguacucugaaaaccaugagaagcaugguuaaagagacggacucuuccuuuaugggauggauguagaagagugugcagcugggguggggugggggcagcucaaccaaguggccuaggacucagugugcaaggagugccugugugucuguauugucugggaucugugcaguagugcuggggaaagcaucacugggcaggguuggggguauguagauagcauguguguuccuuuauggaccaacguuugucuuuuaguucaugugugggugucaagagugggugucuguaugugaauguugagacugugugugugcaugugugugugcgugcacgugcacgcaaaguggugaggacaggauuacaucuggacuaggaucuggaggugagagggugaggugaggggauucugaaaucccaucauuccacucccacccucuccucugagggggcauuccugcuuaagggccuccacccaggcacugagggaugaagggggugauaagaacguauuugugaaucuggacggcuguguguguguguguguguagucagacagggguuaaugguguguaaccagagugugaugucuccucucacugucccaucugaguauugguuuggccaggacaggaaauggagguuacagucacugucuagccaccucccugcucuaggccugacuccaguugguauaaaacaugccagaugggccgggugugguggcucacaccuauaaucgcagcacuuugggaggccaaggcugguagaucacaaggucaggagaucgagaccauccuggccaacauggugaaacccaucucuacuaaaaauacaaaacuuagccaggugugguggcacgugccuguagucccagcuacucaggaggcugaggcaagagaaucacuugaaccugggaggcggacauuguggugagccaagaucacgucacuacacuccagccuggguaacagagagagacucugucucaaaaaacaaacaaacaaacauacaaaaaaacaugccagaugaugcuugggggcuccuuggauucaucagcuacuaaauuuaaggugccagcuugggaacccagcagaauggugucugggucucucccauagacuaaggcaccacuaggacaccucuccuggcucuccuaacaauagauuuggcagucuuauucacuacuugcccaaauuucuuuucuacuucuccagcccuagcccaugcccaugcuggacugagccuccuuggauacugugcuuuacuagaccuugaaacuagucaaaacacggauccugacuccacuguucagagccuccccuuauucuggaguucucuuccuacugcaaugggguagagaguagggugugcagccacugugggaagaggcaggagacugggcccagucuggccaguagugaccuucgcaaguugcugcuucucucggcccuuaguucgcccuuuccaaggcugucucccagagcugccaaagaggccacuguuggggggaagucucuauaaaggcucccuaaauggugguugguaugaaugccucgauuaucacuguugucaucauuggcaggguggaugcugggcacaagcccaugauggcauuuccccacgcagcuugaggagcagagccugccuggagggaugggacugggccauuucugggcugcagguucugagcacuaaucuuuuuccaaugacaagagcccugaaagcaaaacuaaaccagauuucugguuaagaaaauggaggcaguaaaagcucacauucccuggguugaggguagaauuguggcucuucugaucauuucucccccugcaggcauaacccaucccuggcagccccaccuguaacaaaaauaauaaaacccacaaaaagggaaagaaaaagccgaucgagugccaggcaaggacuauugucugcacugcacugcagcccaagcucuggguggcugcuaugaggaaguucuuccuggagagagugugaaugguggcgugggaggcagaauuuuccucuaaggagcuggggcccagggaggggucacaugcugagguucucuaggcuucuguuuccugaagcccggggucaagggucugguaggauguggacuggagcacucugcccaaagagaggccaagagcucccaacggggcaagggggaggaagggaguggccaaggccccauggagggggagcauggagaucccaugguccucuaaccucuggcauuuuccccagggaagagggucaccuagguucuaucccccaccuugucccuccuugacaucaucuuauagacccuccuucagucuccauuggcagagcuagcacugguggcucagggaauuaaagguuaggaaggaacuccaaguucaccagggagagggucugcaaagcuuagagaagacauggagguccagugcugcuccuggcucauuugcauuguugggagagguugguucucauuggcugcguguccuuggccaggccacuggacucugccucaguuucuccaauucacacucuaaacaggguccuuaccaacccuugugcguuuauccagaucucuaccuccccuuacucccugagauucccagcaggaaaaaaaaauaccaccagaaaaaugugacaggacucuuaauuucuucaccuuuuggugaagaccauuuuucuuucuguuuucuuccaaaaauggaagaaaauucuggaggaagaauagugcuccuuuccgggacauucacauuuccccugcuaccgacaaccauagccccagacauaccugcagcugcugcccuacaauagggcauggcccgaucugcagugcccaccuggcucccccagccugcuggaacaucaugccugcuguauaguuggggagacuaauguccugggaaagugccauugcuuacagugacacaggacaccagucaucauaacguauggaguucuugucuaagccaggaauugggcuaacccuuuaccugcuuuaucucauuuaauucucagguccaccuuguguguaugauacucucauaaucccacaguaugguggcgugggggugggaucgaggaacugaggcccugagagaugaggucacagggcuaagugguagagacuagauaagcccuauagcugccuggcuccgccaucccugccccuaaacacccccauacucuucuauaggugagauauaucagccacccgucugugcaucguggggccccucucugcugauccaaagagucccugcccaguuugguuggcacgcccgcuguguuuucugauguguggcucccugggugaucuugcaacacuuaggcaggagugaccucagaggccugugaauggagcaccuuugucaauaucaggucacugcggucccuggcccuccugccuucugacaaugggaguggggaguaaaggguuaacugcuuccccucguguuuauggggguggggguucagugagugcccuggaggcuaaaguuccucuucccagcuaggcccaaacgacuucaugcaagccccuagccuucucuggcccuccgccuugagcccaagcucugucgcgggcuccagcgggagaagccuacccccucccgcaaagcgagggucccaggggaagcgcagagcgggaagcggccccccaccgcggcagagagcggcccagcggcggccagcuguugggggacagauguugggggagccgagaggggagcugggggaggagccucggggccgggaccuccgagaagcggucguuuuaaccucuuaauugcugguucuggguuuuuuuucccccucuggcuucuuccccuacggguuuaccuagaagggaaggagcagagagaauagguagggccccaccuccaacccaccuuguucgccucacaggaucuaaagccuucaagaaggucuugaaccuaaaauaagugaaccuccguuugaguuucggccucucggcucaauagcuugguaacuaacauuggcguuuccacucugagguuugguuuccuuguacagaaaagggguagcuuaauagugggagaaggggucgaggugaaacucagaugggcucuuucguugaggcucauucauccaacaaauaauuaccaagcgcuuacuagguauccagcauaguaggcugggaaagugagucugacuuggucaagggcgcagggcucccuucauauaaccacgaguacccagauaucucugcucuccuuucaggggguagagggcacugcggugcgcgacgcccaccuuacucuuuuuagcaguugccaggaugagcaguaacaccucuccccaaagcgccgcgcauccuuugcaccuagguccuucacacgccgggauccagggacgcaaggcccggaccucacagcaaggcugggguggcaguggacacacccccuaaucccuuuggugcucugguggcaguuccugcacaucuguuucuugaaguuucguugucuccgccgccgauuucgcugugucuggaauccaguggcuccggccucgcagcccgccugggaaggagucugucguucugucggagccuggaucgauaagccuccucgcgcccuucgugcugcugacuccuguccugggugagggacacgcugcagggcagucugcaaugcaaccaaaccuacauaauccccccuaaccccaccucaaggaucuggcgcgaggacgauuucguaaacugagcugagccacgaggagcacaggaggauccuagagcugggacagcuuccagcauuucgggagacacgcggagcaugagaaaguugcugagaguucacuagcggcgccuaccucggaccaaggguaugaggacacugugacugaccuaccuguguaggcgcagaacggacucgggcgucggggacucgcgggacaggaagaucgcggugcgcggagagucuuugacgugucccuggccaagggggaaagaaucccacgagccaagcgcacagaaggcucagccgcucuugcccggcuucugauggccaugaccuuuccugcuccggcucuguccgcucccugaggacgcacucaccgccuucuccaggagcgugggcccuuggccccgcgcuggagauuccagaaucagcggcccggagagaggacgcggcgcugccagaccagccccgcuuccuguucauccaugcgggauuccagcuuuccucgucgccaguccaguugcuccgcagguucuagguacuuuuugcaccuuggagggggucucaaccccagccucauacccuguggaguuuccggcaaaucacucgccggcucugaaccuucgauuccuccuaugaaaaccggaugccagaguccccaccucaccggguugcgacgaagccgagguggcgcaacguugaggcccaggaccccggcccguaguaaggucucuacgcgcggcugggcucccccuccucccgcagcacaaauaaucggaagccagccuccccucagaggccagaaagugcucccaauccggauaccaccagccggguggcggaacccggggucggcucuucgagggggaguaggcuggguugggcaaagcuguuuccucuccccuuuacugcgggacggggaacagagaccguggucugggcugggcacuccgcuggggaagccgcguuuccgagguccggaaccgccugugcuuaggggagcgguggauucaacgaaggugcucugcgccuccugagggaaccgcgccgccugcggaaggguccugucgcgcuccucguuggagacaguaggguugggguugaaucugcgagcggagacuggcagaagccucugggcuccugcacucaguccaacccaacgcuguuuuuuucaacugacaguugcuugaauuugccaaggcaggcaggcuguaaccagagccuuuuugccggacuguuuccuccgugcacacacaagcgauuccgaaugcucccccggguggaggggugcccgcccuggggacgcagaggcaaaucuucuuggucccccacacccaaccccgggaccccaacucugggaagguggaagggguggaagagaagagccagaaacgaaacauuuacaaaccaguguggucagcgcugagagagcggugcagggugccgugggacucugggggaggguaggucagugcaaaggccugggggugggaaagugcuucagaggaggccauaaagaccugggagugaccuuccauuguggcugacugggacacaugccuggaugguggggcggcauaucuugaagguuagggaggagaugggccugaagaggauguggucgcuuggguuuugcaaaccccaaggguuuuggaccagauccugaggguagaguggagccaccauaggauuguaagcaaggcagaaacaggauuucaugugcaugcuggaaacuuugcuuugacugcucuguggaggauggguuggcaggggcgagacuggaaacagggagaccggggaggagguugacagugaggguugcaugaugggagccuggccuaggagggcaacaguggagauggugagaaggagauggaucccagagauacuugggaaacagaaccaacagcaucgaugauuggcuggaugagggguugaggagagagaggagugcaugauuaugauuuucaagcuucaggggcuggguaagugguggcaccauucucugaaauagaggguguaccagaggaaacaggcugcuaggguugggacagagucacaggugagucauccacuuuaaagaacacacuuucccuggugcccgggaucaggcccugggcugacuucugggauggaguaaaccagacuccgcugccuccuggaggggcuuccagucugguguuggaggcagcugcacccaaauugccagacuacaaaaccagaagggagaaggagaagucguagaaucaaggaaggcuugaggggcaagaagacauucgaucugggcuuuuuauuuuuauuuuugucuuuuuaacauuugguauuauuaauagaaugucacaggcuccagagggacuugcuggguacuuagccaacugcaaagcacuaaacaaacaguaguagucauugcuguugucaucuaguucagugcaggacaaggaaaacgagaacucagaguuaaacaguuugccuagugucacaaagccaguaagugcuuaucugucuguucaucuaagaaacugcacuucuguacagcuggcgcuauagcuuauauucaucucuggagcaggaucgcuaggguuccuaucauugcaagcggugugaccuccugcaaguuacuuuaccucucuaguccccauuuuccucaccugcaaaaugaggauuaauugggauaaucaauguaaaacaauuagaaucuugcugggcaagugguaagugcucaacaacuugcuuauuauuacuauuauuguguuuuuucuaacuugugauguauuuuuaacaaacaaauuaauaugcaaauauaagugaccaucguagaaaauuuggaaaauucagaaaaacaccaagaagaaaauaaaaaucacccaccaguucaucuccuaggugggacuagguguagaguguuguugcguccaagcuaaggcuaaugccugaguugaagacuuagaggccaggagccugggggcuggcgggccauugggugguggaaggaggaagguuggccugucugagucucgacaccccgugccuguccucucgaccugcagccgauucgggaccaagugugcccggugcggccgacagaucuacgccagcgacugggugcggagagcucgcggcaacgccuaccaccuggccugcuucgccugcuucucgugcaagcgccagcuguccacuggugaggaguucggccuggucgaggagaaggugcucugccgcauccacuacgacaccaugauugagaaccucaagagggccgccgagaacgguacccaaccugcuccgccuggcaccucugcccccagcccuuucccaccccaccccaccccagcaccccaggaaccacccacacuccucuaccgauugggcccucccgguauagucccgcaggcagcguagggguggggcggcgaacagaucuugcacuuccgggucgaucuuuugcuuaggagucagaagucacugcccuccuuuguaacuauguuuccuuaucaguaaaauggcguuaacaacagaacaccuucccaaagauagaugagcuagcugauguguuguaaagccaggaggcacucagugaacccuagagaugguucucauaaucgggcagccuacuccaccuuuggacagcucucauuggccugggggcucauccccuccgguugccugggaccaggcuugggccaguccuggagagaugacuuggcucccauucucccauuuccuauccuagcagcuccaagccagagguuugaggaaggguuuucauccuggaccagggucucuaacuauaaggggaaaggaccagguuucugagucuggagaccaggcucucccauacuguguugacauaugagguuuccuuuucucucugggccucagucccuacaucugugcaagacagauacuggacuagaaugaucccuaaaucucuucuggcucugacauugugauuccccagauugcccaggaacaagauccaggucuuccacggauccuggggacagggucacagaugggauggagcugggaaagggcagugcuuggcugugggcagaggcagggacucuuucucuaauuucccuguuagggucugugaaagcugcuaacuucucuguaacagggauuauuuuauguaauccuuacaacagcccuaggaaguagguggcacggccccauuuuacagaagaagaaacaggauuugccaaaaauuacauacuaguagauuugccuagcuccaaagcccagccucuuaacuaccauaccauaccauaucauaccauaccacaccaccuuggcccuaagcucuagggcaccuuaaucagaucucauaaagccaaggaggcuucugggauguagcugccucuguuuuaguuucccaucuaaaaaaccaacacaccaauccuugcccugccugcuuuccuaggggacauuaauaccacagagugucugcccaacccccaguuuuucuggggaggaguaugaaccacccugccucaacuucuaggucccagccuggagacuagucagggaccgcaagaguguuccuggccaugggcauaccagggccaucauuuucuccugccaggaucaggacuaagugggucuaagggggcaucuagugaacuuggguuucacuugcugccugcuuaucugcagugaugggcaaugaaauuaucugcaguggucagcaagucagcaguagagcugggauggaaacccaggagucagagcuuucccacacugugguccaucagcgaccacaggcuccuuccacacaugguccaaccaggaccaccuguaguuacaaccuugccaauuacauccuagcucucacagccacaccuguccacagacuuaacaugcugaggaacuugaaagcuggggccuccgaucucucuuacugaucagcccucaguauuggcuacuguuucacuuuuuaaacauaacacacacacagauacacacacguucauuguagaaaaauuagaaaagacgguaagcaaaaagaagaaaauaacgauugcuccaaaugcugccuucuucauauuuuaauguguaucuucucagauuuuuuuccauguauguuacaauguuugcuuuuuuccuucaacauaauuuuuuccuaauuaaaaaguuacaauaaauugugaacaaugguuauuucugagugcuggaauuacuggugauuuuuauuuucuucuuugugcuuauggaaauuuucugagauuuugaggauauucagaacaaugaaguauuaaaaauaaaaugggaauaugguuaguguuuuaguaugacuguaaaaguaauaugaguggaaagagaauaucuaacauauacgccgguuaacaaaauuaaaccuuacagaaguaaggcaacauaugauuguuuuuaaauaccucaaaaguuacaggaauacugaaaguaaaaaguuuccauaaucacauuccugggaaguaaaccacugccaacaccuuguuguauauucuuacaaccuuuuuuccuuccgcuuauuuuuauaaaauuaggagcauaguuccguuacuugcuugcuuccuaucuccucuagccuuuggugucccccaguuucgccagcagggagcccaguuugggacauuagggucagcuagcuuucggauucuaguugaaagggccagggcaggggcuuuccuucucucugagccucaguuuccucccauguauaaugagguaacgccaccucuccuuagggcuguaagacgugguccagucguguaagaaguguccaguacuaagcggacgcucagaaaccccuuccccaaagacugagcucagggacuaggacccugggaucccugcucccagccaacucccgcuccugacccuuccagggacaagcuccccccacccccguccuuuccaggcugccacuagaagagauggggacgcguggucagcugcuucuaucgcccccagggaacggccucacguuggagggggcagugcccucggaacaggacagucaacccaagccggccaagcgcgcgcggacguccuucaccgcggaacagcugcagguaccgcugcaagcagugggcggcgggggcgggggccgggccgaaagugggcggggccgacaaugucuccuggcuccgccccucgggccggacccggguggcggggcggggccgcagcugccuggggcguggccuguggacuggcgccgcugauugggccggggucucggagucucugcgugcgagcgccucaccgcccuccccgccccgcagguuaugcaggcgcaguucgcgcaggacaacaaccccgacgcucagacgcugcagaagcuggcggacaugacgggccucagccggagagucauccaggugggacgggggugggcggggccuggggaccgcgggcacgccccggagcucguagcugggcucggcgcggaggguggugcgugcacguggccauccuucuccaggaggcgacgaggcagucccgccuggggucucccggcggcgcguccgacucuuuuccucgaggcugaggcugccgaggcugucguuccaggugugguuucaaaacugccgggcgcgucauaaaaagcacacgccgcaacacccagugccgcccucgggggcgcccccgucccgccuucccuccgcccuguccgacgacauccacuacaccccguucagcagccccgagcgggcgcgcauggucacccugcacggcuacauugagaguaaguaaccgcagcgccgggagccgcugggccugcggggagggggcgcggaggagcgcacgugggcggcugaggccgaggcgugggguggagggccuuggggagccucgugggugaagaagcgggacccgaagucauuuggaucuaggaguugggggaagaagggucaaaucuucggcucugccucaguggagcgggauccuucauagaggcaagcgauucagcagccauucaaaaaaugccuucaaagcacccacaaugugccagugcccggagacuggggagagaacaggcuggacaagguaccuacucuguggagccugcguucuggugggcauggaaaaauaggcagaugagugugucguuuuaagugggaugauuccuguaggaaaggugcuggguaggagugacuggagaugcugcgggguggaagggaaggggcugggcugccuuucagcaagcagagacugaaaggauggauaggauuuagugagguaccuggagugggggaacggaaugcacgcaggcccuggcccagaaagcaucguggcauggguguguucuggggagcagaaggccagugugaugggaguguccagggcugugaggccuuaggcaagucaccuaaccuccuugagcccugguuuccucaucuguaaccugggaugucaauaaugccagccucacaggguugugagacaccauucaugcauucaguagcuauaucuugagugccuucuguguucuuugcacugggauacgacagugaacacaguagaccaaagcuucugugcuccugggguuugcacuccagcaugggagaugguggagaugauaaaguaacagggagggagcaggcauguccguggcagggaguacuguggcggagaugcaggggcaagcgggucauggugaagugacuugugagcgggaaccuggaggagugagggaggagccccggggauuucuggaggaugaguguucagugaaucugcugcugagcaggugccuaucacagauugucuuucccuuugaaguuguucccaucaauuguuuccucuaagcugggcaugaccaaaaaaauguaaaugacugcgaugcacacagacacaauuccucccuucucuggcuccauguaagagggaaaaagaagggaaaucagacagagaacugcugcuuacugaccauaugccauauauucuacugacugugucucuaaacaucagaggccaccaucuccuugaauagaugaggaaaccaagggcccacuguaaguuagugggagccgguaugccuuaaugaucgagugugggcuuugguuucagauugccaggcuucacaucccagcccugccauuuacuagcugugugacagugggugaguuucuuagcuuucuugcauacucauucccucaucuguaaaaaugaggacaacaguaucucaaagcaguguucugagcaucaaacgagguaacugaaaauccucaacauucagcaagugccgcauaaguauuggcugcucuugugauggugggagugguuuugguuggcagaacuaggagugcagagcccugucuucgcaccaggcugccaguuggaaaccaugucucuuuauauaguuccauuucugaacuaucugcucaauaggagcgacauuuucccccuuucuuuucuaaacaauaacuauauucaggcugcacagagccuguuaaaggugccaaggaucaggggcgcuauaaguaccaggggucugagcuaccugcuaauacuugguguagagucaauaagaaaucuagaugaucccuuuggacuuggggccaugaccuccagagucccugccaggacucuguccauacacucuguugaccaaacuuagaucugucuuugcugcuuagagaagaggcugaggugcccucuccucuuacccuugugguggaacucagcuuggggaagaagagguugggggugugugcaccugcaccuccugcugcaugacugacugagagucaccacagcaguuugcucuaugguaaacuacagucauggaguugugaauuuucugaagccuuaagcugggaagcuaaugaaaguguuagaaccagaccccagaaaaaugaguuuuucuguagaguuugcucugcgguuaacuaaagucacagaauacugaguuuccuggaggcuucgagcuuggaaucugauaaaagcuuuggaaccagaccccagaaaaaugcagauguacauacauuuuccaaguaaucugaaguuguauauggacuccuugaacaccccaggugaagaacucccaauuuaauauaacuccuuuauucuacaaaugggagaacuguggcucagaagggcacagugaauugucccgguuuauauaucaguuguaagugucucuacaaugcccuuucccugugaccaaagagaaugaagccuaaagaagagaccagcaauggacuucuccgcuguagugauaaacaggcugaagcaugagaaauuuggauccgacccaaagguggacuuuccccaacaguuuuagauguuggaauaugguauagaaauucauucagcacauacuuaagaguaccuacuaaaugccaugccucacucuaggugcuggaaauccacaaagaucuagaaucuagaaaacauacaaaaaauuccugcccucguggagcuuugcauucuaguuggcaaagacagauaauaucaaauaaauaauaaaaauaugcaguaagucaggcugggcgugguggcucacaccuguaaucccagcacuuugggaggccgaggugggcagaucacuugaggucaggaguucaggaccagccuggccaauauggugaaacccccucuauaccaaaaaauacaaaaauuagcugggcaugaugguacaugccaguagucccagcuacucaggaggcuaaggugggagaaucacuugaacccaggaggcagagguuguacugagcagagaugaugccgcugcccucuagccugggugacagagugagacccugucucaaacaaaaaugcaguuaagucagaugauaagugcuaaggaaauaaagccgggaggaagacagggaggguaggagauagguguugguguugguugcagucguaaagagagaggugacauacgaguacagaguccucuaagaggcauggguaaagucauggugauaccuaagagauaugaacuuacugagggagggucugaauagauggggcacagccuugcuugcagggccugaauaggcaggguacagacuugcuugcaugcgcaugaauaugaaaacacauauuuauuuaggaguguuuaucagugagcuagaugguuauaccucacucucacguagcucuuuauaaagagcaucacaauuggccgggcacgguggcucaugccuguaaucccagcacuuugggaggccgaggcgggcagaucaugaggucaggagaucaagaccguccuggcuaacacggugaaaccccaugaggucagaucaagaccauccuggcuaacacggugaaaccccgucucugcuaaaauacaaaaaauuagcugggcgugguggugggcaccuguagucccagcuacuugggaggcugaggcaggagaauggccugaaccugggaggcagagcuugcagugagccaagaucgugccacugcacuccagccugggcgacaaggugagacuccgucucaaaaaaaaaaaaagaucaucacaaccaacccuacugaaaccuugcccagggcuacccaggagguaaguggcagagaugaaacugguuucagggcuccagucuguagagagcacggggcaggugggauccugugugcagccugggggaugagcuccaaggcauccucucguccacaggucagguacagugcgggcaggugcacugccggcugccuuacaccgcaccccccguccaccucaaagccgauauggaugggccgcucuccaaccggggugagaagguaaauggagccagguugggucuggugggucagagccacccugcuggggauggguuucuggcagcauccucuguuaaccauuugguaccaugcugcgcuguggcagacccugucugcccggccugcugagacccccaccgcacccccacagcagucacuggagcggugguugcuaguguguucugugugcauggccacuccgaaggccuccuugcagcuccccacuggcaguuugcccugcucugucuuagauuugugaauuuccuuuacucaagcuuuaaguuccagggagggcuuauaucacucaucaccccacuucccaucaucucacugguuucuccuuuucauucuugucuguugggagugaauauccugagcugaugggguucagggauagcuggccagccagugaccuuggucaacuggcagggccuccucuguggagccaggauuucugguugucucaggcuuuaggacugcacuucuaaaagggugcuuagcuguccccauuccagggcuucaagguauuauuucugaagcaaugcaacccuuuguuuaaacuuguccauagugcagaugaagguggauggagcugcucugaaaccauggagagaggaggagacuuaccucccucccagcuccaagacaccucacaguuagccucgaaagccagugcugucagacaacccuucauuuuagaaaugggaacguugaggcccagauagcucaaagucagagauuggaugagaaccuugcuuuuuuuuuuuuuuuuuuuuuuuagacagaguuucacucuuaucgcccaggcuggagugcaauggcgcaaucucggcucacugcaaccuccaccuccuggguucaggugauucuccugccucagccucccgaaguagcugggauuacaggcgccuaccaccaugcccagcuaauuuuuuuguauuuuuaguagagaugggguuucgccacguaggccaggcuggucuugaacugcugaccucaggugauccacccgccucagccucccaaagugcugggauuacaggcgugagccaccgugcccggccgaaccuuacauuuuuuaauucacugacuuguuuauuuggagacauuuccuaugucuugucugugcccagcauccaugaaucuguugcuaggaguggaaacaaguaaaguguggucccuacccuugaggaggccagagucuggagggggaggcagaucccaacaguuacaauacagugugacaggggaagccaugggagcuggggagggggaagggggcaaaggagagaggcagggaagacuucccagaagaggcaaccucuaaggccaggccugaaagcugaggcaucagggaaggcaugagacaccagagcucucagggaacccugagccauucagcauuguuggcaggcaugucugggaggaugagaggaggaaagcgagagccuugaggcugccagguggaagagucuguauuuuaugcugcggcagugugggguccuggagggccugcugcagaaacaucacuguagcagucuucagagacugcuggguuggaggacacccaguaggaagcagggaucccuggaggucaguggguguggcagucccucggagggagagggucagagcauuagggcuggagucaggagcccuccaguucagcagaucccggucuuggugugcucggaaucaccugggcagcuuguaaauauacagagauuccuaagccucgcucucagagagucuguuggggugggauauagggaucugcgaguguaauacucagccugugugauucuaacgggcagccgggguggggacagcuccuuuaggaugguaccucuggcucagccuccugauugagcucaguacaccuaguauguacugagcucucugugccgggcaccacaggagaauguguaugguguggagguacagacagcccuggacagauacauuuguaaauaaaugguagugccuaacguaaaauccugcagaaucuguagugagugagcaugccccaggaacaccaucgccgcugagacugucacauccauaggaagagcugccguuugcugagcuccuucuguucaaggcagcuacuucucacauggcaucugguucacaccucccagccacuuuguggacauagagauggccuucucauuguaaagagauaaacagauuccgagaggugacaugacuuguccagggaugcagcgagucugucggacucugaagucugcgcggcucaguaaucacuuccuuuugugcagcacuucauuguguacacagcccucucuccgaccucauccuucauagucucccugggagggugauugcgaugaccuccauuucacacuugcagaaacggaggcucagacagagcagugcucauccagaaucacaaugugagcaugggcagaacuggccgggauccuagagccaccugccucagagcugucccuuccugugggaggggauucauccuauuagaccuggcucugggacugcagaagugagcugacaugaucccugcccucagggagcuuguggcuuagcacagggugugggcaguuacauugcaggggaaugggcagcuggaguaggcgagaaacuugaccuuagaggacccagaagaggaggcagugagcucuaggggagagacaggggacaagaagaaggguguuccacaucaagagaaccgcaugugcaaaggcccagaggcauggaggagcuugggccggaggggacccugggggacguucaguguggcugagguccagggaaguggggagagccgacaggggccacagaacaaaggaucauggaaagagggucuuggacauuauguggagggcagggaugggcccuggagguacagagggcugggcucagugcuuggagaggagccuuugccuccugguugcucagcuaagcuugugguucugucucauucagccugggggaugagccaugcugggggcugucagauuuggcuauagacaguuucuggcuucuggauuuggcugcugagccagaguuuucccuugcugggcuguguccccaacuuugcacccagaaagucugcauuaaagugucucucccuccuucaugaccuucuguccucucacugucaggccuuuccgccagcuccuagggacuuuucuuguccauaacucucaaauuccuggggcuuggugggcggcagggugugguauguguguggccagcacaggauugucugggcuuucuuccaaguccuuccaggccugagccugccuagcugugaggagacucaguguccccauggggcuggccccugaacccacucaucuagaccagcacuggccuggccaggagaacagugcucugagcacucaggggagcauccccugccuccaccgcaucgucauuuggccacacacaccugugagguuccagagccacauuucuuccugguuguguccccugaucccacaaauccaacacuuggaaaguucuuagaaaucagggcuaagcugucauugaucaguggaggagacugagacccauggaggggaaggguccuaccagggucgccacucuugagagagcuuuuccuaauaagggcuaaaagccaggcauucuggaggccaaaguggagcaguggccaggguggggaaggaaugcccacccuggccacucuggaguuaggccagcucggaaucccagcucugccaccuccccugugagaucugggaaugcaauuaguuucucugagcugcgguuucuacaucugcaaacuggggauaauaauaguucccacuccguaggguugcugcagagaauaaaugcauaauguguguaaggagcccagcacagagccuggugcacagaaaaugcccccagguguugguuaugaucaugaucacuauuauggugaucaucaucauugcuuuccuccaucaccuccuugugauaaccaguucugggcaaguaacauuccugaucagaaaagggaacagccauguagucaugcccaccagaugccccucacacuuuacugugaaaugacacauugccauugaccagccagccagugauccuugaccugaacuucagggaacuggcugugucagcagcagugagaugucaaccaagugcuagaggugggagugggagggggaaagggacagacaguccugaucucccacuguguaucgggcacccagugugucugagccacgcacuucuaggcuucgugcaugugaagauuaagcgcaugugaagugcuuagcccguggcccuguggguaauaagcagucagccacuauggucacggugaccuuggaaagguagaggcaaugugcuuugguagggagagcuugcugugagccaggccuggccuccagugccagguccuccuccucgcugugugcccacgagcucacucgcuuccaccucuuugagccugagugcccuccuuguaaaacagaacguuggaacucccucacggggcuauggugcggcuuccgugaaaucaggcacagaaggugcagggugaaaugcccagaaggcuuuugcugcugcuguuguaucucauugaaucucucugauucucagagagagauuuugucauccuuguuuuaaagaugaggaaacaggcucagagaggugcagugaguugcccaaggucccacagcaagucaguugacagagccaggauuuaaacucagaucugggcccugaguccacccuucuucucugugccuuugagguucucuggggggcagcaggguggggcaggcccccagcucagccaccucccaugcccuccucuugcaggucauccuuuuucaguacuaacgcugccggcacuuccgcaucugcccgugggcgccccacagcugccccucagccgcugagauccaguguccaagcugcggccaggaguccacccaccuccgcauccacccccguccgccauccugcccaccaccaggucgguucccgaggccuggccuuucccucuccugcugagaaccagaacccaccaggagcaccacagaguccuccucuuggaaggcagaacucccugaaaucuggaaucaggguggaaacagccuguuuuucccauuuaaacaggaguccucuucaacuucagcugauuacaauaacaaaaggcggaauugaauugugcgaugccaacggccuucucauuuacagguuuuuuucccccacauuggccuuuauuuacuacuuccuuggaaccaucucugaauucugaauagcugacaacccccaauguuauccacucuguugcuuuugucuggaaaacucuacaguguuugugggauguccccaaaggaaagcuauguucuaauuuuaucauuuccaucugucugguuaugucaaguuaauucagaaagagaagagacagugaccaacccugagaggccuaauagggcagagauggaggccugcccagacuaggaggcagcggggauagacagggaauggggagaagaaagacccccauugguuuggaaaucaaggagagggcggugacauauuggaccagaagaggcacuagccauuuuaaggagaggaaagagaaaacucuggggucagggagagacccuacccccaccuaauuauccagcauauauguaagaaacauagcagcgaugguauucgaucugugccaugacucuucugaauguuuggacagguuagaguuggggaccccuguuggccacuuguugaccucucauaguggugcuugggccaggucuucucaauggaaggggaaucccuuauaggggagagggaacagagcccagugaaauggcagucagaauguuaacccuggauccaucucuaaguagagagagggugcccauugccuaggugagugugccaagcucaggauuccaacuggugccucugagcuucccaaucaauacuuccuggagccagccccacccaccccugagaacagaggucagacacagcugcguaacauccauccugcuacaacucuuccaccccaaacaaaagggcucaggcuacacacgaccaugauuuauguuuucaggggaugcccauuugucccaagcuuauccuguaauucuagaauuaccugguguccugaugcauuuuccacuagagguugcuaaucagcauguuuuagcccaaguccgccuuccugcugugguuaaccuguuauguugcuuuuggaaggagacucuaagacagggaaagcaaguucaugguacauacgcagccauugucucuguuuuuacccauggcagacauugcuaaucaauggcagcucuauuucacugagucuggauaagguuucagaguucaaaugcuugacguuggcacuuaacaugaaagccuauaggucauucuugcucugggaucuacaggcaggguaggcacaggugcagccuaagaagggaaccugcuuccucucccuuccaaagacagugacagcugacugagggcaaagagcaggcaccacucagaacguggugaguacagcucagcucagcacucagucagugguaacuugugcccagcccugugcuaggcgcugacauuaacaggagcaaccagggcccaauuccuggccuuggagcucaaaucuuuccuuugauuuuugcuccugaucaucaaggccccaguggcaaccaugugguaaguggccaaccaagcccuacccagggucacccaacacacucugccuugagccucuccucagggucuauuccuugcguggauuauguggccguagcauguuacaguucaaacaugucuccacuacccuguuaagagcagccugggaacguacaggccaucaagacuauuuauuuaaauacaaaaaaaggggaaaacacacacacggaaaaaaaauuguaagcacuuuuuuuguaaaaccaaugucuguuuuguuacauaccuuucaugucgugcuuuguaaaugucuuauuuguguaauaaaguuaaugcaaguagaagugcuggcacugaaauccag

SEQ ID NO: 13171 - RNA, 22351 nt, Homo sapiens
gaggugacagcuggagggaggagcggggguggagccgggggaaggguggggaggggaugggcuggagcuccgggcagugugcgaggcgcacgcacaggagccugcacucugcgucccgcaccccagcagccgcgccaugagccgugagugcgaccccggugcccgguggggaauuuucuuggccuccugguggagccuugaaugccaggcucagccccucaucucucuccucugcagggagucucuugcucugguucuugcuguuccugcuccugcucccgccgcuccccguccugcucgcggacccaggggcgcccacgccagguaggcggccccaucccuccccaagggaauccccggucuugcgccccuggccugguuucaacccccuccuuuccccuccagcgggcccagcuuccccuuucugcucgcggugcugagaaagacugaggcugagucuuuuggugggaugggggcucccugaagcccccccggcgguguggccuuggcuaaugggcuaucuaguucuuucaggggaaacagcagacugggaucuggugccaacuuggggagaagggacagucccuauccaucccccucaccuguucugggccccagaugucuaagcagccucugcacccaacaaccccgcuguuuccuauaggggccucuuugggaggaagccgcaggcaccaagggaaaugaguucccuuucuccagccucuaaccgucugggaacccauccugauucccauugccaguggagaaggucuccccuggugaagacuucgggagaacaugggagauggaaauacauuuaggagccgggaugcuucaucugggguuuaagagauccccauugagcaaaugaggaaaccgaggcucaguaggugccaugauuccccaagcucacaaaauacauggugggcccaggaucugaacucaggucugucugcguccacacacuucgcaaggucuuuccacagaaagcugcuucuacccacaauggacccggagccacucuggguuucaugggggagguugauggggaaauuccgcccuucccucccccaugcaugugccagguuccaggugaaggaauucagcuccucgcucagccaaccuuccucccccagcucgcugcuugugugugugcgugugugugagcaugugucccaguuggauauaguuuccuccaccaccuagcuguguaaaaucucuaaaaugaggcccagagagggcaggagggagcagagggaguccgcacuuucugcugugaugcucuaaggaucuggugcgugggggaaagaggaaagauauguacauggauuuuggaucagaccaaguuuccugaaacgggcuuuggguggguggcauuuaggggacccaaagagaggacggagggugcucuaggaaagggauugcguugaauaaaagucugguuuaugggaagaggaggaggaagacucauguggccagcacuuuaaaguuuacaaagguugguuguggacauccaccucuuuggugcucucaacagcccugccagagagaugcguuagacccagucuacagaaggggacucugaggcccagagggagugaagccacuugucugaauccucacagugagcuggugguggggaguagaaggggcucuucagguugccucgcugacccaucuugucagucccuggaucagcccagcacuuccucugaggccccaucuggccucauccaggcacucuugguauacaggucccacccgucuguauucuuuuuuaguccauucacuaaugcacaaugagccauggucugugcuauuuuguuuuuugccuuuucuguuuccuuuuguauaauaaauguuuacacggaauuguuuuuuuuuauccccaaggguuauuuaugccagucuuuggcuggggccuggagacacggagcugggaggagcugacaggcugaugguggagccagaaaugccaacagacugucauccaaggggaccagggcugugcggagcucaugggaggaagcagggguauagggagcccagggaagggagcaggggugugcggagcucaggggagggagcagcugccucucagugcgaagaauugagggaggcuucuuggaucugaugacuuuuggacuggaccucgaaggagguggcgggugggggaaacacuaagagacucgaccaggaaacaccguaaggguaauguggagcaggaggcugagguuggaugcguaauguggggaugagacuggaggccagaaaacugguaccgaggcuccugcaaggaucuaggaaagaacgaaugacugguggagugcaggggcagaaggucuggguugcccucauauuuccaagucugcgaguaaacugagggccaagcuacuugggcaucugccccaggaagccaaagccugucuuuuaccucuagaggcaaaggagaugaagagaugagggcugcacucaccuaagagggcaggcggagggagagaaugcugcuuuugccucucuggugggugaggagauggaggccagccuggaggcaaggcugugccgggggcgcccugaaugcucaaguacuuccccucuagucucuggacuugacucagugcccaucuucuagauggggauagggcaugaccuggcaaccagagcugcaugccaggcagaggagccccaggccagcugacccgggcacauggggcaagaugccagcugugccaaggcugcccgggugccugcaccugcucucgccagcaccaguugggucugugggccgggagagggcuuccccaccagcaggcucuuccagcugcugggcccaguugucuggaucuggugugguggugcuuagguguggggacuggggcccaggccaaaccagucaggguuccccaccuuuuuuuuuuuucucucuggcugccagguccccagagacucucuaaauauuacucuuuaggggauuuggguccugccucuucacugggcaaucuugcagccugacaccucugcauccuggaggacuugguguucccuggcugugccuguccccuagucacgcucaguccuggaccuggagcccugacuuuugggcuaggggguguuccuugcccaaacccuuggaaagguccuggaaccaggcaguucuggacaguccucaucuguggggauggggacuagcagcuuggccuuugggcugcgugugucuggcaugcagcguggugugcugaucaucucugccuccgcgugucuuggggacucagugagagcaaaugggaagguucucugcugauggggcaguugugggaggguuguauugauacaaauaauggagagggacagauuggcucuacccagaguagagggccuggacgucgaaaggaaggccuccuuuagcccgccugcuaaacccccuucaugggauauacagaaaaaugaggcuccagaggugggagggacucacccaagaaugcacagccaguaagagcagccacucucuaauacagcucucccaagcaacuacuuggugccuggcccugugcugaguaugggggacucaaagugaauuagacuugguaccugcaucuccuugguuuucuuucuugaugaacagggguguccuccacugagcauagaacugaguuggcaugaaaacaugcaggauugaaguuagaccgaaggaaggccuuccuguacgaauacuuccuaaagaucugguuguggcaggagauggugaucccccugggguccugguuucauucguucuggauuuucaagguucacuuugaaggaaugugacaaauccaacucaacugggucauccucagucugcaucaaagcgacucucccuuuccaucccuuccccaaauccaguccuggguaccuccaggaguaggaggaggagggagauuaagucuuggcuccgcaacuucaaagcaguggggucugggcaagccuccugcuuucucugggcccuacauuccucauuaugcaauggggagucucaccuaccucucuuagggagugcuggggagauaaaugagcguggguguggaagguuguggacuuggucggcuggagcccuggcuuucuggcugggcugugauggucaggcuguagucuaguggcacccagucuccucuccgcccacccugacaccuuggggcaccagcggcaggcccacuguuguccuuccugggagaacuuuuccugccccagagcagugguguuuauggaaagaacguggcgggggaggcgggaggggggaagcuggaugggccggacugggagggaggagccucagcucccgcacagccucucuuggcagggagggugugggcagccguuccagcuucagcgucuggagcuuguggcucuucugccugccgaggcagagcucuagggccauggcgggaggccuuccggcuccaccucagacagcuguugagggccuggaagaugagggacuccuuuuggucaggcuggaggugaccaaucuccucacuucauuuuauuuauuccacaaacauucguuaagcucuggcuaccacaucuggaucccagaccugguuaagccccaacugugugcauagccugugcugggggaagagaaagccuuaagggaagcgggggucccuucuccuggaagcuuaugguggagaagagcagguugaauuggaacccggagccagggcaagggagagugggaggagggaguguggacauuuggggaagacuucuuggggaggcaaggcgugggcucagcugauuuggaggaaauguauuaaggaggcuaacagccuggaugaaggauggagaugcugaggguuuggggcuaagggaggggcuggcgcagaauguuggagcugcacggaccucuggaguucauuuugagaucccugcuguggcagggauggggaaauugagccuaggggaggccuaaccccugugcccuuagagugguagaacuagaccgugaguccuagcggaccuugugugccaggguugggagcugggcagugggugcuacaggggcuccugggcaggugagagagccaggccagcaggaggggcaagaagaagaguucuagcagggugacaaguccuuucuugggggaaccagaccucugagccagcacgggggcugcuccagaggcuucuuggccuuucugggccuguggcugggggaggcgggggcugggguacugccaggcccuuucccuggauccugccugccagguuugccuguggcugccugauaaagccuuuuuguccagccuucuuccccugaccccucccuccuacaccccugcuggggccauuguggggcuguggggaguugccagggcuuaagcaaaacuauuugcaugauucuugugguccuugcuuguguguguguguguguguguguguguguguguguguguguguguauuugaggugguguugccgucuucgaaguggggaccaagaggacucugcugcccaggucaagcccugugcugugaagugaggagugaggagacugagaccagggcaggggauagggggcaggucuugcccagggucaugcucucugauccuagcacccugagaugacagcauuucacccucagcugcucuggccuuucacuacccuuuugaccugcaauaaccaguugcacaaagaauccauauucccuguaacguuggcucugagcccagauaaggaaguauguuugcagaaaggagcccggcguuuucuguguaaggucagagauggagccuccugccaggcgcuaggaguuuuuggucugcccagcucuguucuguuuccuuggccaaguuaucaccugucccugaaccucaguuuccuucacugaacaggguggugggggugaugguggauccuacugaaccugaggagucuguaacuuugcugcuaaagaaucacugaggcagauuuagcaagggggugguggucugagggaucuggguuagaugccaagagggauuuccuuauagaguuucuccaggaggcagcagggcggaugccagagcuccaugcacccucccaggagauuuucuagcccuaucucuccuauucccuuggucugugaccuucuucuggauccuagagcccagaccccacccugaugugggccaagucugauuccaucaggaaugggggcugaggcagcugagaccuuggagucccccuccuccugcacacccacccucuguccccaggguucuggaaaacuucuuuccuuagacuuggcugcugaggcuguggggguggaguggaagugaagggaugggcauuuggucuggugagacuuguggggugauaggucuggcuuucccuuuuucuggcuucaauuuccccaucugcaauguggacauuaugauaccugcucuucucuaccuucugcagaaauggaggaauggugagggaucucguuuuccuaguguucauggggugguggucugggagaaguccccguccucguccucgucccuuuucugaccgcccccccaccccccgccccggccugcucuugcuacugaacucugacuaggcaggaagugaacgcucuagaagcccguggcugaggaguuuuaucagcucuuucuuaacuuucagugucacagccggggaaucuucuccugccgccguuugguggcaauagggagggagggggcgcuuccccugggggccugaugugggcuaggcuggaguuccagagcagggccuggaaaugucaggaugggugguuuauguucacagaggugggaacagggguccccuugggggaacccugaagcccuggcacccagugauucaggacggagcugcgacuuaaguccaugccucuggccccucauucccccaucaggggcuagaugggggucaggaggccacccuagcauggucucugaccuccauuucucacccacagugaaucccuguuguuacuauccaugccagcaccagggcaucuguguccgcuucggccuugaccgcuaccagugugacugcacccgcacgggcuauuccggccccaacugcaccauccgugagcugggccuucagcccucacuccuuccgucuugagcccuucugcuccccgggcccuuucuccuagacccuaacuuccuacccuccucucugaccauggcccuguucuccuuccuugccugguucugccccucucccugaccuggcuucagcaugagcucucgcucuugguccacccucacucccugcuucugaguuccauggugagucuucaccacaugcccuggccccuguccucacgcccgguucugucucugucaugugucauugcucccaagguuccauccuuacccacuuccccauaggugcuacucuguuccacccuggcccuuguccucagugccccaucuuccacccuggcuacuucugguucugguaggagggaccaacugagugacugccauugccccugcagcuggccuguggaccuggcuccggaauucacugcggcccagccccucuuucacccacuuccugcucacucacgggcgcugguucugggaguuugucaaugccaccuucauccgagagaugcucaugcgccugguacucacagguggguguggggcagggcccccugaccugggggagcaagcaagccugcuaguccuuuuggauucuuggcaucugauaaggguaguggguggggagagucuaugaugccugauaaaauaagccccaacccaggaggaggcaagaacugggauggagcuggggguggaaacacccuugucaccguuauuuuugcucucugcagugcgcuccaaccuuauccccaguccccccaccuacaacucagcacaugacuacaucagcugggagucuuucuccaacgugagcuauuacacucguauucugcccucugugccuaaagauugccccacacccaugggaaccaaagguaaaauggggugaggagcugggccuggggauuacaggaggugcucaguucuucucuuugggaaaaaucaggcgaagaacaauuauugacccaauucugcagauggcuagaccaaggcaagacauaugacauguccagagccugggcugagaacaggcaagggcagcagagggucuugccugaggucaccuagagucagaccaauguuuccauaguuccagggugccucuuugcuugauccuuuucuaaugaucaguuggguccugccgggguggaagugacuuagaaguugagauguaggaaagaauagugagcuauuuauugggugcugucucuguguuugggucuuuacagauguaaauaguuuuacaugcuucaccaguguaagguacaaauaagccacauuuuuuucuuucguuacucaagacuucacuuagccacacuggcaggggucuuccuuguaagaccuucccaugccaccuguaauuauccaaaaaccugggauauuauucauuucagacccaucaguucagcaucaaguacagagaggacaagagaggcucaucaguccacugcugcuauacuccaguuccugccacaugguggcacuguugaaugccaguccugugcagccucaugguuaugugcuuuuuuggguucaaaaccuugcaccaugucccugcuugggucucaagagcacuacugugacgguuuuccaucauaugguuagcugcuuuucccaaagcaugacuauucuaccaggauagcugagucuugccaacuuugcugaaaucaugcuugcccagugucagugagugaugauuccaaauuacgguugacagaucacucccucuaacuucccuuuugguggauuuucuuuagggguacuugauauuuuuuccugccagaggaacccagucagccaucuuaauccaaguaauuuccauugaucuugaaccuucaacaucagggcucacaucuugaugcauugugaagagaugccuuuaccagaacucaaaaaauucuauuccuuucugugagggcaauugggugacaacucauuugacacugacauaauuaaggaaggccucucaauacuuauucuaaggaugacuugucuuuaugccagacauagaaagauuggcaucauuuaaaauagguugacacaccuauuuuaaggggagcaagcaagccugcuaguccuuuuggacucuuggcaucugauaaggguaguggguggggagagucuaugaugccugauaggugguggugugguggcacacgucuguaaucccagcacuuugggagguugggguggguggauugcuugagcucaggaguucaaguccaaccuggaugacauggugagacaccuugucuacaaaagaauacaaaaguuagcugggugaaguugugugugccuguagucccagcuacucaggaggcuaagguggguggaucaauugagcccaggaggucgaggcuguagugagccauaauugcggcacugcacucuggccugggcaauagagugagacccugucucaaaaauaaauaaauaaauaaauaaauaaauaaauaaauaaauaaauagguuggcaaacuacagccugcaggccaaauucggcccaccucuccauuuuuguaaauaaaguuuuauuggaacacagccacacacauuuguuuaugugucaucugugacugcuuucccgcuacaauagcaaaaacugaauagaugugacaugucuguauggucugcaaagccuaaaauguuuacuaucuggcuuuuuccagaaaaagcuugcugaccuaugauuuaaaaaauucuacccacugguucucugccaugcuuacauuaucucucgcaguccucagauucacuguaucaaauggguaucauuugccccuuuuuaaagauggagaaauugacacccagagagaugagaugauuuaucuguauucacacagcuagcaaauagcauagucaguugcaaacacaggcuaccuugacucagggcaagggaguucauguuuguuuuuuucuguuucuuuauuucuuuuuggugaaauguuucauuauggaaaaauugcaaagauacacaaaaguugagagaaaagcagaaugaacuauguacccaucuuucaguuucaacauuuacccacaguuucuucaucuuauuucauuucuccccucucauauuuuuauaaaguauuuuaaaucaaauucuaaaaaucaugccacuuaaaauucuaaaaaucaugccacuucacccauaaauacuucuagggucuuuugguagagaguggguuacuugguggugguggggaggugguccugaggaggccacucugggcuuccugcuugggccaguuugccuggugagcccagauguccccagggcagcaagauccagauaggagaagcuacugcuguuuccuaccccccaaccagggaagaagcaguugccagaugcccagcuccuggcccgccgcuuccugcucaggaggaaguucauaccugacccccaaggcaccaaccucauguuugccuucuuugcacaacacuucacccaccaguucuucaaaacuucuggcaagauggguccuggcuucaccaaggccuugggccauggggugaguaccuaggaggggcucaggacugcucuggaccuaauuuggcacgcguaugucaucgacagugggccggcacccuggugaccugagggaaccccucucuguccacagguagaccucggccacauuuauggagacaaucuggagcgucaguaucaacugcggcucuuuaaggaugggaaacucaaguaccagguagugcugggccaggggguagggcagagggaggggucucccauggucuucccuggcaaagacugcuuggggcgggggucugggucauguccugagagggccaaccacgggagugggaagcuugugccaggagcgacaguauacgcugggaggaggcagcagguaugagaagccagggaggagcagacguggccucccaugucagccagggagguggauuuuggagcucaacaggagaugaacauuuguagucugcauuuauuuauuuaauuauuccacaauauuaauuggacacgagaauauaccuggcacaggugauugaguagugaccauuauaguuaaugggcccugcccucaaaaaaccacaggcaaacucuaggauguucauucuaugagggcuuuuguuuaaaucagaacgguccaacagaaauauaaugugaaccacauacauaguuaaaauuuucuaauguccauauuaaaagagggaaaaagaaacaggugaaaugauuuuaauaauacauuuuacuuaaugcaauauguccagguaauuagcauuuuagcauguaaucaauacauuauuaauaaaauaugucacauucuuuuuucaugcugaagcuucaaaaucugguguauauuucacacucacagggcaucucaauuuggaugcucuauuuucacuggagugaucuaaucuguauuaagauuucauaaaauguacagcugaauaaguagagugacauguccgacuuguuccacgcauacuuaaagguuuuccaauagcugaaguaucaguuuuaaaauucaaauagaaauuaagauaaaccuaaauaaaauaaauuaaguaacauucaguucuucauucacacuagccaaauuucuagugcucaguagcuacacguggcuaguggcuaccauauuggaucguacaaaucuuaggcaagcaccaaaacaaaguuugaugcugaaucuuuagggcuaagaacaguacuuggcauguaguagucucuuggcauguauuuacugaaugaaugaagaagcugccauauaauuagguacacuuguagcugccaccaaggagaagcugugagugccacuagaguguuuggaugauggguaaaacuucccuaggaaguuacaaauaaacccagaguugcauaaaggaugaggaggaguuagggaugcuaagaaugggagagggcuuuccagguagaggguuuagcaaguacaaaagcuuagagguggagaacagcuuggugacuuggagggaguguaaaaaugggagcguuugcugagccuagugauggagcguaagaaugacuuuacaggaagguggagaugucuguggggaccguguuaaggaauucuacuuucugccaagagcagagagaguauuuggaaagguuuuaagucagcucaugaugcaagauuuguuguuuuuuuuuuuuuaaguuuuuuuuuucuuuuuuuuuuuuuucuuuuuugcuugggugcagugcagagacuggccugucuggggauaggaguggaaauagggagcccacuuagggaaaggagucagaguggaagaugagcggggguugcuugagguaguggugguagagauggagagcaggggacugauuuuaagagacauuuuggagguggaaucaacagccuuggcugaggggaacuggcagcuggaggcaggagugggagggaguugguugugggcagcugugggugacccccaaccccagguugccagguggccccaucccacaggugcuggauggagaaauguacccgcccucgguagaagaggcgccuguguugaugcacuacccccgaggcaucccgccccagagccagauggcugugggccaggagguguuugggcugcuuccugggcucaugcuguaugccacgcucuggcuacgugagcacaaccgugugugugaccugcugaaggcugagcaccccaccuggggcgaugagcagcuuuuccagacgacccgccucauccucauaggugaggacuccagaccugcccugcccuggaaggucauucccuccauccugagaaguugggggcggggggguacuuagagguggaggcugggauuagaauccucacccuucugcuuaguggcuagaagaccuugagcaggccccucaaccucugugagccucggucuccaaaucuguacguuggggugaacgaugauuguaaggauuuauugagaucaugaaugggaaggcaacuagcacauagcaggccuucagaaaauagaugacugugaugguugauuauuagcugggugacucagcacauuugauuagccacccugagucucgguuuccccugugugcugcgcccggaugcauacuugugguccccagcacgugcagggucaaacuguaacuugcccggccuucaggaaucuucauguucccuucccugcauguaucuaccuuccugcaguuugguagcuucuaggugacucagggacaggauauuuuuguguucccuaugggggcgagucugcaaccuaaaaugucagaugguuuccugccugggagcuuggccccugacaucccuguccagaccauguucgcucugagucaccaguaacucccuucccccaccucuggcaccacugggcauggcuggucccaauuauagagccuaauucacuggagccaugaagagccaggcauugggaauaggaacagucauuagagggaagaggggcugguucugaaguuucagcguugcaaagaccuugaccugagagagcuggaggcuguccagcacacuggcuggagaugaagcugugaccaaaggcaggacccuagggcaccauuuaacuccccuacaaccucaugagccggguaugauuacccugugaaaaucaagauucagagaggugaagugaacucuccagggacacucagcagauggagacuugaggucugguugccaccaaaaucuaugcuacuuccacuccaucacaaagggggcucuucuugaaugggaagggguugcaaaccugagucugaucugugacaugugaguauuggaaagggauucccccucgcgucuacacuuaguauuccuacuuuuggcugacauauauggacaccccgucuuaugccaggcacugugccagcaguuuugcuguauucauugucuacuucucucaacaacccuaauauaguauugcauugauguuauuauuauuauuauuugagauggagucuuguucuguugcccacacaguagugcaauggcgugaucuuggcucacugcaaccucugccucccggguucgagcaauucucgugucucagccucccgaguagcugggauuacaggugcccgccaccaugccuggcuaauuuuuguauuuuuaguagagacaggguuuugccauguuggccaggaugaucuugaacugcugaccucaggugauccacccgccuuggcaucccaaaguucuggguuuauaggcaugagccacagcgccuggccgcacugauauuauuauaacacacauuuuacaguuaaggaaagugagauucugagagauuaaguaacucagcccaagcucagguggcuggaaaugguaaagccaagauuugaauccaggucugcugaucccacagucuguagcuccaggucgauuuccaaaagccaauuugucuaauggcuaauuggccugcauaucaguuucuuucaauaucuaguugcccaguuuuaauuuuguuacagaauguucaauuugcauuuucccuggcuuuuugcuuucuagcugguuauagcuacaaauggggcagaggaaaaacuuauuuauaagaauccuguuauauaagaacauauaggaaauauguuuuuugaaauauauuuagggcuaggcuccccuucuguccucaguauucucuuuugccacugcagcagcucugaguggucuccuugaagucccccucuaucaccgagggugucagcaugaugacagcucucaccaguaaauccuccacuuuuccaucuuuuguagucucuccaccuucuuuuaaugggcuucaggagggaggucauaagaccaauucuuggacaccuccuuugcauguccugcuuagcugggccuagaaccucccucugaaaugugggaguagcuggugcucuugucuugagaccucagucaaaauagaccaaaaguucuauuuucacauccuguuacaaagagacaaaauggaagaggccaaacaaaauuaaacaucaacagcaaggccaggugugguggcucacacuugcaauuccagggcuuuugggaggcugaggugagagaagugcuugagacuugcaguucaagaccagccuggauaacauagugagaccccaucucuuaaaaaaaaaaaaaaagaaagaaagaaagcuggguguggugguacaccuguggucccagcuacuugggaggcugaggugggaggauugcuugagcccgggaaaguucaggcugaagugagcuguaauuauaccauugcgcuccagcuugggugacagaccaagaccuugucuguaaaaauaaaaauaaacaucaacagcaacaacaacaauaaagagaccaaaagcaagcaccucucaugaacuggccugcuuuccaagcugggcaucuaaaucacugugcuuggcugacccuauuuccaauccugcccugcccaggggagaccaucaagauugucaucgaggaguacgugcagcagcugaguggcuauuuccugcagcugaaauuugacccagagcugcuguucgguguccaguuccaauaccgcaaccgcauugccauggaguucaaccaucucuaccacuggcacccccucaugccugacuccuucaaggugggcucccaggaguacagcuacgagcaguucuuguucaacaccuccauguugguggacuaugggguugaggcccugguggaugccuucucucgccagauugcuggccggguaagccccagaggagugcuggugagggcaggugggcugagggauccagcagaccuggguccaaauuccagguucuucuucuguaaaauggggcugaugucacuucuacagggcaguuguaagcauuccugugugaguucauugguucauuuguccauuccacaauaccagacauuacuccagguacuggagauguagugggaacaagacuuuugugguucuuggcucaucuuuuagugcucccacccuagaaagugauggcagucauacgacagcugacagcauuagggcccuuacugcgugucaggcacuguucuaagagcuucuccuauguuaucagaauucuaagaguauguuauaaaccauaguagaaaagcccaccaugcucugggagucaggaagggacaucugacccagaguugcggguuaugggaaaagaagggauguccaagcagaaauuggaaggagggauagagauuucccaggguaagaggugguguuaguggcaggggauggcuguguuccagauagagaggacggcaugggugaaaggcauggaagucagaggacauggcaguuugaggaacagaaggacauucagggcaugguaauguauguaacagugcccgccuaugguguuuauuaaaucauaagccuccgcucugggcugaauuguggcucuuuuaaaguucguauguugaaauccuaaccgccagaaccuuaguaugugacugcauuuggagacaaggucuuuaaagagguaauuaaguuuaauugaggucauuaggcugggcccuaauccagugugacuuauaagaagaagagauuaggucacacacacagagggaaggccacaugaagauguagggagaagaaagccaucuacaagccaaggaaagaggccucaggagauaccaacccugcugacaccuugaucuugaaccucuggucuccagacagaggaaauaauuucuauuguuugagccacucauucugugguacauugucauggcagcccuagcaaacaaacacauucucuuucccuggaauucccagccaacgccuuccucaaucuccccuucuccacauucggaagcucccaucugcuucaucgcagucucuggcuccccuguugccucacaguccucugcuucucucuaauccuugucccuaaacccugucaugaagcuguggcacacauggauuuccauuuccuucugguaauuugacugaaauuagcauuugcugccccggugggcagcugcuggcugcuuuauggccucuuugucgguuucuuuaugguucuuuguggggacacaagacaugaacagagacaauagccuuugugugaggcuggaugguuuucagaacguuuucaaggaaugaccaugaugauguacgugaaaagccccggcgucguaccuggcacaaggcagaaaggccgcagagauguauggacugucaagauuuuuuuucuuuuuucuuuuuuuuuaaauagagaugggguuuugccauauugcccaggcuggucuugaacuccugggcucaagcgaucugcccgccuaggccucucaaggugcugggauuauaggcgacucucaggauauuaagaagagugagugaugauaagacagggcuuccccugauaaccauuguccauggcuacccucucagggguucccaugugaccaauacugagauaacagcuuugcauaguuuaucccauuuaaauugaccacagccauaucagguagaugcucuucccuuccccauuuuuacauaugcgggaacucaaacuuagcuugaauagcugcccaaggucccuauauuaguuuccucaggcugcugcaacaaaguaccacaaacugggaagcucagagcaacagauggaggcuagaagucugaauucaaggugucagcagugccauguucucucucaaggcucuaugccuccuuggcaucuggugguggccgacagucccuggcauuccucagcuugcagaggcaucgcucuagucucugccuuuaucauccuguggugcucucccugaacuugucuuuccucauuuuauaaagacaccaguuauuggauuggagcccacccuaauccaguaggaucucaucuuaacuugauuacuuuugcaaagacuucauuuccaaauaaggaugcauucacggaugcagagaguuagggcuucaacacauauuuaauauuuuagggaacacaauucaacccucaacagccccacagcuuguaaagcuguaauuggcaccauccucugcuugcuuugcucauauuauuucauccaaccaugccuuucuuuuuugcccaauuauaguuguugaucaaaaugacuaucucuuaagcaugaacguuauuauuucauccuaagcaccagagcuuucuuuucuuuccuuuuuuuuuuuuuuuuuuuugagauacaaucuugcucucuugccugggcuggagugcaguggugugauuuuggcucacuguaaccucuaucuccuggguucaagugauucaccugccucagucucccaaauagcugggauuacuggcaccugccaccacgcccagcuaauuuuuguauuuuuaguagagacgagucuuugccauguuggccaggcuggucuugaacuccuggccucaagugauccacccgccucggccuccuaaggugcugggauuacaggcacaagccacugugccuggucagcaccagagcuuucuuuagacuaaugcgccuuaacuguuaguaaucagaaucuuuuucugcagcuuuuuuaucuugccagguuaccugggcuuugaguucuauuuucccucccuucacaggggguuacacuaccucuugguguaauucaacggucuggggagcagugugagccacaaaagagguccucuuggcccauuccacacuucaaagaugaggaagcugccggauguggugguucaugccuguaaucccggcaguuugggaggcuguggugggaggaucauuugagaccaggaguuugagaccagccugggcaauauagugagaccucaccucuacaaaaauaaaauaaaacaaaauuagccaggcaugguggcacgugucuguaguccuagcuacuugagaagcugaggugggaggauugcuugagccugaggaaguugaggcuacacugagucaagaucaugccacugcacuccagccagggcaacagagugagacagugucuaaaaaaaaacccacaaaaaaaaaaugaggaagcugagacucagaggggcuuccugagagagcaugacagcagcaggcccggggcaggucugcagcaucacaacugcuaggcugcccaacacucuccauccuagcucagaagggacucccacuggaagcucuugucccaggaacuuacccaggcuccaggacagccuggccuggcucccagaccacugcugugcuucucucucggcagaucggugggggcaggaacauggaccaccacauccugcauguggcuguggaugucaucagggagucucgggagaugcggcugcagcccuucaaugaguaccgcaagagguuuggcaugaaacccuacaccuccuuccaggagcucguaggugagcagcuguuuccuggaugcagucccugcccuugagggacuggcagcaaagucagggagacaucaaggaaauagaacgggacaauacaugcggcaauguguaacaaccagacuuauaaugggcguggaagugcugugccagggugguaaauaagccugcuuggggagagaaggugacuuuucagcuggguuuggagaacaaauggcauuuucagugggagaagagagggaggaguguuuuaggcagagcaauagaaaguacaaaggcugccgggcaagguggcucgcgccuguaauccuagcacuuugggaggcucaggcggguggaucacgaggucaggaaaucgagaccauccuggcuaacacgaugaaaccccgucucuacuaaaaauacaaaaaauuagccgggcauggaggcaggcgccuguagucccagcuacucgggaggcugaggcaggagaauggugugaaccugggaggcagagcuugcagugagcugagauugcgccacugcacuccagccugggcgacagagcgagacaccaucucaaaaaaaagaaaguacaaaggcauagaggucagacagcagguaucuagggaaacagucauagauguggcuggggcaaggagcuuauguugugggaaugauuagugaugggagguuggggccaaaccguguagaaucuugguuuucauacuaaauauuuugaguuuuauuuggucuagugcuuucuaaguacccacuuacgggccagcugcauaaaaaucauuuagaaagcugauuaagauaccaaaucucagaugccucuccuacggauucugauucaaccagccuggguggugcccaagaaucugcguauucauaugaauaaaguauauauacauauauaugaauauauauaugaauagaguauauauacauauauaucaauauauacauauacauaucaauacauauauacauauacacacacauauauauguguguguauauauauacuauauauauacauauauauauauacauauauauauauacauauauauauacauauauauauacauauauauauauauauacauauauauauauauauauuucccccaauauccucagauguugggcagccaaguuuccagcccuugucacauacaauggggagccacugaagcaggugugacauggcccaugagaguucccaguggaggauggauuugaggaacugggcagggaagcagggaagcuccauauuugucuccccuuggccacaugaacauguggauauugcagaguggagcagauucugugcaugagcuccuugugauccuggaacagcaucuuauucuuuacucucccaugacaaaugguccccgggggcagaaggaacacugccacugaauuucugugugagcucggacauguuacaucuuugagcucuaguaguaaaagggcuuggcccaggcuaaggucuugaaaucugucugugaaggaagccagauggggagcauucucccuucugugaugaucagguaauuagggcccagaguugcucaagguuauaggcuguuugguggcagaucuaggccccugacuuucucuuuaguagcauuuuccuucccuagacccagucccugaggaggggcaauuugugcuuuuccucuugacccuuuuccccagugccaaccaugccaaauucuagggcacaugcucaguugcucaaguuagucuccuggagucccuauuauccccagaaaaagguggaccuggaagggucccgccccagguugaccuuaauggcaucauggaucugaugcuagcauuuccccuuaucuccuuguaggagagaaggagauggcagcagaguuggaggaauuguauggagacauugaugcguuggaguucuacccuggacugcuucuugaaaagugccauccaaacucuaucuuuggggagaguaugauagagauuggggcucccuuuucccucaagggucuccuagggaaucccaucuguucuccggaguacuggaagccgagcacauuuggcggcgaggugggcuuuaacauugucaagacggccacacugaagaagcuggucugccucaacaccaagaccugucccuacguuuccuuccgugugccggaugccagucaggaugaugggccugcuguggagcgaccauccacagagcucugaggggcaggaaagcagcauucuggaggggagagcuuugugcuugucauuccagagugcugaggccagggcugauggucuuaaaugcucauuuucugguuuggcauggugaguguugggguugacauuuagaacuuuaagucucacccauuaucuggaauauugugauucuguuuauucuuccagaaugcugaacuccuuguuagcccuucagauuguuaggagugguucucauuuggucugccagaauacuggguucuuaguugacaaccuagaaugucagauuucugguugauuuguaacacagucauucuaggauguggagcuacugaugaaaucugcuagaaaguuaggggguucuuauuuugcauuccagaaucuugacuuucugauuggugauucaaaguguuguguuccuggcugaugauccagaacaguggcucguaucccaaaucugucagcaucuggcugucuagaauguggauuugauucauuuuccuguucagugagauaucauagagacggagauccuaagguccaacaagaaugcauucccugaaucugugccugcacugagagggcaaggaagugggguguucuucuugggacccccacuaagacccuggucugaggauguagagagaacaggugggcuguauucacgccauugguuggaagcuaccagagcucuauccccauccaggucuugacucauggcagcuguuucucaugaagcuaauaaaauucgcuuucuaaag

SEQ ID NO: 13172 - RNA, 4889 nt, Homo sapiens
auguuuuaauuacagcccucauuauaagaguuaaaaucggccuggcgugguggcucaugucuguaaucccagcacucugggaggccgaggugggcggaucacgaggucaggagaucgagaccauccuggcuaacacggugaaaccccgucucuacuaaaaauacaaaaaaauuagccaggugugguggugggcaccuguagucccaguuacucgggaggccgaggcaggagaauggcgugaacccggaagguggagcuugcagugagccaagaucgcaccgcugcacuccagccugggcgacagagugagacuccaucucaaaaaaaaaaaaaagaguuaaaaucuaccauagaggguaguuuuauucauaauaguaaaaaaaauggaaacaacccaaauguccaucaacagaagacuagauaaaucaacugugauauacguuaauuacacagcaauaaaaagaucaaacugcugauauacacagcaacauggaugucaacaaacguuauguugagcaaaagaagccaaacacacaaaaaaguacauacuuuaugacgcuauucaaaugaaguucgugaguagacaaaauuaaucaaaagugauaaaagugaaaauagugguuaccuuucagugguuuuugacugggaaggagcacaaaagagccuucuagagugcugggaauguucuauaucuugauuucuauggcgguuuauacauguguaaaaauaugucgaauuaugcacuuaagauuaaugcucuuugcuguauguuauacuccaguugaaggcaggagggagaccgaccugccacagaaaccugcaaggguguacugccacaucguucugaaacccaagcugcaauuguacaaauggcucaaaaucccuuuugacuaaaggauaaagauugaaagcaaaagacguauuuugaccaaguguggagggaaaccaacuuugaaugaaacacgaauaacagauaagauagugaagaaagugcuucacugugauucucuuaauaguacucaauaaaaguaucuuuuaaguuuuaguauuucuuucugucauucacacauagcuguuuuaauuuagaguccauuuuuauaggaaaagcaugauaaaguugaaaaguggguuguaggcgugucuaacauauuuuugugugagacauauuuuguguguggauacauagcagguguguauauuuauggguuacaugagauguuuugauacaggcaugcaaugcauaauaaucaugucagggcaaaugaggugucucuucacuuuguugauuguuuccuuugcugugcagaagcuuuuuaacuugaugugaucccauuuauccauuuuugcuuugguugccugugcuugugagguauuacucaagaaaucuuugcccacuucaauguccuagagaguuuccacagaguuuuugcauagugguuuuguaguuugaggucuuagauuuaagcuuuuaauucaaaauuugauuuuauuuuuguauauggcaagagauaggagucuaguuucauucuucugcauauggauauucaguuuucccagcaucauuuauugaagauuaacuauccuuuucccaauguauguucuuaacaacuuuaucaaaaaugaguuccuguagguguauagaucuauuucuggguucaguagucuguuucauuagucuaugugucuguuuuuaugccaguauaaugcuauuuugguuacuauaucucuguaguauaauuuuaagucagguaaugcgauuccuccaguuuuguucuuuuugcuuaggauagcuuuggcuauucugggucuuucgugguucucuauaaauucuaggauuguuuuuucuguuuauauggagaaugucauugguauuuugauaaggauuguauugaaucuauagacugcuuuggguuguauggacauuuuaacaauguugauucuuccaaucuaugaauauggaauauuuuucuguuuuucguguguccucuccaauuucuuucauaguguuuuauuuuccauugucaagaucuuucacuucuuugauuaauuuccagguacuuaauuuuauuuguagcuaucguaaaugggauuacuauuuucagaauuuucacuguuuucacauagaaauguuacuaauucuuucuucucuuugaucaauucugcuauuaagagacucugaugcauucuuuaguagucaguugcauuuuucagcuucagaauuucggcuugauucuuuuuaauuauuucaauaucuugguuaaauugaucugauaggauucugaauuccuucucuguauuaucuuguauuucacugaguuuccucaaaauagcuauuucaaauucucugucugaaaagccuagagguguagauauaugaccucucucugagagauagagaaagaucacauauuucuaucucucuaggauaaaucccugaugacuuauuuaguuuguuuaguaaggucauguuuucuugagugguauugaugcuuguggauguucacuggugucuggacauugaaaaguuagauauuugugguagucuuugcagucugggcuucuugggaaagccuucuugggaaggcuuuccagguauucgaagggacuuggguguugucaucuaaguuuuuggucaccauagucauaucagcauuaggaggcaccccaagcccaguaaugcuguggcucuugcagacuuguagagguaccacuugauggucuuggauaagaucuggaagaauugucuggauuaccaggcagauauucuuguucucuucccuuacuuucucccaaacagacagagucucucugucucugugcugagcugccuacaacugggggagggguggcacaagcaccccuguggccaccaccacugggacugcacuaggucagaccugaagccagcacagcacuguuucuuacccaaggcccauuauaaccacuaccuggcuaccaccaccuuuguuuacucaaggcuuuagggcuuugcaguuagcaggcaguaagucagccaagcuuguguccuucccuucagggcagcgaguucccccaagcagguccguagaugcuguuuggggaccagagccuggaguugaaaaucuuaagaaucugccuuguguucuauucuacugcagcugagcugcagacaaagcuacaagucaagucuuucccacucaucccuccccuucccacaggcagaggagucucuccccauggccagcaccaccacaggcccauggggaguacugccuggcuaccaccaauguucacacaaggccaagagcucuucaggaagcuuguggugaaugcugccagaccuaggacucacguaucagggcaguggucuccccucuggcccaggucagguccagaaaugcugugcgagagccaaggccuggaaucagggauacugagagcccacuuggugcucugccccacuguggccgagcuaguaccuaagcugcaagaugaaauccccuuuacuuuucccccugcuuuucucaaguagaaggagucucuccccauagccaccacagcugggaaugugcugggucacaccugaagucagcacaucucagaaucucacucaagggccauaguguguacuaccuggcuacugcugcugauuauucagggcccaagggcacuuuagucagcagguggugaauacuaucaggacuagauccuuucauucaaggcaacagguucccuucugccuuauauggcccauauaagcccaggauaugucuagaaaugucaucuggaaguuagguccuggaaugggugccucaggacucugcccggugcccuaaacuacuguggcugagcugguauccaaguggcaagacaaguccucuuuacucuucucuccucaagcugaaggaaggagucucuuugagagcugugaguugcacugccuaggguugggagagggguggcacaagcacucccuuggcuaucgcagcaggucacaugccccucaaguccacuggcuccaagcgcagaucagacuuuccuaggaguuguaauccuuguggccuauacugccuuucaaguuuauuuagaaccccagagcccuuuagcccauucagcaacugggauggaugcuuccccucuggcuagggcugaucuaaauucucccucauggguauuagcugaguucugccugguguugcuuuccaguguaacaaggcaacacugaguucuaacacaaaguccuacaaccacuacacucucccuacacagauucucugugccauguggcugcugccagggaucggggagggauggcucuggcaauucaagaccauccuuccuacccuccucagugccucuuucaguaauauaaaguuaaaaccagguacuacaaucauucacuugaauuuugguucuaaugaaggugcauuuuuuguguagacaguuguuaaauuugguguuccuguggggaagacaauugguagaagcuucuauucugccuucuugcucugccuccugcguuucugacacuuuuuuuaacucaaaaauuacuaaaagaguggacuguguguacccaacagucuuuguuucucuguuguucuauaauuacauaacuucacuucuuaagcucuuugcuugcaacuauaucgagcugcuaccaggucaacaguaaggccauugugauggucuuuguaacauucuagggauagggcccacagaggcagaacagaacuaagaaaauucagauucacugaagcagacuuuccacguuucccagccccuuugaacaccuucccuauguaugaggaauuuuccuuaucauggguuccuccuuuucaaggcacaaaccagaaaacucacuuuccauucuuucuuguagcugcaguacagacacaugagcugggcuccac

SEQ ID NO: 13173 - RNA, 922 nt, Homo sapiens
ccuguugaagagucucuccagggcucccuuuaugucccuguuccuuaggcuauaaaugaagggauucagcaauggggugaucaccguguacaucacagaggcaauuacguccuugucacuggaggcacuggaugaggggagaaaauacaguccaauaauugugccauaauacagagacaccacagagaggugagagccacagguggacaaagcuuugaagaugcccuuaguagauggagccuugaggauggugaccccaauguggccauaagagaucaagaugcauauuagugguagaguaaugacugccugucccacugugaaaaugaccagcucauugagggagaugucugagcaugagagcuugaguagggcaacaagaucacagaagaaaugggggaugguguugucagcacaaaaggacagcugggccaggaggagagugugagacagggcauugguacaggagaggauccaggacacagugacuaguaaguuacacagucccucuuucaugauagugguguagcggagggggugacagauggccacauaccgaucguaugccauugaagugagaaggaaauugucuagaucagugaaaaauaugaaaaaauacaucugaguuacacacccugcauaaagaauggauugauccugaguuugcaugcuuaauaacaucuuugggacagugacagaugaaagggagaugucagugagagccaaguggcugaggaagaagaacaugggggugugaaggugagaguccagccggaugagcaggaugaugagcagguuccccagcaccgugaucagguacaugcccaagaacagggugaagaacacagccugcugcucuggccagauggggagguccaggaggaggaacucagacacacugcucugauucucccucuucaug

SEQ ID NO: 13174 - RNA, 938 nt, Homo sapiens
gagauaagacuguugcccuguugaagagucucuccagggcucccuuuaugucccuguuccuuaggcuauaaaugaagggauucagcaauggggugaucaccguguacaucacagaggcaauuacguccuugucacuggaggcacuggaugaggggagaaaauacaguccaauaauugugccauaauacagagacaccacagagaggugagagccacagguggacaaagcuuugaagaugcccuuaguagauggagccuugaggauggugaccccaauguggccauaagagaucaagaugcauauuagugguagaguaaugacugccugucccacugugaaaaugaccagcucauugagggagaugucugagcaugagagcuugaguagggcaacaagaucacagaagaaaugggggaugguguugucagcacaaaaggacagcugggccaggaggagagugugagacagggcauugguacaggagaggauccaggacacagugacuaguaaguuacacagucccucuuucaugauagugguguagcggagggggugacagauggccacauaccgaucguaugccauugaagugagaaggaaauugucuagaucagugaaaaauaugaaaaaauacaucugaguuacacacccugcauaaagaauggauugauccugaguuugcaugcuuaauaacaucuuugggacagugacagaugaaagggagaugucagugagagccaaguggcugaggaagaagaacaugggggugugaaggugagaguccagccggaugagcaggaugaugagcagguuccccagcaccgugaucagguacaugcccaagaacagggugaagaacacagccugcugcucuggccagauggggagguccaggaggaggaacucagacacacugcucugauucucccucuucaug

SEQ ID NO: 13175 - RNA, 951 nt, Homo sapiens
ccuguugaagagucucuccagggcucccuuuaugucccuguuccuuaggcuauaaaugaagggauucagcaauggggugaucaccguguacaucacagaggcaauuacguccuugucacuggaggcacuggaugaggggagaaaauacaguccaauaauugugccauaauacagagacaccacagagaggugagagccacagguggacaaagcuuugaagaugcccuuaguagauggagccuugaggauggugaccccaauguggccauaagagaucaagaugcauauuagugguagaguaaugacugccugucccacugugaaaaugaccagcucauugagggagaugucugagcaugagagcuugaguagggcaacaagaucacagaagaaaugggggaugguguugucagcacaaaaggacagcugggccaggaggagagugugagacagggcauugguacaggagaggauccaggacacagugacuaguaaguuacacagucccucuuucaugauagugguguagcggagggggugacagauggccacauaccgaucguaugccauugaagugagaaggaaauugucuagaucagugaaaaauaugaaaaaauacaucugaguuacacacccugcauaaagaauggauugauccugaguuugcaugcuuaauaacaucuuugggacagugacagaugaaagggagaugucagugagagccaaguggcugaggaagaagaacaugggggugugaaggugagaguccagccggaugagcaggaugaugagcagguuccccagcaccgugaucagguacaugcccaagaacagggugaagaacacagccugcugcucuggccagauggggagguccaggaggaggaacucagacacacugcucugauucucccucuucaugcugacagucuucucucugcuggaaauaga

SEQ ID NO: 13176 - RNA, 667 nt, Homo sapiens
ccuguugaagagucucuccagggcucccuuuaugucccuguuccuuaggcuauaaaugaagggauucagcaauggggugaucaccguguacaucacagaggcaauuacguccuugucacuggaggcacuggaugaggggagaaaauacaguccaauaauugugccauaauacagagacaccacagagaggugagagccacagguggacaaagcuuugaagaugcccuuaguagauggagccuugaggauggugaccccaauguggccauaagagaucaagaugcauauuagugguagaguaaugacugccugucccacugugaaaaugaccagcucauugagggagaugucugagcaugagagcuugaguagggcaacaagaucacagaagaaaugggggaugguguugucagcacaaaaggacagcugggccaggaggagagugugagacagggcauugguacaggagaggauccaggacacagugacuaguaaguuacacagucccucuuucaugauagugguguagcggagggggugacagauggccacauaccgaucguaugccauugaagugagaaggaaauugucuagaucagugaaaaauaugaaaaaauacaucugaguuacacacccugcauaaagaauggauugauccugaguuugc

SEQ ID NO: 13177 - RNA, 925 nt, Homo sapiens
ugcccuguugaagagucucuccagggcucccuuuaugucccuguuccuuaggcuauaaaugaagggauucagcaauggggugaucaccguguacaucacagaggcaauuacguccuugucacuggaggcacuggaugaggggagaaaauacaguccaauaauugugccauaauacagagacaccacagagaggugagagccacagguggacaaagcuuugaagaugcccuuaguagauggagccuugaggauggugaccccaauguggccauaagagaucaagaugcauauuagugguagaguaaugacugccugucccacugugaaaaugaccagcucauugagggagaugucugagcaugagagcuugaguagggcaacaagaucacagaagaaaugggggaugguguugucagcacaaaaggacagcugggccaggaggagagugugagacagggcauugguacaggagaggauccaggacacagugacuaguaaguuacacagucccucuuucaugauagugguguagcggagggggugacagauggccacauaccgaucguaugccauugaagugagaaggaaauugucuagaucagugaaaaauaugaaaaaauacaucugaguuacacacccugcauaaagaauggauugauccugaguuugcaugcuuaauaacaucuuugggacagugacagaugaaagggagaugucagugagagccaaguggcugaggaagaagaacaugggggugugaaggugagaguccagccggaugagcaggaugaugagcagguuccccagcaccgugaucagguacaugcccaagaacagggugaagaacacagccugcugcucuggccagauggggagguccaggaggaggaacucagacacacugcucugauucucccucuucaug

SEQ ID NO: 13178 - RNA, 653 nt, Homo sapiens
ucuuuuuuuuugcauccaaaaucauuuuaauaagagaguaggauccaggguuaguuuuuguagccucagcuggcccgucagccucuggcgcgcucgaacuuccggcccuuggaguggacguaggguuugguguggcugugcgggguucccggggccuugccaaaaugcccguacaccuuucggcccuugagaggaccggagagcaggacggugcugcagcccuugcgggaguccacggccagcuggucgaaaagugaggaucuugcccccugcccugaggacgcggcugcgggccagguuggucacacucagcacacacaccuucaguuugggcaccuccugaacccgcacgucaucuguuaugcuccccacaaucacggccguuuuguuuucccggacaggaagcuucacucuucuggaucaucugggaaagggacagagguggccgguugguacgacucauaaacaaccucuucagcacaaccugguugaauguggagucgguucgucuggccagaaaacugcacagcuugaccaacagccucagguagauauccuggcucuugggcuccuugcgccgaaccuuucgguccuuguuguggcagaugucagcucccaugauggcgucuccugcucggccagguacggaaaga

SEQ ID NO: 13179 - RNA, 1262 nt, Homo sapiens
aucaguuagaauaaugguuuuuuuuuacucaauaauuuuuuuuucuuuuuucuuuuuuuugacagagucuugcucugucacccaggcuggagugcaguggcacgaucuuggcucacugcaaccuccgccuccuggguucaagugauucuucugccucagucucccgaguagcugggacuauaggcaugcaccaccaugcccggcuaauuuuuuuguauuuuuaguagagacuggguuucgccauguuggccaggcuggucucgaacuccugaucucaggugauccgucugccucagccucccaaaguguugagauuacaggcaugagccacugcgccugaccuacucaagaguuuucuuagggcucccuuaaugucuuuauuucucagacuguaaaugaauggguucaacaugggagugacugcuguguauaucacugaagcaauuauguucuugucauugguguugcuggaugggggaagaaaauagagaccaauaauuguccgauaauagauagucaccacugagaggugggauccacaaguggacaaggcuuugcauaugcccuugguagagggaaucuggaggauggugaccccaaugugaccauaagaaaccaggaugcacaggaauggaagcauaauggcugucaaugcugcuguaaagauugcuaacugauugagggaggugucugagcaggacaacuugagcagggcaccaaggucacagaaguagugagggaugauguggucagcacagaaggaaagcugggccaggaggaggguaugcaaaagagcacacgcacaagcgaugacccaggacccagccaccagcaugacacacuggcucugagucaugaugguggcauaauguagaggaugacagauggccacauaccugucauaugccauugaagugauaaggaaacugucuaagucagcaaaaaauaugaaaaaauaugucugugaaaugcaucccuuguaaaagacggcuaggugcugagucugcauguucaucagcaucuuagggacagugacagaugaaaaggagaugucagugagggccaaguggcuaaggaagaaguacaugggggugugaaggugagagucuagcuggaugagcagcaugaugagcagguuccccagcaccguggucagguacaugcccaggaacagggcgaagaacacggccugcugcucuggccggauggggaggcccaggaggaggaacucggacacgcugcucugguucucagggcucaug

SEQ ID NO: 13180 - RNA, 1262 nt, Homo sapiens
caugagcccugagaaccagagcagcguguccgaguuccuccuccugggccuccccauccggccagagcagcaggccguguucuucgcccuguuccugggcauguaccugaccacggugcuggggaaccugcucaucaugcugcucauccagcuagacucucaccuucacacccccauguacuucuuccuuagccacuuggcccucacugacaucuccuuuucaucugucacugucccuaagaugcugaugaacaugcagacucagcaccuagccgucuuuuacaagggaugcauuucacagacauauuuuuucauauuuuuugcugacuuagacaguuuccuuaucacuucaauggcauaugacagguauguggccaucugucauccucuacauuaugccaccaucaugacucagagccagugugucaugcugguggcuggguccugggucaucgcuugugcgugugcucuuuugcauacccuccuccuggcccagcuuuccuucugugcugaccacaucaucccucacuacuucugugaccuuggugcccugcucaaguuguccugcucagacaccucccucaaucaguuagcaaucuuuacagcagcauugacagccauuaugcuuccauuccugugcauccugguuucuuauggucacauuggggucaccauccuccagauucccucuaccaagggcauaugcaaagccuuguccacuuguggaucccaccucucaguggugacuaucuauuaucggacaauuauuggucucuauuuucuucccccauccagcaacaccaaugacaagaacauaauugcuucagugauauacacagcagucacucccauguugaacccauucauuuacagucugagaaauaaagacauuaagggagcccuaagaaaacucuugaguaggucaggcgcaguggcucaugccuguaaucucaacacuuugggaggcugaggcagacggaucaccugagaucaggaguucgagaccagccuggccaacauggcgaaacccagucucuacuaaaaauacaaaaaaauuagccgggcaugguggugcaugccuauagucccagcuacucgggagacugaggcagaagaaucacuugaacccaggaggcggagguugcagugagccaagaucgugccacugcacuccagccugggugacagagcaagacucugucaaaaaaaagaaaaaagaaaaaaaaauuauugaguaaaaaaaaaccauuauucuaacugau

SEQ ID NO: 13181 - RNA, 1002 nt, Homo sapiens
ccccucauagucagaccuacccagccucccuggaccaaucacugggaccccugcccuggacaguggaaucggcuccaggucugccugagggccuccuugaccuccuuauugcggaggcuguagaugaguggguugagagacgggaugaccaggguauagaacacagaggccaucuugucaguguccagggcauagcuggagcuggggcgcagguacaugaaaaugagugucccguacaucauggccacggcugugaggugggaaccaccgguggaggcugcucgccgacugcccucgaccgagcgcauguggaucacagccccagcgaugaagccauaagacaccgugauagcuaacaccguggcugucuggaugaagccacagauggcgaagagaaggaguucauugagacuggugucacugcacgagauggccagcaguggagggauaucgcagaagaagcuauugaucuuccgggagcggcagaagcucaggcggaaggugaggguugugugaacaaaggcacucacugccccacccaggccugaugcucccagcaaggccaggcauagacgcugcgacauagcuguuguauagagaaguggguuucugauggccacguagcggucauaggccauggcugccagcaagcaacacucaguaucagccagaccugcaaagacaaacaucuggagggcacaggcuguguaagggaugguggcucggggcagcagcagguccacuagcaucuuggggccgauggcggaggaauagcaggcauccagcagggagagguuggccaggaagaaguacauagguguguggagccgggcauccaugcggaucagcagcgccaugcccauguuucccagcaggcucaccagguagacaggcaggcaggucaggaagagggccacacgcaggucccagcgauuugugaugcccaggaggacgaauucagcaggggcaaccgcggcccgggugagguucucugaguucauc

SEQ ID NO: 13182 - RNA, 62373 nt, Homo sapiens
uguagcucccgauggaguuugaggucgugaaaccuccgccgagcucugccccggcgagacgaggcgccuccgucgccaagccgcgccgucgcggggcucccgggagcggcccuuagcgaccccgcccgggcccccucagguagggcgggggcgggcacgaugcggcucgggccccagcccgggugccugguccccggcggucgggcgggagaccagucucagcccuggggccugugcgcugucgccccuggugccucgaggguugggaacugagggccgcaccugacacucggauggaacccgggcccugcggaggccccucucucugguagggcuuuuucgaugcggagcgaccggcucaaauggccaccuuccuucgacacuggccgagcggacgccucugaccccuaacgaacccacccaagcaaaggcccggcuucacucucccuuuucuacaccaguuaguaaggggguuuggaagagguccucgaaaccaagucuucuccuagcuuuucagcuuucugcccuggggcuucccgagacccuagcguagagggugguggaggcgaucugagugguaaauaggaaccccggccaaacaaugcccugggagggcuuaaccucccaggauggggacggccggaccugagugguugcacagggguuguggcuaggagcaauggcaugaaacacagccaggaaauucugcuauggcuuucuucuuucccucucucauuuuuccuuuuugguguagccucuugaggagacucuuccaccaucuuagaagaaugguagaaagcaucuuuguuucccagagaagcagcuguacuuuuuucuauccuuagcuuucaggaugggagaagaugaggguagcugucauuuccauccuucaaaucccaaggcagccguuuaagauaccggcagauaaauccuucacaccaaaauugacucaaguaaucacuggcauaaaguaaaucuaauccagugauuuauuuauauuuucauaacccuuggguucccuuuuuaauuccuccucuccccuuacccacggccuuccuuuuuuucauuucuacucucccccuacccauugugggugggugaguuuguaucccaaauaaagugcuuuaaguaaucuuuuuuccaauuuuguauuggccaaacuuuuaaguuccaguaggaacuuuugguuaaccugagaaagcuaacguugcuauaccacagugguauaaagucacucaaaagcaaagaaacaaauguuagccagugcagccuuuuaaugguuaaacauacaaacuuaguuaaaagcuuuuuacgauauuaagaauauuaauagauucuccuuuuuaaaaaaccuuuuagcugucuaaaaagcuauaccacuguuguagcuucacaugccuuucuuacguuguuuacuuccacguucaauuuuugaagaaauagaggucguuacauccuguuaaagacugcuuuucaauauugacauuuucguugauuuggagauuaauguuuucaaaauuuuagaguuuggaaaauugcuaggaggacagaaugugaaacauauucuaguuacguuuagaaaaagcagauguuauaauucaaacaggcacuuguucuaugaggauuuaauuacacucguguucauuaguggauccuuugaguuaccccugaucuguuauuucuguugugguaaccugacauguaagaagacuuacguccuuuguucauauauuuuuguuaaaucauacucugcuuuuguaauuugcugucuuccacuuugaaaaaaccaaaaauuugcauuuuggcaaagcauucuucuuuacacucaggauuuuauauucaaaaguugaacuucuacauuguuugcaauagcuaagaacgcuaaaaaaaacuucauaacaagguuuuaguaacuacuuacuguuuaguuuguaccguguugaaguuucacuuuuuagugauggaaaaaggaagcauggguaaaauaaagcuagcugaaaauuaaaaauaaguucauguuuugcauccagucucaugaauguuaugaucagcgucucuaauuuuacuaaagcuuuaaguguaagugugaguuuuaccucaauuuccugauaaaaguucuaaguauuacuuuauaauuuaaauauucuagaguugcacuguccaguacuagccaguggccacaugugacaguugaagauuugaaauguggcuucugugaauugagaugugcuuuagguguaaaauaccagauuucaaagacuuaguaccaagauuuuuuuuaauaucucaguaauuuuaauauugacaacauguugaaaugauauuuuguauaaacugggauaaauaaaauauauuacuaaaaauaauuuuagcuauuuuaacuuuuuuuuuuuuuuuuuugagacagucucucucuaucacccaugcuggagugcaguggcaccauucggguucacugcaaccucugcuuccagguucaagcaauucucaugccucagacuccugaguaguugggauuacaggaaggcaccacuacaccaggcuaauuuuuguauuuuuaguagagaugggguuuugccauguugaccaggcuggucuggaacucaugaccucaagugauccacccaccucccgccuccgccucccaaagugcugggauuacaggcgugagccaccacgccuagccucuuuuaaccuuuuuuaaugugacuaccagaaaauuaaaaauuacucggauuauaauggcucacauauuucuaucggauauuacuguuguagaucagcauuacucuuccaagaaauauguuaguggaauaaaaguagauguauaaaaacccaaaacuuccagauagauuauccuguuacaaucagaauaauuaaagagcuaaggacuuugguaauaugaaggaugaaguuauccauuggcuaugauuugauaggcagaaguaaguucuaucucaaagaaaguauuuuucucgucaucacuaauauuaguuauacuuguuaaaauagaaaguuggcugggcgcgguggcucacgccuguaaucccagcacuuuggaaggcugaggcggguggaucaccugaggucaggaguucgagaccagccugaccaacauggauaaaccccaucucuacuaaaauuacaaaaaauuagcugggccugguggcgcaugccuguaaucccagcuacuccggaggcugaggcaggagaaucgcuugaacccgggagacggagguugcagugagccgagaucgcgccauugcacuacagccugggcaacaagagcgaaacuccgucucaaaaaaaaaaaaaaaaaagaaguaguuaucucauuauugcccuauuagaaugcauugagacugggcgccgaggcucaugccuguaaucccaggacuuugggaggccaaggugggcagaucacgaggucaggaguuugagaucagccugacccacaggugaaacccugucucuacuaaaaauacaaaaauuaaccgggcaugguggugcgcacuuguaaucccagcuacucaggaggcugaggcaggagaaucguaugaaaccgggaggcggagguugcagugagccgaaaucgcaccaccgcacuccagccuaggcaacagagugagacuccuccaucucaaaaaaaaaaaaaaaaaaaagaaugcauuggaaguuauaucuaauauuuauuuuaaaacaguucaaccacauaguguauuuaagaaguaaaauuugagucauauauacuucacacguuaacggcaaaaucacauauuauagcagucuuuuaaauugcaauucaauuccuuuuucuccaguacugaguuucuagcuuacagguuguuuccauugcuguuuugguuuuuacuugucuuuuagcuagagauccaaauugugcuuaugcuuuaaauaucauuuuuuaagaacaaaacuaauuauuuuuaaguuuucuaaacggggaaguacugugacaguccauuucaguagcuuauauuccucacauagguuaacaagaaugaaaacaaugguuuuaauuagaagaacuaagcccuaagguuuacauuuuuauuaagagaauuguaaaaugauguauacauauaugacaguuaaagaagcauaaacuuuauucuggcauuuuaaaaucagaugccguagaccugaacuggcugcauaauaugguggacuaauaagagaaaaugaaaguauuuagcuggcucuuaauaaagcaguuuguaauuugaaucauauaagagaugccuauugugcuuccuguuuuaugugucagcacucauagcaaggaacuuacagucuggaaaauuauuugagcgaaaaauuguuuauggucccaccuuuaauuuagcauuucucacuccuaugcuuuaucuuauuauccuuuuucaauuuuuguaacugguaacuaaaauuaguuaauacaaauaauuagaauguuuuucuuaaggaaucacuuuagguaucuugaguuguaggccuuuuaguccauuuuaucucaguuugaaauguuuugauuauuugagaagaauacuucaguaguaacuauaaauauucauagcaauuuagacuuacauagacucaaauaaguugcauaaaauguauuaguauaggucuagaaguuuugcaaauuaauauguagucuuagugcuccaugguucauuuauaugcucuuuaaauuauaaaaacuauaggauauuuaccauuuuugguaguuacaaaaauauuuucuagguaaauguuuacaaagugccuguuuugaaggaaugaaguuucuucuauguuuuagguaaaauuuuauauugauuuaucuuaauuaaggaaucuaggauuuacugauaauauuacugaagaaaaacauauuuggaaaaucaaagcguuucuuacaucugaucguauaagggaaguuuaguugauaauuuacugucagaaagcuagacucugacacagagaagaaaauuugguagaguuauugccaaaauuuuggcaguguuuuaccuuuauaucuuaaagguauuaauucaauuugugguagaaauuaaacuucucaguauuaauuauguuaaaaccucugauguuucuaugcugaaacacacuaaggacuauuguaacauaaaacuauacuaaggacuauuguaacauaaaacuauuaagugugcucugguauaguuugaaacaguuuaaaacuguguaguaggugacaauaugaaagauagcauuuuucuguaugguugaaacucccccaccccaagccccacacuuaugugcuuuaauauaaagcauuucagaaaggcuuuggaaaacuaaggaaaagguauuugcucuuauuuuguacuaccagguggccugugauacccuaacccacagaauuaacauuuccaaacagguggccauuaugaaaaacuacacgcaguguccuguuuucauaaauauuuaaucaguucaaguuauuaacuauauuagggcuuucaguagauuuaagaugaaauucauucuuccucaaaggccuuuucuuguauaacucugcaaaccagaaaacuggauguuaaaaauguucaguaguuuuagggagugauauauucaucugcucagugcuuaucucuaaaguuggaaggaaacuaauugguuuuuagauugauggcauuaauagaugugguaauuugaggaugaaaguuguaaaauuauaacuuggaagauuugguuacuuuaaagauaacgauauuagauaauuugcauuagagcuguuugagaaaguuuguauaggggugcuuuuuacauagcaagcccuguaauucauuuuuaccaagauuuuuuuuaaucucuguuuuugugaauauaaaagcgcagggccgggcgcgguggcucacgccugcaaucccagcacuuugggaggcugaggugggcagaucaccugaggucaggaguucaagaccagccuggccaacauggagaaacccugucucuacaaaaauuagccaggcaugauggugggugccgucccaguuacuugggaggccaaggcgggagaaucacuugaaccugggaggcagagguugcagugagccaagaucacaccauugcacuccagucugggcgacagagggagacucugucucugaaaaaaaaaaaaaaaaaaaaaaaaaaaacacaauaaaggcuaauagaauuuuuuuguauguuggcauaauugagaauacuuucuguuauauauuuuuucucuuugaaugugacuacauuuuuaaacaucuaauuucuguggaacuaauauauuuggguugguaaacauuccugugaaauaaaguauuaguuguuugauugcccuaaauaccuagauuucuuguucaccagagagcuuuugucagacuuauguuaagucuugaauuggaagauaaagaaauucugggaaguuuaguguguucaaauuaguaucguuuugcuacuaaaucuuuuacuuuacuaaacuuauggaacuuuuuuuuuuuuuuuugagauuaaguuucgcucuuuuuguccaggcuggagugcgaugacgugaucucggcucacugcaaucuccgccuuccacauucaagugauucuccugccucagccucccuaguagcuggaauuacaggcaugugccaccacgucuggcuaauuuuguauuuuuaguagagacaggguuuauccauguuggucaggcuguucucaagcuccugaccucaggugauccucccaccucggccucucaaagugcugggauuauaggugugagccaccacgcccagcaggaacauuuugaucucagaaauaagaaaaauucucucacuguuuuuuucuaugugccuuuucaguuuuuaaucaugcauauauaacuuuuuagaauaauguuuuauucuucugugucuuccucauuggacuuuacaguuuuugguuauauauaucaaucgcuaaauaauguaguuuuaucagaaguauuguauugaacaauacaagauauuuaagacaauuuuuuuguuuuacuuuggcacuguauguuguggucagcauuagucuuucauuuaugaacaaacagcucucuuaaucaucucucagucaucacagucuucucuuauauguugauuuucagugccucauuuugcuuccuagccaagucuugucagagauuuccucuuucagguggcaaagcuguuuucuucacacuugagucucuacaauauuguuuggaucaguaguuuccaaaguucauuaacuccuggccauacuuuauuauguuuugggguacugguuauccaagggaaacacuuuuuuaaacaacaaaacaaaaaaaccgcccagcaguccaaaguaauuuguguuccuaaaaauggaauauggaaaguuaauuugcuuguuugauguggucguugagaaaaauacauaaaagcuuugauguuuauuaugugagcaaccaauauaaauacaguuuaguugaaaggaacacuauuaagguauuguuuccaggcagaauuucagaaauguaauuaauucagcaaauagguuuuuuaaaaaagacauccaaagguuauaaaauuauuuagaaguauuuuaggucugaagcuguaauaguugacuuaagcaauuaacucuucaaaggugaaugaugaauaugugguuaauucauacuuuuguccauuucuagcuuacaaaacacuacacagcaaaauaaugaucugcuagacugcuaacccgagcauccagcuuccacaaugccugugcaggcagcucaauggacagaauuucuguccuguccaaucugcuauaaugaauuugaugagaaugugcacaaacccaucaguuuagguuguucacacacuguuugcaagaccugcuugaauaaacuucaucgaaaagcuuguccuuuugaccagacugccaucaacacagauauugauguacuuccugucaacuucgcacuucuccaguuaguuggagcccagguaagcauucaagauuuuacuauagguuggugcaaaaauaaucacuauuuuugccauuauuuuaacggcuuguccagccugcaggcuacauguggcccaggacaucuuugaaugcggcccaacacaaauucauaaacuuccuuaaaacauugugagauuuuuuuugugauuuauguuuauguuuuuagcucaucagcuaucguuaguguuaguguaucuuauguggccuuuuuuuuuuuuuuuuuuuuuuuuuuagacagagucucacucugucacccaggcuggugugcaguggcgugaucugggcucacugcaaccuccaccuccuggguucaagcgauucuccugcuucagccucccaaguagcugggacuauaggcccacaucaccauacccagcuaauuuuuuuuguauuuuuaguagagacgggguuucacuauguuggccaggcuggucuggagcuccugacgucaggugauccgcccaccucagccucccagggugcuaggacuacaggugugagccacugcacccagccaucuuauguggcuuuaauggcaaaaacugcaauuacuuuugcagcaaccuaauaauuuguuacaugaaauaguuauugaacuuuauucaguaauagguauauaguauguuuagugaucauuaagguguaaaaaauaaauuucaauguaccugauuuucaugauuguauucugcgaaagauuuucuuuagauaaugucauauccuuauacaaaaccuuagauuacauuauaguuacauauucaauucuguggcuaaaauuuauguauauaagugauauugguggauaagaaauauuuuuauauaagcauauauauuuauucaccaggugauaugaaaagaaauguaaucaaagcuuugaccagaaacagguuuuuuuguuguuguuguuacuuuuuuuuacuucacuugacuuuuuauauaauaguguaaaugaaacaauaaggucuauguagggauguauauauggaaaaccaaaaaccaaugugucaguaauaaauucuccaugauuucuucugaacauguguuguaucaagcuugucuggcuuucaggccacaugcagcccaggacagcuuugaaugcagcccaacacaaauucguaaaguuuuuuuuuuuuuuuuuuaacucaucagcuauuguuaguguuaguguaucuuauguguggcccaagacaauucuuccaguauggcccacggaagccaaaagacaccucugagcuaugugaugcuuuaguugaacauuaggggggaaaaaaaaaagaacaugugcuauagaauucauguuuguaauuauuuuauugaaucaaagcaagacucuagauuugaaauaacauauuuaaugagggucuacuuugcauuagguuugacagaaaguauucagcauuuauuauuacuaauucuuaccauagguuuucagguaguuauuauccccauuuuacaaguuaggaagagaugaaauucuguacaucaugugcuacauauuaaagccagaaaggaauuauuuuucugauuuaauagaaaauccaauaaaccaaaauacuucauucauuccuuuaguaucuugauauuugaaguccuccuuguaaagcacaaaaucucuuuucaguguuuauaaucaaguuacacacuaugaaaucaaggugcaucuacaauugauaguguaucuuaauuuaauugccaguauauuuuuguuaauggaguauaaaauguugccucuugcaaacaacauuuuagauuugauaaaauaucauagacuuuuuguaagaauacuagcuaccaccagacacaguggcuuacaccuguaaucucagcacuuugggaggcugaagugggcaggcugcuugaggccaggaguucgagacuagccuggacaacauggcgaaaccccaucucuacaaaaaauaaaaaaauuagucaggcaugguggugugugacuguagucccaccuacuugggaggcugagauggugagaugggagguucacuugagcccaggaggucgaggcugcagagagccaagaucgugccacugcacuccagccugggugaugggagugagacccugucucaaaaaaaaaaaaaaaaccuagcuaccauuuauuuagcaucugcuauaggucaacagguauuguguuaauaucauuuguaaauguuaucucaguugguucuuaaauugccuacaggucuuuacagugugaauucuguuaucucuuuuacuacuguucuuauucugcuuaagcuacacuggcuucuuagccaguucucagauauaccaaguauauugccaagugauggcuuuuguaguuacuguuaccuuugccuagaacguucagucugucuccauuuucuuuuuuguuguuguuguugagauggaaucucucacugucacccagacuggagugcaguggcgcaaucucggcucacugcaaccuccaccucccagguucaagugauucuccugccucagccucccaaguagcugggguugcaggugcgugccaccaugcccagauaauuuuuguauuuuuaguagagauggggucucgccauauuggccaggcuggucucgaacuccugaccucaagugaucugcccaccuuggccucccaaagugcugggauuauaggcgugagcaaccgugcccagccucucucuucauguucuuuauucauucauaucucacaguucucaagggagccaauccugaccacccuaauuaaauuuguaaccccucgcuaguauuuccagucccccuuaucuuugcucuauaauuucaccucuuggaacacuacaaauuuauuauguuuuuaauuuauugauuggcuaccucuucuccucuccacuagaaugugagcuccacaaaggcaaaacauuuugucuguuuugcucauugauauaucccugguaccuauaacuguguccagugcaugguaagcacuccauaaauauaauuauuuguugaauugcauugaacuuuuuuuuuuuuugagacggagucuugcucugucgcccaggcuggagugcaguggcgcgaucucggcucacugcaagcucugccucccagguucacggcauucuccugccucagccucuggaguaacugggacuacaggugcccgccaccacgcccggcuaauuuuuuguauuuuuaguagauacaggguuucaccguguuagccaggauggucucgaucuccugaccucgugauccgccugccucggccucccaaagugcgggauuccaagugugagccaccgcaccuggccuguauugaacuuuuauagcggcacuacaaaauacagauuuucaucuucauuuugcagauauggaaauuaugacuuggagcaguuaaguaauuuacucaaggucauucauagaaguagcagagcugcaauuuuuacccaaguuuugaccuuugaaugagaacacucugucuuaauaaugcuuaucuuaaguaaauaauauaguaaaaaggugauaagugcuuuggggaaaaaaaaacaacugugucuuuuuuucuccacucuuuaauuuugaaauucuuucagacuuacaaaaaaguugcaaaaaauacuauucagagaacuuguauaacuuuccacagcuuaaccuaauguuaacauccaacaccaagaaauuagcaucgauacaauacuguuaacuuucugcuucuuuucuuccuucauuaauccacacagcuccugcuguuaaguauguuauuuuuugcuguugcuguuauuguuguuauuuugagauggagucucacucugucacccagacuggagugcacuggugcgaucucagcucacugcaaccucagccucccggguucaagagauucuccugccucagccuccugaguagcuagaaucacaggcauccaccaccacaccuggcuaauuuuuguaguuuuuaguagagauggaguuucaccauguuggccaggcuggucucaaacuccuaacuuaaguuaaucugcuggcuuggccucccaaagugcugggauuacgggcaugagccaccaugcccggccuuauuuuugguuuguggaaagcaguuuggcuagguguuugacuuuaauuuuacuuaaauggcuuucauguauuaucuaugcaugauaauuuuauacucaccaagauuauuaucaaguacauaaauaauaguugcaugagcuggaugaauguauuucugcaauauuccuuuuuuuuuuuuuuuaagguaccagaucaucagucaauuaaguuaaguaaucuaggugagaauaaacacuaugagguugcaaagaaaugcguugaggauuuggcacucuacuuaaaaccacuaaguggagguaaagguaaguucauaaaaugcauuuuuacugauaaguaggacuugguaguacauuuacuuugaaugacuugauguggauacccuauuaaguuauggaaaaggaguuugcuugagaaaugccuugaaaaauguauagacugagaaaauuauguuguccuauuuucugaaaauaaccaauauuguuauuaagaauucaagcuagagccgggcgcgguggcucaccccuguaaucccagcacuuugggaggccagcgcgggcggaucacaagaucagaagaucgagacuauccuggcuaacacggugaaaccccgucucuacuaaaaauacaaaaaauuagccgggcgucuuggcaggcaccuguaguuccagcuauuccggaggcugaggcaggagaauggcgugaacccgggaggcagagcuugcagugagccgagauggugccacugcacuccagccuggggcgacagagcaagacugucucaaaaaaaaaagaauucaagcugggugugguggcuucaugccuguaaucugagcacuuuauaaggcuaagguggguagauuucuugagcccaggaguuugagaccagccugggcaacaaggcgaaagcccaucucuacuaaaaauacaaaaaauuagcugggcauggugacacacgccuguagucccagcuacugaggagaccgguguaggagaaucacaugagcccaggaaguugaggcugcagugagcugugaucgugccacugcacucaaccugggcaaugggagugagaccuugucucaaaaaaaaaaaaaaaauuuaccagagucacugcaucuugaaauuuguacauuauuugaauucacuguguaauagugcuguaacagaauauuaguuuugauaaguccuauuaagacagcuucauguaugcauguauucauucagucauucauuaaauuuuauugagcacuuaacagugauuaaggucacugccaucauggagcccacaguuuacugggggagauagauguacaaguguaauaaauuauuuuaagucuaugacaaaacugaaauuuuaucacugcauacuuagcacaucauagguauaauaaacaauuguugaaugauugaauauauugaguauuuuguaccuguugaaugcuuugcacuguuguguauguggccauagugauuuuacugagaaacuuauccccuguauucauucauucauuuauugaacagcuaucuaaagagcguggacugagagugucaggcauucuucuagugcugggauacauuaguaagccaaauaauguguuuuaaaggaguaaugaguaaucauguguguugaaugcuguuggaaggucagauaaaauaaggaacuaagaauuaacuaauuuaaccaauuuagcaaguuuggucaagugaugugggaaaaauuugauugggguggguuucagagauugugaaacaaggaauuggaaguagugaacagaucaauuguagugaucuacaauuggcuaaguaguuaaggcacuagacuaggaaauagcgaguauagacaacucuagaaaauuugcugcauaagagaagaaagaaauggaacagaggcugggcacagaggcucacgccuguaauuccagcacuuugagaggccgaggcgggcagaucauuuggggucaggaauuugagaccacccuggccaacaugguaaaaccccaucucuacuaaaaauacaaaaaaaauuagccagguguggugacacucaccuguaaucccagcuacucgggaggcugaggcaggagaauugcuugaaucugggaggcagagguugcagugagcugagauugugccacugcacuccagccugggcgacagagugagacucugucuccaaaaaaaaaaaaaaaaaaaaaaaauggggcagauuugguaggggaagcaggaucaaugaaaauauuuguauuuuagauggaugaaauaacagcauacuuguucuuauucuguaaugauggaaauguucaaguaaagagggaaaauuugauaaugugggagaggggagaauugcuggagcaauauucuuacauagguacauaggaguagaaucuaagagcuuaccauuaagcaguauucuaaaugucuuauauacaauuaaaaaauagagucauuuuuacuuuuagguuaaacugcuaaaguagcuaaaaauuaggcuucuuauuacuauagaauaauaacaaacagagacagaauacuguuagaaaaaugaaagcacauuacaagggacucauuaggaauuguggcuuaaucguuaaaugcagauaaugaaaauugacuuuuauuuuuuauugaaaaaacuuuagcucccuuuguuucccuuuuccuaaagguguagcuagcuugaaccagagugcacugagccguccaaugcaaaggaaacuggugacacuuguaaacugucaacugguggaggaagaaggucguguaagagccaugcgagcagcucguucccuuggagaaagaacuguaacagaacugauauuacagcaccagaacccucagcaguugucugccaaucuaugggccgcugucagggcucgaggaugccaguuuuuagggccagguaagauagguuacuaucuuaccuuuuuuauuagcuauuggggcuugaggaugccaauuucuggagcucggugaauccugagacucaacccgucuuuauauguacaaaucuugauauaauuaaagauaaauuuguuuuuguuguuguuguuauugcuguuuuguuuuguuugagacagggucucacucugucacccaggcuggagugcaguggcgcagucuuggcucacugcagccucgacauccaugcucaagcaauucuccugacucagcccccuaaguagcugggacuacaggcacacgccaucauacccggcuaauuuuucuauuuuuuguacagacaggguuccaccauguuggccagacuggucuggaacuccugaccucaggugaucugccugccccagccucccaaaguucuaggauuacaggcgugagccacugcacccagccaauauaaauccguuuuuauuaaucuuaauuuauaugauagacagugcuuuuguguuuuaaaacaaaauuucucauuuaagcuucaauugccaucaagauaggcaauauagcuacaguuuuacaaauuagaaaaccaaguuagaggccuaagauugaacacguaauaagccaaagaaagguaagcuuuuuuuuuggucugaaaaaaaauguuuaaacucuugaucguuuuuaggggauaauuauuuaugauuaguguuaucuauguucugucuuaaaaaaucuucaccuauaccaagguaaugaaguucccuccuguguuuucuucuugaagguuuauuguuugaacuuugugauuuagaacuacaguucggguagaauuuauuuuuggaaaggaaacuuuuaauaagugauguugggacaacuagaucaaaaugcggaaaaagcaaaauuagaugcauuucuuauucucuauaaacuauauaaauuacaaacgucagaaauccuuauuaaaaauaaaaauauacugguaauaaaaaccaauaaaagaauauauuucuuuauaaccugugaguagggaacauuuuucuaacuuuaacucaaaaucuagaaacaauaagggaagaaacugauauuugacuauauaauuuuguguuuaauuuacaucacaaaaaaauuauaagcaaaugaaaaagaagaccaacuggggaaaauauuuauaaauuacguaacaaacauacacagaggacuaauauaacuaauauauaagguaugucuaaaaauucagaagaaaaagaccaacaaccaacugaaaaauugacaaaagaugcaagaaauaccauuucucaccuaucagauuggcagaaucuuaaagucugaaaauauauucuguuggcaagggugugagguacucucauccaguagucaugggcaugcaaagugguacagacuuuuaaagaaaggaauuuggcaacaucugaaaauauuaccucuguguuuacccuuuggucuagcaaucccacuucuaggaaucuaucccaaagagacaacagaagguacagaaugcauacaguuauaaaagcacuauuuguaauagcaaacaucuggaaacaaccugaaugccuaugcguaauaagguacuaguauaauaaacugugguauauccuuccaguguaguacuaugcagcugucgaaagaaaugaggaagaaguauauauucugcuagggugugaccuccagauacguugguaaguuaaaaaauaaaagcaagguccagaauaauuugcucaguauaguacuuucuaaguaagagaaggagggagaaaauccacuuauucauuuaaauuuuccaaaagaaacaauggcaaaaaaauagaagacuaauaccaguauguagaagaacgaggaaucaagggaaagcagacagggacagaagcuagacuuugccaacucuaucuuguuuuguacuuuggaaccacauaaauauuuuauguaauuauaaaacaacuuuaaauauuuuuuaaauuuaauuaaaaaugaucaaaauaauaccuaaaaauaaagcuaaaacaaguugguagcauauucauuugagaaugaauuauuucagguuacuuuagaacacaguguuuugacuuuuauaucccuaguggaauauauaauaaauccuaaauuauauuuguuugucauauuguucauaauucuggucuuguuauuuagaaacuuaaacagacacacaguuggauaaaacaagcaagcaaauaauuauguuaaugccaccagaaccaagacuuucagcauuuaaaaaaaaagauacaaggccaggcgcaguggcucacgccuguaaucccagcacuuugggaggccgaggcggguggaucaccugaggucaggaguucaagacuaaccuggccaacauggcgaaacccugucucuacuaaaaauagaaaaaauuagccagguguggugucaggcaccuauaaucucagcuacucgcgaagcugaggcacgagaauugcccuaaccucggggcagagguugcagugagccgagaucaugccacuucacuuuagccugggugaaagagcaaaacuccaucucaaaaaaaaaaaaaaaaaaaaagauacaaguauaaaaucaaagauuuaaguaaaacuccugcagucuuaaauuugaauuggcaauauuaguacggacucaauuguuuuucuaaaaaaugccaguguccaaggucuguccacugaaaaugcuuagaagugaugaauaaccauaacacccagauuaugggcuuucauauauaccauuucccacuaaaaggaggcagggcucuuuggguaaaugccuuacuccagucuaggguaggaagucuugugcugggcggggagcagggaagcaaaaaagcuuauaaucccaguacuuugggaggcugaggugggaggaucaguugacccccagagaaagagaggagggagagacaauuuuguugaaaggacaaaaguugaacaugaaggagcuccuacuagauguaaguggggcaauuuaaacaucauaaugaaugacuccaaaggauugaaacacaauauguacaaacaauuucagggagaguucuuauauauugaggaaaguuuccucuuuuagcugaauucaaacuaauaauacauuuagaaaaugauacaauuagaaaaaucacaauuuuacauccccaaauguauuaaugggcuucagcaagaauuauuuguggcuguuaaacccauuagacgagagguuacuggggaaauuuauagcagauggauaaagucugaacccacugauaaaucuuagcauuacuaaaagugaggcaaauuuuccauuauacaaaguuuuaagauauuuuaaaaaucuacuuuuauauagaauuuaagaauguuaccuuuagauauuuccugauguuuacuuuaagaagcacuagacuaggugucacaucucuuuuguucuacagcucagaaacaaaaauacaaccuaacuuaaaaguggguaaauaacuugaauagacauuucuccaaagaagagacacgaugacuaacaagcacaugaaaaaacccugaguguauuuaguuauuagggagaugcaaaucaaaaucacagggacauacuuguuuauacccacuuggccauuauuuuauuucauuguuuuagagacagggucuugcuccauugcucagguuggagugcaguggcacgcuuauagcccacuguaacuucggaacuucuggcuucaagugauccucccaucucggccucccaaaaugcugggaguggccauaauuuuuaaaauggaacauaaccaauguugaugagaacguggagaaugugggcacguaaaauggugugcugcuuuggaaaacaauuugucaguuccuuaaaaaguuaaacaauuaccauaugacccagcaguuuuauuccuagguauauacccaaaagaauagaaaacagguauucaaacuaauacuuguauacaaauguuuauugcagcguuauucacaauagucaaaagguggaaacaauccgaauguccaucaagugauaaauggauaaacaaaauguaauguauccauaaauaggcuauuccucagccauaaaaggaauaaauacugauacaugcugcauguggaugagcuucaaaaaaacuacguuagguugggcacgguggcucacaccuguaaucccagcacuuugggaggccgaggcggguggauaacuugaggucaggaguuugagaccagccugaccaacaugggaaaacucugucucuacugaaaauagaaaaaaauuagcugggcaugguggugcacaccuguaaucccagcuauucgggaggcugaggcacaagaaucguuugaaccuaggaggcggagguugcagugagcgaagaucgugccacugcacuccagccugggugacagagcaagacuuugucucaaaacaaaacaaaacaaacaaaacaaaacaaaacaaaaaacacguuaaaugaaagaaaccagacagccagcuaguguugccaggggcuguguauagaguguaugaacagugacugcuuaauggugaugaguuuccuuuggggugaugaaaaugucuuaaauuagacaaaguugaugguuguacacauugugaauguaguaaauaccacugaauuaugugguuaaaaugguuaauuuuaucucaauuuuuaaaaaaguccuugccagcagagaaacccugggaggcaaaaaaagaaaaaauuuaaagaauuuuaaaaguccuugguucuauuagauuggugcaaaaguaauugugguuuuugccauuauaguuccaauuuuguugguaacuagauacguuaccuugguuuaaucacuuaacuucucuggaccucaguagccucacuuagaaaaaagguuuguauuuugaaucuagauaaucuuucagcucuuaagcucuauuguuuugauuaauaaccauguauuuguaauuuauaauucugaaauaauuucguauuuacugaaaaguuguaagaauaaugcagagaauuuuuuauauauucuuuaccgacauucagcacuuucuaauauuuugccauauuuguuauucuuucccucucuucugaaccauuugagaguagguugcuuguuuuaugcuccuuuccuuuuaauacuuuaaaacuaaaguauuuaguuuuccuaaaaacaaggauacugucuuauguaacaauauuacauucauuaaauuuuuaaaaauuaaugauacaauacaguacuauauacaauuuguaguucauauuccaguuuugucaacuauuccaaaaauaucuuuuauaguauuuauucaagugugagauccaguucaagaucacuuucuauacguuuuagucaugucucuuuuuagucgucuuuauucuggaacuguuccucagcuuuucuuugccuuucaugacacugauauuccugaagaauacagaccauuuguuuuacagaauauuucuuuuuuuuuuuuuuuggagacggacuuucgcuaugucgccaggcuggagugcaguggcguaaucucggcucacugcaaccuccaccucccggguucaagggauucuccugccucagccuucugaguagcugugacuacagaugcacgccaccaugcccagcuaauuuuuauauuuuuaauagagaugggguuucaccauguuggccaggauggucucgaacucaugaccucaggugaugugcccaccuuggccucccaaagugcugggauuacaagcaugagccagcgugcccagucucagaauauuucuuaauuuagguuugucugauguucuccaaugauuaacuucagauuauaccauauauccuuggcuguaaagcaacauaaaugaaauuaauaccuucuuuggguuuugcauucagaggcuaauaucauuuuuuaaauuauauacaaaauaguucugacaggcaaaguaacagucucaugcaugaaaacaauaccauuuauuauaagccuacuguggguccuuugcauaucauugucagaguaguucuguguguuuaauuuuuuuuuuagagacggagucucgcauuguugcugaggcuggagugugguggcacgaucucggcucacugcaagcuccaccucccagguucaugccauucuccugccucagccucccaaguaacugggacuacaggugccugccaccacguccagcuaauuuuuguauuuuuaguagaggcgggguuucaccauguuagccaggaugguaucgaucuccugaccuggugauccgcccgccuuggccucccaaagugcuggaauuacagacgugagccaccgcgcccggccuaauuuuuauguauuuguuugagauggaguuggucucuguuacccaggcuggagugcagugaugugaucacagcucacuacagcuucaaccuccugggcucaagugauccuccacuuccgccuccaaaguagcuggaaccacaggcacgugccaccaugccuggcuaauuuuuuuaauauuuaacauuuuuuuuguagagacaggguaucccuauauuacccaaacuggucucaaacuccugggcucaaacagucguccugccucggccucucaacgugcugggauuuacaggcaugaaccaccacacccagcuauguguuuuauaaaugacuuuuuuuaccuuaacauuaucaucaucuaauugacuguuaaauacagaauauauuuuaaguucuguuaacuuguguucugauugguauuuaguggaaaauauguuuuauuuauggaaaguauguuuuauuuugcuugauuacuuuuuaaauuauguacgugugauguccucuuugugcuaauuaaauauaaauuauggguaaugggccacuauaaacucuaauacccaaagaugccuaugacacacaugaucugauggguuccucauuugucaugaacucauguuccuuuaauauuuuuagcuaugcaagaagaggccuugaagcugguguuacuggcauuagaagaugguucugcccucucaaggaaaguucugguacuuuuuguugugcagagacuagaaccaagauuuccucaggcaucaaaaacaaguauuggucauguugugcaacuacuguaucgagcuucuuguuuuaagguaagcaguaaguaucuauguaaagacaugccuguuugugagacagagacuuccugaaauucauguuacccagucuagaggcccuagcaaugcagaaugcuuacaagaguugagaggaaacuuuccuucugcauugauugcaucugugauaccaccuuuugguaguacccauuacuaucuauuggcaaaauaagagcauauaugugaagaugucaguaacggaaagaacauaaggaaaucauuugguaaacuugacucuuaucaaguaaaaguggacugcagaagccucauuucuuuacauuuagugucuugaaaucagacuauauuggaaacuucauaaggaguauguaaacuuuguaacccauuauuauguuuguuaucucauucucuguagugauuagauuaacaccuuuaaucugaaaauggccuacauguuaucucagauacaaccaggaaauggaaaguugaggagauuggcccacucugcuuuuagauguuguuuuuuguuuaguggaaaggguagagaagaaccccaagauauuuuaaaauguaguuucauugucuaauagucuagcggguagugacagauacugaaagcaagcugaauccuuaaaguguuuuuaugauccaagaguguagguugcuggcugggucuugagaaaggcucauguacuuggaaauagaaaggccuauuggcuucuaugaaaguaaaacauuuaaauuugaaaccaaagcuuauuuagguuauuuuguugguuuuauagcccccaagagugaaaauaguacagacagaaaaauguuucuuuggcagaacacuuaguuugagauaacagguaguugauaauagaaauguguugaagugaauucauuuaacuccacuaaugaggcuuggacacuagcugccucauagucauaguguuuaguuucaugcucuuagggcaacaauugaaauuaaucucugguuccacacacaaccucacuaggcccuguaaaacucuguaucuuuugaauguguaguuuuuuuuacuacuuaaguagaaauuaaagcuauguaaauacccugaugauaauuucucugguagcagaacauuucuucuuuucauuuuuuuuuuaaagcaacagacuuuugcucuguugcuuaggcuggagugcaguggugccaucauaguucacugcagccuugaacuccugggcguaggccauccuccugccucagccucccuagaaaauuucuuaauuaucaugugguagugguaauauaugccuaccuauuagcuggauuccuugcuugucuaucuuuauccucuacuguuaccaaagugauguuuuuuaaagcauaaaucugaucaugucacuucuaugcuuaaaaauccucaaucagcucugugcagugguuuauaccuguaaucccagcacuuugggaggccaaagcgagaggauugcuugagcccagaaagucaaggcuacagcgagccuagauugugccacugcacuccagccugggugacaaagacccuguccucuccauccccaccccugcaaaaaaagucagugguuucacauucccuucauaauaauauccaaauucccugccguaguauauaauggccuguauucuucucuagccuguaucauaucuuaacccuaugugcucugcuuuuucauguuucuguuucaccacuuguuucucuuuuaaaaauucuauuucucccccuucucuuuuuuccuuuuuuuuuuuuuuuuuuugagacggagucucacucugucccucaggcuggagugcuguggugcuaucucagcucacugcaaccucugccucccgaguaggugggaguacaggcgccugccaccaccaugccugacuaguuuuuguauuuuuucuugagaugggguuucgucauguuggccaggcuggucucaaacuccugacuucaagugaucugcccaccucggccucucaaagugcugggauuacaggcaugagccaccaucccuggccuccucaccuuucuuugcucaggaaacuccuguuuauugugcacaaaucaauucauguagcuuucagcugggagaagccuuuucugaaaucccuuucuucucccuaauuuaauucccuuuccucuuuguugccaucaagccuuauaacuuuuacuauaauuuucuacuuacaaguuucucuuucuuacuaguggcugaaaucauugaaggcaaggauuauguauuuaguuauguaaguucuguuuuguuccagaaagaauuuguggucaggacauuaucuuaucuuuguaccuuauuucuguggugucugauauguaaguaucccccacccucccugaaaaaggaauaaacgaaucaguugaagggagaaagcacagaccaauucugauuuuucucuuuucuauuuuuuagguuaccaaaagagaugaagacucuucccuaaugcagcugaaggaggaauuucggaguuaugaagcauuacgcagagaacaugaugcccaaauuguucauauugccauggaagcaggacuccguauuucaccugaacagugguccucucuuuuguauggugauuuggcucauaaaucacacaugcagucuaucauugauaagguuugugaaauuagagaugcugauguucuaucauugcuguuacauugaagaguauuagaauauucuaaagagucuauacacaaacaguuggagauuccuauguuuuuaaaugucagacucuuauaaauuauccuuauuuucuuuuuauuuuucuacuugcaaaauaaagggaugcaacagggaaacaaauacaugauacuagcauaaaagcagugaggcuuacaaagucucaaauuuaucuauauucugaccucagagaguuaauacagcuuauaaguuuucuaagugucuaaugaugaauuucauagggcagauucugaggugaaaauuuaauucaucacugauacuccuacuguggaaucugaagacacuugaaaacguauuaaauauguugauaaauugaaaguauuugaguauaaaugugucauaagaaccaaaguaaaaagcauucucauuucuguuuguuagcuacagucuccagagucauuugcaaagaguguccaggaauugacaauuguuuugcaacgaacaggugacccagcuaacuuaaauagacugaggccucauuuagagcuucuugcaaacauagacccuaauccagguaugugggaauaugcucaguugcuuauauuuuuuucuacuuuugaggugaauaacacaagagaauuacugcuaacauucuucccccccaacccccaugcccuugguggcuuauuuuagacgcuguuucaccaacuugggagcagcuggaaaaugcaaugguagcuguuaaaacaguaguucauggccuuguggacuucauacaaaauuauaguagaaaaggccaugagaccccucagguaaguacauuuauuacauuucugacugcuguugucucuaacucaguuucauccugaacaucuuaaccagcuguuuuguuaauuggacuccguaugugacucauaaguuucuaucaucucuauucuuuugggaggaacccaguuuuuaguguacuugguaaacauuucauagcacaccaagaguuuagaggguaucuugggugugaguauacuuuauugcagaauauuuuugaccaaauguagauaauugauuccaaacguuuugucucauucuuuucuacugugggaaauugucauuuuuuuucuguauugaauuucuauauguaaauuuauggaauuugaauuuucuuucuuuuuuuuuuagacaaagucucacucugucacccaggcuggagugcagugacgcuaucucagcucacugcaaccucugccuccugaguucaggugauucuccugccucagccucccaaguaacugggauuacaggcaagugccaccacgcccugcuaauuuuuguauuuuuuguagagaggguuuuaccauguuggccaggcuggucucaaacuccugaccucaggugaucugcccaccucggccucccaaagugcugggauuacaggcgugagccaucgugccuggccgaaauuugaauuuucaagauacuuuucaguguacuuuagaaguuaagauauaaaccuggccaggcacaguggcucacgccuguaaucccagcacuuugggagguugaggugaguggaucacuugaggccagaaguucgagaccagcuuggccaacauggugaaaccccaucucuacuaaaaaaaaaaaaauacaaaaaugagccaggcauugugguggaugccuguaaucccaacuacugagacggcugagucaggagaaucgcuugaacccgggagauggaggcuacagugagccgagaucgcgccacugcacuccagccugggcgacagagugacucuugucuccaaaaauauaaaauaaaaagaaguuaagauauaauccuuuauacuuauaacuucuauuuaauaaauuauuaugagccauucacuacauucaauguuuuacauguauuauuucuuauccucacagccaccugcaauguaguugcuguuuccaagcugaaauucaaagagguuaaauaacauaagauugugcugucagggggcugggcgcgguggcucaugucuauaaucccagcacuuugggaggcugaggcgggcggaucacaaggucaggagaucgagaccauccuggcuaacauggugaagccccaucucuacuaaaaauacaaaaaauuagccgggcgugguggcaggcgccuguagucccagcuacuugggagcucucugaggcagggagaauggccugaacccgggaaguggagcuugcagugagcugagauggcgccacugcacuccagccugggcaacagagcaagacuccgucucaaagauaaaaauaaaaaauaaaaaagguugugcugucaguaagagcugggaucaaaccuacacuuuguacucuucucuccuuauucuuagaagauauuauaacuuaaaauauuaaaaacaaauguuuucauccuaggcucauaagaauaagaaugucuuagauuuugaugcaaauuguagaaguaauagugaaauuuuaauauucugccucauuguaugaacucaaauaguuuaagccugagaguugcacccucaagcugacaagugaauugguaauuuuucacuucuagguggaauuguauucuaccuuuucugagaaaguuuaaguagacaaagcuuuugguuuuuuuuuaaugcuuuuuaaaauuguuugauuuugguagcagaauuuuaagacagcaauaaauugaugaaaaaauauuuucuuuuucugggcauucuguuaacuaaugaauaaauggacauaacauuugaaccaguuucgaauaaucuucagaaggaauaucugaagugccaauucaggguuaugucacauaacucacaacaggaaacaauggaauauuaguuguuucagcacaagaauuacuugucuaaugugaaaaagaauuaaagguguaauuauaaaguucugaacuuccuagagugaauaacaaauggaaucuucaccuugccacucauugaauguguucccauuuuuguagccucagccaaacagcaaauacaagacuagcaugugccgagauuugcgacagcaaggggguuguccacgaggaacaaauuguacauuugcccauucucaggaagagcuugaaaaguaaguguugagaauucuguuucauauggguuuaauuuuugauuuuuaugggaauguuauauacaguccugaaguuugugaugacuuucaaaaaugcaaguuaagggcugggcaccauagcucaugccuguagucccagcaguuugcggggcugaggcaggaggauugcuugugcucaggaguuugagaccagccugggcaagauaaggagacccccgucucuacaaaaaauuuaaaaauuagcuguguggcccacaguuguggucccagcugcucaaaagacugaaguggaaggauugcuugaaccccauaggucaaggcugcagugaguguguucacaccacugcacuccagccugagggacacagcaagacucugccucacaacaaaacauauaagaucuggguacaagauuuacauaagugauuuagaacuuuacucaguggucauauuuugagaccauuuuauagcuggaauccauauuuauacugagcaccugugcagaaugaaaauacuugcagucuuauuugcucagauucaguuaaaccuagcagcaaagucucaggcaaaaugguaaagcagauauauauccuuuuuacggcuuuuggucuuuuuaacauucuuuuucccuguguauucuuucucuucuccuaugguuaaccccuuuuucuaugucccuuuacccgagaccuaaaaguuaauguauguaagguuuaauacuauuauccaauuuuuguuguuuuguuuuuuaacuaagacuuucauuuuugagaccucaccaaaaaauugaucccagcuuuucuacuuucugcuggccaguguaucaacuuuuuuuuuuuuuuugagguggagucuugcucugucgcccaggguggagugcaguggcaugaucuuggcucacugcaaccucugccuccccuguucaaacgauacuccugccucagccucccgaguagcuggaaccacaggcgcccaccaccaugccuggccaauuuuuguauuuuuaguagagacaggguuucaccauguucaccaggcgggucucaaacuccugaccucaagcgaucugccugccuuggccucccaaaguacugggauuacagacgugagccaccacaccugcccugucuaucaacucuuugugggcauauucauuuuguuuuuagauacuuuaaacaaacugagcuaauuuucucccauaccuccuccuccugccuuccauuguacucaccucguguacccaguuuagccauccagccuguuauauaugcuguguuauaauaaucauauuugucagcuguccuuccuuagcuuuuucugcuuaaucagucaaaaaguucugccaauucaucuuccuauauauuucucaguucuuuauucuucuuuccauccuugugauccaagcugucaucuccuuuucucgaucccuuguugccuucucacuagucuuaaaucucucgcuguccaccccuucucccauuauuucccuuaaaacagaaauauuuuaaaagcacagauuuacucauaccacccuucuucaccuaagccuuugauagccucucauuguccuguagauuaagaaauaaaaucuauguuguggccucuaagacccugcaucaucuaaucugugucugccuuucugaucucauuacacaacacuaauuguacucaagccacacugaccuucucucaguuugugguaugcacugugcucuuucccaccucaggucuuuuacauaaugcuguuacuccuagccuugccuuugagaccuuuccuuugucuagcucauccuucgcuuuuucaggguaauuccccugacacuucauacuaaccagcuuccucuuucaaacacuuaucacauaaaauuaauuaguggccuguuuuagagcuugacaaacuucuuuaugaaguccagcuagcaaacauuuuuggcuuugugggccacagaaucuguuacaaccacucagcagugccacuguagcaaaaaaacagccacagacaaugcauaaauugggcauggcuguaaacuuuauuuauaaaaacccuuuacagaaacuauggcccaugaucuguuuauuaaauguuugucuaucuuacauaaguguaacccccguggacuauaucuucauuguugucuccuuuccucaguggcuagcuugggcacuguacauaaugagcucuacaagcagcagcauugugauagagagaagauaagugugugugcagugaaaagagcagaaacaugcuucucuucucaguuuuuuuccccacuugaagugccuagagaagaggauuaaggaguccuaaggaaaaaagaugcuguuuguacccaaucgaacuaguucuauauacagaauuucacaucaagauaauuugggagacuccaggaaauacauucagcuuguccauaccugaaauagagcuuuuuagcuaaaaggggagcuuuugagaaaguucgacuaaaaaagucagagaagaaacugugguuucauugccauuccacccucaauuagugcccaggcugaaaauccauuuucuucuuucucauaccuucaaacagacuucacauucuucaucugcaguaccuaguucagaacuuuauuauauuuugccagacuuguaauaguagcaguaaaaauaauaauagccaaacuagguguaguggcucaugccuguauucccagcaguuugggaggcaaaggcaggaggauaccuugaguccaggaguuugagaccagccugggcaacauagugagaccucaccucuacaaaaaaauaaacaaaauuggcugagcauaguggcauacgccugucaucuuagcuacucaggaggcugaggugggaggauugcuugaacucgggaggucaggucugccgugaacugagauuauaccacuguauuccaacccgggcagcagagcaagacucugucucaaaaauauaaauaaauaaaaauaauaaaauaauaaauauauaaaauaucacucauucaaaaauaauaauaauggcaaaauuauuggucacauuuuuaguguuucacaugguaauccaguugguuuuacugcuucaguggcuuuuuauccaguaucuuccuauaucucaaucugucuuuuccauuuccacuauuuucuuuuuaaaauaugugugucuccuuuaaauucuuaauuaguuccucaguacaucacagaaucucauccugauuuuauccucuagcucuacucugccauuuguauacuuuguuuuuaagguauauucaauuaaucacuguugauuacuauauaaauuucuuuuacucuucuuuucacuugucuauauuguuuauuccauauuguauuauuuucucucuccucuuuaucuggauaacuauuucuaaucauacucagauauuaucuucccuccacagacuucccuaggcaguguuaauugcauccuucaccaugcugccauagcacuccauacauaguaguuuaaaaauuaugguauaguuagcugggugugguggcaagcaccuguaaucccagcugcucgggaggcugaggcgggagaauggcuugaacuugggaggcagagguugcagugagccgagauggcgccacuauacuccuguguggacgacagagcaagauuccgucucaaaaaaauaaauauaaauaaauaaauaaaaauuaugguauaguuauaaaacuacaguauuauaauuguuuauuuacauguguguuuucacuggacuucauuuaucucauggguuauuaaucuuuuuuuuuucuggagacagggccucacucuauagugcagugguaugaucuuggcucacuugcaacuucugccucccaggcucaggggauucucccaccucagccucucgaguagcugggaccacagacacacgccaccaugccuggcuaaauuuuuuuuauauuuuuuguagagauggggauucaccauguugcccaggcuggucucgaacuccugagcucaaucugcccaccucagccucccaaagugcuaggauuacaggcaugagccauggcaccuggcaaggguucuucaucuuuauauuuccugcaucuagaaaacaccugauaacauaaacucaguauguuuauguggaggagcaaauaauauacaguucuuacuucuuauuuccaaccagcuucacacucuauugcuguuuaaacaaacagggauaauacaaaggauuagaaaaguaggugaugugacuguccuuucaguuuaaaaaauacauauugcuaccucacucugagcuuuuugaggauaggcuguuugucuuaguucacauaacaccagaaauucagcaaauguuuguucaacuuaaauaaauuaauuuuaccuauauuuucuuucucuauuauacaccccucuaaccaaacaaaauguggaugcucaauaaucccuucuuagaauacauauuuauuauauguaaacauaaaauaaauauguagaauaaauauuauguaaauauguggauauguuuuagaacuaggauguugggguuauguuccaaagaauugcuacauucuggggagugucaaaagcgagggaucaaccaacucaacaaauaguggccaggagcaguggcucaugccuguaaucccagcacuuugggaggccaaggcugguguaucacuugaggucaggaguuugagaccagccuggccagcaugggggaaacucugucucuacuaacaauacaaaaauuagccgggcaugguggugcacgccuguaaucccagcuacuggggaggcugaggcacgagaaucgcgugaaccugggagguagagguugcagugagcaccacugcacuccaaccugggugauagagugagacuuugucucaaaaaaaaaaguuauaaaagauuauuauauacugguuacuauucaagauguuucuaauggaaaaagaggaacaguaaacauguaaauaagcaauuuuggccauagcaaagaauuuggauuuuauucuguuugcaauaagaagucauuuuagaguuuuauuuaaauggaaugaugaaauuuucauuuugucuuagacauaucacucuggugucugcauggauggagacaaguuaaacuucuauauugguccacaggugggaguuugguagcucggguaggacuauagcaauggaaaugaugaaaaguagucauacuuaggauauauuuuggaaguagagcugacaacauggaccaauugaaugugggcuauaaagaaaagagaggaaucaaggaugacuccaagguauggagccugcauaacuuaguggucucuugcugaaaugggaaaugcaucagggcagaaaaucagugguucucuuggccauaaugauguuugaagcuuauucuauauuaaugcaacaaauaauaauugggggccgggugagguggcucacgccuguaauuccaauacuuugaaaggcugaggcaagaagaucacuugagcucaggaguuugugaccagccugggcaacauagcaagaccuugucucuacuacaaaaaaaaaaaauuggcugggcauggugacucacuccugccugggugauggagacucugccuuuaaaauaauaauaauaauugggcacuugggauguuaugagacaguguauugugugcuaaagauagagagaugcaagaaaggcaaaagucuuguccuccgggggcuuacauuguaguaagaagacagacaugaaauaaauaaauauagcauaauaucuuguaaugacaggcaguaugaaaaaaaaacacaaaggagaaaaagagugauugagaaaggggagaucucuuagauagaauaguguaggaaagacucuuagaagauacaacauuuggccaggcgcaguggcucacgccuguaaucccagcacuuugggaggccgaggcaggcggaucacaaggucaggagaucgggacuauccuggcuaacacgaugaaacccccccccccacuaacacggugaaaccccgucucuacuaaaaacagaaaaaauuagccgggccugguggugggcaacuguaguaccagcuccucgggaggcugaggcuggagaauggcgugaaccugggagguggagcuugcagugagcugagauugcgccacugcacuccagccugggcaacagagcgagacuccgucucaaaaaaaaaaaagaagauacaacauuugagcagguagucaaagaaggugcccacgagaaaaaaagauaauuaccucagugaagucuuagaggaaggcaaaugggcuugagaccuaggccacagguggugagacuggcuuuagucaggaacaggaacucauugucccuuaucuuuaagaggaauguggcuacaggugcaggaagguuacuggaauugguagcggaaagauaaauuauucuccucugcuuucaucuauuuucgugguuaagugggaaacaauaucaucuagcuguaggaggggugguugaaaguggaagggaaaaggcuauuggagaugggaaaaugaacuuaguaaagaagcguauuaaugaauuauuuauaauuuugaagggauuauagacagcgugauugcacaauuuuucuccaacauuuagcugcuugguagcaggcacaaaauaaguaaagaauuggauugagcuuuuaccaaaugagauacagagggaguggaucaagggaguuaaaaauuauuuacaagggagggauuaaugguagauaguggauucuaagauggguaagaagggauuuaaaaagaauagggagaguuacgcaugguggugcacaccuguagucccagcuacucuggaggcagagcugggaggaucacuugcauuuaggauuuaaggcagucuaggcaacauagugagauccugucccugaaaaggcagccuuuagcugccccaauacuaagaauucaguguauaucccuacuugucacuugcuuuaccucacuugguuaagauuuuauuucuccugacucuuuuuugagagguucauaguuaaaacuuuauuuuuugcuuucuagagcaaccuuguggauuaucucaguuuguuguuuuuuuuuuguuuguuuguuuguuuguuuguuuguuuguuuguuuuuggagacagagucuugcucugucggccaggcuggaguacaguggcacaaucucggcucacugcaaccucugucucccaggcucaagcaauucuccugcuucagccucccaaguagcugggauuacaggcaugucccaccacuucuggcuaauuuuuguauuuuuaauagagacgggguuucaccauguuggccaggcuggucuugaacuccugaccucagguaauccacucgccucagccucccaaggugcugggauuacaggugugagccaccaugcccggccaaguuuuauuuuuugaggauggaaagcaaggagacacgauauucuguauaggaacucugaggaaaagaauaaugagaguagguuucagagagaauguggaggaaggcauagggaucuuugggccccuccagacaaccagauugucuuccugaaauauaggucugcucaugcccuucuugaaagaaguaauuauugguuuuccucuuaucuauaagaugauguuggccaggcacaguggcuuaugccuauaaucccagcacuuugggaggccaaggcaggcggaucacuugaggucaggaguuugagaacagcuuggccaacaugaugaaaccccaucucuacuaaaaauacaaaaauuagccagguguguuggcaggcgcgcgccuauaaugugcaccuguacuccagaggcugaggcaggagaauugcuugaacccgggaagcagagguugcagugagcugagaucacacuauugcacuccagccugggugacgagcaaaacuccgccucaaaaaaaaaaaaaaaaaaaaaucguguaaacuggccaucaccuguuuuuuuaauauucuguuacuucacuuuuagccagucuaaucuaggagcacuugucuuuuauugagcaucaccuuccucugccaauguguacauguuaaagagaaggagaagagaaggacugaauaaugaaguuguuuauagauaccagaggacuaaaagggaaacuauugugaaggcauugcuuacuacuaacacuuuauauuuaauuaccauauguuuauauauaacauuaauaacauuacuuuaggcauauauaauuaugacaccaaauauguauagucuucuuucuguucgugaacuuaauuuuucaccgcuuuaaaaauguuguaggggccaggcaugguggcucacacccguaaucccagcacuuugggaggccgaagugggcagaucaccugaggucaggauuuugagaccagccuggccaacauggcaaaaccccaucucuacuaaaaauacaaaaguuaaccaggcgugguggcaggcacgugccuguaaucccagcuacuugggaggcugaggcagaagaaucacuugaacccaggaggcggagguugcagugagccgagaucgcgccauugcacuguaaccugggcgacaagaguggaacuuaacccccccacaaaaaaaaaaaaaaaaaacacauacacacacacacacacacacacacacacacacacacacacacacacacacauauaggagggaauauuguuaaggauuauauuauaaugaaauuuugguguauacauagaaacacauuuucuuuuuauuuauuuauuuauuuauuuauuuuuuauugaucauucuuggguguuucucacagagggggauuuggcagggucauaggacaauaguggagggaaggucagcagauaaacaagugaacagaggucucugguuuuccuaggcagaggacccugcggccuuccgcagcguuugugucccuggguacuugagauuagggaguggugaugacucuuaacgagcaugcugccuucaagcaucuguuuaacaaagcacaucuugcaccgcccuuaauccauuuaacccugaguggacacagcacauguuucagagagcacaggguuggggguaaggucacagaucaacaggaucccaaggcagaagaauuuuucuuaguacagaacaaaaugaaaagucucccaugucuacuucuuuccacacagacacggcaaccauccgauuucucaaucuuuuccccaccuuugcccccuuucuauuccacaaaaccgcaauugucaucauggcccguucucaaugagcuguuggguacaccucccagacggggugguggccgggcagaggggcuccucacuucccaguaggggcggccgggcagaggcgccccucacauccccgacagggcggcuggccgggcggggggcugacacccccaccucccuccuggacgggguggcuggccgggcggggugcugaccccccaaccucccucccggacggagcggcuggcugggcagaggggcuucucacuucccaguagggguggcugggcagaggcgccccucaccucccggacggggcggcuggccgggcggggggcugacccccccaccucccucccggacggggcggcuggcugggcggggggcugacccccccaccucccucccggacgggguggcugccgggcggagacgcuccucacuucucagaugggccggcugccgggcggaggggcuccucacuucucagacggggcgguugccgggcggagggucuccucccuucucagacggggcggcugggcagagacgcuccucaccucccagacggggucgcggccaggcagaggcgcuccucacaucccagacggggcgguggggcaaaggcgcuccccacaucucagacaauggguggccgggcagagacgcuccucacuuccuagaugggauggcggccgggcagacgcuucucacuuuccagacugggcagccaggcagaggggcuccucacgucccagacgauaggcggccgggcagaggcgccccucacauccccgacagggcggcuggccgggcggggggcugacccccccaccucccuccuggacgggguggcuggccgggcggggugcugaccccccaaccucccucccggacggagcggcuggcugggcagagggucuccucacuucccaguagggguggcugggcagaggcgccccucaccucccggacggggcggcuggccgggcggggggcugacccccccaccucccucccggacggggcggcuggccgggcggggggcugauccccccaccucccucccggacgggguggcugccgggcggagacgcuccucacuucucagaugggccggcugccgggcggaggggcuccucacuucucagacggggcgguugccgggcggagggucuccucccuucucagacggggcggcugggcagagacgcuccucaccucccagacggggucgcggccaggcagaggcgcuccucacaucccagacggggcgguggggcaaaggcgcuccccacaucucagacaauggguggccgggcagagacgcuccucacuuccuagaugggauggcggccgggcagacgcuucucacuuuccagacugggcagccaggcagaggggcuccucacgucccagacgauaggcggccaggcagagacgcuccucacuucccagacgggguggcggccgggcauaggcugcaaucucagcacuuugggaggccaaggcagguggcugggagguggagguuguagcgagcugagaucacaccacugcacuccagccugggcaccacugagcacugagugaaccagacaucgucugcaaucccggcaccuccggaggccgaggcuggcggaucacucgcggcuaggagcuggagaccagcccagccaacacagugaaaccccgucuucaccaaaaaaauaagaaaaccagucaggcguggcggcgcgcgccugcaaucgcaggcacuccgcaggcugaggcaggagaaucaggcagggagguugcagugagccgagauggcagcaguacaguccagcuucggcucggcaucagagggagaccguggaaagagagggagagggagaccguggggagagggagaccguggggagagggaggggggagggggagggggagagggagacauuuucuuaaauggaauccaaaaucaaauugccaguccuuuuguguauuagaguauuauauccaaugaucaccauaaauaaaacucaaaacuuaguaucagaaaaaucuuucauacaaauguuuuuaacuuuagguauaaacuauucugagaacuauaauacagaauuucuauuuuuguguaauguuuguuuaagaaugaguuuuuuaaauuauuuuuuuaaauuauauaauccuuuuacaguuugguaacaacagaaaauggcuucagcucuugcauaccuuuucucuuuacucuguguucucaaccaaauuuguugccaguuccugucauuuuuacauaacaucccuuauauucuaguuauacaaaauuuucaaauggucucuuuccacucccucaaaagguuuuuuugaauacauucuuggacaaaguggcaugaggggaaaaaaaaauacauauaaacucggcuugcuauauuaauuacauguauauuauaugugaauggcauauauauuuucauguggcaucuguugcaguagaauuugauauagacuguauuugauuauuuagcugaagaaacuuuuugucaaaacuguuuccuccuuuuucaaucuauucccauugcccauugccauuuuuugucuugaguaagauuuagugaaauauucaccaaucuguugauuguuuuugaaacagguaucgauuaaggaacaaaaagaucaaugccacuguaagaacguuuccucuucuaaauaaaguugguguaaacaacacugucacaaccacagccggaaaugucauuucugucauaggaaguacugaaacaacagggaaaauuguuccaaguacaaacggaauuucaaaugcagaaaacaguguuucccagcuaaucucacguaguacugacaguaccuuaagagcucuggagaccgugaagaaagugggaaagguuggcgcuaauggucagaaugcugcugggcccucugcagauucuguaacugaaaaguagguauuagguaaaaaugauuacuggaaauucuuuuuccuuuuuagaaaugccugaguguuuuuauuucugcugaugaauaccgguuaaucagaauuuuuaugcagaauauuuugugauguagaagaaacacuaaauacuaaaaaauuugaguucuaguuugguucugcaacugaauagcccugugaacuuggaaagugggaaagugacuuuaacucugaguuuuguuuuccucaacucucccaaagagacuggaccagaauuguuuuuuuuucacaccuuauuuucuugaacuguaguguugauuccauagaggugccagaaaagaacuaaauagaaaccuaagcagguaaaaugcugagccucuagcucuguuucagucagagcgcuuucacuuuauacucuguaaugagguguagcacuuggccgggugcagugguucacaccuguaaucccagcacuuuuggaggcugaggcaugcagaucaugaggucuggagaucgagaccauccuggcugacauggugaaaccccaucucuacuaaaaauacaaaaaaaaaauuagccgggcaugguggcgggcauauguagucccagcuacucaggaggcugagguaggagaauggcaugaacccaggaggcggagcuugcagugaacccagaucgugcuacugcaauccagccugggcaacagagugagacacugucucaaaaaaaaaaaaaggaggggacucuuuggagccacacucucugggcuuucaaguucuggcucaugguuucccagcuguuugaucuuaggccaguuacuuaaucugucuaccuuaguuuacuccuucauaaaacuagaauuauaauggugucaacuucauauguugguugcgaggauuaagugaauuaauacuccaguaugccuugaacaaugccuaccagauaguaagcacucaguaaauauuugcuuuauuauuauuaucaccauuaauuguuacugagugucagcauaagauuuccuuugucagaggguuuuggugccuuuagaaaaagguuuuuaaauuuucagauuaucugaaaaguuguuuccaacucuaaaaucuugaguaagauuuagauugaugaauauuuuaauauucaucaauauguugauguucagauuuuguugccuauaaauagucuaucaguaucuguuauaugccugcuaggaaaaaagcauugugcuaggcacauagcaaucaaugauggauagauaagcaguaacauuugcuacuucugcagucagcacaugaugggggagauuguuuauuaaaggacuuuuacaggcugggcacgguggcucaggccuguaaucccaacacuuugggaggccgaggugggcagaucaccugagguugggcguucaagaccagccugaccaacauggagaaaccccgucucuacuaaaaauacaaaauuagccaggcaugguggcgcaugccuguaaucccagcuaccugggaaggcugaggcaggagaaucgcuugaaccugggagguggagguugcagugagccaagaucgcaccguuguacgccagccugggcaacaagagugagacuccaucucaaaaaaaaaaaggacuuuuacaaucuucccugggcaagauuuuagaaaagauauauuugagaacauggucuaguuaacaaauguuauuuaugcacucaaucuuguagcuguuuuuggcacaugaauacaagauacuuugcuuuuaagggauuuaugauauaguuguggagacagcauuuacacauaugaaacaguacugaaguuggauuaaaggacaggaaaauuuuauauugcugggagaaauaugggaaauuacagaaaaaaaacaacauaacauggauuaaaucuaucuguaauuauauggaauauugaggagaccagucuuuuagaucugaaggcuuauauuagggacugguauaaaauaagguuagauagguuggugccagauuauggagaccuuauguauacauguuuaggaaauaagcuuuugaagauuuuuggcaagaaaauuuuguaaaacuguuuuauauccauacaauggaaaauucagccauaaaaaaggaaugaaguacuauuaugugcuacaauauggaugaaccuuuaaacauugugcuaaaugaaagaagccagauacaaaaggucacauuuauguuaaauguccagaauaggcaaauucauagagacaggaaguagauuaaugguuucuagggguuuagggcugggacaggaauggggaaugaaugcuaauggguacagguuucucuuggggaugaugaaaauguuucagaauuaguggugauaauuggacagccuugugaauauacuaaaaauuacugaauuguacacccuaaaauaaugaacuguaucucaauuuuuuaacaaaauagacuaggguaaaaacuuuuuuuuuuuuuuuuuuuuugagauggagucucucugucacccagguggagugcaauggugcgauuucggcucacugcaaccuccaccugccagguucaagcaauucuccugccucagccuccuaaguagcugggauuacaggcaccugccaccaugcccggcuaauuuuuguauuuuuaguagagacgggguuucgccauguuggccagacuggucuagaacuccugaccgcaagugaucugcccgccuuggccucccaaaaggcugggauuacaggugugagccacugugcccagcugguaaagacuuuuaaaaaauaaaucuaaauuuuuauuggaacacaguuguuccaguuguuauuggaacacaggaaaaagaauaauucuaugagagguauuguggauggcuucuuagaggugaagugaugauaccugagcuauuuccaaaaguauggauagcaaggaaggaagggccuuguggauggagaaggcagcacaggcaaaaugaauaaggugugagagaagcugccauggaggagagccuagaauccugaaagucaucuaggauagugaucucaugcucacuaggaugugacugaagauuagcuuuuucuauaaguuccaauuuuugagauagcuugcaugauuucaugaggugauaaauguugaccuuaucauggaucuuguugccuugaagauuagcuuuuucuauaaguuccaauuuuugagauagcuugcaugauuucaugaggcaauaaauguugaccuuaucauggaucuuguugccuuuuuguugauaagucuaugaguuuaccauuucaaaguacuaauccaaauuuuagguauauaacauuuugacauggagggaccagauaauuuauguaaagcacagugccuggaauagacucaaauaaccacuugauaaauauuaguuauuguuuuaaggaaauccuaaucauuuuccuuguugucucuauuuuacuuuauguaaagaauaagcacaguccuaaaauaucuuuauacucuaaacccuuacguuuguaccuacuuuuauuacccacaguuccuuaguuauuuuuuacauuuuaauauacaguuacacauagaaguaaacaucugcuagacuaaucugugauaaacuuaaaggcagcccauauaccuuuuucuuuauauccuaccuuuaaaaugauuguucuaauuugaggaaaaaacccucuaaucugguugagaugcaauguauugaguuccugcauaauuaacaagaucauuuucuucacucaucacauaucuaaagcuuugucaaaauuugacuaaaacaagcaaauacaaucagcaaaauaaauauagcuacaaauccagcugacuaagcuuuggccauauauauaugguuuuuuuucuuuucuuuuuuuuuuuuuuuuuuugagacggaguuucgcucuuguugccugggcuggagugcaauggcgugaucucggcucaccacaaccuccgccuccuggguucaagcgauucuccugccucagccucccaaguagcugggauuacaggcauggaccaccacacccggcuaauuuuguauuuuuaguagagacgggguaucuccauguuggucaggcuggucgcgaacucccaaccucaguugaucugccugccucggccucccaaagugcuaggauuacaggugugagccaccgugcccggccgaaauuugacuucuuaaaaggaguuaagaaagccauaagauccuuuccagcugauuacuuagugacucaaccaagaaaauucuuuuguguuaaaaauaauaauaauaaaagguugguguguuuugccucaauuuaaugaguuaccauuucauucacccagcaaguauuuacugaguaccuacugcaugccaggaacuguuuuauuugucugacaaauauuuaccaagugccuacucuguuccaggagcuguuuuaggugcuggggauauaggaauuaucaaaauaaacaaaaguggccuuuccucaaggaguucauauuucagcuaaucuaacuccucauagaaaacaacucuuuucuuaccaugucuguuuucuuugucucaaauaguuccacuaauggacuauauuuuuucgguugagaacuugucgaacagaauuuucuuuuuuuuuuuuaaccuucaguagggaaaaauguuuguuuaaagaaugaguaauggccaggcacgguggcugaugccuguaaugccagcacuuugugaggcuaaggugggagaauugccugagccuaagaauuugagacccuccugagcaacaaaucuagaccccgucucuacaaaaaaacuaaaaauuagccgagugugguggcaugcacuuguagucccaucugcuugggaggcugaggugggaggauugcuuaagcccaggaggucaaggcugcagugagcuguuauugugauuaugucagugcacuccagcccgggugacagagugacacccugucucaaaaaaaaaaaaaaaaaaaagaauggguaaauggugacuaaugaaucacguuaauaucugggaaucguuuuuauucccuguggcccacacaggaauaugacaucuguuacgaugaucacgugaauuagcuguguaagguggcagugaaauucauugccuuauuugucaauguggcaaugucugaaguguuuucuauuagugguuucagaauauaauuuuauuaaaaauuucuaguaaggaggacagucauagacagugauuucuccuuugcccuuuguuaaauuuucucuccaguaaaauugguucuccacccaagacuccuguaaguaauguagcagcuaccucagcugggcccucuaauguuggaacagagcugaauucugugccucaaaaauccagcccauuucuaacuagaguaccaguauauccuccgcauucugaaaacauucaguauuuucaagauccaaggacucagauacccuuugaagucccacaguacccacagacaggugaguaauuuuagacaauucuaagaaaaaaagaaacauuguuuccuuuagauaaaugaaugaauaguucuagaaugucuacauuuaaaaaaauuaauccuuuugacuaugugacucauaaguuuuuuuccuuccccaaggaucugugcuucuaaauacagcuuuaagguugucauuccuacaaaucaaauauaauagggucaggaaugaacuuuagggguuuucuguaaguccccugaaaugauguaaaaaaauguuuuauuuauguaugcuuauguucaauuuuggaaagagagugaacaacuuacauagauuuugaaagaggucuuuaacgucugcucccaaaaaaguuaauaaaaaucaaugauauaacugacuaauccaaaaccaguggcaauagaugcccuagaaggauauuuaccauccgucuguuaauagcucuguuguguguuuuaaggagcacuuuagcaaaguguugaauguuaaugauuuucauauaguggugucuugaaaauauguaguuuguggucaggugugguagcucacacuuguaaucccagcacuuugggaggcccaggagaaucacuugagcccaggaguuugcgaccagccugggcaucauagcaagacccugucucuaccaaaaaaaaaaaaaaaaaaaaaagccaggguauaaagcuuuauaaagcaggguaagguaagguucaaagcuuauuauauuuuccuacauuaagggcugccuuagauuuaagccauuauaaaauguuggauuguacuaagauuacauuaaauauuccucuuuccaauuuucaaggauacuauccaccaccuccaacgguaccagcugguguggcucccuguguuccucgcuuugugagguccaauaacguuccagaguccucccucccaccugcuuccaugccauaugccgaucauuacaguacauuuuccccucgagaucgaaugaauucuucuccuuaccagccuccuccuccgcagccguauggaccaguuccuccaguaccuucuggaauguaugcuccuguguacgacagcaggcgcaucuggcgcccaccuauguaccaacgagaugacauuauuagaagcaauucuuuaccuccaauggaugugaugcacucaucugucuaucagacaucuuugcgggaaagauauaacucauuagauggauauuauucgguggcuugucagccaccaagugagccaaggacaacugugccuuuaccaaggguaagugaagaugcuacuauaauguagucauuaacagcccagugucuggagucaaaccacccagguauauauccuggcuccuccacuuacuaauugugugacuuaaggaaguuacuugaccucccuaugccucaguucuuucauuccuuugauggaaauaauaguaguaccuaccucauaaggcuguugugagaauuaaaucagaaaaucaaaccucuuagaacugggccucauacauguuaaugcucaauaaauguuauauuuggauaggaaauuguugggaaaguagaaagaaaucuuaaaaauacaagguuaggaccuuuuuucaguaucaccacauacauacaaaugacuucccuaagcaagaaaagugagugcucagauucugcguuuaacaucaguugaauaaauauuaaccuuuuuauuuuaaguguauggagaauagacuagggugacuuucccugcuguauuuuuuuaucccaacaauaucauaaacuguuuacaucauuuucacacaguuaaauuuauucaccacucccuagaugauuaagauuguuucuuuuaucccccauuaggaaccuuguggucauuugaagaccaguugcgaggagcagauaagaagaaagccagaucagugggcacaguaccacacucagaaagcaccucuugucucuucaacucuuccuguggcaacacagucaccaacaccaccuucuccucuguucaguguagacuuucgugcggauguaagaaagguuuuaauuacuuaauguugcagggauaggucaaacagcugacuucaaauuacucauucaaaccaggaauagcuauguuggauauuugcagugguuuggugugcaauugaguuuaguucaauaaacacugaauauaaaugcacuacggcuagguguuaugagacucugaagaccguuaaggcauaguccuuuacuaagaauucaaaaucuuuccuauaguauaauuauuuuaugguuguuuuauuaauagugugauuuauaucuaucauuuauugagcaccuacucaugccagcacuguauuaguacauuugcauaaagcuauuuuauuuaauucucacaaaaaccuuagggggcagguauuuuccauauuuuacaggguaggaaucuuacagaaguuaaguaauuugcccaagaucuuucagcuguaaauagcugggauaugaauccugggcugucugagguauuucuucccuacuuaacaagaagugcagaaauaccuacaguauuauuuaugcucuuuacaucacugcuaauuauuguucuuggcauuaccaaacaaguuuguguaccaggaugauuuuaauuuaaucugguguuuucaguacuguuauauuuggagaaaaccauuaauuucuuuuuuaaguuucuucugguuuauuccccauccccagaaguucugauauuaaaauuuuuaaaaucuuuucauuauaaaaaauuucaaacauauacaaguauagagagaauaauaugauaaacuccauguacccaacacccagguuccacgguuaucaacucagucaguacugucuuauuuauacccccucuucccccuggauuguuuugaaguaauccuaggcauuauauuuuuuaacccauaaauauuucaauaaagcauugaauuuuuaaacuagauccaaauaggucuugucaaacuuagacuucuucaaagcagguaaauaucuugacaacagagugacagagcugccacuugcuugcuagaugccacuugcuugcuagaugccacuuguauuuucuuuuuugauauacaauuaugcuucaggaaaugaguauuucccugagacuccgaucugcugaguucgacuugagaaaaguuuuuuaacuuuuuugcccuugaguuuuuuuaucugaauaauuaguaaacuagauuuaaugauucuuauaacuuuaguauucugguccuauaaguauuccuuauucacagucccuuuaaaauuuauucauuuccccuuuaucuccagagccuccuuugaauuccuuuuguucuuugauacugcauaauuuaucaguuauauucccuuauuugcacauguucuuuuucucaagaaaauuauaaacucagcuugguguaguggcucaugccuauaaucccagcacuuuggaagaucgaaguggguggauugcuugagcccaggaguuugauaccagccuaggcaauauggcaaaacuucaucucuacuaaaaauacaaaaagauugucugggcauaguggcgugugccuauagucccagcuacuugggaagcagagcugggaaaaucaccugagccugggaagucgaggcugcuagugagcugugaucaccccacugcauguuagccugggcggugggagugagacccugucucaaaagaaaaaagaaaauuauaaacuccuuuaggauauggacugugaucucuguguguaucuauguauuuguuuucucuuacuuuuuuuuuucuuggugcaccccauaccauguuaguaccauacuauaaauauuuguuaauugguuuugauaguauuagucaaauguuccauaugagcacuuaaaggacaaagugaaaagggaaagcaugccauuuucuauuguaaaaauaccauuucuugcuuauuacaguuuuuuauauuaguuauugaaaaaguauaauuguuugcuaugaaguccucugaauucuauaauaguuacuuuauauuaguuacaagcuuguaaauuuaagcuucuuacuaauuggcuuuauuuauuuuuuuuuaaccaguucucagagagugugagugguacaaaauuugaagaagaucaucuuucccauuauucucccuggucuuguggcaccauaggcuccuguauaaaugccauugauucagagcccaaagaugucauugcuaauucaaaugcuguguuaaugguaugauuuugcugggguugcagggguuggaggugagagaugaugcauguucacucauguuguagaaugaauguuuucuauucauucauucauauuguugccuuauaacucaguagcagcaggguuauauuuagguaagucugaaauaaauuauauuuaauauuuaaguuauuugaacauuggugguuuacugguaguuuguuggauuaucguugagucuagagcuaguuuuaaauuaaccaaaaaaccuaauuacaugucuuuugauagcauauauuuacuagcugaaguaauugccaacaguccuuuuauugauuuucuuugguuuacauaggaccuggacaguggugauguuaagagaagaguacauuuauuugaaacccagagaaggacaaaagaagaagauccaauaauucccuuuagugauggacccaucaucucaaaauggggugcgauuuccagaucuucccguacagguuaccauaccacagauccuguccaggccacugcuucccaaggaagugcgacuaagcccaucaguguaucagguaauccauuuagauaauaccuagccugauauguucuaagcacuaugccuuuuuuuuuuuuuuuuuuaauugagacagagucucacucuguugcccagacuggaaugcaguggugugaucuuggcucacugcaaccuccauccuggguucaagcgauucuccugccucagccucccaaguagcugggauuauagacaugcaccaccaugccuggcuaauuuuuguauuuuuaguagagaguauuuuguauuuuaguuucgccauguuggccaggcuggucuggaacuccuggccucaugugauccacccgccucagccucgcaaagugcugggauuacauaugugagccacugugccuguccuaagcacugugcuuuuuaauccccaacuugugaaauggaaaacauuucccuccauuuaacaaccaugggaaacucagaauuagguguuuaaccagcaucauauggcuagugggauaaaauacagaucuauuuugagaaguauacauucaccucaguacacugauuuuucacuuuuuugaccauuguuucauucuacaugucuguagauuaugucccuuaugucaaugcuguugauucaagguggaguucauauggcaacgaggccacaucaucagcacacuauguugaaagguaacguucuucuuaauucuauaugauucuccauucucagacuuguauguaucuuaaggguacacauucuacccccaguucaugaaaugugcuuugcuuguugucugagcuauauaacaaauuucugaaaaauauuugcauuuaaauuuggaacgaugagugaaguuuucaggguugaucugucacauaaaacauaugguuauuacugcuuuuguugcuucauucacuucacuuuuauuacaauaaacauauuucucuuuaaagggacagauucauuguuacugauuuaucuggucauagaaagcauuccaguacuggggaccuuuugagccuugaacuucagcagguaggcucuguaacucagcuauaaauuuuugagaaauagaaugacaguugaaagcuauaguuggaagcuaacuuuucuuuuuuucccuccucauauaggccaagagcaacucauuacuucuucagagagaggccaaugcuuuggccaugcaacagaaguggaauucccuggaugaaggccgucaccuuaccuuaaaccuuuuaagcaaggaaauugaacuaagaaauggagagguaaagaaacugaaccuuucggcuucaugcuuaauguauuuguuuucugcugcugcaucuugguuauaccauuacugagugcauuuuggugugccuaucucugauggaugauugauugcuuuuaaaacuuauaacagaaauaaaauuguaaucccagauuucuuaaauaauucuuuaacuagaucaucgggauuuuuguuuuuuugagauggaaucuugcucuaucgccuggagugcaauggcacgaucuuggcucacugcagccucuggcucucagguucaagcgauucuccugccucagcuucccgaguagcugggauuacaggcacccaccaccaugcccagcuaauuuuuguguuuuuaguagagacaggguuucaccauguuggcuaagcuggucuugaacuccugaccucaagugaucugcucgccucaccuucccaaagugcuaggauuacaggugugagcccccgugccuggcugaucauugggauuuuuuacuuuaauuuaaaagggaaaccccagguuccacagguauaaaaucaguauuuuucuuuuuuuuuuuuuuuuuuuauugaucauucuuggguguuucucacagagggggauuuggcagggucauaggacaauaguggagggaaggucagcagauaaacaagugaacaaaggucucugguuuuccuaggcagaggacccugcggccuuccgcagcguuugugucccuggguacuugagauuagggaguggugaugacucuuaaugagcaugcugccuucaagcaucuguuuaacaaagcacaucuugcaccgcccuuaagccauuuaacucugaguggacacagcacauguuucagagagcacaggguuggagguaaggucacagaucaacaggaucccaaggcagaagaauuuuucuuaguacagaacaaaaugaaaagucucccaugucuacuucuuucuacacagacacggcuaccauccgauuucucaaucuuuuccccaccuuuccccccuuucuauuccacaaaaccgccauugucaucauggcccguucucaaugagcuguugggcacaccucccagacggggugguggcugggcagaggggcuccucacuucccaguaggggcggccgggcagaggcgccccucaccucccggauggggcggcuggccaggcggggggcugacccccccaccucccucccggacggggcggcuggccgggcagaggggcuccucacuucccaguaggggcggcagggcagaggcgccccucaccucccggacagggcggcuggccggguugggagcugaccccuccaccucccucccggucagggcggcuggccgggccgggggcugacccccacaccucccucccggacggggcggcuggccgggcggggggcugacccccccaccucccucccggacggggcggcuggcuaggcagaggggcuccucacuucccaguaggggcggccgggcagaggcgccccucaccucccggacggggcggcuggccaggcggggggcugacccccccaccucccucccggacggggcggcugccgggcggagacgcuccucacuucccagacgggguggcugccaggcagagaggcuccucacuucucagacggggcggcugccgggcggagaggcuccucacuucucauacggggcggcugccgggcggagggucuccucacuucucagacggggcggccgggcagagacgcuccucaccucccagacgggguggcggccgggcagaggcauuccucacaucccagacagggcggcggggcagaggcgcuccccacaucccagacgacgggcggccgggcagagacgcuccucacuuccuagaugugauggcggccgggaagaggcgcuccucacuucccagaugggauggcggccgggcagagacgguccucacuuuccagacugggcagccaggcagaggggcuccucacaucccagacgaugggcggccaggcagagacgcuccucacuucccagacgggguggcggccgggcagaggcugcaaucucggcuuuuugggaggccaaggcaggcggcugggagguggagguuguagcgagccgagaucacgccacugcacuccagccugggcgccauugagcacugagugaaccagacuccgucugcaaucccggcaccucgggaggccgaggcuggcagaucacucgugguuaggagcuggagaccagcccggccaucacagcgaaaccccgucuccaccaaaaaaauacgaaaaccagucaggcguggcggcgcgcgccugcaauugcaggcacucugcaggcugaggcaggagaaucaggcagggagguugcagugagccgagauggcagcaguauaguccagcuucggcucggcaugagagggagaccauggaaagagagggagagggagaccauggggagagggagaccauggggagagggagagggagagggagagcaaaaucaguauuuuucuuaguuacagagugauuauacagaagaugcaacagauacuaaaccugauagggauaucgaguuagagcuuucagcacuugauacugaugaaccugauggacaaagugaaccaauugaaguaagugccacaauuagauaauugagaggcuuuguuugauugaaaauuuauaaaauacuuucauacugaaggauuaacauuuuauuuucuuaggagaucuuggacauacagcuugguaucaguucucaaaaugaucaguugcuaaauggaauggcaguggaaaaugggcauccaguacagcagcaccaaaaggagccaccaaagcagaagaaacagaguuuaggugaagaccaugugauucugugaguguuagacagaaaauucauaaacagugggcauaggacauaauaaagagaaaaaaaugcgaaauuaauuuuuggcuuuaugcugugaggggaagaccuuauaugggcaaugauuuggucaaucuggauuuuuagggaagaaaaaguaaaauugaacuaacaaagcaguccauuuugguagccugaaacuugcuuuuuguugagauaaaguuaaucuguguuccagcaucagguuaugcuucuuuaaucugguugccaaauuucuagacuacaaaauggagaaugacaaccuagauuaaugguuucucuuuuugaaaaucauguuaagauuuucuuggcuaggcugggcguaguggcucauggcuguaaucccagcacuuuggaaggcugaggcggguggaucacaaggaguucaagagcagccuggccaacauagugaaacccugucucuacaaaaauacaaaaaaauuagcugggcauaguggcgggcaccuguauucucagcugccugggaggcugaggcaggagaaucgcuugaacccgggaggcggagacagugagccaagaucgugacacugcacuccagccugggcgacagacugagacuccaucucaaaauuaucuaucuaucuaucuaucuauagauagauagcauauaauauaguauauuuucuuggcuauaauacugccauuuugaauaauuacugccaaaaauaugggcuuaaucuucaacuugguaguuuggccuuaaacuaacuaguauuuuaauuuuuaucauaacuuuuggaaaacaggacuuuucaagccaggagugguggcucacaccuguaaucccagcacuuugggaggccgaggcggguggaucauuugaggucaggaguucuagaccagccuggccaacauggugaaaccccaucucuacuaaaaauacaaaauagcugggcgugguggcacaugccuguaaucccagcuacuugggaggcugaggcaggagaauugcuugaauccaggaggcagagguugcauugagccgagaucaugccacugcacuccagccugggcgacggagggagacucugucucaaaaauaggaaaacaggacuuuucuaguuacuucugauacuucuagugauaaagacaugucuuugcuagagacuccuaaaguuugcuguagcuuucauuaaauauguauagucacccuuaacaguuugcacuuaaagcuaauuuguuuuuaaugucauuucuuuuuucucagggaggagcaaaaaacaauucugccgguaacuucuugcuuuagccagccacucccagugucuauuagcaaugcaaguugccuccccaucaccacaucugucagugcuggcaaccucauucugaaaacucauguuaugucugaagauaaaaacgacuuuuuaaaaccuguugcaaaugggaagaugguuaacagcugaaaggagguucaucuuucaaauuugugaccacaccauggaagcauuuacacuagcuuuuuauauauauaauauauauuauauaauguauauuuuuuuuaaaaaaaagauauuacugggggcauccauuuccuguggacucuuugauacuucaagcccucuugcauuagcauuaugaaaaaaaaaaagaaaauuuacuuuacuaggguaacauguucacuuuccagaaaugauuggaauuuggacaacauuuaacuuaagcuucaagcagcuuuuuaugaguuuguagcaauccggugcaguaacugagccauuuccuauuuuaaauggcuucuauagaaaauuaacaacucaguuauuaaacuagcaggauccuacaaugauacaucuagugaaaguagacuuaguuaacuuauuuauuucuauuuuauguuucacugagagaaguuuccaucucauuccagcugcuuuauuuaucuuuuucauggaacuuugcauggauuucuuuuucuuuuuuuaauuuugaagaguggaguuagauguucuuaccauagaauuuuacaggguuauauacuagcauucuuuacugcauuauauguaggaguguggugcagugcuuuuaucuguagcauauaauuuuuuuuuaauuuuccauuuuucaagaguaguuucugcuuuguuaauauuuauacacaggcuacuuguugaaguaauuaauuaaaaauauaaccaagugccuaagucuuucagcugauguacuagauauuaaauucuccuaaguuaugcagaaucguuuuuacaauuuugauaaauuaugcacuaauguaauggcaguuuuuuaaaaugcagauuuaagccuguacauuauugaaucugaugacuuggcaaaagaaucaggugcuuucagcuuucuugagaaaacccuguauguagcguuugcacugacuaacaagaugguauugcuggguuuuuaauuuaaacuaauuaauuugguuguucauugcauuaucuugguuaaauauuguuuauuguuacuucauguugggguuuaguuuuucuuguuuuuugacuguuagguugauaagacuaugaacuguguaauaguagaacaguggcuaacauuuauucauacuuaagaacaugaauaauuucugccuugcuaaaaugugacugaaaugguuuugacuuggcaucugaaaguauacaauguguucaacaagucaugcaucagauuugugggagguauuguacugaaaccuaaauuucagucaacauuugaaaagaagagcugggcauuccuuccuggugaucuuuaccuauaguuuaucuaucuguuuuucuucuguuucuuuaagauuaguuugacuuuuauuauuauuuuuuuaauuaacuucugugaaguuguuuacucugaaaauuguacuggaauauuuuaagccaagcugaucuuucaccagguguacuguauguaagggcuuuuccugcuagcaagaugcuuaaacaggaucauguuauuggucgucugagcuauuuaguuguuuuacaaaaccacagcauuguaucagauaagauuuugauaaaaaguuuugugcacauuuccaggggcgggaggguugacauuucccugaaauuucuugauuagaaugaguaaauacugguguuugauaccugucuuaaugaacaugcucauaaggugacugauaaguuguaaauauaccugagaaacaaagggguaguuuugauauucuggugucaguauggaagaucuuacacauuuauuuaauacucaaauguaugaagauguuuguuuguagcauaacaacagcacaguagccuugacuuaguuuccuuugguuaguacuguaccuuuuuugccauggccagugcuccccaucccuaugaagacauuuuauuuauuucacucuguaaccugaaaugaauaggaacaaggguuuuaaaccauguuacauuaacuuuucugacauuauaaauuagccuagaauauuacaggaacaugauuguuauauaauuuauaucagaaccuuucuauaaauaugugcuuauuacauuugaaaugcuuccaauguacuuuauuugcuguuuguaauuccaaaaaggauaugcaaaccagucugucuauuucauggauauuuaauagugagaucuuccauguugaagguaauguauuuuuuuuuaagauuuuaaaauugcuauuuuguuacaaaauagagaccuauuaacaguuugagagcuccuuaugugcccucagggaaagaacccucugugcaacagaacuacacaaaacaucuucagcacguucugagggugaauauauacuacauaaauugaucuuguguauuuaaccuuaucuuuuuaauuuuaaaauugaaauuuugaaacuugguugugcucugcuggaggggguugggauaaacugcuuagauguuugccuacuuguccagugaaauuacauuugcaucaguauauguauauaccugccaaccuuauugguaugucucagaacauuuauauuaaaauaaugcuugucuugcagcaggugaucccauaaaacaauaacucccuguucuuaaaaacuuacucucuuuuucacuaacaacauaggaauuguuucuguguugagauuauucuguguugcauccauucucuauguaguggucaccuucugucugucauggugggcuuaaugugaaguaaagccauugguucucugccacuuucgaagaaagggcaguucaucugauccuucuucagaaugguaccuacugauaucaucgaggaaaauguuacaaaucagaccuaggauaugacuuuuuaaaauugaggcauuucccgucauuuggccuuuuuaccaacaagaugugauguacaaauuuggaaucaaaggauacaaagcaacaagagaggaaauguguaauguggguaaccaaacugcauauguuaccuauugucuaaucagaaaaaauagucugaggucuggaaagcaggaaaguggugguuauuuucuuucauuuuuuguguuuuuguuuuuuaauuucuaaguuccauucugaaauccaugugccgcauucaguuacugugguuguagcaucaguuuuuuugugguuucauuucauuuuaugaauucagaggaaguuacauauauauuuuuucuaguugguaccugaacaaagcagauucccuugccuuugcugccacgucuuauuuucaaugccaugugauaaaccagugucauacaugaaaguugugcauuguaauuuucaaaaaaaagggaguucauuaggccaguggcacugauuuuuccuucccaucauagcuauuuauucuaguaagaggauaauaaaagaaauuuccuauacaagaacugaaauuuuccauuuguauggaucuagucacuuucagauuucaauuugagguuaaguauauaaagcacaucccaauuuuauaugcugccuugagaaaauuacaggaugcacggcaauuuguaggaauuucaaaugggaucauuuaaacauuugaaaaauuauuuuaaaaaccaucuaguuugcuuuuggauuuuagacauuaaagccuauguugucuuguuaacagggguggaauguauaaccaucagauucagcaugugauuucaccuuugaaucugaguauuucuucccuaucuucuuugagucauuuuuggagcagacugucaccaguauugauaacuaagcauuaaagggaaaaguugcauugcaacuaugcauugguuuccuggaagaacuuuucuuuuguuuuagugaaugaagaggcuugaugggaucacuuacuguaacuccuucuacauaaggaccccuucugcaagcagaacacaaaagaacaugcucaaggaguaucccauuuucuggauaaauugaagaaguuugcuaguaaugucuuuauacuagcgucuuccuuguaucccuuugcuggcaagggaauacaaggcgucaagaccacagaucaaaacaccccacauuugaguggagucuuauuuuuacuccaagagcaguuauucccuucuagucuaaaauuggcaguuuuuucuuuuuuuuaauaaaauuuuuaaaauauucccaaaccaguggaacacagacacuggcugcacuuaguacugccaaaagccaaggucauuugcacauauuccaucaaccugucgagaauuaggccucacuuuauaacccaaggcauggaagugcaugcauucucuuagcugggcaaacaauuauacuguaguugugauacaacacauguggcuuuuauuuguacugcacauauccacuguacagccacuugggaguaucgugguuagcuugcagcaacugcugucugcauuuauacuguuuauugcauauucuuuucccuggaagugaaagagaaauguuuuucuuguugcauugauuacauuuuauaaauuugcuuagcuggaaaguuugggaaaagaggccuguuugucaauuguacaaccgauugugaagcucuagugugaauauuuuuacgucuguauuagacauuuucuuugcaaaucuauuguucgauugaaauguaaaugaaauuaaagaugguguacacccaucauguaaaaagcaggcaccaucucuaagauggauuuaaugcucauuuuuaaggcauauacucagcuucuauuuaaaacuauaauuuaaaauaauucuguacaaugaaauggggaauauauaugggaauaaauucuauuccauuuauuucaauuugaauuuccaaauuguaauguuucccuuugugcuauaggaauaggauuaaaugggggaagacuaggauuuauaaggccuguauauggggggagggcagagauggaacaaugaggguugugaugauagugaauagcaaagagugaauucuguguguuuuugcuguagcacugaagugaagagauauuagcuuuggcuguucacaaaauagagcaucaugauuuucaguguuugagagaaaauugauggaaaaaguuugcaguacuugacauguauuugcaugcacaaaauaaaauuauuuguccaccuuaaaaguuguuuguuuaaugucaauauuaaguuuaugguauguuuuaguuaucuagauuuucuuggcauaguuuuuggcuuaacagagcuaccaggucacuccuugagauuuaaaugauugcaugccucaucuauauaucauaaggaaggauuugaaagaaaugaauagacccaaggagguugagauauaccuuaauucugucaagucacuuccuucauucaacacagcacuuucugggugggagaugaggauguagauaguacugaguuuacugucuaguggagaaaguaggacagaugcauaacuaauacaaagcaauguaucauagaaguuugaagacaauucuguggaccucaggagaacgccuuggguggaucuagacaccauuuucauugggccucaagugguuuuauucauucauucagcugauauauuuuaaaccccugucugugcuguucaguaagguuaaagguccaugaaacaugaguuucuucucuagaaaaucacaguauggaaaaucagaagacagaauaauucagugagcuauuguucuaauguaggguguagggaaacuccaaaagaaauuaugggguuaguggcaguggugagcaaaaggaaguacuucccuguaaaaugaccuccagcuauacuuuuagcuacauaacaucgcaccaugcagagguaaguagaggaagcacccugaguuccaacuguaccuucacaacaacccacucaaucuugaacuaucauuccuugaaguacugucuuggauagaaaagaggaaaaaacaggccgggcgcagugguucacgccuguaaucccagcacuuugggaggccaaggcggcuggaucacgaggucaggagauugagaccauccuggcuaacacggugaaaccccgucucuacuaaaaauacaaaaaauuagucgggcgugguggcggacgccuguagucccagcuacucgggaggcaggggcaggagaacggcgugaacccggaaggcggagcuugcagugagccgagaucgcgccgcugcaauccagccugggcgacagagugagacuccgucucaaaaaaaaaaaaaaagaaaaaacaaacuaccguccuuuacuuuagauguuauaacccguaucuuauguuugagauguuaucuaacucgcccagauguuguaacuacaaaguaguagaaucagaauucugauuugucugccucuuuucuaccucucaaggagguggugguggucauggugaucggaacuuauauugaccguaaguguuacaauggaagagguguuuaaggaauggugcuucagugacuaauagagcacuuaauauuuucuagaaacaguuguaaguacaauaauauaucacgacuuaggaccauaaaacugaggcugagaucuuaagagauuuugcccaaggucgcagaggagguagguagggacuucaugaaggacagcaaauaccauucuaaagagacgaguuauauaaucuaaacaauuugggauuuuagaucccuuuagccauggggugaaagguaaagcuggagauagaccagcagggaggccaggucagcaaucuagguaagaaguauugagagcauggccaagcugggacggaggaaaaaaagauggauuuaaaaaguaggagacagcaauggacaggauuuguaguguaggaaguc

SEQ ID NO: 13183 - RNA, 23558 nt, Homo sapiens
cagggcugcccuuccgguuccguugggucccccuuuggcucggguuccuugccccucccccuucccggagccccgaggggccggagcuccuggcggugccggauccugacggcggccuucccccgggucuguaagugcggagacggccggagcggcgggcuggggugcggggugucucaaaauggaaccccccuggggcccuggaucaaccgggaccugcacugggaugggagccgagaggcuggccuaggccccuggggacuugaggagcccuuggcccggcccacgcugcgccccgccccuuucccuucccugugacuggaguggggagccugaggaugccccugggaccgccucauaggaccccagcugagggcccagcaguuggcuugggggccugacucuggcaucuuauaagaagugccagaggugaggcccuaagaaaacgagccucgggagccagcccaagaccaggcauucagugccagucuuugagaaccacugugagugcuagguuacccuuuugcugggguuuuccccuauuuggccacuggucgcagcaccuuuuauauuacuggcgcuauaccagacacuggagauuggcaagauauuguuccaguuuucgggauuaaguuugggagccagaucugaacaaauaaguacuccuauguguauauauauguauguauguaucagucacauauguguuaauugcucaaggggccguugcugagaaggcuuuagaaagaaagugaugucugaauuguacuuggagagaguaaaguguugaagaguuuuucagggaagacaguugcaauacuguggagaaaugacugagcauaacuugugugggaagaggaggaaauggggggacuccuaugcacagaauggauaugagacugggaaagucgaccgagguccagauggugaaugguguaauccuaaaggagauggguaguuuuuugaagaguucggaacagaauauugauauggucagauuugcacugcaggaaaucauuuuguucuguagaaagcccauagagaagggacuuucuauuaacugcauuuagacauuuagcuaaaaguuaggaacgcuuaucggagauucuuuugaagggguaaugggaucagccuagugagaggcaaaaaauuccugaaauaaguuauaauggugucauugguaaggagacaaauauacuggagaugauuaugucaagacuccauaauuaacugaaugcugaagaagugugagggaccaaaucuaauucuuagguuuuagaccucugagcugaaggaugguaaugccauuaucagaaauaaagccauaagcuuaguguagauuaugaauucauuuuuuggacauguugaauuaaaggucuaaugagacagacacauagagcuguccagcauggaguuggaaaugcaaaucuuuagcucagccuaaacauuguagcuagagguaaaaguuugaguuaucagcauagaaguggaaaccauggcaauagcuggcaucaggaagagaauuuugaaaaauaaggaaauuuggggggggaggguaaugcuugcauuuaugaagcagaaagaggaauuggagcuaguaguagucagcaguaggcaauaaaguguaggagugcaggguuacagcaagcaagaagacccagaaaucaagagaagggaauuucgaggagagaccacuggaucaauucaugcagagcaucuggagacuugggggaggggagaguauugcauuucuuuaugaagaggucauuagugaccuuuuaaaaagcaauuuaguacagugaugaggugauacucuaugaaauauuagguaccucagcugguuugguguuaaaugggaauaaggauaggacacauuuaaagcauuucacaaagaaaauugacaggcuuuauuuguauaccuaacacaugcuuauaggguacauaccagacacuguucuaagcucuuuaaaaaauuaaaucauuuauuuuccauaacaacccuaugaaauaaauuacuauugauagaugggaauauugaagcagagugguuugaguuuacacagaaaguaguugagcaggguuuugauccuaggaaauacggcuccagaguccaugguuuuacccacugcucuaugcagugacugaauauaggagccaaaggagugggaaacauuuaagcaaagagaggcucauugauaagaauggagaggcuuggaaagagacccagguugagaagaagguaaguaaaggauuuauguuugauauguuuuuuauuucuuucuuccuaaguccguuuccacucucugcccauuuagguuaauuucuuccacuuucaugcuuucauuuaucacuuaccaucuguaaucagaucuuuucuucauauccauccagcucaugaauccucaccuugaugucaugcaggcuucucuggcucaagaccagacucaugaucaugcccuccaauauucccugcuuugcugaaugacauucaucaaagauauccaguuacagaaaccaaauaucuuggagucaucuugacccuuuccccacauuggucaccaagcccaucaguucuuuguuggaaaugucucucaaaucuguuuccccucuccauccauauuauuguugucucucuucaggcccaugccauucugucuugaucuguuuagaguaaucacauacuaaaaugcuuccuuguacuuuucuccaagccauucuccauaagaaauuuuuuuggcuuauugaaguuuagacagugcaugagugcaggcaucaugcauuucaagugauagggaaauagccuagaacagguauuuuugaguaccuugaauugagauuuaguuugguuaaguuuggccauggggauugggauuuagggauuguuaacauagggagguaauaaaacauugagaaacagaagacaggcuuuuugaaaaaaauagcaaaaaauuggagacuuagcuuugaaagagauacuuacccuuauacaauuuagugaagccucaaagaacagaccagcaaaacaaugguggaaaacaguucaauaguuaaguaauuugcccacuuccacauaacaguucaaaaaaaagaacuaggccgggcguggugucucacgccuguaaucccagcacuuugggaggugggaggcugaggcaugagaaucacuugaaccugggaggcugagguugcggugagccgagaucacaccacugcacuccagccugggcaacagagcgagacuuggucucaaaaaaugaaaaaaaaucaaaagaagaauuaaaucuauauucaucaacauaaauugcuuucaaaaacaaugagugaaaaaaguaaguugcaaaacaauauguauaguuuauguauaagaaacuuaauuacguuauacuuuuguggcuagacauauagaaguauuguuuuuaaaaugccaggaggggccgggcacagcgguucaugccuauaaucccagcacauugggaggccgaggcggauggaucacuugaggucaggaguucaagaacagccuggccaacauggugaaaccccaucucuacuaaaaaugcaaaaauuauccgggcuugguggugcaugccuguaauccuagcuacucaggaggcugaggcaggagaauugcuugaacucggagguggagguugcagugagccaagauugcaccacugcacucaagccugggcaacagagcaagacuccguuucaaaaaauaauaaauaaauauauaaauaaauaaacaaaaugcaaggagggagagucaggaaggaucaaacuuaaacugaauacugagugguaggcaguugagaaggggaauuacaucuaaaaucuucaaaaauuuuucaagaagaauacauucuguauauauuacuuaaaaguugaaacaaaagcuugauaacuuggagaguaucgugucaugaaaguuaccuaaaagaagaacaagauuaagguuuauagagagaaaggcuguaguauaauacagccucuuuagaaaaagaacauaccaugucaaugagggacaaagauuuccaaguaguuuugagugguaaguugaaagauaagggcacuuuuaugagacaggugaggaagcaaacugauaccuagcuuaagaauuuauuauacagauagaaaaauuuuacuugccaguaguuauuagaagcauuugagaaaagaaacuauuuucucacugccuguaguauagcaauuuacauugucccaccuggaauauucaguaauuagucauuuuuuacuauccucauuugaacaaagggaaaauuucaaauuaguuauaauuguggaaggauuguauaaauauaaaugaagaggaagugagaauauucccauuacauugauguuugagaaauaucauucaaaacuugcuaauagaaacucaacaguauucagauuuaaucucaguaacugaggcaauagauaauaaagaccugaacuauggcaaugauguaagaauggaggagugaggaguuggugaucauucugaggaaagaaucaacaaaauaugaugacugugucucugaucuaccugaucaguucuuuacuuuccuucaguuacaagaagcuugacuauaaccuagaauuaucugagugauuuuuaugauuauuuugaguaauuacugcuauacuuagaaguuaccuacaguuggggauugugaaaucaaauauauucauaauuuuuauugucugcuuuauuugcaaauggcauuaaguuucaguccacaaagauaaauacacaaaagauggaaaauaauauaaaguaaaauagaugagaaagguauaauaaggauaaaggcauaauaugcaaucaggaauaugacuaauacauauaugcuugccauuuaagucuucuaauuucaugcaaauuuggcuugaaguuauaacuuguuuuuaaacauaaaccuuuuuuugaagcauaacaaaaacaaaaauauacaagucauaagugugcagcucaaugaauuuucuuggccuguguuugugauacugaauguaaggaaggaaaucugaagaguuacacaauuuuuuuuuuuuuuuuuuuugagacggagucucgcucugucgcccaggcuggagugcaguggcacaaucucagcucacugcaagcuccaccucccggguucacgccauucuccugccucagccucccgaguagcuaggacuacaggugcccgccaccacuccuggcuaauuuuuuuuuuuguaguuuuaguagacacgggguuucaccguggucucgaucuccugaccucaugaucugcccaccucggccucccaaagugcugggauuacaggugugagccaccgcaccuagccgaguuacacaauuauuauccuugagauaaaacuguaccagccaggugcaguggcucacaccuguaaucccaacacuuugggaggcugaggcagacagauuaccugaggucaggaguucaagaccagccuggccaacauggugaaacuccaucucuacuaaaaauccaaaaauuaggccuggcgcaguggcucaugccuguaaucccaccacuuugggaggccgaagcaggugaaucacccgggucgggaguucgagaccagccugaccaacaugaagaaaccccgucucuacuaaaaauacaaaauuagccaggcgugguggcgccugccuguaaucccagcuacuggggaggcugaggcaggagaaucacuugaauccgggagguggagguugcggcaagcccauugcacuucagccugggugacaagagugaaacucugucuccaaaaaaaaaaaaaaaaaaaaauuagcugggcaugguggcaggcaccuguaaucccagcuacucaggaggcugaggcaggagaaucacuugaacccaggaggcagagguugcagcaagccgagaucacgccauugcacuccagccugggcaacaagagugaaacuacaucucaaaacaagaaaaaaaaaauuguaccuagauuaguuguuucauaccuggauuuuggcaucaugcaguguaaaccaccaguuccagaucuaacacuuaacacuuucaaccuccguugggguuuacaaguuauuuauguuuucuaagcuuaguuucgucauauacaaaaugugggauaaugguaauacuuaccuguagaaauuuucacgauuaaaugggucaauuuauuuauuuauuuauuuauuuauugugauaggaucuggcucuuucacccagacgagugcaguggcaugaucauggcucacugcaacgucugccucgugggcucaagccauccucccauucagccucccaagaagcugggacuacaggcgcaugacaccacgcccagcuaauuuuuguauuuuuuguagagacgggguuucaccguguuggccaggcugaucucaaaguccugagcucaagcagugugcccacuucagccucccaaagugcuggaauacaggcaugagccacugugcucggccuaaaugggucaauuuagguauaacaucuauaccugaaauguagcaaggaagauuagguaucauuucucuuauuuuuaaauaaaauuaagaugguucauaagaaacuuuuuuuaacuaucaaaaaaaauuuuuuuuaaguguuuaaaacagguucaugccuguaauccuagcacuuugggaggccuugugggaagacugcuugaacccaggaguuuuagguuacagcgagauuugauugcgccacuacacuccagccuaggcaacacagcgagacccugccucuacaaaaaauaaaaacauuagcuaggugugguggugugcaccuguaguccuggcuacucaggaggcugaggcaggacgauuguuugagccuuggugccaaggcagcagugagcuaugauuacgccacugcauucuagccugggugacagaugacagagugagaccuugucucaaaaaaaaaaaaaaaaaagaaaguugaaauuugguuuuauauugccaaaacuauuuugguaacaaacccuagaaagaaagcuuucccuaggcacucaaaagaagauaucauaaugaagagcaucuguaccauagccuaguaauaauuucaugggggaacauuaagaacucauuauucuucuguuuuuugucaaaugagcuguauaaaguauaacaaaccauuggucauugcccucaaauaacuaacagucuauuggaaagagaaacuagugaaaggaaacaauuaagggauaagauguguggccuggaaauaagaauuuaucagagagagacaauagagugggcugacacauccuagggaaaacauccuuuaagaaaccaauaaauuuugcucacauucuuagacuacagcagacagaucaaagcaaacacuucccugaacuaucugguuggcugcuguuguugauaauuuucuugagaacugauggauaggaagcacagucaugcaucacuuaacaacugugauguguuuugagaaaugcgucguuaggugauuucaucauuuugugaauaucacggaguauacuuaaugcaaaccuagaugguauagccuacuacacaccuggguuguaugacacagccuguugcuccuugguuauaaaccuguaccacauguuacuauacugaauacuguaggcaauuguaacacaaugguguuuguguaucuaaauauagaagagguacaguaaaaauaugguauuauauucuaugggaccaucauuguauaugcaguucauuguugaacaaaacacugucauaugacacaugacuaaaugaaacuacacuccagcucuucaucuuuagagcaaggaacaauugucucugaggauaguugucuaaagcauugugaguacugucauaauauagguagaaccaaugaaugcuuauuuuggggugugaggagggaaauacugaucugaggguuucauaggcaccuucaaaaccagcuaaaugcuaaaaaagaaugccacuuuuguuuggccacuugaaacagucauuuuuacaacucugguuacaaauuggaacauucaucacuccaaauccaaaaugaguauuuuaagcuacugcaguugcuaaaagugaccaaugauaauaguuuugcugcuuuaaauuacugacauuuucccuguauaucuucuacauuuucccuucauguuugauacucacugucuuuucucugauguuucauuugcuugucuacaucgcuccucucucaaugcaguuuuuguauuuauugugauuaucgguacauucaaaaugucauacaaggggaaagauuaugcuuuguuuguguuuuuauuaauauacuuauuacuucuucuuauauuggugccacaccaguucccccuccuaaauuucaccucucuuucuuuuuuuuuuuucuuuuuuuuuuuugagauggagucuugcucuguugccuaggcuggagugcagaggcgcaaucucggcucacugcaaccuccaccucccggguucaaacaauuauccugccucagccucccgaguagcugaaacuauaggcgcccgccaccaugccggguaauuuuuuguguuuuuaguagagaugggguuucacuguguuagccaggauggucuggaucuccugaccucgugauccaccagccuuggccucccaaagugcucacaggugugagccacugugccuggccggucaccuucuuucaaugccauucucauucaaaugaacuccuaaauguagaaucuuuacacauuccuuuuauucauucucuauauccagucaguuaccaaguucuuugaaauaucuuuuguuauuuuuccuuucgucuuauucccauuuuuauuucuuucuaggccaucauggccucagaccugcaaugcuucugcagacacuaagcuggucuuccuaacaacaguucuuccuuaccacugucaaacuaaucugauagguucaacuaaugcaaacugagcacuugcuguguauuuagugcagucuuaggcgaugggaauacacacugauuugaacagaagaggguuuggccaguaaugggacaagcaauguagcugcaauaaguauaauauaauucaaagcaaaaguaaagaauauuuugucuuagaagaugcaaguucccagcauuagauggagauacuucccccuaauaccaugaaacuuggaguuuggaugggaaggaauaaguauuuaauaaaguguguugaguguuacaguagaaguaugcaaugggcccagaagagacaauucuacucuauuaagcggucagggaagggccucucagagaaaauaaaggagucacaauuguuuagaaagugguguuuuuguuuguuuuauuuuacuuuguuuuuuuagacagagccucauucugucacccaggcuggagugcaauggcacaaucucggcucgcugaaaccuucaccucccagguucaagugauucuccagccuuggccuccugaguagcugggacuacaggcacgugccaccacaccuggguaauuuuuguauuuuucauagggacaggguuucacuauguuggccaggcuagucucgaacuccugaccucgugauccacccaccucagccucccaaagugcugggauaacaggcaugagccaccaugccuggcuuguuuuuuguuuugguuuuuguuuuugugauggaguuuugcucuuguugcccaggcuggagugcaguggugcaaucuugacucaccacaaccucugccucccggguucaagugauucuccagccuuagccuccugaguagcugggacuacaggcaugugccacuacgcccagcuaauuuuguauuuuuaguagagaugggguuucuccaaguuggucaggcuggucuugaacucccgaccucaggugauccgccugccuuggccuccagaagugcugggauuacaggcgugagccaccaugcccagccuagaaaguaguguuuuaaacuaaggaaacaaguaucauuaggucuggagccaagagagagcuguuauguaucaggcauuaaggaauaagaauaaaaccuggacucugccaucaggagcugauauccauuguuacagaaguuaagaugauaaagauuggacuuugggguccagauguggccaggagaagcugguugucucaucugacucugaacuaagggguugauuaauacauaaaauucagugaauuucuugaugcacugagauuauagagcuauaucucaaagacagaccuagcauaccuaccaaucucauagaagacugguauauaaagagaaugucaauucauuaugucauuaguuuacagugacuaguggacuggaauuaucguguuggcauggcaaauuuaucuuuucccuugagagagacaaaugggaagccagguuaugagaaaaucauuuaugagaguauggaaucagaacauggagacuuucaccaaaggaauugcuauauaaaggaaucaguaugcagacaguuuggggaaagauaccuucuccauuguugaauggguuuuuccaguguuuaccuuaauuaugauuggguuucauuaaucaguuuauauucaagagguuagucuucauccaggagacaacgggaagucacugaaggaguuuaggcaggggugggguauaaucagaucucuguuuuugaaagauguggugguaugaaaacuguauuagagggaacauaagcaggaagccaaggcaacauuuaugaaucaguucuaguaguccacauaaugacuaaugauugauaaauagggauaaaguuuaaagaacaaaaucuaauagggauugauucgaucuauguuaccgcuacucagauucccaccauauagcucaugucguuuuucuacaucaaguaucuuauuuucuuuauaaagaaguguuccuuaaaacggaguuuagauuuuuccagaauggacaggacaaagaacuuugucuuugccuaaacauugucccguuaguucugugacuuucauuuuauugcagaaauacuuguaugaauaaguucauaucaauuuaaacagaaaagggcuuggccaggaauuggacaagcagugucagugcaguuguuuaaaauauagagcaaagaaaaagagcaaaggaacccauguuugcuguagguucucucuucuucagagaccaguuuuuacugaaugauuccagagaggugaaaaucuccauauuagaguucugaaguggggagacaauugcuuuugccuuagaagaagcagguucacaguuuuauauaaaauaagauaauuauuucaucuuuacuuguguggguuauguuuuaguuugcuuuagaaaccugauagaauucucauuugagaaguuaaaagauacucuuggacuaucccaagcacuauucucguauaaguaucuuuaaaaguugaacgaaugccaagcuauuuacacaaauacaagucugcucuuuaggugcaauuggcacuugauauugguaagguguaauuuuuaacagccuuugaaaccuguuauaguggcuuccccuuucaaggaagauuucauuuggauacauacaaaacagauaugacaacacagauuuguuuuuggaagguagauccagcuuucuuaauugucugaguuuccuuaaauucaaccuuuuuacauuucuguucuuuaggucugccaaaaugucugaaagaucagaucuccuucacuucaaguuugaaaauuauggagauucaauguuacaaaaaaugaacaaauuaagagaagagaauaaauuuugugauguuacaguucucauagaugauauugagguacagggacauaaaauuguguuugcugcagguucccccuucuuaagagaccaauuuuuacugaaugauuccagagaggugaaaaucuccauauuacagaguuccgaaguggggagacaauugcucuuauccuguuauaguggugugcuggaauucccugagauggaacugguaaauuacuugacugcugcaaguuuucuucagaugagccacauuguagaacggugcacacaggcccuguggaaguuuauaaagccaaaacaaccaauggauaguaaagagggaugugaaccacagagugcuucuccccagucaaaagaacagcagggagaugccagaggcuccccaaagcaggacucaccuuguauucauccaucugaagacaguauggauauggaggacagugauauucagauuguuaagguagaaucuauuggggauguaucagagguuagaaguaaaaaagaucagaaccaguuuauuucuucugaacccacugcuuuacauucaucagagccccagcacucccugauaaauucaacuguggaaaacagaguaagugaaauagaacaaaaccaucuccacaauuaugcccuuucuuauacaggcagugauaacaucaucauggccucaaaagaugucuuuggcccuaauauucgagguguagacaaaggccuacaguggcaucaccagugcccaaaguguaccaggguguuucgucaccuggagaacuacgccaaccauuuaaaaaugcacaaacucuuuaugugucuacucugcggcaagacuuucacucagaaaggcaaccuucaucgacacaugcgugugcaugccggaauuaaaccuuuccaguguaaaaucugugggaaaaccuuuucucagaaguguuccuuacaggaucaucuuaaccuucacaguggagauaagccccauaaauguaacuauugugauaugguuuuugcacauaaaccaguuuugaggaaacaccuuaaacagcugcauggcaaaaacagcuuugauaaugccaaugagagaaauguacaagaccucacaguggauuuugauucuuuugcauguacaacagucacagacucuaaagggugucagccacaacccgaugcaacacagguccuggaugcagguaaacuggcccaagcuguccugaacuuaagaaaugauaguacuugugugaauugaguaggggcuucaugcucacaacucgaacugacugacaauguggcaauagucuuagucuuuuuaggagugauuuugcuaguuugacuucuccaaagccucuguguaggugguagggagugagucaaagcacuaauagaccaggcaacuuaccacuuggaguggauuugccuuacuuuugcccucucccauuuucuguuuugaguuauuuaucuuguaaagucuguuuuccuuucccaaggaauaauuccuuuugucuaccuaacauugacuuaugucuuagacugacacuguuuuaggcuuuucacuaggcacauuccgaagguaccaacaaguuaauaacgucaccuacucuccacuaauagaugcuaugcuaagagaagugaauaaucuuucuuugguagaaaauaggcugagauauaaggugauauugcuauugaccugaaaaugugauagaacuucugguugccuauugauuauuccuccaugucugauaaaugaaucugcuuccuaccauuuguacuugucuuggagcuggcuauaaagaaguaugcugguuuguuauguacucuuuucaacaguaucauagcccaacuucaucucauugaauuguucacauauaccagaguacucucucuugaggaacaccugcaggcagauaguuagggaugaccaugaggagcauaaucaacagggauagaaguacacuuauacaacagcacuuacaugggcgguuucucugguagcaugucccauaagaggccauaugcuuauaauuaauguguaacuuguugaugcuuuugagaucaggacugcuccaggcacgcuaaaaaugugcuaaaguauagugggcucucuaaaaagaggcuauuugggagucucugaauuuuguuucagaguuuagccaucagaaaggugaguuuggccaucagaguuuuguccugugcaccauaaaagucucugaauuuucguuuccucauguaccuuaauuucuaaaacggaugauaaaaguuagguuggacacagaaggggcaaucaaauuucuguauucagauaccucuuaaagguacacugugccaccuugcugccuuugauugcaaauacaaaguuaauuuucaaaaaggaaaaacaaaacagcucuuuuuccuaaaacacauguuguacuucagaccuaaaauucuaagucuuauuuguuucucacccaugaguuagauuuagguaauaguauuaguagaguccuuagagaaucuuaagaggucauuuacuccaccucuuucauuuuaaauugggguauccaaagccugaagagguggccuggccaauauugaccaagguauaacuaaauaugagcuagcaucuucuuccuucuucucgcuaucccuuggcuuuaaaagauuuaguacaugaagaauaaugcauuagcaaaaagcuccuaguuuguguuuccccuuugugucucccuguuggcuuucugagacaaccugaauuuugccaacaaaauaucgcagagggauuuauauuaauuauuuuuuaguuagaugaauauuauauucuucccauccaagugagugauuugcuagguuuguuuagggagggaaaaagcaagaauaaugugagaagaaucuaaaugcgaaguugauuuuguguggaaaacuguuuauuaguuuccaucaggauuuucuguuuuuauuuuugagcuaugagagugcaugcagauuugaaaaauuaggcuugcauagucagaggggaucuucaauuguuauauuugauacguuuacauguaucauuguuaucauauguaaauuaucaucaugugagucagaugugaaguaugauuuuugucuuuuguucaaauauuuaaaaugauaauacaguugagugguaagacuaauagguaccuuaugccuaacaucacucauuauauggucuaaugaugcuuccuagcauugugauuuuuacaugauccagccaaagaguaccaauucuaugcaauagugagacucuacccugucaaccaaacagcauuuuuugguauuuucugucaacaucauuucuucacagggaaauuucaaguuggagugcuucguuugcucacauucaugucuuguuuuuguuacugguuugaagacuaaaaggcacggguucaaauaagauuggucucuuugguuggagacuauuucuggguucauucaguuguucaagaaacauuaguuaagcaccuacuguugcuagacacuaugcuagauacugaggauaaugaagguaagauugauauagucccugcccucauggagcuuauagucucauguggucuuagugaaacaaagucucaauuugcuuuuauacuagaaauaauaaagaaagcugccuugcuguauucgaucaguuaaaaucagcaacuuugugcuuuuguaucaguaaaacauuuaguucucaccuuuugaaaaugcaaaccacugaagugauuuacagucuccuccauuuuuggcuggagagguguucuguuucugugagacauuuuucuaauuuuuguggaacuucacuuuccuccuucuuugcuuauacguguuuguuagauuauauugcaaagaagucaaguuacugauauccaguauuuuacagaggaagaugacuuucaaaacuagucauauuucuguagaggaggaagauuuuuaaaaccuuuaucauucagcauuuguauuuuauggauccccaggagaacuaaaaaggagaugacucucuaccauaguuugguuuaaaaaaaaauuacucugucaguuauuuauuuauuauuuaauacuaaacuccaaacugaaguggcucugagguaaaucagauaugauuuuaauuuaaguuucuuuauuagcagaucuauaaauggaaggugaccaaugucacugcuucuaaaauacuguccuaaacaacccagaagauuuuauuucagcucaugaauagcuguucuaaaucuguuguauguuagacauacuaugaacuaccucuucacuuauuauggggaaguuuccuuaauaaaagugugacgauuaaagcucuggugucauugguuauuuucucacucuccccuccuucuauucuuuuuuaauugcuuuacuuugaauacaggaaggucuucuuuauguauagucuuaaaaauacauauuaagcaugcugagcuugccuucagaaaaaaauacgaauuaaucagaaaguuguuacuagauucauuuacuuccacgagaaccuguugcuggaggagcagagcaacugccuuuaagaauugguucagaggcggccgggcgcgguggcucacgccuguaaucccagcacuuugggaggccgaggcggguggaucacaaggucaggagaucgagaccauccuggcuaacacggugaaaccccgucucuacuaaaaauacaaaaaauuagccgggccugguggcagggcauuagucccagcuacucgggaggcugaggcaggagaauggcgugaacccgagaggcggagcuugcagugagccaagaucgcaccacugcacuccagucugggcgacagagcgagacuuugucucaaaaaaaaaaaaaaaaaaaaaaaaaaaggaauagaauuggugcagaggccgggcgcggcggcucaugccuguaaucccagcacuuugggaggccaaggcggguggaucaccugaggucaggaguucgagaccggccuggccaacauggugaaaccccgucucuaccaaaaauacaaaaaguagcugggugugguggcaggcaccuguaaucccagcuacucgggaggcugaggcaggagaauugcuugaaccugcuaggcggagguugcgguaggccgagaucgugccacugcacuccagccuggaccacagagugagacucugucucaaaaaaaaaagaaaaagaauuucuucagucauaucuucauucagcacaaauacuugaugccuaccaagugcuagacuucgagaauacaaagaucaguaagccacuguccuaaauaacucugccuagaugaggcacaaauuaauacaggcguguuaagugcaauaaugaaggcaggaaaagggauuacagguuucaaacugggaaccaauuaucuuagggcaguucaggauggcuucaggaugaugagauuuauaaacggguucuuuaaagauacguuggggaaggccgggcucgguggcucacgccuguaaucccagcacuuugggaggccaaggcgggcggaucacgaggucaggagaucgagaccauccuggcuaacacggugaaaccccgucucuacuaaaaauacaaaaaaaaaaaaauuagccaggcgaaguggcgggcaccugaagucccagcuuacucgggaggcugaggcaggagaauggcgugaacccaggaggcggagcuugcagugagccgagauccugccgcugcacuccagccugggcgacagagagagacuccgucucaaaaaaaaaaaaaaaaagccuggggaaaaggcuagggcacgucagaggaaacagcugggccaaaaguuuugggauggaggaacgcauuuaagugugaagcuagauccagagguuggggccaucuccugauggggcauuaucuaggcaaucucgaauacggaucuuuaugauaguuucugcucugccaccuuucaaguuguagguggccccaauaaggagaggaaucgucccagaauaauccauaaaaggucugguuacucugacagacgugccguaaccgaaccucaaaccccgucuccaauucggauguucaggaggacucacaaaaggaaauggcucggcugggcgcgguggcucaacccgguaaucccagcauuuagggaggccgaggcgggcggaucuccugaggucaggaguucgauaccagccuagccaacauggugaaaccccgucucuacuaaaaauacaaaaaugagccgggcgugguggcgggcgccuguaaucucagcuacuugggaggcugcggagcgagagucgcuugaacccgggaggcgaagguugcagugagccgaaaucgcgccauugcacuccagccugggcaacaagagcgaaacuccgucuuaaaaaaaaaaagggauggugggggaaaacggcucgagugccgaaacugggacaagagagauggggcuugccggcauucaggagccuuucugucauuccaagaggggggaagugaggaaggaagaccgucucagaauguccuuccggggcgccuagagggccccaguaaagaauaaagcugguuggcaccggauguguuuucuuccaggcuaaguccaucuuccggcuugggcagacgcugccgcggaauccuugacucuaguuuucugagucggugagugagugcaaaguagauuccucagguggagggugccugaggaagaggaggaggaggaggaggacagcugggcucggccccggaguggcuaaucuugugcugcaaccacugggccgacagggccuuggcccuucgcaggguugccuccagaauaccugugugcugaaccuggcauccgguuucaguucagcagauguucccugagcuccuccugcucugugugggccccugagcucggugcaggaacacagaugcaucaggcaccaucucgcggugcucagagagcagcugacucucucugguugaaacgggagguggagucauauuaguuuuacuugauuugggcuuaaaggagccuaaucacuagcugaaaaaaggaacuggaaacgcgaauguaagaaauguguauucgugucuuuuugucuggguaaugauggaaaaauuuaguauugaacgagguucgaguaugaaaaagagaauagaaggugauaaagccauaaagauggguuagagccaaaucgugaugggucucguauucuuuccuaagaaaucuggacugucccggagguagagaagaacgauagaagauuuaaagcagaaaagggaaauuaaaaauaaaauaaaauaaggguuguuaauccugguggcacucaggcggguaaucuggcauacagaagagugugguauaaagaagaccuguuggaagacauugcaguuguccaggugaaccggaaggaggaccuguuguagugguggggaguaggaaguuuggagauuacguuaaaguugcuaauuggauauauuauguuaaaucaacuuuuugguggucacagugcuuauauuggauauucaaaauugauagauuguucuugaccacaaggcacacaacauuuagcaaaagaaacaagcuagaaacuguucacuacaauucauuguaaugaauguuguaacaaaguuaugaaaaaugugcuaugagaucauagagaagugcauuauaaaguucucguuuugagaugguggcauaaagguucauaacaccuacauuagacuuugagucuucuucuuccuaauucagguuugggguuuuucguuuguuuucaccauuacagcaugggaaagcauucccuauccuuauuacaucaauguuuguguuuuauuuugcuuagauugugaucauggcugcugagucugauguucugcauuuccaguuugaacagcaaggagauguggucuugcagaaaaugaaucuuuugagacagcagaauuuauuuugugauguaucaauuuacauuaaugacacugaguuccaggggcacaaggugauuuuggcugcuugcuccacuuuuaugagagaucaguuuuuacucacacagucaaaacaugucagaaucaccaucuuacagagugcagaaguuggcagaaaauuguuacugucuugcuauacuggagcacuugaaguuaaaaggaaagagcuuuugaaauacuugacugcugccaguuaccuucagaugguucacauuguggaaaagugcacagaagcuuugucaaaguaucuggaaauugaucuuucuaugaaaaacaacaaccaacacacugaccugugucagucuucugauccugauguuaagaaugaagaugaaaauucugauaaagacugugagauaauugaaauuucagaagauaguccuguaaacauagauuuccauguuaaagaagaggaaagcaaugcuuugcagucuacaguagagagucugacaucagagagaaaggaaaugaagucaccagagcugucuacaguagacauagguuuuaaagacaaugaaauuuguauccuucauguagaauccaucaguacagcuggugucgaaaaugggcaguuuucacagccuuguaccucuucaaaagcaagcauguauuucucugaaacacagcauucauugaucaauucuacaguugagagcagaguggcugaaguuccugggaaucaagaucagggcuuauuuugugagaauacugaaggaaguuaugguacagugagugagauucagaaucuggaggaagguuauucacugaggcaccagugccccagguguccucgaggcuuucuucauguugaaaacuaucugcgccaccuuaaaaugcauaaacuauucuuaugcuuacagugcggaaaaacauuuacacagaagaaaaaucucaaccgacacauccgaggacacaugggcauacggcccuuucaguguacugugugcuugaagacauuuacugccaaaagcacacuucaggaccacuugaacauacacaguggggaucggccauacaaaugccacuguugugauauggauuucaagcacaagucugcucucaaaaagcacuuaaccucuguccauggcagaagcaguggugaaaaacuaucuaggccugaucucaaaaggcaaagucuacuauaauuauaaucacagacuuguuauauaaaguuuguauuauucuauuacgcaagucuuucuguagagaugcagcauuuguaauauuucauccccccaaucuuuguuucuuauauuuugucggcuuacacauaaucauucuuucugaacuucuaacaguuccaaaguuaugggaggcacaguaaagcugaugggauucugucucaucucauaccuuacauauaagucucaguaguaucccuagagaaauaguguuccucucuuauauauucuugauucuagugacaaaggauccagcaguauuugcagauuccgauuuggagucucuagguaauugauuuaaguauaaaauccaaucauauaaaaacuuuaaugaauuaggauaacaagaagagaaaauaaagguaaaaacacuauuaccuguuucuagucacuuuagaacagauggcacuaaaaaaauuuuuuuuuaacuuuuuaccagcuguucuuggauuccaaacuaaacaccaagauacuuuucauuuuaaaauguauaaaguaacaauucagauucacuugggaauagcagaauuuuuuuauacaggguuaauaauccuuaaaauacuuuuauuuccaugccuuauuaguauacauacuuaagaaaugguucauugggcccgaguuucuugauuuuauuuaauacaaucggauuuaauaauuuuguggccaguaaaauuauaccauuggcaugaagcugugaaaaaugagaaauucuaccuuuaccagggauaucuguucuacuguuuuaaaaguuccucucuauuuuauuuuuuauuuaacaugaaguaaaauugaaauuucuucuugguguauaguucugugaauuuuaacagaaagauuugugcaccacuacugcagucgguacagaacaguuccuucacucccaauagcucucuuaugcugucccuuuguagucagcuccuucuagcucuaauccuggcaacaguucuccgucacuauuauuuugccuuuucuggacugucauauaaacagaaucuuauaguacguucccucuugaaaugcuuuuucacccagcauaaugacuuugagguucauccaugucauuuuaaauuuugaauuggcaauauauauucuagcuguuacuagaugagcaauuuaaaaagguguagcuauuaguguuguauuuuuucauuuacauuaauguaauuuccauucacuauguguugauaaaaaucuuaaccaucccuagaguuuuauauuuccaaaaauaugccaaaaggaaaacuaugacuguaugauuauuuuagcgagagucauauuugagaugguguucugagccauaguucucuaacaucuccgucuacauauaacacaaaacuuuuauaaauuauuuuaacaaagauuaaaauauacugcagggcaaauaauauucucuaaaacacaggaacugcuuuucguaaagaagacugacuagaugcaucuuucuuugaagcuguucuaguccuccucuaguuaacuuagcuuuauguagaauuucuacuguauuuaauuucuauugaagcccuucuguauuuuaaaauguaauauacuuuguaccauuuauaaaaauugugugaugaaugaaucacauguucguuguuauaaguguuaaccuuuuuuugacaauuuugugggaaagacauucuccacugaauuuuaacuuuccuugagacuuucaagaaugcaggucucguuugaugaaaaaaccgacuucauaacccaauguuacuaguuagcgacauugugcugaauuucuccuugaacuuuuuaacuuuauauguaaaauaacuuugaucuuggucauuugaaagaucauuuccaggucuaaaauuccaugauuuuguauuuaauucuuccugagaacagaagaggggaaagcaagagaggacgguuuugugucuuuaugaacuuuguuacuuaaguacuccauuggagacauaauuuuucuaauuaguggaucuuuuuccacuggaaagugugauagcucauugcuaauuuuucauucauaguucauugcuuccauuugaccuaagauuggccauuuguuggugugaaaauauuuucuuuucagaaauaguuuacuagugauugaaguacuuuucuuauuuuugcuuccuauuauaaaauggcguggggggaagggggaaggauggagaugggaggagaggguaaaagaauaguacucugauuuuuuaagaauuaguaucuacuaucuuggauauuugaaaaaaaauugguugaaacuauguuuaaguuuuaugugugccuuguaagauuguuguaaaauuuuuugugagcacuuugagauuuuugcugggggagggguguuuugugaaagugaugguuauuauuuauauuauuuauuccuguucaguagcacggaaugaucuccaaacauuccuaggagagugucuguuugcaugauaugucuaaaaauuuucaggaaaauggaaucuuuuuuuaaaguucagguaugacaaaguauagaauuuauucauuuaacauauucacauuuaguuuauguuucugauaugacagaaaaaugaaaaguguuugaguucagccucuucauuuacuccauuuacauauaaaagaucuugaaaagguaguuguuacuucguugucagagaaaaacacuugcccuuuuuccugggauguaacuaucuuacauguuuacauaagaaauaauaaacuggaggugggaauggagaacaauguguuuugucuucaucuuugaauuuuaaaggauacaauuu

SEQ ID NO: 13184 - RNA, 8000 nt, Homo sapiens
uuuuuuauaacaaugaauauuuaauuuccacaucacagaugaaaaagacucucugaagaggcaucugagggaagcuccagagagcagccgcuaaucagaaaagggccuucucgcgagagcucuuccgcacggcucacuuuuuucuugaacuuuuuuauuuuuuauuucuuccugcuuauuggaauagauaugcucauuguagaaaauguauaagacacagaaaaauaaaaagcagcagaggggaaagaaaucacccaugauuccacuggcuguuauugacguuuagccaugaaccuuuccagucuuuuuucuaugaauuuuuccauaagcagaugacagcgaauguggugugauugcaguucugcauccugaucuuuaaauuugucuucauaaacauuacguuucaugggaggacaagauucagccacugcaccagcuaguuguugcugacaguguagguuguuccauguuuuaauauuauaaacagcagugaugacaaucuuccagugugauucuuugccaacuuugaggguuaaccaaauggaaguggaauuacuagguccuaugugauggaucaugaguuuaaggcucuggacacguggcaaauuuaguuucuuuucuaucuggaacgagcuuccucuccugagagcccccaccccaggcuggcacacagaggcagggccaggcguggagcccagaggccugcuucccgccugcacgugaaguucugagggcgccccuaacugccuguucucuucucuuuugucuuccucugccccagccugguaaagcccuugcgacacuaugcggucuuccucuccgaagacuccucugaugaugaaugccagcgggaagagggcccgagcucuggcuucaccgagagcuuuuucuucuccgcucccuuugaauggucucuccuuccuucuuccauuucccugagcucggcuuggugacucugcggggcugcauggcgaaagcggggggcuggugcugcuugccuuugugucggggggagggugucuggagcugcugccugccggugccccagugccaacaugcaggguggacaccaccucugcgugccaccucucagggcauccguuuugccagcuccacagaggcugugacaauagagaggugacagggugauacgcgagcauugguccccuuagagaugaaaugugcuugauugcuaguggaacuggugacuacaauuagccugguuguugaucuccaaguccuucuuuaucucagcacaucuuggaaagccauggagaugggaaucagaguuuaaguuaaaaaagaaaacguuccucauaugaaauguguauauuaaaugccagccuauccaaguguucugaucugccugacuuuuuaaagauaauuuaaucauuauuauuuauagccuaagccucauaccaauuacaaguagcgauuuuuaaaaguuucacccaccauccagccaccccuaagauuaagcugcugucgcccuccuuccuuuacccguucuugccccuccacccacaaguguuucagagcuggcauugagcagagagacagcuuuugucugucugcccuuguuaacacgguuauguguuuuuaaugggagccuuuaagggaauggaaacugcccuuugcgggaugcccguggugcccacagcaaccuuccagggggcacguuaaucguuuuggucauugcacagaagagagaugccuuucccucccucucccucauguccccugcacccucucccuguucccaaaccccagcaucaggucccucccccugggauggccuguggguuccucuggggaccuuauaaaccccaggcugcuuggcccucugucauugaccccacagggucagaggguccugauccuuuccugccagcaggucacuggggacccagacaagucacuccccucccaguguccucacuuagaaaguaguggccuugccaagcgcaguggcucacaccuguaaucccagcacuuugggaggccaaagcgggcggaucacuugaagccaggaguucgagaccagccuggccaacauggugaaaccccaucauuacuuaaaaacuacaaaaauuagcugggcaugguggcucacaccuguaaucccagcuacucaggaggcugaggcacgagaaucacuugaacccgggaggcggagguugcagugagccgagaucacacugcuguacuccaaccugggugacagaacgagacucugccuuuaaaaaaaaaaaaaaaaagaaagaaaagaaaguaguggccuaagcuggugucauccaagcaucacacgucacuuuugcuguaugucaaaucuuuguuucgauuuuuuuucaaaagauuuuaaaauuagccuucuccuaagcaauaauaucuaugaugucauaggcguaauguauuaguuauuauuucuguugcuaauuagaacaaaaagagaaccuuuagcauaagaaauguucaucuaugugucaauuuaaaacaccuuuugggaaaaggcacccugcucccagccaggaguccaccaggucauguccaaggcccagcuccaucauaucgucucugaacuaacuggcgccuuaauuauuuaaauaacggcgagggcucgcuuccuuagcccaugaccuuagaagucaguacaggccuuuguguguguguuugaaaagaaacuagcccauccuaacucaaaaugggcucaaaagaacacuauuuccugaaguuccagaagcacacugacugacuuuaacccuuucauugugcucaucuuuauuaaagggucucuaauuccuuggucagggugagugagggacguuugaagccucucaagcuuggcuuccauuuccaccucuugcgggugcugugugacauaggugaguuauuuaacaucucugagcuucauuccucauccauaagguggggguguaaguccgacuuccuggccugcuugcauugcuucagcgagagaguacaugauggagucccugcccaucacugggacuguuugaugagcccucccaugucccccacccuggugccuucacugugauccuacccuugaccgccagguggugcccuucccccacuuuaccagugccacgggcaccaucuccgccugacguagggccaccaccagccccagacuugggguuagaagaggugagauguggccaggcgcaauggcucacaccuguaaucucagcacuuugggaggcugaggcgggcagaucacgaggucaggaguucgagaccagccuggccaacauagugaaaccccgucucuacuaaaaauacaaaaaauuagccaggcaaaaggcaggagccuguaauuccagcuacucaggaggcuaaggcaagagaauugcuugaaccugggaggcagagguugcagugagccgagacugcgccauugcacuccagccugggagacaagagugaaacuccgucugaaaaauaaaaauauaaaaaaggcuagaugcacuucccacuggggcuccacuagagguaaggguugacccaggcgcugccucuccaucuacccaguggugcccugggacucagguccaugggaagggaaggcaaguggaacccuuuguuaacuauacuuggaucagcugcaaaguaguggugugggguuuuuuguuuguuuuuuuguuuuguuuuguuuuuugcuuuuuuguuuugagacagggucucgcucugucgccuaggcuggagugcaguguugugaucuuggcucacugcaaccuccaccucccagguucaagcaauucccaugccucagccacccgaguagcugagacuacaggcacgcaccaccacaccccgcaaauuuuuguguuuuuaauagagacaggguuucaccauguuggucaggcuggucucgaacuccugaacucaagugauccgcccgccucggccucccaaagugcugggauuacaggcgugagccaccgugcccagccaaugacugcaagguuuugaauguguaaaaguacagaaagcugcuagcagaagagccugugugacagccgugcucacuggugggcgauggaugcuguaaccaacccgugcgugucugcugugugccgggcaccgcauuugcucauguaaccaccaccaccaccugagcaccugaggcucagagaguuaagugaccugccaaaggucccacagcaagaaauagcaugaccagagguggaaccaagguuagcagggcaagcuuaggcccagacagcuccccuggagagcuuccccagcccaguuccccaugggcuguucacagaaccugacuguggcugugccuaggccaccaaacaaacagcagagcagggcgggagcaagaggagcaugacugcuggccugugagcccccuuccaguccugucuguuccucacaccuugucugaauggcucacaagcccaguagccaguuuuaugaaaggaccuguaguuuggggggcacuaaauggguccccugagugcaagugagagccaaagcgaguugcccugguucacagccccaggcccaucggcaugcccagcuugcacccucgcagccucccagacuccugcccucacggagaccccgggacacucuccugucccgcaggccccugcgugcaccccucaagcccucaaugugcuugggcuggaguccgcuugcuccuccccugaaggccugggugggagagugcagccugcucuguccccgacaggccgcagccguaucggacacucagggagucagacagcgcggaaggcgacgaggcagagaguccagagcagcaagugcggaaguccacaggcccugucccagcucccccugaccgggcugccagcaucgaccuucuggaagacgucuucagcaaccuggacauggaggccgcacugcagccacugggccaggccaagagcuuagaggaccuucgugcccccaaagaccugagggagcagccagggaccuuugacuaucagguauggcaugggcaagggaggguaucggccgggggccggcacuguccgcacacgaggugggauccccaugugacaguggaagagacuaagggagaaacagugacuuuccaagacccucagccaaugcucagggucagugugacuguaaacaccucccagggugccggggcccacaccacccuaacagugacgguaggagaagaugcuagagcccgauggaaacuugccccacucugugugugcaucagacgggggggcgggugcugccagccacucuccucgcacccccaggcagggcugcagccccugcuggaaccgggauugcguccaucccugccagggcuccuuggcagagccuguggaugcaaguucuuggcucugcauuaugaaugcaaaucaguguguaauucccacugugacgucuaauccaucacauccccgcucggugccucaguuuccucacuugcaaguggggucuucugacuuugcaucacugggucacaccgugggguucacagagcuccagucauucaugaguguucccugcugggaacgaggaccugggccaggagaaagggacuggcacccgggccguguggcuugcaaguggcagagccaggacuccaacuuggccuccuccuuccuccccagccaaggugccuccuaccaggcccugagucucacucgcgcccccgggcuuacaggugauugcgggugccugcgaucuaaaaaguaaaaagggccagccgguagcuggagucacuuuccuaaaacuccuuggcaaccgccacuggcauaaagggacgagagcuuugucuugaguucccggagcacaggcuuggagucccagcacacguggguccucugcugguaaccugggggagcccucagcuguuccaaguccgaggagcugaucagccacacaacuaggcccagcacacauucagcacacagaaguggugugggaaugggcacacauaugucccaacucagcccguggucacugccgcccuccuucccucccaacagaggcuggaucugggcgggagugagaggagccgcggggugacaguggccuugaagcuuacccacccguacaacaagcucuggagccugggccaggacgacauggccauccccagcaagcccccagcugccuccccugagaagcccucagcccugcucggaaacucccuggcccugccucgaaggccccagaaccgggacagcauccugaaccccagugacaaggaggaggugcccaccccuacucugggcagcaucaccaucccccggccccaaggcaggaagaccccagagcugggcaucgugccuccaccgcccauuccccgcccggccaagcuccaggcugccggcgccgcacuuggugacgucucagagcggcugcagacggaucgggacaggcgagcugcccugaguccagggcuccugccugguguugucccccaaggccccacugaacugcuccagccgcucagcccuggccccggggcugcaggcacgagcagugacgcccugcucgcccuccuggacccgcucagcacagccuggucaggcagcacccucccgucacgccccgccaccccgaauguagccaccccauucaccccccaauucagcuuccccccugcagggacacccaccccauucccacagccaccacucaaccccuuugucccauccaugccagcagccccacccacccugccccuggucuccacaccagccgggccuuucggggccccuccagcuucccuggggccggcuuuugcguccggccuccugcuguccagugcuggcuucugugccccucacaggucucagcccaaccucuccgcccucuccaugcccaaccucuuuggccagaugcccaugggcacccacacgagcccccuacagccgcugggucccccagcaguugccccgucgaggauccgaacguugccccuggcccgcucaagugccagggcugcugagaccaagcaggggcuggcccugaggccuggagaccccccgcuucugccucccaggcccccucaaggccuggagccaacacugcagcccucugcuccucaacaggccagagaccccuuugaggauuuguuacagaaaaccaagcaagacgugagcccgaguccggcccuggccccggccccagacucgguggagcagcucaggaagcagugggagaccuucgagugagccgggcccugagggugggggaugcaccgaggcccgaggguccguccacugcugcgguuccgaggcucccccgccacucucucucugcccagguucugcuggugggaagggaugggaccccucucugcugcccccuccuccccuccacacugcccaucucugaugucuggcccuggggaauggcaccaguuccagccugggaaucaacccaguuccugagugcccaucccaccccgcgguugccucuccucggcacccuugauuggguuuugcacuaaagaggucagcugggccaaugauauugcuccagaccgaguccuacccaccuucccccggaagugucccaagaggcuccgaaggccuccccuccgagcccagcucuccugucuccuccacagccaggcccugcacgcccaccuccucggacacaggugacaggguuacccuccaguuugagcucaucugcacgagacacagguagcuugggguugaaguuaggacuccuccugggcuggaggauuuaccugguggggcacuuccagacuguuucuagcaauauacacacacguucuuuccugugucuucaccccaaaacuucaguugauucugaccugggaggaucuggggaccagggggucuugggcugccuugugauacacagccccagccacccugcacgggggcugcgagcaccagcaacuuugauuuauagaaggaaaauggaaacccccaucugaguauuuugggaggagcccccagcccucauccagcucuggcacgcugauaccucca

SEQ ID NO: 13185 - RNA, 1450 nt, Homo sapiens
cuagacaaugugcccagggccggggcauggguugggggggugccugagcaggagagccagagggccagggaauaguagcucuggggagcugugucugggagccacaucuggguguggggggacagcuuuauaggcccagcucagaagggucccacagugaccuaggcccucugggaucugggauggagugggacugccucaaagcugucauugucgcucccucacccgccugacugucugggacuuaaaauagcaggagcacagcggaucuccugagaaguuucuggcaaagagguuuagggggggagggugugagucgccgcugggaacucuugaguuugaagcucccaaagcccagcugcuccaccccugcccccagggagccuagaauccaugggcggggcaggugggggguccucuguucccucccuguccugcugugggaguggggagacuggguccugccccagcucugccauggaagcaccggcuagauggcugggccaaguccugcccccuucggaccucaguuucccagauguaccaggaguugcggaccucaacaucugcugagaggucccuggaguucauggcagguggucccaguacagacacccagagucagacagccaugggcugaaaucccaguuccacuccuacuggcugaguggcucugagcaaguccucccagcucuccgggugaguuucuucaccuguaaauuaacaaugaaaccaaguccugcucguuccaagcuucagauugcgcuauccgguaaggauccuggcagcuccugggcaacugccccccagccccagccuccaccccauccucagauggcacauuuugugcugccaggaauguuaacagcaacgugaccccacuuuuaaugccauguacuuuacacacacuaccucuggcuuccacgcccuggaggacagagcuggcuacuguccccagcgcucuccugggacauccuuaaccucaguacuggccacuccuggacggaagggguauuggcuccugagggggcccucuugggcaucuaccgugugccaggcccugugcuuggcucaccccuggaguccuguggggcagggcugaugcucccgguugugcagauggggagacaggcucguugcuccccuguaucaaagaggugcagggaccccuugcaguucgcaguccgcagggcgcggggccgggcucugggccgcgcggugcguguggcuggcgcgcccucuaguggccgcucugccugccguguugccccgcgcgagagcugcccuagaguggacgcgcagccgcuggcgcgggaagucccuucucccagcccgccgcggucccgccugcugcggcuccaccuccgccgaacugcaagcggucuggccugccugucaguccucguggcuucgcagggaccccaccauggccgcacgccccgccccgauu

SEQ ID NO: 13186 - RNA, 1450 nt, Homo sapiens
aaucggggcggggcgugcggccaugguggggucccugcgaagccacgaggacugacaggcaggccagaccgcuugcaguucggcggagguggagccgcagcaggcgggaccgcggcgggcugggagaagggacuucccgcgccagcggcugcgcguccacucuagggcagcucucgcgcggggcaacacggcaggcagagcggccacuagagggcgcgccagccacacgcaccgcgcggcccagagcccggccccgcgcccugcggacugcgaacugcaaggggucccugcaccucuuugauacaggggagcaacgagccugucuccccaucugcacaaccgggagcaucagcccugccccacaggacuccaggggugagccaagcacagggccuggcacacgguagaugcccaagagggcccccucaggagccaauaccccuuccguccaggaguggccaguacugagguuaaggaugucccaggagagcgcuggggacaguagccagcucuguccuccagggcguggaagccagagguaguguguguaaaguacauggcauuaaaaguggggucacguugcuguuaacauuccuggcagcacaaaaugugccaucugaggaugggguggaggcuggggcuggggggcaguugcccaggagcugccaggauccuuaccggauagcgcaaucugaagcuuggaacgagcaggacuugguuucauuguuaauuuacaggugaagaaacucacccggagagcugggaggacuugcucagagccacucagccaguaggaguggaacugggauuucagcccauggcugucugacucugggugucuguacugggaccaccugccaugaacuccagggaccucucagcagauguugagguccgcaacuccugguacaucugggaaacugagguccgaagggggcaggacuuggcccagccaucuagccggugcuuccauggcagagcuggggcaggacccagucuccccacucccacagcaggacagggagggaacagaggaccccccaccugccccgcccauggauucuaggcucccugggggcagggguggagcagcugggcuuugggagcuucaaacucaagaguucccagcggcgacucacacccucccccccuaaaccucuuugccagaaacuucucaggagauccgcugugcuccugcuauuuuaagucccagacagucaggcgggugagggagcgacaaugacagcuuugaggcagucccacuccaucccagaucccagagggccuaggucacugugggacccuucugagcugggccuauaaagcuguccccccacacccagauguggcucccagacacagcuccccagagcuacuauucccuggcccucuggcucuccugcucaggcacccccccaacccaugccccggcccugggcacauugucuag

SEQ ID NO: 13187 - RNA, 978 nt, Homo sapiens
ugauuuaggccacuugccuuggucucagaaucaccacugucauagccagucagucacagggcauccagcagcugcugcagguugagaagcaggccguugagaaggugucagaggccugcagccaaaagaaccagaggcugaagcaggccaaaguggcaguucaggcugaaauugaauagugccaccugcagagggagaaagaguucaaggccaaggaagcuguggcacugggaccccaaggcagcugcagcacggaaguggaggagacccaggauaaaaugaccauccuccagaccuacuuucagcggaacagggaagaggguguggauaaccucuuggccuuugcggcauccagccagaaauucaugaaaacuacggcauaaauggauaggaggagaagcgccuguuccauggacuggcauuuuagcugcccucaugaaauaagaaacuuuagcaagcucuaguuauauucuaaugagaaggcauuuaauuauuucuguauguuguauaguuggucccuucacuuuauggagagcagcaaauccaguuucuugugcagacauagaacuaaaugugucauccuuuuacuucauguuucuuaggaauuuaaugguuaugugcugucuguuuuccuaugccuuuuggcucaaguaacauauagcaauguugacuuuuucuuuuuuagaucuaguaaaacaacaacaacaaaacaaucuuugaagaaaggaagggauuaaguauuuuuccucuaauacuuucuugaaggucaaugaaaaagugguaaauaguuauauguaaccugugugaagcagcagccagccuuaaaggaguccauuccuuccaaggcuuagaacagugacuacugcuguaauugcuuaggcugcuguuaguuucucuuaaucaaaauuacuaugugauagaauucauguuauuacuugguguacugaaaauaauuuaaaaguaaagacucugucgugc

SEQ ID NO: 13188 - RNA, 790 nt, Homo sapiens
ggggagggaggccaugaggugucaggggccacagugaggucaccauggggccuucgcaagcaaaccugggccccacguagcccacaaaugaguuuugcucaaccccaauaaugcuuuauuaaacaaacaaaacacauugccaauguccaaaaagugaaggauuucacauaaaaacccaaacugacaacuuucccugaaaagucugcgucagccugcggguucccugcacuccugagcuuucccugaaaagucggcaucagccugcggguucccugcgcuccugggccaccccugguguaaggaguuuccugccagggagggccacaggcccgccuggaaucauagcagaggguccaggauguggaggcggggcuguggggagaggaagggggcacccucaacagacgggggugcugcccaggcuggaggggcaaggacagaggaagucaggcagagaagguggcccccagggguccccaagaucauccagcagaaaggaaacuuggagccacaacacuagcccucccucuacagccaggagugcaaggcccagggcgggaggggaggccagggucggguggucccagggccccaagaggggaaaacagggaagggggguuuccucccacccagaggcaaaggaagccagggucaggugggaggcagcggggucggcugggaaggccucuggcugcucaccuggguucucgugacuggccaucugcugguccucagaauccagcggccccggagaccaggcuucuucccgcagcuccaugucugggucccu

SEQ ID NO: 13189 - RNA, 1278 nt, Homo sapiens
cugagcacaggguacuuuauugaugguauaugacaagguggggcucccuaggccccuccccucuucaaggggucuacauggaaacugugaggaggggagauucaguguggugggggacugaguguggcagggacuccccagcagugagggucucucucuuccucuugugcucuuacuggggcuggugguccaggggucuuacuccuuggaggccaugugggccaugagguccaccauccuguugcuguagccaaauucauugucauaccaggaaaugagcuugaaaaagugguuguugagggcaaugacagccccagcauugaagguggaagaguggguguugcuguugaagucggaggagaccaccuggugcucaguguagcccaggaugcccuugagggggcccuccgaugccugcuucaccaccuucuuggugucaucauauuuggcagguuuuuccagacggcaggucagguccaccacugacacggcaguggggacacagaaggccaugccagugagcuucccguucagcucagggaugaccuugcccauagccuucgcagugccaguagaggcagggaugauguucuggagagccccguggccaucacgccacaguuucccggaggggccauccacagucuucuggguggcagugauggcguggacuauggucaugaguccuuccacgauaccaaaguugucauggaugaccuuggccaggggugcuaagcaguugguggugcagaaggcacugccgacaaucuugagguuguugucauacuucucaugguucacacccaugacaaacauuggggcaucagcagagggggcagagaugaugacccuuuuggcuccccccugcaaaugaggcccagccuucuacaugguggugaagacgccaguggacuccaugacguacucagcgccagcaucgccccacuugauuuuggagggaucucgcuccuggaagauggugaugggauuuccauugaugacaagcuucccauucucagccuugacggugccauggaauuugcuauggguggagucauauuggaacauguaaaccauguaguucaggucaaugaaggggucauugauggcaacaauauccacuuuaccagaguuaaaagcagcccuggugaccaggcgcccaguacgaccaaaucuguugacuccgaccuucaccuuccccauggugucucagggaugugguuuggcugacgaugcaaaagaagaugcggcugacuguagaacaggaggagcagagag

SEQ ID NO: 13190 - RNA, 1278 nt, Homo sapiens
cucucugcuccuccuguucuacagucagccgcaucuucuuuugcaucgucagccaaaccacaucccugagacaccauggggaaggugaaggucggagucaacagauuuggucguacugggcgccuggucaccagggcugcuuuuaacucugguaaaguggauauuguugccaucaaugaccccuucauugaccugaacuacaugguuuacauguuccaauaugacuccacccauagcaaauuccauggcaccgucaaggcugagaaugggaagcuugucaucaauggaaaucccaucaccaucuuccaggagcgagaucccuccaaaaucaaguggggcgaugcuggcgcugaguacgucauggaguccacuggcgucuucaccaccauguagaaggcugggccucauuugcaggggggagccaaaagggucaucaucucugcccccucugcugaugccccaauguuugucaugggugugaaccaugagaaguaugacaacaaccucaagauugucggcagugccuucugcaccaccaacugcuuagcaccccuggccaaggucauccaugacaacuuugguaucguggaaggacucaugaccauaguccacgccaucacugccacccagaagacuguggauggccccuccgggaaacuguggcgugauggccacggggcucuccagaacaucaucccugccucuacuggcacugcgaaggcuaugggcaaggucaucccugagcugaacgggaagcucacuggcauggccuucuguguccccacugccgugucagugguggaccugaccugccgucuggaaaaaccugccaaauaugaugacaccaagaagguggugaagcaggcaucggagggcccccucaagggcauccugggcuacacugagcaccagguggucuccuccgacuucaacagcaacacccacucuuccaccuucaaugcuggggcugucauugcccucaacaaccacuuuuucaagcucauuuccugguaugacaaugaauuuggcuacagcaacaggaugguggaccucauggcccacauggccuccaaggaguaagaccccuggaccaccagccccaguaagagcacaagaggaagagagagacccucacugcuggggagucccugccacacucagucccccaccacacugaaucuccccuccucacaguuuccauguagaccccuugaagaggggaggggccuagggagccccaccuugucauauaccaucaauaaaguacccugugcucag

SEQ ID NO: 13191 - RNA, 3033 nt, Homo sapiens
auuuuuuuuuucccuuaagaaaggaaagagaaaguccaaccacuacggcaauacuuuuaagcucuacuaaaugaucguauccuuucuggcuucgaaacuuuuguaccuaaaaaucgagagaggcgcugcauuuuuucaguugaaacugucaaaacuuggagaagggggaccucggaggcaggcaggagaggaggagaauccugaaaacucgguggagguugggaagaugcugugccucgaggauuaguuuaaacagggggcuauaaaagauguaacagaugcaaacuguaacacaagggccauuaacccuuucucugccgggcacacucaguccccacgccccacaccuauugucuccugugcuagaagcuuugcagaaaaccuggaaagugaguaucaguuuccacacauuugcugagaggggugaagggaggggggcagagagaaggggaaguggauauuuuagaaagcaccuuaaauuuaccuaggcauacauaguaggagacuuuuaaguuugacauauuuuaucauuucuuuccuuguccuauugauuugaaauuguuaggggaaauccugaaauaaagaaauggucacacaagugucugggaugaaacagcuggccugucuauauucauccugagacacacgacugcauauaaauacauguuuaauaaaguaaguugcuaguuuuaugggcaugugugugugugagagagagagacagggcauuugugcuguaaacuuuaucuuugccuguuacuccuaagucuggaguuaguaaucuugccuucaucauuacagggggagcauguaaaauauaucaguaggugggagauaaacacauucauguuagccgggcucaucacuguuccugggaacuccugcuaucucucucucgacuuuucagugccaaaguauggaaugggauauauguguguaugugucuucuauuaaauccaugucuauauuacuuugccacuaaaaauacaauuuuaaaaguuauccuaauuuaaaacccugauauccugacagcaguuuucuucccagcuguagugccccccccuccacuuugguaaacgacucaaguuccaugaggacuuucacuucuuuauuuauaaucacagaagugagguguuacuucacacacauacacacacaaagaaugaaauaaagaaaugaaacucgcuaagcagacaaaaacagacaacuuucugcuuagaaaacagccuucucggugggagaggaugaacugccaugucuaagagaaagacuugcccccgaauuuguaggucuguaacugaccaaguuuuguaauuauuaacagguauuugccaaguccuaauugcugaauauaaugaauuggaacuagaugcgaaaauagagcaggaccucuccccuugaugaguuuuuauuccagccauauaauucucaauaaaacuuuuccugggcuggauagcaaaggacaccuuugguuaccugaaugaacagguacaggggaaauuauuugggggagggaaaaaggagagaaaagcaaggagagagagugugaguguaagagaaagcgaagaagccacucuugagaaaagcuugccauaaaggagcuaaacccaccugaaauuccuacccacggacaccccuucucacuucagacucacauccccacucaaaaugagaaaauuagaaaaggaggauggaggacgagcacaccaaaaagggauaaaaagagagaaaaggggaggaaaaaaaaccuaccugcgaagucuuguuuguaguuuuggccagaaauggugagaagaaaaagcaugaagaagccgcgaagugugggggagaaaaagguggaagcgaagaaacagcucccggagcaaacuguacaaaaaccucgccaagagugucgggaggcaggaccguuauuccugcagagcagguuagaacugaucucuuucggccacuccaggaaacacaaaccuggggacggacugacguguuacgccucuucuaaugacauuuuuuucuuuuucuuuucuguaggagagagacgagagacccugaaacacgcgccaccuaucuuuguggggagggauaauugaagcgcccugagcgugagcaucaugugaaaacgugaucgccaaguuucucucugggaaaggaucugggauagauuauaccuugaagucuccgcaaacgcuuuaguggaagaaaugaaauuccaccucccucccuuccuccucucccucccuuucgccuucgccucccuccccccucccucccuucucccccccuccaccccccccuccccgcccgucaagccuuuggcaucauuauccucaucacuaaauccuacagaguacagggcggaaaacggugcacaccauucacagaacuggagaacuccaaggggcgaaaguuaaagggaaagaucccggguccucaauccagauagucucuucuuauacagauaucucuaaugaccagauuugagaugcacaucaaauuguguagguaucucaguacagcuucuggaacaaaguucucugcccuuucucuuauuguuauuuuuuucuuuuuagguaccagagccagaaaaaaaaaugcugcaugggagcugcaucuuagggcauguguauuagggugugugcaugaugaauuucuggacuggaucccaauauuaaaaaguaguuuggcauuuuaauaaagggucucuaaguaaauuaaaauagaacacucgguuggccgaucucugaaucucucuacaccucggggagaccucacuacaaaguaagggagaguguguagggaggcaggaggagaaacgagaaaggccauagagaaacuuagcagggaagggagagcaugauauuaaacggcauggggucuaaguuuuggaguauauauuuuuugauauuacaauuaaaguaagauuaaaaagaaaagacuccaccuuugcucugaagggauugguuaugcaaauauggaagggauuuccuggagaauacagcuuucuacuguaugguuaauuaaauaaucacucaaaag

SEQ ID NO: 13192 - RNA, 91232 nt, Homo sapiens
cagcuucgggccggaaccggaaguuuggggggcggagcccggcggaggccaggagaccgaaaacgcggccgagcccggagcccggagcuggagccagagccuggaccagaacuuggccgccgccugcaccgccgccgccgcugccgcccgccgccccuuccccgcgccgcagccgccucgccgccaccgccgcgagcucggccgccagugguccucggacuuuaggugucuggguugaaggucgguccggacaucggacccagucaguucccagacuguccgggcggcagcggacgccgcugccgccgccgccucuucgucgccucagccuggcguuuuguuccgagagacgggagaggcgagcggagcugacagugauuuugacagugauuuaaacccgcuuuuguuguuguuggcuuuucguuguuugguuuuguguguugugcguguguguggcgguuuuucccccguggugcauuuuauuuuuuaucguugugcucuuuuuuuucuuuuuuuuuuuuaacccagugagcguuuuuuuuuuuuuuuuuuuuuuuuuuuggucugggcuuccgaauauguuuuaugacgguugauuuuacaccaggagguuugucuccgaggaagacccagggaacuggauaucuagcgagaacuuccuccggauuccccggcgccucgggaaaaugggagcugcugcaaaguuggcguuugccgucuuucuuaucuccuguucuucagguaggugcagggagcgcggcgcgguggggcugcuccugcggccgcggcggccgcugcugggggccgcggcugguguugagucggagaguccaguggagccuggggagguugcccacucccugcgccccucggcugccaccgccccccccccccgcccccaggucugauugugaucuggaaaccuccaugcauuuuucucuuuuugaguugggucggcgagcugauaagagugagugcuguguuguuguggaagugagaaagucauguuuuguggccauaacacuggaugacagcgcugguuggguugcaauuaagccgcaaauaccacaagugacaauuuaugcaaagguugagaucugaaaggaguauuuagugugggcuccuccaaaacaaggguugcuuuuugucaucguuuaauuagugcuucaccggugaauaucacgacauagaucaagccaguugcugcuuaauuuuggcugugggaaacaauacauccuaucagcaauuuaaucugggucuccccucacguuuucuucaacuucagcguccagcaguguuaaaaauaguuguaguuguuguuggaguauuaacuauaacccagugcagaagagguaugccgcuugguauugguaaugugcuggcguucaaccaccauuugugugcucuuuuggggcauagauuuugcuuaccuacggaauacuuauuuuaaacgcuuuguauugaagcauuguuuucgguuuagaacaacccaugugaaauuguuuuuguuaaauauaguacacucauaaaauagguuuuagcucaagguugggggaauaaacgggccauuuuauauuggaaauuuugauuuugugaggacguucuaugguugcaaccagugguuggaaaaacuaucuagucuuuuguauuugaaauucuauaaauaaauacagcaucuagcugaaaggugugcagauguacauaacaggagaguuaguucaauagaugaaacauuuuaaauaagucucauuggaucuauuuauuguaaaauuuaauauucaguuacaagcuuguggcauagaauuacgggggacucuuggaaacgggggcgaauugacagguuucauggccaugucuuuaucucguuugccacaggaaaauuaaagggugguagucuucuuuguguaccucugugggguguguguguguguguuuguguguuuguguccgucuuccccaccccccuuuaaauauaaucuuuuguaauguauagaauuuugcugaaugguacauuuccuugugguuaauaaauggauaaagucuagucuuaugucuguagugguauugaucaguuccgggugggcugaauguguugugaaauggcgaucauugccagagauuaaccaaaagaaucaugucuguuuaaauggaagaaggaacaugcuuaaggcaggcugacaguucuuuuugugcacgguuugggaaggaagcuaaacaauggugugucugaaaugaaugaaggccuugauaacauuaaaccucuugcuuuugugacaugacuuaaccauguaguuuuuaucuuuccaguaguacucuuuuuuccucugcuucuauauguuguggcuggugaacuccucuuguucaaaucccuuguucugaucucuugcccuugaggaggaggggcaucauggccacugaccaaggaauuguggacauuauucccucucaaacccaccugagucacacuaauugaugaaggagguuauucuugagcagucucaagguauuacuucuugaaaagcaggcugucgcuacagaucuuacagcuucuucugcuugguuugguaguaaaaauaauugagcauuaguuucuugugggauuauuuucauugggccaggauuauuuucagugggccaggagguuaauagcuauaauuuugaaauaaagugauuuuguugcuguagggcauauagauauuccacuuauauuaaacuaauauuauguuguugcauaggcuuuuuaagaugaacauucccaguugaacuaaaauaugugauucuguugaagauaauugaaauaaucauaaagaccuuaauccauauuuauacaugaacaauuugaguacuuaaaaugucugauuuuuaaaagccuuuuguuauggaucagaugcacucuaaaaaaggauuauuauguuucuccaacuaauugauuuuucuacaaaaugugugaucugacauguuggaagcaugaggugacuauuuuuaugagaauuuuaaaaauucucagguugucaguuuuucauuucuagauauuugauuuuuuuuaaaaaucaaaaugggaaacaauaguaaggaacaguuuuguuccagguguuuaggagggauguuuacuauuucguggacucugauuuuucaguuuccaucccaugguauguauucuggagacugauuaugcagacuauuccuguaggauauggccaaguguauaauuuccuccucucucucauuccaggggaaacauuuuaaauuuugccccuauccuggagugccuucagauuaccuuugauuuugaauuuuuucauuccucucauacuuucucagauucuguuucaaaacauaaaucuuaguuuucuuuuuauagcauugugguuuauuugugucuuuccccacaguuuguugaaguaugagaaugacuuuaauacuugcuuuaguacuuagauuuauccuaucuagaguuaugcagcuauugugguauuugaguugcauagaaguaaguugagaauuccuuuggauuuugugggagcuggagcaguauggucaauguauuugaugaaagaggaaauggaaauaugguaauuauguuuucuucaguucagcuaggcaguacuguguaugugugaauguaugugugguuggagggggaguuagcauuacagagaaucuuuugggauucuuuugaacuuugauuaacaagugauggaugauaaauacuuuguuuucuaaaaggcagaaucucuuauaaauggugucuguggucaaauucaaauauaauacauugaaacauggagacuagaaacaaaaugaaacaaaauucucccuccauucauuuucuauuuuuuuuuccuguuuaugaucuaagccaacaguucucaagcuggggugagucccccucccuacuuccccagauccccauccaugggacauuuggagacauuuuugguugucacaacaggggacggggugugcuacuggcaucuaguuggguagagggcagggaugcuucuaaucguccuaaaauacaugguacagccuuccacaacaaagaguuagcuggcucaauaugucaguaguguagaggucaaaaaacccuguucuaagaaaaccaaauaccacauguuccuauaaguaggagcaaaaugaugagaaaacaugaaaacaaagaacagaacagcagacacuggggucuacucaaggauggagggugggaggagguagaugagcagaaaagauaacuauuggguacuggacuuaauaccuggguaaugaaguaaucugcacagcaaaccccauuauacgaguuuacccauguaacagaccuucacauguacccccaaaccuaaaauacaaauuaaaaaaaaaggaaaaacucaguucuaaacucuuaaauuuuaaaagcaguaguuuauuaguaaaagggcucugcucucuucccccuaaaguuaguaaucuaaauuuuacaaguacaugguauugaugaucuccagguaacguuguauugaaagauuuuuaucuuuucauuaucuuuuaaauuagaauaugauuaaauuagagaaacagacuauagauacgcacauucuuucauccuugaugaaaugcuugagaauucaccaguauaguauaauauuuuauacuauaauaaaauauuccaaugacuuauggauaaacucuccuaucaccgauuuugauagagugcucaugaagacugcauguuccuggacauaaugaaugauugguuaagguaucaaguuuaauuauauuugcuuuagauccaggauuuucuuugccaugauaugaucuuuaaggauauuugccuuuauuuuuacugacaucauugggcugccuuauggcgguauucguguguguguguaacauguugccugaaauauguucacuauuacauguucccugaauaguuucaagguagaaauucuguuuuuuuaaaaaagauauuucuuuugucuagcuaacuuuaauuucaagaaacuuuuaaccuaaucucuuaauuacauaauuaucuugagaaucacuagcuggguuuugguuaccguuagacuaauucaugauacaguaaguaauauuuuaugaucuauugcagaucguuucccuuuuuaaggcuaaaucuugaccauaauuaauaaaaugcuuaccuuguuuugaacucugguuuuaagggaguuaaccuagccaaccaagauaagaauuacagugaaacucuuagcaaauuaaggagcauuauaccauagagaggaaaauucugaagucauucccacaaaugguguccaaaugagccucacagugucuuuguaacacaccucuccauacccuucucucugauacugacauuuucgccuuuuggguccaccagacucacuguucuuaagagaagcacaacuaaaccaaaugagauuuuaguaaucucuaaauuguuucuuuagauuccaagacuuuauuuuguugcauuuugacuuuuuaaagugcuacuaugauuuucucaucuuugauauuucaugaguccaaugauuuaaauuuguguuuucauggucuguuaaguugccaguugccauguugucucagauuauagguaagguuggcaacauuugauacuaggggucacugguaugccuuagcuuuuugcucacugcucuguaacucauuguuuuuuccauucccuuucauuauuguucccuuuccauuuuccucccuucuuugucuacucccuuuucuuccccugacccuucuguacuuccuuauacugcuugcuuguggaacccaguuguggcuuagcaucaugggugacuccagagggcuuacccguaguuuuaaugaaaacagauugaauuuagaaugcuugagaauugaccagauagucuuuuccacuguuuuuucauuuacugguuucuggacuaccucgcacacccucuugggaauaguguuacucucuuagaaucaaauggcuugaacuuuagauugcucuuauucucuuuuuuaauauucagguuuuccuuaacucuuugcugcuucagaaaaaguuucgcucaucuuauuauucauuuaucaucucuguuuaagccaaaauuugacuagaaccaagaguauauuuauugcugcugauaggaccacauuagacuuccucugugguagauuuaauucuguuagauuguaaaauagucaugucuagacagaacauugauuucaaauugacuauugaacaugaaaauuccaggaauaguguauagaggaaggaggaggaggaggagaaaucaagaagguaagaaaacuacuguagauagcaagugacuuucugucauucuccaccuagauuucuuguuagucacuuuuguauacccagugcaucuagaggucaggcuuuguuuuaauaaagggacuuaaaggaaauauguuuuugucucugagauuggauuuuuugaacuguuagagugguggaccuaagggaaagaauuggaaacuucauauggauagugaucaagaauguggucguagagguugguagacuugagcuguggugucagugcugccaguaucuagcuuauguaucauuuucuguuacuugauuauuguagcacuuuucuagcuaagauucaccaguucccuaucacuacuuccuuuucuuucuaguccaucugcauagcugcuggagugaucuuauuaaaaaauaaaucugaauauguuacccuugcuuaaaaccuuucacugacugugagucaccuuuagcauagaaucuaaagucuuagaaugucauaaaagguccuucaucguuugguuccugccuauuuuuucuaaccucuugguauugguuaagaguauagacucuggauauagaccuaauugguuuaaaucuugguuucauaacuuaaccuuggucaaguuacuucaccuuugugugccucaguuuucucaucuacacaauggggggauauuaauagugccuaccucagagagugguuugaauauuaaaugcuaguuauucugcugcagcuucuccucagccugaguacuauauuccauccauacagacuugacuugcaguuucuuaaauguguaauccuuuauuguauaucaguauggugccuuuguacauauuacucuuccucuucuaccuggcuaaccccuuuuugguuuuaagacugagaaguaucaccucuuuagaaacauuuucucugucacucaacccagauugaguuaguugcuuucuguucaucuaacaccuuguaaaugaccuugauuucaguaauaauugcaaauguuuacuugccuguuuccacuuuagacugugcaaauguuuacuuuccuguuucuacucuuugaagacaucuuuccuuuauccacacacccauuccuggaaccugguacacaauaggugcucagcaaauguuuauuaaaugaaugaaaugaaauuauuucacuucucugagccacgguuguccucuuaauguauugaaguggugaacuuggauuagaugaucccugauuuuuuuuccuacucugaaagcuuuaugguucuauaauuuuaagguuagaguucaguggugacauuuuauuaagaaaagaugauuuugcucauuguuuugauaucuuuaaguuauguucaaauuuaaauuuuuuuaaauaauuaaaauuagaauuugaauuauauagauuuagaggggaucuuagguauccucauguuccauggcuuucauacuuuuuugacuguaauacacaauaggaauuacacauugcauuaugacuuaguucccauguaguaguagggguguauguauauaugucugugugcaucagaaaugaaaguuucaugaacuguguacucuuaacuaugugcaggacacuuauguauuuuuauauuacauuucauuuaaaaaacauugaucgugacccauuaauugauucauugaccaacuaauggauuguaaaucccuaaaaccagugaccuaguucaacaauccuuauuuccuguauucaguacucucuuaguggaaaaggaagcuucauauguaaaugugugcaaugaaaaauauaugcacugaaaaauauggucauuaauuaaucuacaauagagacugugugccuagguauagaauauagggaaaacuggucucaagggagaacauggcucuucccugauuaaggucuucucucuuuuggacuagucgaauaaauuaagcacacacgaaggcgcugaaacaacauuagauuguaauuuuggggaguugggauuuuuuaauuuaggaaagacuugcuggacuuaguacuggaaaaaaagucuuagacggagauuaggaaggauguuaauaugaaggaaaagacacaaaauagcaucaggaacacaauagccauuugagaguaaacuugaccauggaugaaggcaaggugggauggagaaauuuugacuaaaucugaggaagagauuugugugaugaagagaguucacaauugcuugaagaaguaggacaaucucaggggguuaacccuuaaauucaaaugaaaaguaauuaaaacugaggagguaagaguggaugauacauauccugauguaugucccaaauaccccauauguggauauaggacugaaaagcaacucgaagacuaagguagaaugguagcacuacuaaauaaaauugguaaggaaguaaugagccagaggaaaauugaaagugccuucauaacuaaaaaaguuuacagauagauauaguuuuagaugauaagcaugaauagaaauaaagacauguauuuggaaaaauaagaguacauaauaaaacaugauaacguaauauucucuuaaagaggcagacacuguaugauggauaugucuucauugugaagucuaguuaaagaauucuaaacauuaguggcucaauauguuguuuauguuuaaaugauggucaaauuucaguaauuacucauacuggucauccagauuauauucuuugaaaucuguaugagacccuacaguaaaauacacuguucuaaggaaguagauuuagaugcuuuucugaauuugguauaugguauucacgcuugaaaccuaaacuuuucagugaccauucuuuuggacuaguuuuuucuuugguuggcuguagucacacugggaauuacuuuauucucuaauauugcuaaagaaaauaaauguaaagcaagaagagaguuacuacauuagaaggacuggcuacacauguggggagggguugccuuucaaaagauuuuaaaaaugaaucaagucuuuacauauuguaauaaaaguaagccuauuuauaaagcuuagagggaggaguuuucguaguuaugauuauuaacuuuaaaauuuuuauuuuaaaggaaaaguuuauuguucuucccaucuucauaacuauaugugauauaucaagcuugcuccaaggcauuauuucaagaggaaggggcauggacaaguuaugagaucuuggcacauuucuaaaacucugagauuaacuuuuaaaauuuguaaaccaagauguauuaaaugaauugauaacuccacauaacaugguagcugguccagaguagaucuuacauauuaguuuuuaaucuaucuuuaagucccauuuaaaaggauaugguauguaaaacauuaaaaaauauagauuugguucuugggggauauuuacauuugcagguuacuuaucagucaguuaaugugaaauaauacucugacuaaaugauacagccaaagaacauaucauuauagagagccagauagcugccaauaaauaucuagaauauucagauaucgugguuccuuacaaagaguucuuuaaggucucacuguuuuagcaugcauuaaaaagaaacaauggacuaaaucgucucuauuuauuagugggaauuuaaaauaucuuuuuuucuuggacaacuucucuuaaacuuuuuaaguguuuuaaaacuuuuuaguagaaguaaaguuuugaaagauucucaagucuguuuuuuagguaccagcuacuuuaagcuuugaaaacacaaagcuauucaaugacuguacuuugagaucaauauuuugaaugugguauaauauuuuggacuaaaacuuaagagucugucauucaaauuccuacuuuccuacugacucuucuuugaccuuugacagccauuaagauuucacuuuacucacccuaaauuaaagagggugaaauagguauucauucacuuaacaaaucaauauugaacuacaugcuagacacuaugguaagugcuugggauacauuauuaaacaugaagacagauaugauuaugccuuucugaagcuuauagucauaaaguaaguagucaaaugaacaacauaauuacagauugucauacgugcucggacagaaacuaacagggugccgagaggauuacucuuuauuugccuuaucacauaucacaucuguuuacuuuaucugccuauuucuuuuuuuuuugagacugagucucgcucuguuggccaggcuggagugcaguggugcaaucuuggcuuaccacaaccccagccuuccaguucaagugauucuccugccucagccuccugaguaacugggacuacaggcaugcgccaccaugccuggcuaauuuuuguauuuuugguagagaggggguuuaaccauguugggcaggcuggucucgaacuccugucucaagugaucugcccuccuuggccucccaaagugcugggauuacaggugugagccaccgcgccuggccuauuucuuauuuguccuuucuaauauuagaauguaagcucuacugggguggggaagggugugacuuuuucuuaauacuuccaaugcauggcacaguuucuggcacagaggcgaagcucagugaauauuuaacuagcugccugaagcaaugaaugcagugaugggacuggagagauagggacaggaucaugcaggucuuugauguaacaggggaaggaguuagaauaaaaugcaaauggcagugugaagcaaagaguuuuaaggaagagcagaucuggguuauguguugagaucacuuuggcagcuaucugaaaaacauacuggaagaguguaggagggaagaggugagaccauuaggaaccuguugcaucaguguaagcuagagagacucuccuagaucccuuccagcuuugaacauucucugauuguauuguaaagcuugccuacacuuaucagucuuccuuuuguaucuuauuuuagucaucuuauuuuuuuuccuacuugucauugcuuaaaaaaaaaacaugaauggauaggcuucuugugcauaugugaacuuugaauacaaauucucagaaaaaagaaauaaugaaacgcagacuagagguuauugaauuuuuguaacaaauuucuaucuuuagauuuuguacauuugcuaauuuauauauauucuuauuuaagcauuccuauuucucucugaaauuggcuuuacuccuuuucaggugucuauuuuuuucauaagcuuaccaccucuuuauuguuucagauguaauauacuauauuguugguaugguugaagauucagaaguagaaacucaguguauuuuauaucuuaauucuuagaaauuugauaucuuuucagguuaucaaggucuuacaauaaaggcugaaaggaugaauacuuaauacuuuaggcuauuaguuuuacucagggcugcagccucuaacucuagguauucagcuugaauguuuuuaucuggaaagauuucaauccucuccuguuggugguaaagagguggugcuuggcacagggaaauaagcucuuuauuauggcagaaguucagcuguagcaucugugccuaggaaaaacugcauuauuacacacagguaaaaccagaagagauguuaaacuuuacugaauuuaaaaaauauaauggugccugccucuuuucaucugguuucacuuggauuuuuucauuuuggaagcagauaaagcuaaccaucuuugauaagccaccuucuauaaaguucaguuuuacccuauaaauacuauaggucauuuuauuuauuauuaccuuaaguaaaauaguucuagaagaagaacuggaugcuaggccuuucuuuuaccugguaguggaguuucauacuucaggauuagugaauacaguuugcuaauuaauuuuauauaaccuaagacucaaaaugaacuuguaauaauuacuaaaauuauaugaggagaaaugaaaagucaaugaguaaaugaggacgaugauaaauaaugaauaauugcaagauaacauauacaagacggauaugguaauaguaaagcaauuugauuagugggcauucaaaguagaauaaaacaccuuucugaauggccagaaaaaugguugaauagccacugaccaucuuuuuaauucuauauuauauaacaaaucuuucuugguaaucuuuacuuauuuuccuccucaguucuuuagagauacauauacuugguuuggguguugaauuaggaaauuaauugcuaauuguaguuuuuguuaaaauguaaauagagauugcuuauuagcugagaggguuagaaauaauagaggaaauuaaauuagcaagcuuuuacugcugggagggccuaacaaacugucagguacuauuuucuccaguaacuaccuuuaucggaaugaugcuuaggaagaauaaacuacucaagcugauccucacuucugaaggauggaguaaaaguaaaagguuagggucagagaagaagggugguuauacuuuauuuuccuuuugaaucauugaagaguaguuuugacuuuuuaccugcagaucuuauuuuucacuauuguaucccuagaauauccccacaucaagaacuguaguuucuaguuagucuagcaacauauauuuagcaguccucaauuagacaguauuuuuguaauuaauaucuagccuugcaucugugauggaaggaaaucagcucacuaagccagagcacagaagaguagaggagccuacucuguuauagauaauagaaccauugaaacguuauuugucaguuagggcugguuaauagaaauaaaagcucauuuuguugguacauauguagccguuuguuggcaagaaugguuuucuuuaaaaaaaaaaaaaaaaaaacaaaaaaaccccuaacacuugcuuuaucuucagauucaaugaaaguaauuaauuaugcagaucuuuggguugauauaguagaaagagcaaacauucugccaggagaaaaccuggguguugugccugucuaccacaguauggaauaucaugugaacuugggaaaauuucauuaccuuaguuucuauuuuauaguaccuaccucaaagauuugaguaaggaucagaggcuacacacacaagcccaagcauacucacauaaacauauauacaugcgacuuaaaaaaaaaauuauuuuaaguucaggaguacaccugcagguuuguuacauagguaaacuugugucauggggguuuguuuuauggauuauuuuaucacccagguauuaagccuaguacucauuaguuauuuuuccugauccucucccuccucccucccauaggccccaguguuccccucuauguguccaugucuucccaucauuuagcuuucacuugugagaacuugugguauuugguuuucuguucuguguuaguuugcuaagcauaauggccuuccagcuccauccaugucccugcgaaggacgugcucucguuugcuuuuauggccauacaugcaacuuaaauuauuuuucuucucuccuaccuuuugcugaacaugcaaccuuuaaaacuuugaaaugcuaugccaaauauuuguaauuaauacaguuauuuuuuucaaggaguagagaguaauaggaaggauugaagggaacuauaccagcacuucgaauucagaauuugugaugccugaugggucgacauuuaucuuuaggcugucugcaaauaaagggguuaauuccauaaacaaccaaauauuagauauuagagggcuuauuccuuacagugaccuuaaaggcucuguaugauauggccccauuccauccuuaucuuuugcgguauuggcccucugguaguuccuacaacaaaccaacugcuuuuuauuccucugagcuuuuuuucacuuguuugucuuccauuaauauuuaugacaagggccauaucagacuuauaauguaguuucuuccaugccuggcacauaacagaugcuuaacaaauauuuaucaaugaauguugaaugcuuucgagcacuuagaauggggguccgcagacauuuuuguaaagggccagauaguauuuuaggcagucccuuuugcaguuucucagcugugccagcuguaacacaaaagcagucagacaauauguaaauaaacuagugucacuguguuccaguaaaacuuuauuugugggcacugaaauuugaauuucauauaauuucaugugucacagaguauuauuauuuugauuuuuuuucaaccauuuaaaaauguaaaaaccauuguucaggggcuauauacagacuggauuuugaccugagggcuguaguuugccaaucucuuggacauuguauagguggcaucccucccccaccuuagaaauauguuuaaaaaacuuuguucgggagcauuuucuuauagaauuauuguuauauauguagguuaaguuccuagacuaauccacaauccuguuuuacuuccaguguuuuagucuagcaauacaacuuuguuuuacccccaagaauaacucugucucugagggaaaauagauuuaguauuccuucuuggaccagaagcagcacauauucuccccagcacucucacaguuuccuucuucccugaucucucuucuaccugcugggguuugcauccuaggaaauacucuucuaggggcuccuguaggguggaaugguaacaaaacuaaaaagagcuuucugugugugauuagagaggagggcaugggaggagaaagguggagagaagagugcaaaguaguuucuuuuaaaacugcagauuacagcccauuugaggcuuauaaaaucaguguagagggucaccacagacaaaaaaaaaaaaaagaaaauagaaaauauuagaaugaaucacccauagcauaguauuguuuugugaaacuucaguugugugugugauuguauguguguauguacugggucacagugaaaaaugugcuauguggucagaaaaguuugagagccuguguuccaaggguuugggguacugauccugaguuuuuuuguuuguuuguuuuuguuuuuuucccuuacuguauaugaggcgcaugaaaaguguaaaggcagucucuugauuucuugcuacaguacguuuuugguacucagcuaccuuaugagguaguuaacuguuuuacagaugagaaaacagggucauacagauaaaaagcuucacaacugagauugaaacagaagcucaccagaagcucaccuuauuuuagaauauguucuucuuccauuauaccauguuguuuuuccuguaggaaaaggagcuauguacgacuuccuuuguguuuuagaggacaaaaauuauuccaguuggccacagcucacugauuucuugagacaaagcauuggcuuuagugauaggacagggccacugaaaggugugaagagaaugguuaggaacucaguagaaaggaugacguaguauguaagaaaggagggauuucaccuuuauuuucuucuuuguccucuguaguacuaucccugcuccuucauuccucaccaccagcugggcucuuaacucaugcuagaaauagcacagaauugaggaugagguuuagugaggaaggguaauauaaucaugucuuuagcugaaaggggaaugaggagggaaacccaaguagcagggccaccuggccacccagauggguuggcuguucccagguggcaauuuacaaguggguguagguaaaacagggccugcuauuaauuguguuacaagcagaagucuuggcuguggaaacugguagcuuugauacgcuaauugaaaauaguucuuuuuaaaguuauauuaagggaaagccugucuuaagcaacacuugguuaguccagagucaguuacccauuuuaaguacuuaaaaaucauaauauaugucuuuuaagaaaucucuuuuucuuaguuucugguaaaaacuaauuuaucccugauucugaucucuaccuuaauuuggaaugguuuugggaagaaaaagauugaugggaaggcucuucuucacuaggaaaguaacagaaccauaguagacagguugguuaauugaacagaaagaugagagauccuuacagaauguguucaucuuccccaggccgaguugggauucuugcuuuuacaaugggaauuacuguuucauagggaaugaguuuuaacuauguaguaguaucugaagacuuaguauuuuuuagcccaucacuugccccuacaguauugcuuaccauucuguauuauaauaucuuguuaaugugucaggcucccagcugacccuaaguuguuacagauuuuucaguguaaaguuaguguguucagcuuagguuaagaguauugaagccagaugccugguccucgucuggaaaauggagauaauaaggguaaccuacuuuacacaguuguuauaaaguguaaaugaguugauagaugcaaagugcuuugaaugauuucucacauguagcauucuaaauaacuaaauaaauauuaauugcugaugcugcuugauauuacccaccagugucaagcucugaacuauuuauugaauacgaacaaguuauaauguagugaauguauucacaauauugaggacauuccaguauauuuauugagaaacuguaccuuuguagauggccaugcuguuuuguuuaggaugcaaguaguguuuauuuauaauauuuguauuuauuugacucugauuuaauucuagaacaucaucugguguucagggaagaauacuaauauuuucaauuauguaguuuauugguauaguuuuauguaaagauuuuggggaggaucuuuucagaaaaguguaaaguagcaugucauucaguaguauacagguugagcaugccagaucugaaaauccaaaauuugaaauucuucaaaauucggaacauuuugugugacagcaugaugcucaaaggaaaugcucauuggagcauuucagauuucagauuuucagauuugggaugcuuaacugguauaccaccaguauuuugaaauauugaaauauuugaaauccgaaaaaaaaaucugaaauccaaaacacuucugauccuaagcauuuuggauaagggauauucagccuguauucccgaaugagagcaccugaaaaccuucuuuccaaagugagagaaagauaaaguggugugaaugugugaggggaauaacugaaauuucuaaaaguguaucuuguuuuguuuucucagcaucugaauauuaacauuucuggguaguuuccguguuuuauaguuuuuuaagugauuucaugucuguuucuguugauccuauuugagccuguuugaacuagguucuguuuuguuuuaacucaaacccugagauaaugcaauuugccugaagucacuaaucaguggagcuagaacuaaaacccugauuuucaaguucaguguucuuuuguaguagcaaaaaaugcuuucuggcuuuuagagaguccccuuccacugucucccauccuuaguguuugcagugauuuauagaguugguugcuuugcagauaaucuuuguaccacacuuucagaaacccauguuuagagucuggggagccagaaguagcaauauagcaauaauaagcaccaaagcgaacucuaauucuagggcagauuuuuuuuuuuuuuggaguaggggucuugcuuggcuagcuugauguuguaacuauaaauccacauguuaauuguugccugaaguaaauuuguagguaaauccugccauugauugcugcagaugugcuuuucucaaucacuuuugcuuuugauuaagaacauuuaaaauuguuuuccugggcagggcaccauggcuucaugccuguaaucccagcacuuugggaggcagaggcgggcagaucaccugaagucaggaguuugagaccagccuggccaacauggugcaaccccgucuuuacuaaaaauaugaaaauuagccgggugugguagcacacaccuguaaucucagcuacuggggaggcugaggcaggagaauugcuugaacccaugagacggauguugcagugagccgagauugcgccacugcacuccagccugggugacagagcgagacucugucucaaaaaaaaaaaaauuguuuuucuaacaguccauugcuagaucagucucauuacacaugugccagaauuuuacauuauuuucacauuacuacauuacuugggucaaaauuggaacuggcaaguuaugucacagcacaaccauuauguauaacaauaguauugcuaaugauuaccguuuguuaaaacugucauuauuaaccaccacuuauagcaugcucccugcuaagugcuauuaaguuuucaugauaaugugccugacuagcccuacaagguaauuguuaccccauuuuauagauaaggaaacugagacucagugacuugccuaaggcuauguaauuaaguaaguagcagaacuuaggucuguaaggcuuacaucuauucuuugguaucuacuaugcuaaaauaaugaguuaccaauuccaggacugugugauguuuuuugaaccuguucugccaagguucucuauccugcucaaguuaacagcaacuacuguugccagcaccccuugaaaccuaugaugugguaaaaacugcugacuuaccaaauugaagugaaugauggucuacuauguuuccuguggcugauaauagcagagcuuucuccaccucugaaaugaaaguacacugcuugacccuugaacaacguggggauuagggguauugacacccugugagguugaaaauccagauauaacuuuugacuccaccagaaguuaacuaauaauacccuguuauugacuggaagcccuacugauaacauaaacaguugauuaacgcauguuuuguauguuauauguguuacacauauacauacuauuuuguauguuuuauuguauucuuacaauaaggaagcuaaaggaaagaaaaugcuauuaagaaaaaucauaagggagggaaaauauuuuuacucuucauuaaguggaaguagauuagucuugcuaucucagggauggcagagguagaagaaagucugcauacagguggauucacacaguucaaacccauguuugaggguuguuugagggucagcuguaauuguccauagcugcuuaaaaacugaguaacagaaguuguuccuuuugguuauauagugagccagaaucagaacuaggucagaauucauuugcucugaucaccacuugaguaauuagagaaucaaauguucaaaguaaaugcaucuucuuaaaaugauuauaccuugacucagagaaguugaauuaauugaaauuugcucauguagaagaaaacaaauccauguugcuuuugacucauauuuagaacauaauuuaauguuaguggucauuaauugcucauuggugccuguuuccuguguugggugagugagcaagaacaugcuagauaaguacgaauaguucuggcauuaggauuugugguuccccucuucacauuauuuuuaagacaaauugauuaaaugauguagcauacuuuguuuuuccuaauugaaggaccucaacuuucuguuacuauaacuuuuuguuuuuuuugagagggagucuaacugugucacccaggcuggagugcaguggcgcgaugucggcucacugcaaccuccaccucccaguuucaagcaauucuccugccucagccuccuaaguagcugggauuacaugcgcgcucuacaacgccccgcuaauuuuuuuuguauuuuuuuagaggugagguuucaccaucuuggccaagcuggucugaaacuccugaccuggugauccgccuaccuuggccucccuaagugcugggauuacaggugugagccaccguuccuggccuguuauuguaacuuuuaaaguaucaauuagcuugcagaaacugagauaugaagagaauaggaagaaagggaaauuucuuaucuguguuuuuuaggcuagggaauaugaauaaaagguggcaaaggaguagugaagacaaguaaaaaauuccuagggacuugauuugaauuuaagggauggaauuuauagaaaaccaaauauagccauaauccguuuaguuauaauuuccauuauaauuaaacaauaauccacuuaguuguugaaaucaaccaacaauuaaggggacccuacuauguucgucucauugugccagguacuauggagcuuacaaaaagaguguaaaguuuuuaauugucuaagaaaacagucacuuuggaaugauaauccauaugcucuaaaaauacacauucugaaacuaaaaaugcaauauaaaaacaugagauacauugauuacuaaaauuaaugauaucugacaccaagugacuuuuuuuuuuugggaggcuuggcuuaucuuuuaggacuucacuagguuagggaugcauuucagauucuacuccaccuagucuuaguucuuggccuuguuucuuucugaauuuauugcugcuaaaauaaaaccaccacgaggauagggauuguggcccucguguuuauuaccacaguccuaguguccagugcucaauaaauacuguugaauaaauuaauaugaaagucuuccuuuuuccucucaccguccaguuucuucaaaugauuccucuguauguggcuccacauccguaccuuuuguucccucuuuaaccaacuguuaaccuaaaguaagugacauaauucucucaaagauuaaggauuuuuuaguagccuaaucuaaagcauucuuauuauauuugauuaugaauugacuuuucuauaaguuugacgcuauugucugccuguuucuucucaaaguucucuuguccuguuacacucccaauucuguagccccuugcuaccucaguauucauucugcccauccuuuuuguguugcuguuucucagaguuuaauccuuaauggaauuuugcucuacauacccuuccuguugaaguaaucccaucucaucuucacuuuuugacuaaguguaggagauguccagaguuaccuugcugauucugaucucccuccugagcuccaaacuuauuuauuagucaucuaguaaauguuaaguauaugucacaacugggagaagagaugaauaagacacaaucuuuacccuaggggauucauagccuagugggaggagaaugauuaguaaacuagcauuuaugcagcacauggaaucuauguuagagucccuugggauagcagaagcagcuuuuggaguggggucagguaauuuuuccuacagggacacuugaggugaucuugaaggauggaugauuaggaguucaccagguaaauagagagggaggaauauuuuauguuuucucugucaggccuggugaguugcucccugguggugagacagcucaguauggacaaguuuuccaaggcccgaggacaguuagagaguaggcccaggggagccaaugucauggccaacaaaaugguaucaagcauuaaagccagaggguuagaagugacugagaaaacaggggaguuaauaacaaacgaaauacaugacuacucauucaaagcaguguauguaagggaaugauuuagacuaagacucugaaaguggcaugcgcuggguuuguccuuuucagugauaccuguuguauauugccguagccaccaugauagauuaaagcagugcuucuccagcuuuaauaugcauaggaaccgcauggagauauuguuaaaauguagauuuugauuuguuaaaucuggaguggggccugagguuccgcauuuccaagaggcucccagugaugccaugcuugguucagggaccguacuuucagaagaaagagauuaaaggagccaagaauggccaaaugcagaggaaacaauuuauacaggcacaugaauaauuguuauguguuucaggaacugagauuaguucaggacacugagaucuuaaggcauauaugggggauggagcaguaaugggagacgagucugcagagguggguaggggucagguuaugaggggcuggauuugcuagcgaguguuaacuucaugccaaggacuguggaagggccauuuugagcagaagaguacuauuaucauucaaugcuuuagaaugaagagaugaauuagguuuuuaucaaguugaguucaaaguacuuguggcccauucugauagggauaucaaauaaguaguagagguagaucuaagcugggcagagagauuugaguauucagccaauagauguacagcaugaaaucaacuaggcagaaugaggaaugaaaacagaccaaagaucuaacucuggggaaugcugucauuuucagagcagggagagaaguuaaggaagagcuuguagagaagaucaagguguguccagaaagguagaaggaaaacaaguaucguuucauuguaagaaaucuagauggagacaguauuaaaaaaaugucagaucuaauaagguagagccugaaaagucaccacuagauuugucaauuaggagauuauuuguaacuuuaccaagagacauuuugguaaagugguggagacaaaauccauguuguaggagaugaguagugaaauguagaugaggaagugguuucagcuguggucuauuacuuuucaagaaauguuggcuaagaagggauguaaagagguggggaagaaagccagagucgagauguuucugugcuuaagaguugaguucaggagagagcuuacagaaaggggaaaauuaaaauugaaaccauuuggagccagaaacuuggcugccaucuucaacguguucuucauaauguucuucaaaauccaagcaauuacuaaguucugucaguuugacuuuccauguguuucuugagucuauaccugcuuccuuuccauuaccaauguguuaguuccauccuuaccaucucguaucuggacucuuuaaguggaccuauuccucccuuacuccagaaacuaaacaaagcaaacaaaaaugcaccagggaaacagaaaacuucccuuccacacucuuugcuagaaaccguggagauuacagaaacuaagggaucuaugaaaauguacagaucugcuccugacaguuaacuucuuaaaaccccuuacuucuugucacuuacaaauggugaaagucaagcuuuuuaacaauacacgcaguacccccaagauuauucuuuuccagcuucauuuccugccacucacugccucccacuuuaaucuuacaacacuagaagacuucugaucuuuacuacccuugugccuugugccucuacacuccgcugauuuuguacuuccugcaauuacugugggacaccucuaucucaccucuucccuagcaaguuguuaggugcuucuuucuguguucccauagcaccuuacuuauuuacugauuguuacacuuucuacauuauuauuuucucuacuucucucucuucacguuagaacuuaacaaguuuuucucauucaucucuguauucuccgugaguggcucaaugcugguggaaucggcgcccaguucacguucacugaaaugugaagaguaauacaaggagguaguggcauuugucuggaccuuggaagaaugauaggaugucaccaaguucccuuugauggggaagaggauucuguacagaguggcuagcauacgcaagagcuuugaggcagucaagaugauaauauuuauagauaaugcugaaaacucccuuuagacaggagagaagaaguggaaaauguaauggcagauaacguuagaaaaauaaguugggcacagaugaaauggagccugggaugccauguuuuaagauuuuucuuuccuuuuuuccccuguagcagugggcaaccuuuguguauuguuaaaaaguagaaaauaacaccaacucuugaauuuugaagaaagguucuguauuuucuggaaguaucugauguggauaaucuguucccugccccccccaagguuuuagucauuucuguuucuguuauauuuuauuuuauuuuauuuauuuauuuauuuauuuauuuagagacagggucuccuucuguagcccaggcuggagugcagugacgggaacauggcuuacuacagccuccaccucccaggcccaagcgauccugucaccucagccuccugagaagcuaggaccacaggcaugccaccacaccuggcuaauuuuuuaauuuuuuuuguagaaauagggaucuugccauguugcccaggcuggucuccaccuccagggcucaagcaguucuccugucuuggucccucaaagugcugggauuacagacgugagccaccaugcccagccuuuauuuuuuuucaguuuccuuccuaaagauaagauguuuuguuuuguuuuuucaguucucuuccuaaagauuauagcauguuugcccauuuuggguauaaguacuuucugucacuguucuuucauaucuuuaaaagcaguccuugacgaguucuagauuuguuuucucucagagauaauuauuuaauaauauaccuugcauuauuuuuuucuuuaauauuagaaaauauucugauaccuacuuucauauuccuuagaaaacuuucuacauuuguuuccuuuuggcugguaacuugcuguucagaauugcuuguugaaauugguaaaccuggaaguguuaauauacguaugcuuuuccagguuauuuguaaaaguguugaaauugauuuugcaucauucauaagggagacugacuauucuuccuugacguuugcuuauucccuuaagccaauaaucuaguuuaugauugcaagacccucgcaguuguguuugcguguguuuaaaugugguguugucaaguuguggaaggaaauccagggauugaauguguuugggaaacuguuagacaagauuagguuaaauaggggaauaacauauaggguaacagccauugaaaagcagugugccuuuuauuuuguugcuguggagaaaacagaaagcuguggccuaugcuuaugcucuaguugaagggagaauucuauauuuaaaucaacaguaaauguuacaauauaguuuauauuuaaaugcaaaauugcaugagaaaccagaugaauaccagcugaguaacuaagaaauccaggacaaagaaaaaucaagaggcaaaguaggcuggaaagcuucaugaaggaaaugggacuucagugaaccuugaaagaugaguuaaaaucuauauagcuggaaaagugguugugguugagggggugagaaguugcggggaaggcaagggaaggggcaugaacuaagauggggugggacagugagaacaguauguuugcaguguaggguuuagaacuggguugggagggucaauuauugccagguuauuuauguagguccuugaaugucagaguaaaagaguuggaaagguguuuggggcuguaugaagggguauagguggguguagggguauaugggaggacguaugaggaggggggaugugagguaugugggggaugugaagguguugucaggugugugagaaggucuuaaugugguguauucucuaaagcaaaauaaaaaaauuaguagagugaaaaaugucugaccuauaagaaaaccuucuauaaucguaaaugccuguuagucauugugauuagcauaacauuacaguaaguauuggccuauuuuuuccucucuuuaauauucuacuugaucaucuuuguuauuaauuuaauaaaaaaugcuacuuauaaucugaaauaacucuauguaucugcccuuuuuugauuuagucuuugggugaaguauaccuugccacaaugcugaauuuaacaugccacuucugauuuuucuuguuagaguguuugagucuugagagcagaugucacauuucguacaauucuuuggccugucuaguacccugugggcugcccgguauggaguuggcacuaaauauuggagaucuaugcauuaacccuuacgucuucaggcuugguaaccuguaaagucaguaugcaguaacucugaauaucauagauaauugucgugagucuuuuaguugcaagaacuguuuacccugauuuaucucauuucauucuccuguuuaauccacugacuauaucgugaagacaaccccauuuuuccuucuucccuuuuaaugaguuuccuuuuucauuacuucucaguacagacugcuuucugcauaugugccauucuuuucccugaguacccucuuccuucuuuauauacuucuuuuuauacuuuccaaauauagcuagaaucuuuuucauauacugcuucuaugaagccuuuuuuaauuaaucuuuuuuauuccuuuuagucuuuauucacauuccucauguauuuuguuugccaauaagcuauaaauuauuuucaauaaauuucuaaauuuuugauauguuugauauucagaaugaauugcagauuccccaagggcagaaaaagacucuucuauuucuuuugguguguuuccauaauguuuugcauauacugagcauuuagauacgguuauuguuacaagcucagucuccuguccugugccuagagcucauguguggaaaggugccuccccugcuuuauuaaaaguccucugguucucagacuugauuuuuuuuuuuaaauauacauuugcuaggaagaaauuguuuuuccuuugucuuugucaauguugaguaaaugccaaugaguuaauauauuaauacuacuuaaauuagugguugaauacgcuuuauugugcauuuagcuccugcuaauaauuuucuuugcauuuuaauaccuaaauucuaagaaccugaagggacaucaagaaauaauuuaauuugaucuacuuuuaggucaugguuuuauucaaauaagaaaauuugcagaauaucuagccuagaugucucugcauuuacguagguauguauaaaauuauaaguacauuuuuauaucagauauaucaauauuuugugaagaaaaaguaaaaagaaagaauaugcuguuugcuguauguucuagcaagcaaaaguguagaauagcugcucuuaugccuugcacugccuuuucaguuucaauggaauugagcagauauauauugaaaaacucauuguguaauauucugaggacuaagccucguuguuagccaucuguuaagauuucauuuuaaagacaaacuugccuucuacucuuuggggucaccuagagagcugcuuaaauugccaucuucuugcucuucuuuuaaucgacaucuuguuaauuuuucugcucauucucuucucuuguuucuuucucccauuugcauuccuuaugacuugauuucauuuguucauugaucuuuggcaugaguaggagaaaaauaauuuguugaaugccuaccguauuacagauuuuuauuuaugaagauugcuuguucucugaugcaaguucuuuuacccaacauagugacaaaccugaucacguauuuuccauuuucuccuuugaguuagcauugaaaauauggagcccaugguuugauacguauuuauucuaccacagcaaaauuuuaaugauugauagcucacuucuuaaguguguuccaccugccacuuuugcaucuaccaaaaaaagucauacauuauuuuugcacauuagccauaguauguaaagcccaauuaaaaguaagccaugcguugaugcaaaaagcuuauuaugucuuaauggaaaguuaauaucauggacauucaauguguuguguaauugauuuaaagcauugauagcuuaccuuauguugugcuucauauuuucagaauacuuuucaacagacauuucucucucuugccccuuuucagucuggcagcaauagacugcagugauuuuuuuauuugauguucugguuuaucacugccacuugugcaaauucaagaaaguugucaaugauguauuucuuggcccauacaauuaacgaaguguuggcuugaucucuuccuuugacauacaggcuacuagaugaacaugguagaagucuguggucccugagucauuuuguugagcaggauuuguuguagauguuuaaaugcauccuuucugaaaauuaugauguuuuuuuucuuaauaacacaucuuuuaacucccagcauuuuguaugcauuuaguuuuacauauagauauuuuacaaguagaaguuauacuugucuuucuauaguuuccaggauuuucuuuuuccuuuguuagagguagccaucacuuuaccuucuuggaggcacauuuuaaguacacaggagagaaagcaguaagaaaaguuccagaaauuacuugagagaguaauuuccaaguacaagauaggacuguuucuaggguaggcaagaaggugguuuauguguucauuuguuugacagcugugccuauuuguuugacacuuguauuggagacauucauguuagcuuauuguuuuccuugaaaugcccacauacauuauuugugaugagacaucauuuuagauuuuuuaauuggaugaacuaguugguacaacauugaggaaaugauugaacagauagaguggcuguguucuaagaaugccucauauggcauggguuauaaugaggucauugggacaaucaaguuuagcacuauggagugucuagaguggugcuacaaaagaaaugcaaugccagcagcaaacaugagccaaaaaaugaaauuucagauuuucuaguagccacauuaaauguuuuuaaaauaaaauuaauuuuaguaauguauuuuauucaacaguauauucagaauaucauuucaaugcauaaucaauaugaacaugauuaauguggguuuuuuuggugcuaauuuuuugaaauccaguguguaucuuguacuuacggcacaucucaauucauauuagccacuuuucuaggacucuaacuauacauggcuaguggcuacuguauuggacagcuaaagucuagagcauuuggugaaauugugaaauugugaugaugccaggaaauuggggaaagcauaagaggagcaaauaugaaucucuaagguagaccuugugcagggaauucuauaggaaauuauauacuuuugggagagagacagaaacugguguggaaugaaacuuugaugauggugaaaccauuuggaaaaugagaauggcagagauucaauagaaaaugaaaauaggaaacggcagaacuugacaaugcuuaauauucuaugacaaggccaaaauauaauaguugguucuuuuuaagaaaaacaucuuuuucauccaagggcuuuuuagccuaggcugugucuguguagccuggaggagagaaguaguuauucaugaaacacaagagaagccauugagaucagcagauaaaauugauugcagaggaauaauguggauagcagcguggcauggaggaugaauuaugcuaauauaguagagaggaagagucugagguaaaugauugauuuuuguaaaguaagaacuggacaaaguucuuggugacuuaagagcaaaugaaagauuaggcagaauacuauaucagaauuuauugcuuugacagugaaauaagauaggaccuagugauagggacuuuggucacaguauauaagugguuaagagcucaugcacuuaacuuuaauccagucuugaccacuuaacuuugcauuucuuugcaaguuacaauuauccaggucucaguuuuuucauccauaaaaugggcagaaacaccuacuucauagaauuacauggauuaaaugagauuauauauguagcaacuuugacuaguaugacacaucuuccuguuauuugucuuaguuugggauguccagaggggaaaaaaagaguuaccauuguguuuucuuggaauacauguuuauaucacaucuucuaaguuguuaccccuuaaagcaguuuucagaguucagcuuggugaaaucucuugauuauuucucaaacuguggugugaggaccuccggcauuagaaucacuuugguuguuagauaaaaauauagauucuugagcugcacguuagggcugcucagucagucucugagaguagaaccaaggaaguuuuauucaacacucaaauauagcuguugcauaucacauccaauuggagaaccacuagaauggaugauucuaagaucugguuugguucaagaugaaucuacuacgcacuguguuaaucuagaguaggaguuggguaggaauaauaauaccuauuccuguuuacaacguaggauuguugugggggaugaaauaagauauuuuuaaguuuguaaaaguagguuuaaguuaaaagauauuugaaguuuagacuccuguagauuguaacaucuaaagggcagugacuuuucuguacuaggugagucuagguggcucauaguugucauuaaguaguuuuugaugacaaauuuccuguccaccaaauuaugagcuuauuuuuaucucuuucauccacauuuaauuuuuugcuuauuuuacuuguguagaggcgaagcgggauuauagacguucaaaccagauggauauauaauuugaaauauuaauaucuguuuaaauuuagagguuuagagugugucaguauuauaaauuuuuuucucacaaucucuguaacucauuaaucauuuaagguagauuguucuguuuaaggauuaucuguaaucuacccauaauacucuuuuccaucaguuaaccucuucugcucucaauuaaugauaaaaccaacccagaacaaaaagccacccuaccgugaguguacuuuauggggauaaaauacaaucucccauuuucuccauuuccagagagauguauaugcucucuuauugagcaguguaacuacuuuguguucauuacaguguuucgugcuuuaaaaauuuuuauuuaauccuacacauaacuaauagaaucucuuuuuuccccuguggaaauaaaaaaacugcuuauuaaaaaugcagagccccagacgaacaguacacuuugagagaauuucagugagucuggaauaggccugcaaaucagcauuuugaugauuuugauggagguugugcacugugagaaacauugcucuguuucuuauuaccuccagaggcauaaauauguaggugcugucuacauaaaauaaauuaggaaugguaugcuuccagcuugaaaaugaacaaauaaauguacaucagaacuccauguauguugguguauguuucacauaggaacugaagaugauauuagcacagaugucagauaaagggacaaaccuaccauccacagguuacaaguguuuaguauuacagaaaacauuuuuauaaaaaggaagaucauaggacauguaaccucucaaaguuuauacuucucagccuucccuuuuagguuagcuucagggaucuagaaacauuaccauccauuacagaaaacugaaagauuauguggcaaaauaaacagggaagcagaaauagaauagacaguguacuucuguuaagaaaaaguacuuacauuaagaaaaacuauugagcuuuauuagauacugaguacugugcucuugcaagcaucuucuacagcacuaguguucaccucuuaaaagcauuaaaugauacuggcauugccuucauucccuucaauccucaguuuuugguccucuuuccucuuccuaauuuaaacagucuacucacuguuauucuauucuuguaauuugucucacuuuuuuggcuuccaugacuucuugcuuuucuuuuuuauuguauaguauaaauacaaaaugaauaaaacagcuucuaaaagaaaauuuaaaauauguaucaaaagugagcaaaaaauuuaaauuugguuuaauaaaacccauuuucuuuauagcaguguugcuguuuuuucuuuuagguauuuaccccaaaauuaugccuugaggcauaugccucaagguugagguauaugccauaaauugcuuauuuauauuuuuaaaaugcuaauauuaaaggcuaagaucuuggacuguguggcaccuagggacauaauucucaucagccuaucacugucauucacuucaucagaauuacaagggcuuuuaacaccuguagauauguaaguuccucuugcgcuuucauugcaguuguuuccucuucuuaauuuguuuuuaaaaagcagaauuguucuucauuagaaauuggagcagguggaugaaagugauaaacaaggagaggauacgugaguuccacuaggaauuggucuuaaaauuuaguggaaggccagggauuagaauuggugaccccugacucaucugccagccaguugcuuaaauugagagcaguucugauagacacaguuguuccuuguguccuuucaacuacauuuugucuucuauauguugcuccugucccuucaccauguccucauugcacagauacgccacugaguuugaaaagggauaacugguagccuuauuaguaaagcugcugugucucucuauucuuuuacuuucuucuacacgucuugaucgcaggauuuuaugcucuggguggaccugaacguaaaaguuggccagcuguggccuuauuuaguuuuugguauuccaaaaguagcuuuuaacauggagaaaagugcccuauuauuugaacuuuuuugaaucuuuugguaucuuucaguggcccacuaguaagaauuuuuuugucuuauguuuaaauguuucacuaauagaagacugggaacaguucccaauaauuauuaugguucuguggaucuuuguuuuuuaagaaaaugauggauguaaacauuucucugaggaaagaaaugggggaaugacauucaggauagguugacaaaagucacaaaguuuuuuucaagacauuuguuuuauuaaaacauaagcaaggugcuugcuuuggcagcacauauacuaauaucggaauaauagagaaaacauuagcauggccccuggucaaggaugccauacaaauucaugaagaacauaagcaaagaaagauauaucaccuuguuaauuuaacucuuccacuguugaauuuaaaguaaggaguuaaacuuuguuuauuauucuuuaguucuacuuuuccugaacaaaaaauugcuuuuacucuuugcuuaguaaacaauuuuucuuauuuuauuaguucacauagauaguaaaacuuaucagucauugauuauuguugaaguaaacaugaccuuucaagugaaaguuauauuagugaaauugauaaaauuuguaaacuaaaugugaguaauaggcuuuacagauguuuauaugaaagcuuucuguuucuguagggggcuagucuacacuguguuguccauguucuguugcugugucuuaucuauguucugcuguaacuucgauccuugcuuuaaacuuuacauuuaucaugcugcuuuuuuuacucuucgaaaacuguauuucucaauuaccgacuauacagagaaaugugaauacuuauaguagaagcuguugccuguaguaugugauuuuuuuuccauuaaauuaugagggcaaaaucuauagagcuacuauuaaaauaauucuuugugguaauuaacauaggacagaacugucuuuuuguuagauuuuaggcaguguuaauauagcaagacuauaaaagugucagagaaaaauuuuuuauuuugguuuacaagacagaauuaagcuggauuuggaggaaauguuuuuaauuguaaacgugaaagauuuaaauuaaauauacuuuggaauauuaaacaaaaacaugugugugaaucugauuuuauuauuccugcuacucuucuuuuauaguacuuacguaagccaguaucgaaaacaacuuuggugauuguugaaagguguuggguugagauuuuuaccuuuaaaguggacagacaugacuuuuacaaauaagacuuuuacuuuuuuuuuuuuauuaagaaagaggccaggaacuaugaacuagauuuagauauuuaucugauuuagaaugucuaucugaaauuuuugguugccuuuucucugaguuugaggggaagacugcccuuguuuuguguuacagugacuuagggauuuuuagagaaagguuauuaaggucuuuccuaggcugggcaugguggcucaugccuguaauuccagcacuucaggaggccgagguugguggauugcuugagcucagaaguuugagacuagccugggcaacauggcaaaacccugucucuacaaaaaaauacaaaaaaaagccggugugguggcagccaccugcagucccagcuauuugggaggcuagggugggaagaucaauugagcccagcagguuaaggcugcagugaacuguuaccaugccacugcacuccagccugggugacagaaagagaccugucuuuaaaaaaaaaaaucuuuuuuuggaggaaaagguaaugguuauagaaaaaucauauaagcuuaacugauuauuuuaauuuguuaagaguuuagagaauaguaugauaguuucuugggaguagaccauaugguaaauguauguuuuucaaacuuacuaaaugcaaucaaacuguuuucagugguucaagaaguauuugcaaauuagagaugauauuuugcuuuuuuucauuucauuuugugaacuggugauaacuguuuuucaacuuuguuuuacucuguuuuguguugcuauuacagaauaccugagaggagguaacuuauaaagaacagaaauuucuucucuuacaguucuggagacuccaagaucaaggcaaaggcaucuggugugggucuguuuacuguguccucacagggcagagggcagaaggacaagagacagcccacuccuaaaagcccuuuuuauaauggcauuaaucugugaccuaaacgccaccauuaggccccaccucucaauacacuggcaauuaaauuucaacauaaauuuuggaaggggugaacauuuaaaccauagcaaacuuuuucaaacauuuucucaauguuuaaguccacuccauuaucucaccuauuaaaaggaaguuagggauggggagaaagugguagaaagaauguaucaaggccugagauaguuugauguucaaagaguguccacuugucucaugugaguugaggcuaaagaagagccaaacuguggaaaggccuguaagauuuguuaaagauuuugauuuuaaggccaaggguagugggaagccauugaauggcuuuaaguugggguagugacuugauuuuguuugcuuuaguaaauugucugacuugugaaugaagaacugauuagaugggauaaaauggaagcugggagaccaguuaaagaggcuguugcuauaguccagggagagauguuggugacuugcaguaauaaccuuccagugauacucacauucuuuaaaaaucuaacuuagauuuucuaauucuaaugcuuaugccuuaaaccucuucccugauguucuuuuuuguuguuguuucaauucucuauaaauucucauuugacaagcuagauaacaugguuuuauuguuuuacugauuaagagugcuaguauaaaugggugauaucuuuaugacuaguaugaauuccuuuauagaggguuuauuuacuuucuaagguaucauuacuaccuaccaucaagaagcuguuaugguugcugcucuguauuaucaagcagugaugacuaguaagcauuuuuuauuuuaaaaaaaauuuuuuauaguagguucuugcuauguugcuuaggcugguguugaacuccuggguguaauucucacaccucugccuuccaaaguauugggauuacaggcaugagccacugugccuggccccagugacauuuuuuaaugccaacucaggauacuucaaucauuuuuuuauauuucuuuauuaaucuuuuuauuuucuaaagucaguuuuaagacaaaaaucuacucuuuccagagguauuaacaugauuuuaaaaauaauaaaguaccuugauaaagauguauacuugaaauccucugucuuuaugaucuucuaguuacuugucuaucauuccuuccuucugucuuaccuugcaggauaaauuagaauaggccuuaguugaguuucagaauuauugaaagauuugugaguucuuuuacuuucuacuuguugugucuuuugaaaauugagcuucucauuuuucucuuccuuucaagaaguuagcuauuucucaaacuuuggaauuacuuuuuuacuauuucugcuuaauaccuagguugucaaagugccugcaacuaguaugacagcauuagauauuuguugaaugcagaagaugcuguaccugugugaaagaccuaguguccucuaagauuucuuguagcaugucaccagaauagauuucaaaguguccugcccagggguggaagggcuagaaaggguaaaauuuucucauucugaaggggaaaacacugggcuccuauuuuucccucuuuguuuaauggaaaucuaucccuuuuauaauguuaugagaagcuuacuuauauugguuaaaaugagaagaaagcaggucuuuucuuaaaaccauuuccccuaccccauuuuuaauuauuaaaaaggcacagggaaguugagaucuggaacauuuucaggcuuucuuggccuguccuagcaaagcaguccuaaauguggucccagguguuauucaguugaaugauaaauccgaaguuuugugauuugcucuuuuccugguuccuguuguucuauauauacuuuuuguauuuagggaagugaaguuuuuugauaguugauuuuaaaaucagugucuuuauucugggcuaccaaccaaauaauaacaauuugaaguauauuucuucccaaaaagaugucaagucauuucuuaagaguguuagaacaguuaccuuuaaagaugaaaugauucuugguucugaugccuucauauuguaauuuuucugccuguacaucagugugucuguaucugugacuugaauuuuuuuuuucuuuccuuuaggucuuuuuggagaaaacauuauaauggaugucuaguuauuuaguaauugaaugcagguuaguuagcaucuuuuuuuuucuccucucaagaagcugcuuaguguguguguguguguguguguguguguguguguguguguaugugugugugugugugugguuuuuuuuauauuagauugacagggccuaaaauguugcauugccaauauagaaauuuuauuugaaaauuuauucuuuuuucauauaucuaacuugucuaucauuaaguuugugagaggauaggacaaaaagaugcuaacuaaccugcauucaauuacuaaacuaaguaacaacaagcccuauguagaguaucuucuguauuuagagaaagguuuaagaaauuuaaguccucuaaaaauuuuguuaauacaaaaauguaccguuuguguugaacuggaucuacaauuuaagugaauuaagaaacaaacuauuaagaauuauuuuaaaaggaugguugcuugucucuuuuauaaaaggaaauucuaccauuacaaauuugccacucucuuugggacucuaaaacuuuuauguugaggcauuuuaagaaagagauuugagaaauugauugaguuauucaaauuuuggucuguauccagguagauauauauuuauuuggagccaucuauguggggauaauuagucauuuaaguguuaacaauauugaaauacguuuuggaugcuugccuuuguaauuugucaggaauuaacauuagaagaccuuaaauaacgcuggaugcaguugcucaugacuguaaucccagcacuuugggaggcccaguggggcggaucacuugaggucaggaguucgagaccagccuggccaucauggcgaaacccugucucuaccaaaaauacaaaaauuagcugggugugguggcgugcgccuguaauuccagccacuugggaguuugaggcaggagaaucgcuugaaccugggaggcagagguuguagugagccgcuaagauugggccacugcacuccagccugaacaacagagugagacucugucucaaaggaaaacagcaacaaaaagaagucccuaaguaacuagugguuaaauguugacuuccaaguauuuuuacucuccuuacacaugccacaugcacauugucuagugccacaacauauaauguuuauauuuuuaguuuauucugugcuaguugugcuuuuaguuuaguaauagaaauauauuacuuuaguuagauggauggaaucuuguaauguuuugucagacugauaguaaguacuaaguaugggguauuacagacaagaggaaaaaaaauuucugggaagaaagccagacaauguuuguguuuuccuuuagaagugauuguuugguggugggaaggggcuuaguuuaaaaaaaaaaaauuagauugacagggccuaaaauguuguauggccaaugcagaaauuuuauuugaaaauuuauucucuuucuucauauaucuaacuugucuaucaaaagucuuuugggacaguguggacuuuaugauaacuuuugaacaguguuaccuuucauaaugcuuaaaagcaacccagggcagccaaauaggaaaggugacugccucuaggauguguaucaauauagaaaagaaaagauaucaaaagacucaauguguaguaaaaugaguuuuuuuguuuuuguuuuuguuuuuguuuuuugagacggaguuuugcucuuguugcccaggcuggagugcaauggcacgaucucagcucaccacaaccuccaucucucagguucaagcaauucuucuaccucagccucccgaguagcugggauuauaggcgcacgcuaccacacccagcuaauuuuuguauuuuugguagagacagcguuuugccauguuggccaggcuggucuaaaacuccugaccucagguuaucugcccgccuuggcuucccaaagugcugggauuacaggcaugagccacugugccuggcaaaaugaguuuucaaguaggaaagaaacuacauaauacacaaaaguaauaaacaagacauugagauuuuuuuuuaauacucauaaucuugcuucuuaaaaguugaagcaacauaguuaugaaaaaaacuguuggugauuauggccuguuaagugauucuauauccauuguuauuuaaggucauuaugaauuaucagcuuaccaucuucuacuguauuuaaagcuacucuaauauauauuguuaauuuucuucauuagcugguuuuaaaugaccaaauauugcuuugauggaaauguuugugaugagguuuuugugcuuuguuuuauuuuuguuuuucaaauuucucacucuuaacauugcugguuccucaaagaugauuucacauuaucuucauagcaagcagaagugauccauuuuuacucuuucugugacagauugauguuuuauuaaaaagagggccugcaucuuccuaaguaaaauaaagcacuaaacaaacccuuaauguagguagugucuuuucaguguaauugacacuuuuagguugguuuuugcaggaacuaguaggaacuauugugugcauguuuguuuccuuaauuuuuuuagaagcucuguucugauuuugagaauuuaccuuuuaucucuuauucuucuaaauuuaugcccgauuuuguuuuuuugugcauuuaaaaaacuagccuauaaauucuguugcaaguauuggccucuagcugcagucaccauuaucccuucuccccgcaaagaagaacaucuaauguuagaaaucuguuuugcacagccuaguuaaaacuuguauuuacuuguaccuguuuugauguaauucaucuuaugaguuagggccagagaacugcauggaacuauuuuaaucuuaaaacccgggcauuuguagauacucuacacauuuuguggcuguaggcaaaaagaauuuucuguuguguguuagguauuuuugaagaugccuaacuuauucugggcaauauacaguguaucuuucaugacaguaagacuaaaauauuaggaagauaauuagcagugaagugaagcauaggauaauuauguauagaagcaagcuuuguuuucucagaaguuuauaagauaaaacauuuagaaacagcuaacuacccaacccaauaaaccaaaucauuuuuaucuuuuaguuucuuaugcuuagggaaaacaaauaagggacuguggaaggcaaaagcuucaucucuguauucuaauuugacaaugcauuugauaccuguggccuuucagcauagauauuguauaccccuuguuuuuauuggguaguuaauauaguguccugaguuuuguucuguuccaacaguuuacucauuguuuucugauuaaucuuuaaaauacuaccucuauucuuuugaugacuuccaaaccucuccuggcuauacccaauacuacagaauauagaaugcuguaguccaaugagggcagucuugucaaacacucugguuauucacaacccuguuuauuuggucuucaucuucccaaccucuguuuaacuuacaguucugugucuccuuaauagcccugcuuuaguuucauuuucucugcaaagcccucuuuuuucuuacuauucuaggccuugugaauuguugauuuagugcaaauguaacugaauuccuauacugugcuaggcacugaugauacuucaucugcauauguccaguauuaagcaaaguuuucucuaaaaaaaaauuucuaaaaaaaagucaucuuauauuugaguccuuaaaaaguuuuucauauuuugagcucucucucaauuauuuuauuuugaauagaaguauaguauuuggagaauauagaagagcuugaaaugaugucagucaguacuuguuuuaaaagucuguagagguuuccugagggaauagauaaaaggguauaguaaaaaguuuaaacaaauuagaaauuauuugugggcagggaguuauacucuuauaaguuguugugaaaaaagccuuuacaaucacuuuuaaaagagauauguaagcaguuacauugugaagaucauaguauguaccuguagcacaauuaaaaaaccaaccaucuuagaaucaugugaauggauauuuguggcuuggaaaaacauuuucaaugaugguauuaugacuucuaaaaguauuguuucucagaacaacuuaaauggaaguaaagauuauucacuucaugauacuuacaggucacucaaaaagaaaguaacgagaugauacuuggugaagauguagguaaaguuugaauaaaguuauuuuguaaaauuuaugugcuuugugauuuuaaaacauucauaagacuaaauuaauaaaaguauauauuggacuguaugauguacauggaaagguuuguauauuucaaauugguaaaaauuuaaaaaaagaacuuuuuauuggggaaaauugggaaauccuuuguguugagauuugccugguacucauuuauuuaugguagcuugcaaguuucugggcaguaggaugauuauuaagcauagucagagacuguuaaauaauaccuacugaacuaauaaaauuuuguauacauuuacugauugaugccaugaaagauuguacuauaccagaauuuuccaaguaccuaaaaucauucuuuuguauaguauucuugauacuuaaaaaaaacuauacuguaagauguuuuggauuaaaaccaucauucaauuuaauccaucuucuauagcugauucuuuggacuugugguuuguccccagaguggcaggagcaaugacacgugaaagggaaacaagaauugcuuuuuaaguuggauuuauuacauuugaaacuucauuaacucuucccagaggacuaaguugccugugguaggcacaaguuuaggaaagagauuguuucauaccucuuuauacuguuucucaaugacuuuuugaugauuucagacagcauuagaauguuuuuccagaaauuccucaaauuuguaaguucccgaaacaguucuuauuuuucugcuuaacauugguugcauacauaggagaauugugauagguaagcuagucacaggacuaugaaagauauugucaucuuaaucagaaaaaaguguagugaaauugauaauuguaaaagauuuacauuucauccaccuguuucaaagaguagagggaaaucaguaguaguugaguuuuuauucaguuauaauuuguuuuugcauuuuaucauucauuaaguacuguuuguguuaagaacucaaguaagauggauagucuuagacccuaguggcaucuuuuuuuuuuuuuuuugggacguuuguuuuacauugauuuaauucaaagcugcagaccccaaaaacuccuuaaugccaaugauaaaauuguuagguauuucaucauauugagaaugacacauucuaagcaacuauaacuguacuguacaagaagacaaggcugagugcuuggcucacaccuguaaucccagcacuuugggagucagaggcaggaggaucucuugaggccaggaguucaagaccggucugggcaaaauagcaagaccuuaucuauacaaaaaauaaaaauaacuagcaguaugugguggcacauaccuguuguccuaguuacuuaggaggcugaggcaggaggaucgcuugagcccaggagcucaagucuacaguaagcuaugauugcaccacugcauuccagccuaggcuauagagcgagaucuugucucaaaaaaaaaaaaaaguuuaaagaagggaaacuagugaaaaugugauuaaagaauguaauagauggaacaguuugggaaaaaaagaacucuuuaauuuuauauuaagcuacauccagauauuuuuugauugacuacaucuauuugucaauuuaccaaauauuaauugaaugccuucugaguuucaagaauugugcuagauauuagggauucagucaugaaaauauuacacuauuugcuugcaagaagcugacagucuggugaaggacauuccauucuaucaccaccuucuaucuucuuucuaaauaaagacgugucaguuuaggccauucuaacucauauaucuucucugguccuuaaaucagguaucuaucauuauuuuuauaaaaauuaauuuuuuaauugacaaauaauugcauauauuuauuaucaacaugguuugaaauauguauauguugugggauggcuaaaucaaacaaauuaacauaucuauuaccucacauaugcaguacuuauuuuuuauggugagaacacuuaaaaucuaaccccaauggaauucugacauguagaagaacguauauagacaacugauuuaaaaaucagugaguaaauauaaaacaauuacauuggauugcaagaagugugcacuuugggagaaggaggaguccugauuaaaagauuuuuaagauuuuauuaugcauaccuugagaaaacuuggaaauugucaccauaugagagguuuuucugggaggcuuucuacaagagcugggcuuucuggaacuacugggauaauagagugaggacauucaaaauguauuugccugaaccaugucugauugcuccagcuccauuuguuggaaaagcuauuccuuuuccauugaauugccuuugcuuauuugucaaaaacgaauuagacguguuuguauguagaucucuuucuggguccuauaucuuuuucacugauguauguuucugucccucugucaguaccuugcugucuuuauuauugcaguuacauuuuaagccuuaacgucaggaaagcggguggugauuucucccacuuuauuauuauuuuucaaaaaaguuuagaauauacuuguuuacagugaaacuugcugagauuuugauaugaauugcauuacaccuauccaucaauuuagggagaauugacaucuuuauguucaaucuuccaauccaugaacaguuugucuuuccaaauguuuagguuuuauuugauuucuuucaucagcauuuuaaaauuuuaaucauagggauccuauacauguuuuguuaaauuauaccuaaguguuuuauuuuucuucagagcaaccguaacugguguugcauuuuuaauuuuaguuucacuuguucauugucaccaaauagaaaugcaauugauuuuuguguuucguucaucuauccugugaccuuacuuaauucgcuuauuaguucgggggcugcugcugcugcuucuuuuuuuuuuuuuuuuaaagauuccuucggaauuccuccguauaccagcaugucaucugcaaauagagggaguuuuauuucuuccuuucuagacaguaugcccuuaaguucuuuuccuugccuuauugcaguaguuacaacuuucaguacuguguuucaguacuguguuagaguguugagagugaaauuguugacuuguuucugagcucagcaaaaacauuuguuguuucacuguuaaguaugacaucaacuguagguuuuuugguaggugcuuuuuaugacauugaguaaguucccuucuauuccuaguguacugauaguuuuuuuuuuauugugaauaauauucaauuuuaucuaaugcuuuuucugcaaccaccgauaugaccauaugauuuuucacuuuuagucuguugauuuguuagauugugugauugauuuuugaaucuugagacagccauguaugucuggagcagaucccacuuugcugugauguaauacuuuuaaaaaauauauuguuggauucucuuugcuaaaauuuuguugaggacuuuugcaccuaaguuaaugagagauaccggucuguguuuuucuuuuugggcuuuguuuuugauaucgagaugauacuggucucauaaaaugaguugggaagucucuuuuguuucuggaagagguuguauaaaauugguguugauauauuaaucauguuuuuaaaaaacaaaacuugaauuguccucagauacaguugcuugaggugaaaauuuucucauagaaguagacuuuuggccgggcgcaguggcucacgccuguaaucccagcacuuugggaggcugaggcgggcagaucacaaggucaggagauugagaccauccugucuaacacggugaaacccuguuuccacuaaaaauacaaaaaaaaauuagccaagcuugguggcugccgccuguagucccagcuacuugggaggcugaggcaggagaauggcauggacccaggaggcggagguugcagugagccgagaucgcaccauugcacuccagccugggcgacagagugagacuccgucucaaaaaaaaagaaguagacuuuugcagaguuaugguaaaacauuuuaccaaauuucagauucuguguauugcuauuuuuuuuuuaaugguaggaagaaugaagcagucaguacuagucaguaaaccauaagcaguacuuugaauauagaacuauuauauaaauuaacucauacuagauuaugugauuagacuuacugauuuacuguaaacugagugugaauuaugguucuggaaaagaauuuggaaauugaaucaaucugcuugauuuuacagaugcggaaacaagguagugagggguuugguaccuuguccaaggucacaguuugugaaacagauuccagauucaggccaacucuauuaagccaguggguuuuacauagggaggaacauuagauuaccagugggucuuugcagaaaaacaaaaacaacaacaaaccccacacaugugcauauacuauauucuguauacauuagaaguagcagcccuucuucuauagaauacaggugagacagauuaccagaggaguuugcaguaugucaguucaugcuauuuuuucuuccguaguugagaggaaguccauggcaccauuaguauaguguguguguguguguguguguguguguauacacacauacauguacucuuuauauauaguagcauguauauauauaguguauguauguguauauuuauauauauucucaaaauaaacuuuucagcuccccauucccaggaccuacauaauggcacucagacauaugaaugugagaaaauauagaggggauucugaugcacaucauugguuaagaacugcuguacuaaacccugcacgcaaaccuuuuauacuuauuuauuucuuuugaaaaugucaguaguaacuauuuagaguuacuuugauagaauaaaccuauggguagagauuuaaaguuucagaaaauuuuaaauugggagaugucguuaaaacuuaauauacauaaauaaccaugccauccuuuuuagaacuacaccuuuaaaguuguaauguaagcuuaagaauauaaaaauacauauaauuuacuuauuuuuauaaucaugauguuacuauauugaguuuuuuuagagacuugaugggauagagacugauugcagaaucagcuugaggaggggugggaaaauugucacagcauuccccguaagccauuuucuuucuacuuaugaaaaauaccacucuaguuuagaucuagaaaaccauccuuaauccuaucuaccuuaaaaaaugguggaaauaucuuuuuaauaaauaaaauggcccuuuguuuaucuuuuuucuagacuaggauggcaaauacaagacacuaaugcugcuccccuucccuuccaauacuaugaaauccucucuaaaaauauccucaaaaucuuucuugguauagugcccuaggcagccauuacuaacgcugauuggaauugacuccgaagguaaaaccuauuuggcacuuuugcucuaggcaguguucaauuuuuuugucaguuuuguuuaguuuuugggguguuccuaugccugagugggauucuucuuuuggaaauuggaaauaguugcauagugguuuuuaacaugaauuaaauaggugauaauucacagagcccccuuucccaacaaaauaaacaaaagguagguuagacggacuauugggauuaggauguuguuuuaagcuaggagguggcagaccgcacaaccuaugggccaaauccaucuuggagcuaagaaugauuuuuauauuuuuagaugguagcaaaaaaaaaaaaauccaaaaaaagaauaguauuuugugaguuguaaaaacuaccaaaaaaauccaaaaaaagaauaauauuuugugaguuguaaaaacuacaugaaauccaauuuucaguguccauaaauaaaguuuuaaugcaacauaaucauguucauucauguauugucuauggaugcuuuuaugcuacaagggcagaguuaaguaguugugacagaccacauggccuguaaagccugaaauauuuacugucugaaucuuuacauaaaaaaauugccauuccuguuuuaagauaacagugggggcauugaauauugcuuuuguauuauuugguaaaggaggaaacuuaccuugcucauauuuucaacauguuucugaaaauaauuuagaaagugccuauuguuugcauacagauaaguggugguagcagcccuucuuuuuuuuguuuuuuuuguuuuguuuuguuuuuuugagacagagucucuuucuguugcccaggcuggcgugcagugguacgaucucggcucacugcaaccuccaccuccuggguucaagggauucuccugccuuagccuccugaguagcugggauuacaggugcgcgccacuaugcccagcuaauuuuuguauuuuuaacagagaagggguuucaccauguuggccaggcuggucucaaacuccugaccucaugauccgccugccucggcuucccaaagugcuggcauuacagaugugagccaccgugcugggcccauucuuuuauacacgguugagauggaguuaccagaacauaguuugcacugucaguucaugcuauaauuucuuccacaguugagaggaaguccauggcaccauuacugcccacaaauacuggcaacuuauaacuacaucucugugcuaguauauuguagaaccacuguucucaaacuuuuuagucucaggacuucuuuagagcucuuaaaaauuaaagaccccaaaacuuuuuuaaaauaguaauauauaucaauauuuaccauaucaaaaauuaaagaaaauguuuaaauauuaacuuauuuaaaauagcaauaauaauccauuauguguuaguaaagaacaaguuuuuaugaaaaauauuuuccaaaacaaaaaauuaguaaaauuacagucucuuaaugauuguuguaguagaagaaaacuggauuauuguaucuguuucuccguucaguuuuugugauauguuauuuugauugaagcauaugaaggaaaucuggucauacacagauacauaguuagaaaaaaaggaauaguauuuuaauaauuuuuuuuuuuggugugacuguuuuucuuugauaucauaccauaacucaagauaugguaguuucuuuucuauuguuuuuuuugaagucaguuuuauuuacauagaauaaaaugugcuuuuuuagauaugcaauuccauaaguuuugauuagaauauaugaaccauacauauuauacaaucauaauacacccuagucaaggcgugguguuccuauuuccuucaucccacaaaguuuccucaugcccuuuuguaaucaccuccuuuucccucacucccagcuucuggcaaucucugagcugauuucugucugccuuuuccagaauauuauguaaauggaaucauacgggacagccuuuugagucugucugcuuucacuuagcauaauguuugagauucauccauuuuguuguagguaucacuaguucauuccuuuuuuauuguauggauauuugcuucuccauucaccauugauggacauaggaguguuuuuaguuuucagagauuaucaauaaagccacucugaacagucaucuacagauuuuuacauggacuuauguuuuuaucucacguagauaccuacacaugugauugcuggguaguauggcugguguauguuuuaacuuuaagaagcuguaaagcuguuuuccaaagugacugggccauuuugcucuaccaccaucaauaugugaaaguucuaguugcucacauuuucagcaauacuugauauuguccguuuguguuuuuguuuuguuuuagccauucuaauuaguguuaguauuucauuguaguuuuaguuugcauuucccugaugauugauaauauuggguagcuuuuuucaaaaaaaauuuuuauucuuugcucuuuggcaaaggaccuauuugaaucuuuugcccauuuaaauaauuggacaguguuuuuuccuaugauugacuuguaagaggccguuauauuuucugagcaucaguccuuuuuuagaaauguguuuugcaaguauuuucuuccagucugugacuuuuuucauccccuuagccuucaaagaguagaaguuuucauuuuagugagguucaguuuaucgguucugucuuuuuuguaggucauauguguuguucuaagaaaucuuucguaauucagggucacaaagauuuuucauguuuucuuuuggaaguuuaauaguuucagguauuauuuuaggucuaugauauguuuagaauuaauuuuuguauauggcgugauauauggguugaaguuguuuguuuuuucuuuuuguguauggauauucaauugcuccagcaucugugguugcuacgacuaucguuuuucuauugaauugccuugacaucuuuucucuacaucaguugaccauuuauaugugggucuauuucuggguucucuguucugucccauugauacauguuucugucuuuucacuauaaccauacuguuuuuauugcugaaguuuuauaguaagucuuaaaaucaguuaguaugaauucuccuuuguacuucuuuuucagaauuauuuuggguauuccaguuuccuuguuuuucaaauagacaagacauaauuuuguaaaugcuaguugcaguggggaagcugaaaccauugaugaacuuuuugucuuuuguaacauuaaagucugcuuugucaugcacauugaguggauuuuuuuuuaacccaugaauacuuuuguaauaucacaauucauuuggaaaauauugguucucugaauuauguagacuuucuaaauacugucacauuucauuauucaauauuuaaaagucacauuuauugauaucaccacugaucucaucagaaaauucuuuugacuauuggaaagguugacaccaucaccuauugcugaugguaguagauaaaaauuuucaaaauuuuuauuuuuugcuugaaaacuuaaauuuuaucauuggaaacgcauacuuguuaguugccuuucuugaagucacagguucacuugguuuacuuuugagaacaugccugucagauacccaagucuaaauagccauagguuguuaguuuacaacucagucauacgugggcuuuuucuugaggcaaccauuguacaguugauccuugaauaacaagggucuuaauugugucagucuacacauauguggauuuuuuucaauaaguauguuggaaaaggcuuuggagauuugggacaauuugaaaaaacucacaaaugaacuuuuuagccuagaaauauugaaaaaauuaagaaaagauauaugucaugaaugcauaaaauauauguacaaaccagucuuuuauuauuugcuaccauaaaauauacgcacaucuauuauaaaaaguuaaaauuuaucaaaacuuacauacacacuuacagaccauacauggcacaguuugcaguugagagaaauguaaacaaauguaaagauacaguauuaaauuauaauugcauaaaauuaacuauaguacauagugcacuacuguaauaauuucauagccaccuccuguugcuauugcggugagcucaaguguugcaaauaucuacuuacaacaccauaugaugcuaaucaucucagcuugagcaguuugucucuccaguaaauuguauaucacaguaaaaagugaucucuugugguucuagcauauuuuucauuguguuuagugcaaugccgugaaccuugaauaacaccuugggacccauacaaagugccacucuugguacuggaauugcuccugagaagagaaaagucuugacauuacaagaaaaaguggaauuguuugauacauaccauagauugaggucugccguugugguugccauuuaugauuuauuuugugaacagaagguguaaacuuacaguaucgauaaauacaguucaguacuguaaauguauuuucuguuccuuauuuuuaaaauaauauugucuuuucuuuagcuuacuuuaguguaagaauuuaguauauaauauguauaacauagaaaauauguguuaaucgacuguugaugcuauugguaaagcuucugguuaacaguagucuauugggaaaguuuuuggggagucaaaaguuacacacugauuuuuguuugugcaaagccagugauccuuaccccugaguuguuaggggucaacuguagucacuaugcagcagaguuauguuugcuuaguuuuugucccacacaauauuaaaaaguagucuacucaagggccaagguuucauaaaauuaacaauuucuguggcuuuucaucaaggacauucucaagugaagugaaacuagugguguucagagaaauacugugauauauaugguuauuuccuauuauaauggcuauuuuuauauuuaaaguacagggauuaaccuggaaaccuaaacccaaaguuauaagugggaagacggugaauuacugacacuuuaggaauaccuaaaguugcuaucuugggaaacagucuuuuauuuuaacagauaaugugguuauauuauuguuuuuauuaucuuauaggugcuauacuugguagaucagaaacucaggagugucuuuucuuuaaugcuaauugggaaaaagacagaaccaaucaaacugguguugaaccguguuauggugacaaagauaaacggcggcauuguuuugcuaccuggaagaauauuucugguuccauugaaauagugaaacaagguuguuggcuggaugauaucaacugcuaugacagguaagaacacauuuaagauuuuaugguaguauugaguaauuuucacacuuccccucuuuuugaaaggggaaagaucagugcauaaauuuucacuuaaauguuucuugcuuuuuaaaaaaugggauuauaaagaacauuauaacaugcuguaaugacaguauauuuuaaaguaauaaacauggcauauauauguuuuaucuuugauauauuuugaauaaucuacccaguagugagaacucugaaauaaaaaccauuuuccccaauauuguuacgauuauaaacuuuuaaaaugccaguuuuaaggaaaacauuuaaaaaauuacuuuaaaagaguauaucuguugaaaaucuguccucaagaagaauaaaacuuaaucauguguuuaauuuucuuucaguuuccuucuuuauguaucuggaagaaauugaucuuacuacauuccccccuccccccgccccuuuuuuuuuucuugcaaaguaggccuuucgcucuuuacccgaagagacuuuuuauuuuugagacagauuucgcucuuguugcccaggcuggagugcaaugaugcaaucuuggcucaccgcgaccuccgccucccggguucaagcaauucuucugccucagccucccaaguagcugggauuacaggcaugcaccaccaugccuggcuaguuuuguauuuuuaguagauacaggguuucuccauguuggucaagcuggucucgaucucccgaccucagguuauccgccuaccucagccucccaaagugcuaggauuacagaugugagccaccaugccuggucuaccccaagagacauuuuaacuugacauucagaauuucaucagaacuaacaguccucaaacuacauacuuguuuuaauugcuuuacucuguacuggaaguaaaauacaguggucauguuauugacugccugugaucuuucuguauggagucccauagcuguuagggugaucccuuaacugccugggccacaggauuucuacuguggguaggugcugaagacaggcagaagcugugaaguccuagauaaacagacauuuuggagccaaaaaguacugcuguauacagugaacacuagauacuucuggaucacuuuugagagccucaguugauuaccuggaaucuguguuugauuagcuguaugugacuaagagcaaaaugcauugaauaggcccuugaaaauuggauuaacuacacuuuuugugagaaauuacaacacagucauuuagauuuagauauauauuucguauuuagaauguacuucuaaguaugugaauuuuccagggauuauuucuauguacuuauauauuuuagcugcauuucugauuaucagccucugcuaacagaaguggucaagugauaugugcuguuacgaaagguacacaggaagaaauuggggaaaaaugaguuugggaaucaucuuuaucccaaacuaucuuuuaucauuuaguuggaaucagggauuccuauucuuuuuuguaguagaaaacuacuuugcucuuuaccuaaagacaauacuccagcuaugugagacucggauagugccaaaaagaguagugagccauuuucacuggagucugcaaguguguuauucauugcaaauacuugcucuuagaaugguaauuacuauaccaucuuugugucuggagguuaaaugcuaauuuuaaacuauaaaauuuuguuuuuauacucuaaauuugauugaaaacaaauaggauaguaagagaaguaagaggaaaagaagauucaagaauugucaaaguguggaagaaaagaaaaugauaaaagaagaaugaaauugaauggugaaaaguaacuuuauugaauuaauuaggcuaaguaaucauguuaaucuguuguaauuugagacaugauuuuaaauauguuuuuaaauuuauauauuucucuuuauaaauuguuaaaauuuagcuuucauuuaucuuuaaaaaccuccugccaaauagauguugauguugaguauauuuuaguuugauuuuguuaaaacuccuaucucccugaaauuucuucagcuuuucacuuaagaauuaaauucuaccuuauuauucugacaacuaucaaaaaaguucaguuuguuauuaagauacaucuuuuaaguucaucugauguugauuuuuuuuaauaguuuuagcuguuuauuaguggcugauuaggauuuguucuagaggcuaaauccaggucuuuucaugacuuaagguccuauauaaaaggcuacuuuauuuuuauuuuuuugguuuaauucuaauccguuugaguuaguaggugcuaugugauuauuguuuacguguuuguuuucuacuuauugcugcucaucucaacccuguucauugcauucagggaauuuaaaucuacacucuaaaaaacagugacaguauuaauuucucagccuaguuuggguuucugauguugaaauguuucacccaugagauacgagcuuuuaucacuuagcauguguguauguauuuauauguauacauacacacacauacacaguuuuauauauaguuuucaguuuuuguauucacagaauggaaaugccauauuuccugugagcaaaagcacucuuugaccaaauugccucauugacuuuauguccucuucaagcuuuucuaauaauuaaaaaaauaaaaaaagaugcuugccuuagguugcucauuaaaaaccaaauuacagcaauagucucuaguagucagugugauuguuauaaaaucaguuguuaauuuuuuuuucuuaagagauuuaguaacaggaauccaggaacauuuuugguuuuuaagaauuauuagauauaaauacgaaucuugaaguugaauauaaaugacuaauuuauuauuuuauugcagaauaaaaacacuuguuguagggucaguauaauaauauugauuuuaauuauuuuuucucugcuuauuuauaggacugauuguguagaaaaaaaagacagcccugaaguauauuuuuguugcugugagggcaauauguguaaugaaaaguuuucuuauuuuccggagauggaagucacacagcguaaguucacagggaaaauacguagguuugcucaacuguagauuggaaacaaaauauauuuguguugauggaauaauuugccccuaccucuuccccaaaauuugagacuaugacagauauuuauuauagaauuuuguagaccaaaucugaguuauuuuucccccccuuuuccacagccacuucaaauccaguuacaccuaagccacccuauuacaacauccugcucuauuccuuggugccacuuauguuaauugcggggauugucauuugugcauuuuggguguacaggcaucacaagauggccuacccuccuguacuuguuccaacucaaguaaguuauuguccuguacuuuguaguguuuuaaauuguauauuuuugagaaauauuacuguggugaaacccacuaacuuauuacagauuauuuuccuuuggaguuaauuuuugaauguuuauugucaugagaacucuagcuaacuuugcaaacuuauuaauguaccuaccguguccuuaacuuuucucacuuuaggguugaggucgaguagaaugaagggauauucccauuucuauuccucuuuggagaguuuuacucucaugcuaacacuaaccugcuuugcuucuugagaagucauuuaugauggagaagugaaaucauaacccugucuuugcccucuguccccuccuccauuucuagauuucugugccuuuuucaagaccacuuggcaaaacauuuuauccauggggauagacuuaggaaaguaaccaaaaaaguauagaaaagagagguuucauaaagccuucaggaagauaccuccauaaagauguuuuuguagggaagaggagcagaaaaguaaccuuucuuaccauauguuguugguagaucaaguauuuuuuuugguugccucauaucaaguguguacugaagacuaaacacuucuuuuaaggcucuugauugucacacaucacaccccaaauauuucuggaaauauagguguggagaguaaucagauuaaauucauuaaauuuucuacauucucuuaucauguagacacuuugugcaggucugguauuuauaaggacuuuucauggaaguaguuaguauucuacaggucuacgaaaacugauaacuuuugguuuuacuugcuugagacaucucugaauuguaguuuuuacuguguuucuuuuaacucuuaagaucacauuaccucagccuucugaaucucuugguguaacuuugcuucuuuaauaccagaaggauuaaugguuaaaacuugauagaaaaaaauggcaaaguccuauaauuuaaugaccaaaacaacuccuucccucuaagcuuuauuuauauaacacauuuauuucucagcgcuugcagcaaucuguuagcauuagaucauggauucccauaauccuuguaagauguguauauagagaaauaaacccaaagguaaaauaccauguucgguaauuagguaaacauuauuuuguacaccuugaguauuuuaacuuuuaaacaguaguagcuaaguuuguguucauuaagaaucauuucuaaaaaguguuuuaaaauaaaaaguuuuaguaccuagucuauguaguuuacuccaaauggccauaggauacacuuuaccuucugucagugauaacuuuuaaaaaauuuguuuuaguaucaaaauuuagaagagagaguauucaguauuauaauaguuuccucaguuuaccagaucugugauaugcuaggaacaagcugggaaccacauuuauaaauaaauuuguuaagguuuuuauaggaggaguuuuaaaauguaaucuuauagauaacacugaucuguauacaguauuguuacaaaaaugugcuuaaagcuuuucuuaaagggcuuuauauccuauguauguggucaguuuuuuaagaaagacuaaauaauuuaaggguuuggacuuuuaaaaaggauugauguuaugcauaaauaagaaccagggauuuucugugaguauccguacaucucuguggguuuuagauauuuguuaugguuaaaguuacuguacacauuuauuuaguacuuacaugcucugucaugaguuuauaugaauuuguaugaauuucugaaaaauaaggaagaaauguaaagauuuugugauaaagucaccugguguggucaagcuuugguaugaaaaauacaagacaggccugacuuuaugcuuuccuucugucauaaacuauguuguggaaaaggggcauugucaucaguguggaacuucacuuuugucaucuuuugcagucucugaagcaguaugguuucgugcuucaaaucuuguuuuugcugagagguuuaugcaaacuguucugcaagaccacuucguggccaucauguaacaaaaggcuuaguuuuaucuucuauuucaaaauaaugauaauuacaucaagcauuuauugagcauuuuacaguguacuagggcacuguuaaguuauauuauacauaaagauauaaauuauaugggaacauauaaaaagcauaaaauauuuuuuuucaaugauuuccaaguugugagacugauuaucaucuuuggaauuuguuaaaaaauacaaauuuugggaccacacuccugaaaguauggaauggggcaugggauguuauguuuuuaauaagcuucccaggcgauucuggugaccagccagguauggaaaauacuaauuuacuuucaucucacagaguuguuuauguaguaaaaucuccauuuuauagauagaaaaaucugacccaaggacucuuugacacuaaagcuuuguucuuauuacuuacgcuguucugccucuuuuuucauaaagcacaugccuuuuguuucauauaauucaguaaacuuuucugccaucucaaaaucauccuguaggcuaauuuauuuuccuuuuggauauugaauaauuuguaugacuacuaaaaugaggaauaacaucaucuuauguaaacauugucucacauaggacaaaaagagaaguaaagaagucauagauacauagaagggcauauucauguguuuuccauuaaaaauuuccaaaaauucuaaaguacauuuuggaauaggguugaugacccuuuuuagaauaggguuuauaaacaugugauugggcuguagauaaaaauaucugugcuugaguugauacugccaauuccuauuaagacuuuuucgaaggguaggagaaguaggagagagauauuugaagucuuaaagugacuucuguauuucaccccauauucacguccccauauuucaacuuuacaucaguuaggaaaagaucuuacagucuugcugcggauuuuuggaacauucuuccucuggauucuuuaagugcuuuuagacagugccauaacauuugucauucuuuuucuuagggagacuuuuucucaaagcuuuggcuaaaggaugguuugugaaugaacuggucuguuguaagacauuguucucauuauuaguaagcugguucuggcaguuaggugagggauucuuuaugacaucaaauuguuuagaauuuuuccugguuguguuaguauuuuguucugaagaagugauguagggguauaaguacuuuaaaaucuggucuuucauuaugguuccuaguaaccaauacaaauacaaauucuagaauaaauuuagcacagucgaaggcauagaaaaaagcaguuuucuggucguuuuuuuuuuuucauaaguccuauauuucugucauuguuucaugguaucacuuuauucuuauucauccuggaugaaagccuuggagacaacuauucuuggcucugucauuuaccaaguccuguucauucaccuuuucauccugauugauccuauuguaguucaggacauuauuacuccuaaggcuaagauuauuucuauaaucucaaaguuggccuucuugcguccauuucucucccuucaucuguacuauugccagaauagcauuuuacauguuugauuauguuacuuaugugcuuaaaauaugugugggcucucagugagccacagcaaagaauacaaaguuggagcaugacauguggucuuccauacucucuuugucuuuugguacuuucuucccauuacaccccaaaacaucugucauaugcaucuaacauuguauuaguuguaauccuccuugaaagauuugagaaaauagugcuugggucauucuuucauuugucauucauauaaauaaccccaguugagaagggcucauaauguguuuuauucucccacuagauuguaagccucuugaagaugagauauguauuguaauuacugcugugucuuacacaguauuuguauggaauaaucauucaguaagugcugaauugcuaaauugaguuuguugcauuuggaauuauacugagaugauaaugaaguauguccagggauuccuuuaauaaacauucaggugcuuuagggcuuugcguugagagaaaucuugaggccaugauuuuguggggggcuguaaaauaaguugaaguauuucaggcauuuauaagagaaugacauuauucaguucuuucuguaaucacagacugaagcauccuaucuguuuucguuacccagcucacuuuucuuuugccugugcugaaacuaucuucccacauauaggaagaugcuuuuauaauaugcauugaguaaaccgaaugcaaacugguuuuucuagugacagugagucaugaauaugagggaauugauggacucuauuauuaagaagucuuauugugguuagaguuaaugcaguuucaguaaaauggcgccgcuuucauaaccauaugugagcuuguuuccugcuuauaagaucuauauuugugcugauaaaauaccacuugauaagaaauugaauuuuaaggguuagaaaugaccuaccuuuaacaaggcacgaaguuagcuucuuguuuacuuuuaaaggcuauauaaguagcacuucaguauugaaaauuaauucuuucuuaaauaacaucagccuguucaaucuuuaugauaguuugucuaggugugggucugauaaggacuaaagcuuugggauaccuaaauuaggcauacaaaauaauccuuuugaccuuagcauuaaagugauaauagguugucauuucaugcuaugucagagugcuauucacugagaaaccaagccaucugugaaaaugcuuuguaggauuuucuucuugaacaugaguuuauguauuuaaaauuaauaagaaucugaaaggguaggaaaacaguuuucagccaaguuaauuuagaagaguauacugcuuccuuacugggggagggugcaggagaaauuuacuaaauuuauugaguauuuaauaugcuaauaacaaguuauacuuacaaaauauuacauucauagaaacaugucuugaaauagguugacuacugauuggaguuuaugaacacaucucuuucucuucugcuuuuucucucuucauuuaaaauucucuucuaauuaaaaaguuaauuauaaauacaugcuugugguaucaagacaaacuguacagaaagacguaugaaaaaauagaaucauuuucuccucuuuucccuuucucugucacuuuccugaaauaaucaauuuuaacagauugguguguaucccuuggcaccuuucuuuagccuuauuuuuuugaguauauauguuuucuuuuuuauaaacuauaaacuauuccacaacuggcuuauuuuaauuuaacaguauauggacagcuuuucagauugauauuuuuaaucuuuuguuuuauuauguguuuuuaagugaaauguaauagaguuuuauuguaugcuuaugaaauagcaaaauuugauuuuuugguaaaaauuuuguauauuuaagguguacaaugugauuuuuuuuuuaagcuuagaguuuguauuagguuucugcaaagacagaacucacaucucacaaauauuugcaacuguauuguuuuaguauguuugaaauaugacauaaugcuguugucuuaggcgugagcauucuuuuguguguguguguggguguguguauguguaugucuaagaaauaguauagggcuacuauagauguuguucuguguccuaccuuggugugugauuauuuuuguauugguaaccuaaauuacaacuuacuuuaaauauauacuucuaauuguggggagaagugucauaaguuaucucgacaugcagguugacaaaaaaaauuacucucaucaggcauauauaauuuauuccacuuacaaaugcucagacaaggccaguuggagauugucuaaaauucuguguccaaaagcaaaaagggaggaaggggagaaaguagaaaauuuaaaccuuuaucaauagcuuaaaauaagguaaaguugcacauuaaaauuaauuagugcaccuuauuucuaaaagugacuucuguuuaaauuuugaaaucuugaguucagguuuucuuuggcuuguacagggucucgucugucaguugauuggugcauauggaccagacuauauaauuuauccuccuucucuggcaaggagauguguauuuaggaggaagugaguuuguuuuuuuccuguguucuucauuuccuggaccucauccuagaccuuguucuuucauuccuaguuacuucauugcugucaaaucuuuuuuuuuuaaauuaagauaauagaaaugaaaaacgucccauuguuagcuaaagcugcuuguagcacaugagcuaggaauuguucaggguuuucauuuuugcuuaaccgcucacucaaugcuugauugccuauggugugccaggcaccaugcuguguguaugguaaaaguggcacgaggacaguacuugcuucaccuucuggggccuacaguuaauauguaggugaaguaacacaggaugauuguuugacuguagccuggaaaugaaggguaaagaguguaagaagugaguugcuucaacaauuuuaggcaaagacuggaggaagggaggaaaaaugucuauuuccagaucuguacugauugggagaggagccacaugugggugccuagcuaaugcuaagugcucaguaaguauucacuguuauugguguuagaguaacagcuucaaaauugaacucaaacagaaucauuuuuacugaaauuauuguugauauauguuaauacuuugaaauuaacuugguguaauaaaagauucauuuugaguauuauaucaggcacuauacagaucacuuuacacauauuaacucauuuaauuuguuaguaccaugggguucuguccuguuuaucaaguccauuuuuuuuuuuuuuuuuuuuuaacuuuaaauucugggauacaugugcagaacaugcagguuuguuacauagguauaucugugccauggugguaugcugcaccuaucaacccgucagcuagguuuuaagccccacaugcauuaacuauuuguccugaugcuccccuucccuuguuccccugccccuugacaggccccaguguacguuguucaccucccuguguccauguguucucauuguucuacucccacuuaugagugagaacaugugguguuuggguuucuguuccuggguuaguuugcugaggauuauggcuuccagcuucauccaugucccugcaaaggacaugaucucauuccuuuuuauggcugcauaguauuccaugguauacauguaccacauuuucuuuauccagucuaucauugaugggcauuuggguugguuccaugucuuugcuguugugaauagugcugcaguaaauauacgugugcaugugucuuuauaauagaaugauuuauauuccuuuggguauauacccaguaaugggauugcugggucaaaugguauuucugguucuagauccuugaggaaucaccacacugucuucuacuaugguugaacuaauuuacauucccaccaacaaugugaaaguguucccauuucuccacagccucgccagcaccuguuguuucuugacuuuuuaauaaucagccauucugacuguugugagaugcuaucucauuguaguuuugaaguccguuuuauagauaagaaaauugaggcauucauagaugaagugacuuggcuuagagucacccuaguggguggcaaagccugggcauuuauauccaaggauuauugcccauugauugaauggcuuauuucaguaaauaauuaaguggaguccauaaaaaaaccaaagcaggggcugggugugguggcucagaccuguaaucccagcacuuuaggaggccgagguggguggaucaccugaggucaggaguuugagaccagccuggccaacaugggaaaacaacauggggaaaccccaucucuacuaaaaauacaaaaauuagccaggcaugguggugcacaccuguaaucccagcuacuucggaggcugaggugggagaauugcuugaaccugggaggcggagcuugcagugagccgagaccaugcuacugcacucuagccugggugacagagcaagacucuguuucaaaaaaaaaaaaaaaagaaaaaaaagaaaaaaaaagcaaaguaggauaaagagaucaaaguauauaaacuacauuuaaaauaguuuucauagugacuauauguggccuuguagauaaccauuuuaccaucucacaauuuauucauguguaacaugguuuauuuucugguuuuuucagcuacacuugcagaauacagauaugaaaauaaaucaaaauaaacuucuguagccagucauaaaaccugauucuuuuaagcaucaaccccaaaaagagaaugggcauaccuacguuuuuuucagacuuuuaacuccagugcuggcuaccuugaggugcucuacuucuuagggaacauauccagaaucuucauuucaccugccuuggccuuucuuugcuuuccuuucaagaggaguaagaugagagaaacuguaggaaguaggaauuaucacagaggaauuuugacgaucuaauuggcuggaaucauugcugugcaauugacaugucaauacuguugaaucucuuaauguaugucuugcuuuccuuaguucagaaacauuguccucgcauauacuguauuauuuauaaauucuguuucuauucugcuuggcaggauagucuuuuuaaaauuuaaaaugguaaaauuucuuagaauguaaaauaauuaguugauauuaagaggaaacaaauucagaauuugucaguuuucauauaguuuggauaggaggaccuuaauucgucuugguaguccuaaaaaguuguugagugagguaucuccacucccagaaaaaaaucagucucucucucucuagauacagagauacagauauuucuuggaaugguuugaauaguaaauaaaagaaaucuuauaacacauaucauauauacauauuuauaguauauaaacaaaaaucucuauuuucuggaaagauuuuuuguauuccagaucuguguauguguuuacuaaauaucuccauuuauaugucuccaagcacuuaccauucacagguagugauugucucucacaaaccugguucucaguaaauggaaccacuguccauuugguugcauaagccaggaaacuaggaugucucaacucuguuuuucaccuuaacugcuucucccuaguacuuacuccauuuuucaaggguguucuccacagggaaaucuucucagacuuuaccugucauuauaagucagguuucucuuuacagauguugaagguacugaauuccuuuuuauuagugugaauuguugauuaguccuucuguccugcacugcugcaagcuucaugagagccuggcuagucagugccuggcacagacuaguuacucaguaaaauuuguuggaugaaugaaugaaugaaugaaugaacuauucuucauucuuuucugauauuuggcaguaguuuuuuuuccaccucagggagaagcaacaaaucuuuuucucaccuacaaaccuaauagcuugauauuaaugugcagauucgauuuucaccguuaccuacaguuauaguauauaauagucaagcuacauuuucuauguugugaauccagaguuuuguuugcuuuuugcuuaguuguauauuuuagugcauuuuauuuugcuuuauuuuuauuuuuggagaugagguaucacucugucacccaggcgggaaugcaguggcaugaucacagcccacugcagccucaaucucccaggcucaagaugucuucccuccucagacauccgaguagcugggaccacaggcauaugcaaccacgcccagcuaauuuuuaaaaaauuuuuuuguagagaagggaucucccuguguugccuaggcuggucucgaacuccugagcucaaagauccuccugccuuggccucccaaaaugcagagauuauagguaugagcuaucacaccuggccuuuaaaaaaauuuugcuuuaccgcucuuauuuugucauguaguuuauacauugaggacuguugcuggugucucuuguuuguuuauucuaauccucauuuauugagaaguguauuaagcaaacauaugugguuauuuuguauuuauucauguacuuaagugaauguauuuuuuuguuccguuuuuacccuucauauuuuguugcauaguugauauuuugaggcuuguucuuggugucaguuuggguuauuuuauagcuuauccuaauguucauuucuugggaaauguauugggcagagacauacuuuuugguaagauguauggauagcaccuacuugcacagugcuaguauagugucaucuuuauagugucaucuuuaucucugaaaacaccuguauuuaaacaagaucugagagauccuugagccuuuggaaaccauagucuacuuauucaguuggcauguauuucuuucaagggauuaauuuuacucuggaguacuggauaagauguuuugauaguaggauuaucucagccuuuuggaugaauuauaaauacucuugaaucauuaucacaggaagaaaaucuagaaggaagaaaacuaguuaagcaacugguacagauaaaugaguuguccauucuguuuugucagugcuauuguucucuauagaaauauuggaaacuggggaacauagccaucauccauuggaggaauucucagccuucccuaccacuggugaucauauuucuuuuaauuuuaaauuuagacccuuaccuauuuugggaugacuggaaaaaugaaaauccuguucucuaucagugucugagugucuuuagaaugugagaugugugauuacuuguucccagggccaccucugcuuaacugcuucaccuugaugugcugggcaaguagguuugauaauauucugucacuauguuuuacuuaauucugaugaucuuguuuuccugucuuaguuucuugccaugguguauuauggugcacgcacauagccaccagaaacauuuuucugucucaccauuaugauucugucuuccaugaaagggaagugaggcaguucaggaaauaggaaauucuagagguucuuaagacaacuaucagaaagucugagaaacugauuucuagcuauauauaaauuuguuagggcugcuagcucguuuuugcuaaaggcaauacugcccucuagugucgagaaggcaauuccaauuuguaaauuccuuguuuuauaauuuagacucuagaggcucuuagaaaaauaaauaaucauuauuuaagacuugauuuaguuuguuugcaggcaugaagucauuggaucaguuaacuugggauuaaacuggagucaagaauuuguuuaccaccuaucucucauaucuaagggguucuuuuugauauuacuuuccucuguuuguaaggaaaguguucccuaucuuuauuuaaacaauguaaaacuuuggaucauugccaacuuuuaaaauacuaaaccauuauucucuuuccuucacuuuuguaacugaugugucauuuuucauuucauucuggauaugaaucguaauuucuuuugccuguguuuuuucuucacaagcacgccuuucauauaaugauagagguaagaugcauugauguuuguuuuaugguuguggaacuuucuguggaugcauacuaaacauuuuguucuuagauuuuuguuguuguuacugcuuuacugugcauccucuauaauuuauauauuuaugucauaaaggguucucccucacccagcuuuuauaauuaaaaugugauugauuugacuuaggaauggcuuuuaguuuuaagagacugagaguauuuauauuuauuuaagguaggauguagaaaaaaccguuuuacuugauuagaaguuaacaccuuaacggcuccauucgccucaaaaaccuuguauugguuaauuuuuauaugucauuagcuuaaaugucagcauguguucauuuuuaacaggggucgauuuucuaauccagcccauuguauuuaaaugugaaauagauauuuuuagauagcuucaucuuuggcaucuuuagcaaaugaacuagcuacaggaguauaacuuuugaugauauuuugcuaucugagguuuaagcguuuaauuagauuaaaauucacccuucaaauggagaacucagaauaaguaaaaugaucagagaugacuuuguagcuucccaccucuaauaauuuauuccacuguugguuauaguaaugauauuggguagugguuugggggcaggagauuacuuuuuaccagguuaucauuucaguauguguucugaagcugaugucuucugauaccauaauuuuuacauauaaaugaguaaagaagaaauguaaucagaacuguguuugaaugcauaucuuuuuaguuuugcaaaauagcauggauguuguaagagaacuggaaauuuagggaaguuuuuaggaauucugaaauccuucuaggugccucucagcuccccauugguuucucuauguagccagguaaagccauauuuuguguaugacaucagaaauugcuugucauuuugaaauuuaugucuacauuugucuucccaggggcucauauauuuuaaagguauacauuuuuauuuuuagaaucaaguauugauuuuuuugugaauaaauuacuauaaugaugccaauuaauugaaaaucauuucuacuauuauaggaugagugaaacuuacagaugaauuuaaaguuucauucuaguaauuuuuuauuuaaaaaggauuagagauuuuauaaucuguccuacaguuaucauuuuugaacccaauccuuuguguauuaaagaauauuauuuaaaauuccauuuuugaaaagcucaugucauugcuaaagguuuugagauucuacaggaagaccuuguagaccuuuuugucacccuuucgaaauugaccaguauucuuucuaauugaagcuuuuaccuuuuaaguaauuuugacaacaauauuuguucuggcuguuacuauacaauauugaauaaauuauaguaggagggugaucuaagauuauuucuuucugaaauaaugauagcuuagaaacuuguuaaacagagccuugggaauguaugggaacuugaaguauaugcauuuggaaaacauuuaaugaacuuuuuuuuuuaauguagauauuaaaaauuauuuuuucuaaaauuaauguuauacuaaaaucauaguuugaauugcugacauauuaauuguggauuaaauaaucuauaucuuacagacugaaucauauucauguuguugauguccuuuagaacagagaauggguaauguguagauuaacuauagagacauuaccaguguacauaaaagcuauuaaaaaucuuaauauuguaauuuagcacuguauucccucuaccuaguuauuuuuccucuucagcuuucagccauuuucuguauacuuuaguuuuuaguuuuuggcauccccucugguuugaaaccuaucucucuaccuuucuaacauuuucuauuuaguuuaaauaugucuuuaugcaguuauacaauaacucuuugcccuugaggacugaaugguuuccuuuccuguagaagaguuguuuucaagcuuuuuuucucuugucuccacauucauauaagcagucugcucugaucaguagaauuucucggauagaggugaucacuugaagaaugagggagggaggguguaguuuuuaauaaaaacucucuagagguucuuguguccccuccacugagaaucacacuugagagcccauccuuccuauaagauuuauaucugaccuccuugacccgucacucugcuaaacagaaacguucuuucauguuuugaaugugggaaggacaagcaacuuguagacaaaaaaaaaaaaaaaaaaaaaaaaaaaaagucugaguuugaaaugagucacaagaagucuuuuguuuuaucuuacuguuuaaacaggaauucuaaagccauuuuauaaagaugguuucauuuagaagaagaaauugcauguuuuuccuacauaacaccuugcaauguuucuguugcugagguucuuucuaguacacaguaaacuuuuaaaacuccugaguggcaccagugagcugagugaugccuaaagaaagcacuaacugucuuugaggcauuagaagaagagagaaaaagaaaggcagagaggaugcauugaucugggaucacauaccauuuccaagugucugaggugccacccagugucaucauaucaguugcuuuugccacagaaauuuuaguuccuccucaaaauacucauuaugcagcccuccaaacccuucuguugcuuuucucuggaagcuuuccaaaaggcuuccugcaucuugcuuuaguugcagauagggaacugagagaaugcuuucaauggaggguugcauucugcuuugauaggauuuccuugugauuuguagaugcuguauuccuauuuauauauuauguuugcucuauuuuuaaaaaacuauagcagugcacguuucuuucauuuaccauauccuguuaucuacuaugaugaccacuucuuuucuggauuuuuauucguacuucuuugccagucagucaguuccagaacacaaaugauuuuuuaucucagaucaaagggaugaauuguuaauauguuuaaaauuagaaugaaccaguuugguuaaagaaauauuuacuuacauauuuccuguaugugcuuuguauuugauauaccuaucugcaauguguuuaagaaugacugccgguaucucugagauuaaugaagaaaaaauuuaaacagucacuggagaaaguaauagaucuucaggagagguuuuugcugauauauagucauaauuugcuguuucuggcacuuuucaaaucauccuccucgaaguacacacuggaugaaacaaaugaaauauuguuaggaguauuucguaguucacagaaaaucuuaguggggaauauuacugagacugaucagaaagauuuuagaucuucucuccugugguacauauauagcaauaaugcugaacauuauuaugaaacucugaauucagguugccugccuugugaucacuauagauaauuaguaaucuaauuauggcaacauugaaguuaaugucauucauauguguuuacuguuucugucaguugacuuuucaguauacucacuuuuuuucucauuuucagaguuggugugugucauguucugcuuauuuauaguauuauuauuauuuaucuguaggacccaggaccacccccaccuucuccauuacuagguuugaaaccacugcaguuauuagaagugaaagcaaggggaagauuugguugugucuggaaagcccaguugcuuaacgaauauguggcugucaaaauauuuccaauacagguauguuuauugcaguuuugucaucuuacauacauguuuuauggcuaggucaucauaacucagaaauagucucaaaacagaagccauauguaccaaggugguucuuugugauacuggggaaagcaguuagcucuuuuaaugccugccuuugcaucugagaaauggaauuguuaauauaacaaucauuauguuugucuggagugguggaauuaaaugaaugcauaguagaucuuuugccagugaaaauucuaauagaaauguuaaauaaagauaaagauuccaauaaacaagucuaauugagugguuaaauuuuaauaucccccuacguugucagagaaagcaaacaaaaaaacaaaagagcaguauacuuuguuuuagaauugguauuuagagguauaucaccagacuugacuuacuuucauucuacuuugaguguuuaauuauuucaguuuuuguuugaugcauuuucagaggcaaucgagacuucaaauaauugguuuacuguugaauuguuuuuaagguuggcuggacuucucauaaaacucugaucuaauguaccucugagcuauucuuguguuuuguuuuguuccguuggugguauagauuuaugaugauucugucuuccccaucucuugcuuauauacccuggcagcucaugauacccuugguacugacgucuuggcuggauuugguguugcaggcucuaccaccauacuuagagaguggauguuucuuuuuccaaaguuaucauauaagcaguuucuuugucuuaauauaccuagauuuuaaccuuuuuaccuccucuguucaaucuuaccuccucuguucagucuauaaacuguuuacauagaguuuaugaacuguauuacauuuuuuuuugguagcuguaaaccacaguuuaguuuucagagagaaaguguauucuguugugccaagauucauaaauaagauaagggaagaaauuauuuccauguguaaggaagcauaaagcucagagaaaggcauuuggaugauauuaacaagcccgacaacagcaacaacaguagcuaacauuuuauuguaugcuuuuauugggucagguagggguguuuuacauauaugaguacucacuaauauguguacguauauuacccacauguacauaaaaugcaacauauaauacaacaauucuauaagacagacacuacaaugccuuuucuacuuaaugaggacacugaaggauuauguaacuugccagagguuagugggagagccaggauuuaaguuuggacaguuuggaugcagagaguuucuaaggguuucuaaccauuaugccauagugccucuuacuauuauugucuuuuaguagugaaaagaagcuaaucuuuuauaaguagauacuuaguagacauggauugcuugcaggcacaagugaauauauggugucuuaaauuauugcauugcauaucuuugccccuugcuuucucauagaccuuguaggguaugcuaaacauuuuuugaaggauguuugauauuauguuaguuuuugaaaagaagaaguuuucuauuuagaggaagucauucugccggaauuucaucuuucaaggagauuauucugaauaguaccacaaguaacuucacaccaugaugaaauuacaguguaauacuugcaguaacuuacguguugccauuguaagacacagaaugcagcauuuccgaucaccuucuguguuuguaaacuagaaacacagaaaaguacguuuugagggaaugaaaagggcaggcauuuaguauaaauuuguuaaccuauugucagagcuuuuucuuauuacaaaacagaacaaaaaauuuuuuaagacuuuuuuguuuuguuuuguuuuacuuuggaacuuauuugaguaaucucuuaugcaugguuuauuaaaccuguauuccuuguguucuuacuauucuuucuuuuugacucuaggacaaacagucauggcaaaaugaauacgaagucuacaguuugccuggaaugaagcaugagaacauauuacaguucauuggugcagaaaaacgaggcaccaguguugauguggaucuuuggcugaucacagcauuucaugaaaagguaaaacuacuuaacguuuuacuuuaguaaagucugaguuggccugccuaccuaaugcuggcuauaaaucccucagaguuauuuuucgagacaucuuauaguugauuaauauuuaaccugaaaauaaaaaucauucuugaauaaaaauguuuuaaaagguaguuuauuuuaauaaaagagcaaagauggcaacuuuuuaaccuaaaacucuacucauauaaaccacccuuuuguuccuuauuucuugugcuguaauuacucuuacaaacauuuauuuuaguguagguaaugcuuaguaauuuucauuuaccauuuacaauucauuuugauuacgugaaccauuuuuuuaaguuuuaaucagucuugcuugugacaaaaccagagucaggaaauuuaucugaucuuugaucugucacuaacuugcaggguaauuaucaccaaaauguaauugcuaguuuuccucaauuuuucuacuuuuagagucagugugaaaguaccauuaaugaaguaggaaauuauguuuuugguaauugguuucaucauugugaaauguaagugguucuuuuacuucucuuaucuugaccuaaaggacaacaauaaucuagaggaauauucuacauauuaguuguuauuuuauguuguuauuuuguguucugcuagucccaugauauaacaacucuauagucaggauauuuuaacuuuuaaaauauuuucuagaaccuuagauuuucaacuagucuuuaaaaaaaaaaaaaaacaaacuugucuuauagauugguggaaguugacuauucuuguaacaaaaguuuaaagcucugguauuuccuucuggucaaauguuuauuaaugugaaauggaaggaaauuugaaccauuugaaccauuccagaaagauuguuucuuggauauuauuuuucccugaaagggaaacucacaaccucuuauagguaaaaagaaaagucuccuuauacauauggccuuugucaagaacauaaguuucuuuuuuucccucuuuuuuuaggguucacuaucagacuuucuuaaggcuaauguggucucuuggaaugaacugugucauauugcagaaaccauggcuagaggauuggcauauuuacaugaggauauaccuggccuaaaagauggccacaaaccugccauaucucacagguagacuaaauuuauauuguuuucccagauaauugaguauauauuuacuaaacuuuuaagccccuggguaaauuuuaauuuuuccuuuguuaugcaaucaugcuuuacaagacagucaguuuucauuuguuuuuuaaaauuagcuuugagauuggccaggaaguauuuuggauaauguauauguuaacauuauugguaaaguuuaaugaucuacuucaucucauuucugaaagcaugauugaaaauaaacuauauuuucucgaucucaaaggaaaaagacauuuguuuuaccucaaaacaugauuuaucaauagggauuauuauccaagggcauguaaugaaggagagacuuugaaugucuuccuugcuuguuuuuugaaugaccuuaucuguacccugagccaagucuuaaagggaggcaucacuuaaaacaguuguccagugaagaaauacuacuuagacccaacaguugucaugcccgcaaaaggaaaaaugauugugucuuaaacauggaauucaguuugccauguauuuaauuuucuugaacgugggauucaauuuguugucuuguguuccauuuaaagaugguuguuugaaaaguaggcauuaacugauucacagaacagauacuuagcugagugccaccaggcgauguuuuagguugcugggaggcauuauuguaagucagccucuaauuuagguucugauuuugcaaacuuuaaaugacgucuaccucagaaauaacucuucucacuuucuuacaugcagucuauuggccucgucuucgauuuucccuugcccuaccuggucacauagggaauuaauccuuaaggacccccaaaguuauuaagggccugaaagucuuuugaaacuaagaucgauuagcuuuuauagcauuugggagugucugcuugugcuuucaguaucccauuauuggucuauaugucugcacauaaauuuaaccacuagucauuggcauagauguauuuaacuaggguauaguaaucucuaggaugagccaguugagacagguguguagaagaggauaucuuacugccuuaaaacuguuacccuuuucagaacaccaggaucuagcuagagcaguguauguuuaugguaaaaaguuucuguuauucauuccauaagaugcuuuucuacaaccagguggaagaauauaagaaccucuauaauaagggauuauucuaaaauguaggucucuaccaauaagcagaaggccccaauucagcuauuuuuuaaaaguuucuucauuuugguuuaaaauuucuguuucuaugggaguuugcaaaucagaacucugagauauuaacaguaguuuuaugauugguaggugggugacauagauaacauaucuuuuugguauggcagauuuuuauauaacugcuuuauagguaggauuccuucuuauuguccauguuaugaauagggguuugucaccgugcucuuguguuuaaggcugcauggggcucugagcuuuguuugucucacuuucucugcauuucauaauuuuaaguaacuauuuuuucauaguguacauauucccccuuuucugcuuucaauaaaaaauuuaaaaagguaacuaguuuaaacuuaauuugaauacucuuuuuauuugcaagggacaucaaaaguaaaaaugugcuguugaaaaacaaccugacagcuugcauugcugacuuuggguuggccuuaaaauuugaggcuggcaagucugcaggcgauacccauggacagguaaggaugaugauuauaaaauguaagaaaaaauaaacuuguuccauauuuucuuagaauggcaugucaggacugaauuagucuaaaauuguugugguguuuaaaucagcaucuaauagaguuaucaaaguuucugaggaagacauuuucauaugaugguagaggacucaggugguuuagaucaagcacuucguaaagcaacccuuagacacacgucauaggauucuuuuugaaaaauugaucaaagaauaauccaccaccuuuuaacagaccucauucuuagggaauucuucguaugaacuccguaguuuuagucuguuaguucuuucaccaucuuaagaagaguggaagaauaauuagucacuguccuuacuacaguguauuaagauuuccuguccauuuucccaugcaauaauaguuuauugcuucuuguuguuuauugcuucauuaauuucuuuaaucaacuugauggcuuuucuccaaauucucuccagaguucagagcacuuguaaaccccugaauuagguaacucuucacaccucuguauauauccauaugcacagaaaucuuaguaaugggaaccucuaggaaggccaaaagggaaaagaacauuauccauacaguuuauucucagaaacuuugaggcuggaaaagauguuuucauuccugcaagaucaccuuuuauuuuuauuuauuuauuuauuuuugagacagagucucgcucugucacccaggcuggagugcaguggcaugaucuuggcucacugcagccucugccuuccaaguucaagugauucuccuggcucagcuuccugaguagcugggauuacacacaugcaccaccaugcccagccuaauguuuguauuuuuaauggagaugggguuucaccaaguuggccaggcuuguaucgagcuccugaccucaagugauccucccaccucggccucccaaagugcugggauuauaggcgugagccaccacgcccagccaagaucaccuuuuaaucagggaaaccaguucaaccuaaaaggugacauuuucuacaaagcuaaaugguucaggccuucgacauuaucauuucuucaucuuucauaucauguaaauuauuuggccaacuaauucuuagguuucuuuuccccagcauauccuauugguuccugaggacacguuuuuaaugucauggcaccaccaauuuuggcaguauugacuaacuauuuaagaauguaguuugggguaauggucaguagccauauagcucuagaaaaguugacugcaaauguguaugggaauggaggcaauuuuguggagaauacuaccaagauuguguaggaagccugaggacaaacuucuaagcuaauugaaugauagacuaucauaagacuaaauucugggaacauauucuuaauuugguaccucauaagcccucccucauuuuuugagaaaaaaaauuucugacucauucaugucauauuuuuaacuccuucacaacuggguuuuaugauuaguuaaaaauuauuggcuuacaguaaugacuccuugacuuuagauuucauggaccagaaaauuucagaaauauuuggagggacuugcauguuauugcacauuuuauauaguacaaagaacacauauaaaagagggaacauuuuaugucaacaugguaaauaaaccauaaucuuacaauaaaagagguagguaccuuggauggcauacauuuaccuguaagagaaaaguaggcuuuagggaaacauucacugauagcacaauuaaaauaauuauucugaguaguaaauuuuuuaaaaguagagccacuuuucccuuuaauguguucuccuugaacuuuagucuuagugaucugucuuuauucuuaaaaaaaaucuuuacauguauauuugcauaaauugcccaacuuuuagucuagaguagagauuauagccaccuaaggauggagcguuauggacguaccaauaucuagacuacucucuaguucgaauacaucgcaaguauguugugauguacccagcuaucucacaaauauuuuuaagcauucauauaugaauguugucaagcaccaaccaaagcuagcuguacuagcuuaguaaccauaguuacaguacuaagaaauaccaaauuguuggggacaguuauaaauaaaggacuccaagacagaagaauuuaugaauaaacaaauacauagauuuuguacagauagaacuuuuuaacaucagucuguccuuuacuuagcuaauucuuuuuauaacauuuuauuaguuuuuuuaauacagagaaaagaccucaaaaaaaguuuuuuuuuuaaagcuacauuucaaacaguaugcaaagguacaguugaaaaguaugcagcauccuucucccagcugacaauugguucaguuucuugugauuacauccagaaaggggaacauaaaaacuucuaagucuguaccagcauaaugucuguugauauauuuuuuaaguauacgcagaaaggaucuuucuauuuauacgcuauaguguguauaccuuacccugguaauagaccacauuugguuuugauucaucuuacaaaaucauauguuaguucauaaaguuaaugaaugaguacucuuugcuuuuaacaucuuuuucagguugguacccggagguacauggcuccagagguauuagagggugcuauaaacuuccaaagggaugcauuuuugaggauagauauguaugccaugggauuaguccuaugggaacuggcuucucgcuguacugcugcagaugguaagggaaaaaaauauuuuuaaaaaagauauauaugccuaccacacauauaugaaaagggaugauacacuccaagguaauauuuuaaaguacaguuuuuuuuuaauugacuccaagagaugguagagaauucaggaggcaggggagcagugggugggguaggagaggaaaggaauugcuauguauugauccuuuaccauuacuagcuauguugcuggacacuucacauaccuuaagguuauuuccuaaaacgguuucagagguaguuauuaugcuuuacauaugaggaaauugagaugcagagaaauuaaguaguuugccuacuuuagccucaaacuggugaaugaugaaaccuagauuugaaacucugauccagacauagggagaggucugcuuuaaggucauauggguccugccccccagguuaaaggguuucuauuacuuguucuuguuauugaaguccauguucaagucuuauagauauuugcuuuuauuuauuuauuuuucuggguaaauuuucagacgauauuuccagugugacagaacuauuuuaguguuucaagcacugucuuuaguacuccuucauaaggucuuuacucugucuucaaguauguugcagcauuuuuuguuuugaauaauauaaggcaaacuugccgacugcuaaacuccuaaacagauguaaaugagcuugaucuguuucuuaaguucuaauuuauaauugccuaaaaacuuccugugauugucaaagaccauagaagaaauugugaauauuuuaaguuauaaccaauguaaccuauguuacuaacaauauuuuauuuucugaguacuguaauaggcucucguuguaggacagacugccacuggaauaugaaauucaauauaggguacuauuaaagggaauuuaauagaguguucagaaaugggcauucuuccaggauugagggauuggcuugggagucaaugccaaaccuaagaaaaguugaagcaauuuuggaauaauuucagaagucuuuaggaagaagcguuaagaacgcagaguguuuugacucuaagaggaaugacauuuaugaugugcauuuauggaagcagaaguagguuagauggcagauguuauaggaaaauauauuuuauaagaacuuuauuaauaugaacucuccauaacaaaucauuggauuaaguaauuuaggagacacaagaccuuauucucaaguaauauacaguuuaguuagggcaauaaaauauauccuggacaauuaacucuagaguaaguuaagugugaguugucuggcccauuccccaguacauagguauucaauaaauguuucuggguuagugcaauacuuaagaaauacaagcauguguuuuaggaguuuaggggagaaauugcuuuguuuauggggaagagagguuucagagaaguucuuuuggaaaaagaaaaggcuagauacugacuuuucuuaaaugccaugaaauaauuucagagucaggcauuucugacucuuaagucagaacccaauuguuaagucagaaauugggguagagaggauagugugagcauugauugcuaaaguaggugcuuucacguguguugaugguuacuuguuuguuaaaugaaguaauucucaaacuuuaaugugucauaccagauucuuaggaaucuuguuaaaauuuagauucugacucaguaggucuggguugaagccugagagucuacauuucuuaaaagcuaagcuaccaguugacggcaguguugcuggccuguacaccacauaaguguugaauagacaccuuagaaugucgguacuuugucacuggaaguacucaagcagagaccaacuguccagccauagauaauucuuauauuugaagaggguuaaguuagaugaccccuuuaugauucauuguauucuacccaggaguauuuagugcauuucaagagcuucacaaaauuuguguuuaugcacacauacaucuaucuggucacugauacugcucaguggugaccugugucugucaaaggaaggcaauccagugauuaaaaccagacuucagaguuauuuagagaguuggguucaauuccagcucuaccguuuaacagcuguaugucuuugugcaaauuauguaacuuuucugagcuucuuaucaguaaauagagguacugccaucuuaacccugugaaguaaguaauauauguaaaguuucugaucaggauaggugcuuacuggauguuaguuauuauuaacuccuaaauacaauuuucuauuuaucugaguaggccuaagaaaaaaggaauuauuuauguuguuuaauguugucuaugaaggcacauccugacuuguugggaccccuaguuggagagccuguuugugauuuucuaaaaaauaaacauguacuuuuuggcagcuguugugagggaguguagagaagagguaugacucugaggugcauaauuccucauguggggcaugcaggggguuuggauaugccauagaauaaacaugguuauaauagauugaaccuagagccuccagagcuggaagcaccacuguuaacauucugaucugaauuguaaggaauggguaccuuaaagggauauuauauaacguuaauuuacaaauacugauuguuccuuauguccucugugcagauggaaauaggcauccuuuauaccuagauaagaaagccccuuaugcaaucuuuaagggaauuacaugccaaauuauaggccuuuucauuucccauacauuaguuuggucacacugugguauaaguacaguugagagucuguuucucuucuguccucauagcauguaaacaguugggaauaggugacagaguauauuuuagaaaguuuguaccaguuugaaagucaggaggauuuuaaugaaaaugauuuauuuuacuuuucuuacuuuucaggaccuguagaugaauacauguugccauuugaggaggaaauuggccagcauccaucucuugaagacaugcaggaaguuguugugcauaaaaaaaagaggccuguuuuaagagauuauuggcagaaacaugcuguaaguuauccaguuagcuuuucauuugaaauuccaauaaaacacuuuucagaggaauuauuuaucucugcacauuucucuuucuucugcaaguauuuucuggaaggugaucuucacacaggauauucuagaguucuagaggcagaauuagggcuaugucuguauaccccugaaggugauuguaaaguaauagagcuuuagagggcuuuugucucaaugguccugugcagaagauugugucaucuauuuagaaaguuucccagggaaaaggcaugccagacucggaaacuguggauaguuggguaacuuugcugaugaccacuuccaauaugacaacauuuuaaaaaguuuaugaagcaccauguuuucuccucuccaugggaguuuguuguagccuuuuaauuucggcuuagacuuucaagucuuaauagugcuuuaaaacuauagagaccaggcacauaacaguauugcccugguuauuucagucuaaauauaacuagaaaccuggcuaaaaccagguagagaaaucccaaggguggcuuucugaucuucuguuuaauuguaagauagaaaugcugauauuaacuaagaaaacaauaaaaauugguagguccccuuuauccuugauuuuugaguccauuugaaggguuagcauugaaaugaccuggguuaugaacaagggauagagauuuuuuuuuuggaguuaaaaaaauuccucuugugauagucucaugcuuaaaaaaaaaguucuguuugugcuuuucuuuaugauucugcacaugguagucaauaaaagugaauguugacagaaacuucuuugacccagaaaaauagccauuucuucaugaaaauuuuauuguuuccuaauagaaaacaaaaacugcuguggcguuugaguauauguuuuucuccuuuuagggaauggcaaugcucugugaaaccauugaagaauguugggaucacgacgcagaagccagguuaucagcuggauguguaggugaaagaauuacccagaugcagagacuaacaaauauuauuaccacagaggacauuguaacaguggucacaauggugacaaauguugacuuuccucccaaagaaucuagucuaugaugguugcgccaucugugcacacuaagaaaugggacucugaacuggagcugcuaagcuaaagaaacugcuuacaguuuauuuucuguguaaaaugaguaggaugucucuuggaaauguuaagaaagaagacccuuuguugaaaaauguugcucugggagacuuacugcauugccgacagcacagaugugaaggacaugagacuaagagaaaccuugcaaacucuauaaagaaacuuuugaaaaaguguacaugaagaauguagcccucuccaaaucaaggaucuuuuggaccuggcuaauggaguguuugaaaacugacaucagauuucuuaaugucugucagaagacacuaauuccuuaaaugaacuacugcuauuuuuuuuaaaucaaaaacuuuucauuucagauuuuaaaaaggguaacuuguuuuuauugcauuugcuguuguuucuauaaaugacuauuguaaugccaauaugacacagcuugugaauguuuagugugcugcuguucuguguacauaaagucaucaaagugggguacaguaaagaggcuuccaagcauuacuuuaaccucccucaacaagguauaccucaguuccacgguugcuaaauuauaaaauugaaaacacuaacaaaauuugaauaauaaaucgauccauguuuuguaacaaauucacuguguuauuuaaggaaaaaaagguaagcuaugcuuagugccaacaauaaguggccauucguaaagcaguguuuuagcauuucuugugcuggcuuguaauguagggaaaaaaagugcuguuuuuugaaaagauggugucauuucccccuucuucccauguuuuaaagccccaucuuauauccaguucccaaaauuugcauacuuaccuaaguauuuuuuuuaggugugcuguguuuggggaauauuugaaaauuuaaagcaugauuuaaaauuuuuuaaagugagcugugacacuggaaagcucuucauuuuaucuuuuaaaauagaguuuuuucuauuuauauauguaaaauuguaguguauuucuuuucaccaaacagugugugggacauucuuuaucacuguuuuaggaucaccucaggaagugucguuacccagaauuccccacugucugcuaugagacuuguaacuuuaucacuauacuucugcuuggugccaucuugucagaguaauauuugaugucugugauauguaaagaauuauccuaggauaaagauauuaaacuuuaagcagauuucagauguuacugcuuuaaaacaaaucagggauaacaaauuaaacguauaacuuaaaauaugcaaugacauuuagagguaaccaauguugauauagguagcauagccuagccuccuccccaaaauugcuuuuacaacuaacacugauacuaauuuaggauaguucaugccuuauccuugcuaagaaaauggaauugaugguaggcaggugcuaaagugcuuuucaaaacaauauuacguuagaauacaauuggauucuuccucaaauuuauacaggccaaaaaguaaaacauuaauuuucugaauuuccagauuaccaaucaauuaaucaacaaauagccaguauuaugcuguguauuucugucaggucauuuuaaaauccauguuaauuuuauaaaagaauuuuuuacaugucacugucaggagcucacugugaauguguugucuucaaaugguuauuuaaccacacaguacacuacauuuuacauauauguacguaaucucugggaauaguaaauuaauuauguuauuuauaaacaauacauaggucaacagacuuuaagcagggaggaaaagaagaguaauagcgucugugugcugcagaccauucagaacugucacguguguccccauggucucauucauuguauuccuagcaauucccuuuucaauguugaguucaccucuuuauuucacaaaguacuuggucucucaauuucuugaucugguuuugcuuccauuuaaaaacuaaucaagaagggaaaauauugagaaugugcauacaagaaaaucauuaauuuccugaagaugaauuucuaccuguugugaacauuuaacuuucuuuuuaaaaguuaaacaaaaauaaacaagggauauuaugaugaauguuuggcuuaugugaguacuagagauaaaauuuuuaaacccaguuauucacaauauaaaauguuuucaaguuagaaaaaauuuuuagaaauccuggguauuguauuuaacuguagcuaaccaauuuuaaaacuuguauucuuuugagaacuauuauuaauagaaaaacuuuuuauaagcaguaaaauaagaauguuccagugacuaccuguccuuauaccuagucuuguuaaaacuuucuuuugcaggguauuuaguguuugguuuacagucagugcagagugggcaaguuaacagaaaguuugagcuagagauacuggaaaaaaaaaagaucaaagaaugagaaaaauggugauccauuuuggggcaaacugagaccccccaaauaacucuuuccucauguguauggugcuccucaugacucgucuuguauuuugccuuucugauacccaucagaacugcugcugcucuaacuuauacucuuuaccuugcccagaucuccgcguaaggaaugcuuuaugaucaacuugccauaggacugauggauuaaccaguguucggcuuuauuugaagucuaugcccugcacagcucuuguauguauuuuagaugcuagaaguuuuuuuagcaugugaugugugauucuuguuugaauucuagguaccuugugaauuccagaaaaagagacugugcuucacgauuguuagucccaugaacuugcacuaucuaucuuucauggugauguuuugaaaauacaaucaggaaaaaacccaacaccuuuggaauuuaaaauagaaucauaucaugaaauuuaaaaagaaucucuucuguugcauuuccucaccccuaaguaacagcuacauuuaaguaaaaugcaggugguaggggaaaaaaaaccauggcgagauggugguuuaguggaauaaacugauuacugguuuuuuuguuuuuuuuuuuuuuuuuaaagaaagaagcuucaucacagauacuuuccaguuucucuuuuauacuuuuuugaaagauuacuuuuuaggaacauuugguaugauaugcauaaaauuauuuauccauuuaugggcaaaaugauacaaguagcaucuugauugaacaucauuuaccucagauauucaaccagcaguacguuuuuuaugcagucucaacccauaucccauuuguuaccucucagaauauugguaagcaguuauuuucgcuuuacucuguauuucuuguguuuugggcacagguuauuguacuacugucaaaucguacuugcuauuuuuucugcaaguauuuaacagaaagcuuaaaauccccauaaaaccccaccuuggauaagugauuguuaaauauuguacaaauaaaauguaugcuauccccauuccauccccaaguuaaauaaaaaaaugaauacgguaugauuugcauaugcaguuuuucuuuagcuauguuuuuuuuuuuuuuuauacuuuaaguuuuaggguacaugugcacauugugcagguuaguuacauagguauacaugugccaugcuggugcgcugcacccacuaacucgucaucuagcauuagguauaucuccuaaugcuaucccucccccauccccccaccccacaacaguccccagagugugauauuccccuuccuguguccaugugaucucauuguucaauucccaccuaugagugagaauaugcgguguuugguuuuuuguucuugugauaguuuacugagaaugaugauuuccaauuucauccaugucccuacaaaggacaugaacucaucauuuuuuauggcugcauaguauuccaugguguauaugugccacguuuucuuaauccagucuaucauuguuggacauuuggguugguuccaagucuuugcuauugugaauaaugccacaauaaacauacgugugcaugugucuuuauagcagcaugauuuauaguccuuuggguauauacccaguaaugggauggcugggucaaaugguguuuccaguucuagaucccugaggaaucgccacacugacuuccacaaugguugaacuaguuuacagucccaccaacagugugaaaguguuccuauuucuccacauccucuccagcaccuguuguuuccugacuuuuuaaugauugccauucuaacuggauaaaauacuggcaaaacgaauccagcagcacaucaaaaagcuuauccaccaugaucaagugggcuucaucccugggaugcaaggcugguucaauauacgcaaaucaaugaauguaauccagcauauaaacagagccaaagacaaaaaacacaugauuaucucaauagaugcagaaaaagccuuugacaaaauucaacaacccuucaugcuaaaaacucucaauaaauuagggauugaugggguguauuucaaaauaauaagagcuaucuaugacaaacccacagccaauaucauacugaaugggcaaaaacuggaagcauucccuuugaaaacuggcacaagacagggaugcccucucucaccacucguauucaacauaguguuggaaguucuggccagggcaauuaggcaggagaaggaaauaaaggguauucaauuaggaaaagaggaagucaaauuguccguuugcagacgacaugauuguauaucuagaaaaccccaucgucucagcccaaaaucuccuuaagcugauaagcaacuucagcaaagucucaggauacaaaaucaauguacaaaaaucacaagcauucuuauacaccaacaacagacaaacagagagccaaaucaugagugaacucccauucacaauugcuucaaagagaauaaaauaccuaggaauccaacuuacaagggaugugaaggaccucuucaaggagaacuacaagcuacugcucaaggaaauaaaagaggauacaaacaaauggaagaacauuccaugcucuuggguaggaagaaucaauauugugaaaauggccauacugcccaagguaauuuacagauucaaugccauccccaucaagcuaccaaugacuuucuucacagaauuggaaaaaacuacuuaaguucauauggaaccaaaaaagagcccacaucgccaaggcaauccuaagcuauguguucuuaaagaggggagugguagcuuuguaacuuacagugaggcuuacaccuugacaacugcaagaaugaggauaguggugagugaagggagauuuguuaauuauggcauuucccucuauuaucgucuaaacagauuauauucccacuaaaguauguguguugguccugccaguauuagaaaccagaggcuuguuggcauugugucacacaguacacaccaauggauucucagauuuucuaggguaaaggugaaggauggggcagcacuuagguuauggugguuugaaagaaacugaauugcuuucuaaaccagaugaggaucagagugcgaaccauggugaaauaugcauggaaacuacagaaagacugaaguguuucuuacgguguuuucugcaaaacgugauucauuaggacauuaacagguauuacguuuucaacauauacagcauuaugauacaguaaguuuggaccaaacagguauucauuccccagagccuuucacaugcacgagaaucagucauuuuaacaagaauuccguuucugcugggccacuuggaucccuuggauucagauguaaaaacacacugaaauauuccuccuuucaccugcuuuucaguuugagguaaucagauugaaaagcaggaguucaugcauuuuuugguucuauuuuuccuccucuaguaaaugaagaaaauaagcuauauguauaaguuuacauuauucuugaaccgcuuuuuaaacuaggguuuuucauauuuguuuuuauugaugacaauuaaagcaauuuaagagacgaaguuagcucaaaacucuugcgaauagauuuuagcauuuuuguaugagggaauauggaaaggccaacaagcagcacuguuccuccccacaaaaaugccuugggaauauaauaggcguacacuucauuuguguaacuuuuccuaauguauuuuuuuuuaauuugcuuuauaacgguuucauguuuaccucaauugguacuuagucuuaaaaucuuucuuuauacuugguuauugauggaucuucugcagcucuuauguagccaaugagacagaugagggcugucagcuuuuaagugacaucuuaagcuaauaagaaauuggaauccucaagucauuucaugaggcuguuacccuuuaagacaaauaauacuuuccucaaauaguucagaaaauuuuuaaaaggaucacuuagagcauaaguguaaaauucuugcuucuaguauauaauagugauguuaccaugucaaguauuuuggugaaauauccccuaaaaauguguagacuacggcacagauugaguaugcaagccuuagcuugaaugagacugcugagaaguaaaugacagggaucugaauacuuagcaggcuuaacuuuuugcagggaaggaaaggcuauguaugcaaaagaauagguuguaacuacugaagagcuacuuuaugcucagaaaccuuuuauuccacuuuguauccaagauuucauuaaaacauuguuccuuagagcauacuuuaaaaacuauuugguaaggaauccacuguugaacuucaggucuuaauagcacuggcuuuggugcuaaacugaguugaauuccaagccuguuggccauucccagcauugccacugcuguguuaguuuucucaucuguaaauaacugccuacaucucacagggccucuaauaguuaaauagauuguaagcugcacaagcauagggacagucugucuuuuguaaaccucccaugcacacaauaggaaaucaaauauucuugaacaaaugaagucacuaagugcucauuaaauuucauuuuaaauauaugccucuguuaauucauggaucuuggaacuuacuuaaaagacaaugcuuugacggacauuuccacauuccucauagggauuuacuuuuuaauacaaacagguucaguuaacauugccauacacaucucauuacuuuugggagugcuuuuccagaaaucucugguagucacgucacuucaugauggggcuacguucugagaaaugugucuuugggugauuucaucacuguaugaacaucacagaguauacuuacacagacccugaugauauguauauagccuguuacacacuuaggcuauacagauagccuagccuauuacucuucagcuauagcacuguacagaauguuacuguaaucauacuguaggcaacuguaacacaaugguaaaacauuuguauauuuagacauagaaaagguacaguaaaaauaugguauaaucuuaugagaccacccuuuauacaaugucauugaccaaaauguuacguggugccaugacuauacuuguuaagaaggaaaauuccaguccuuuugaccuaugguaggcucaacaaucuguaauuuuagaaaauccuacaagggauucugauguggaugguaugaguaccacauuuugagaugucuagaagaaaaaucuucaaacuccuuggccuuuuucuuccauggaaccaucuucugacuaagcugguuagucuucugaacuagaaaaccugggucugggauagaauccaaaauuugcauguggacagaaaaaaacacugcagcaaaccugcuguaccaaagguuacuuauuauacuucagugcuuaccauuguuuuuuuuacuccuuugguuuaagguuuguaaagacaucuagcuguuagguugaagugagcucuucaaauagaccauuauauauauaaguguuaaaaaagcacauggucuagucccuaaaacagucauauuuuauucuucugaacagcuacuuacaaaguaaucucaaucagugaaauuauaaaucauguaacuguucaugauuaaaaggcaagacacagccaagacaguagaugggcaagucucacauaaauacaagaauguuuauagaauguuuagcauaucauguuaauggacaauaguuuuccguucucuacagaaguaugaaugaaaugccaaaguugaagucacugguuauauucauaaccagcuuagugaggauguugcccacugccucacaucuguaggacaguugggauauuucugcagagcauucauaauuugaguauuauccaaaagcaguuucaucagcugguacucucucugugaauuuccugaaguucuuuccaugggcuuuauuaauucuaauugcugcaaguguucaaaagc

SEQ ID NO: 13193 - RNA, 3376 nt, Homo sapiens
cgaaggccugaaccauuuagcuuuguagaaaaugucaccuuuuagguugaacugguuucccugauuaaaaggugaucuuggcugggcgugguggcucacgccuauaaucccagcacuuugggaggccgaggugggaggaucacuugaggucaggagcucgauacaagccuggccaacuuggugaaaccccaucuccauuaaaaauacaaacauuaggcugggcaugguggugcauguguguaaucccagcuacucaggaagcugagccaggagaaucacuugaacuuggaaggcagaggcugcagugagccaagaucaugccacugcacuccagccugggugacagagcgagacucugucucaaaaauaaauaaauaaauaaaaauaaaaggugaucuugcaggaaugaaaacaucuuuuccagccucaaaguuucugagaauaaacuguauggauaauguucuuuucccuuuuggccuuccuagagguucccauuacuaagauuucugugcauauggauauauacagaggugugaagaguuaccuaauucagggguuuacaagugcucugaacucuggagagaauuuggagaaaagccaucaaguugauuaaagaaauuaaugaagcaauaaacaacaagaagcaauaaacuauuauugcaugggaaaauggacaggaaaucuuaauacacuguaguaaggacagugacuaauuauucuuccacucuucuuaagauggugaaagaacuaacagacuaaaacuacggaguucauacgaagaauucccuaagaaugaggucuguuaaaaggugguggauuauucuuugaucaauuuuucaaaaagaauccuaugacgugugucuaaggguugcuuuacgaagugcuugaucuaaaccaccugaguccucuaccaucauaugaaaaugucuuccucagaaacuuugauaacucuauuagaugcugauuuaaacaccacaacaauuuuagacuaauucaguccugacaugccauucuaagaaaauauggaacaaguuuauuuuuucuuacauuuuauaaucaucauccuuaccuguccauggguaucgccugcagacuugccagccucaaauuuuaaggccaacccaaagucagcaaugcaagcugucagguuguuuuucaacagcacauuuuuacuuuugaugucccuugcaaauaaaaagaguauucaaauuaaguuuaaacuaguuaccuuuuuaaauuuuuuauugaaagcagaaaagggggaauauguacacuaugaaaaaauaguuacuuaaaauuaugaaaugcagagaaagugagacaaacaaagcucagagccccaugcagccuuaaacacaagagcacggugacaaaccccuauucauaacauggacaauaagaaggaauccuaccuauaaagcaguuauauaaaaaucugccauaccaaaaagauauguuaucuaugucacccaccuaccaaucauaaaacuacuguuaauaucucagaguucugauuugcaaacucccauagaaacagaaauuuuaaaccaaaaugaagaaacuuuuaaaaaauagcugaauuggggccuucugcuuauugguagagaccuacauuuuagaauaaucccuuauuauagagguucuuauauucuuccaccugguuguagaaaagcaucuuauggaaugaauaacagaaacuuuuuaccauaaacauacacugcucuagcuagauccugguguucugaaaaggguaacaguuuuaaggcaguaagauauccucuucuacacaccugucucaacuggcucauccuagagauuacuauacccuaguuaaauacaucuaugccaaugacuagugguuaaauuuaugugcagacauauagaccaauaaugggauacugaaagcacaagcagacacucccaaaugcuauaaaagcuaaucgaucuuaguuucaaaagacuuucaggcccuuaauaacuuuggggguccuuaaggauuaauucccuaugugaccagguagggcaagggaaaaucgaagacgaggccaauagacugcauguaagaaagugagaagaguuauuucugagguagacgucauuuaaaguuugcaaaaucagaaccuaaauuagaggcugacuuacaauaaugccucccagcaaccuaaaacaucgccugguggcacucagcuaaguaucuguucugugaaucaguuaaugccuacuuuucaaacaaccaucuuuaaauggaacacaagacaacaaauugaaucccacguucaagaaaauuaaauacauggcaaacugaauuccauguuuaagacacaaucauuuuuccuuuugcgggcaugacaacuguugggucuaaguaguauuucuucacuggacaacuguuuuaagugaugccucccuuuaagacuuggcucaggguacagauaaggucauucaaaaaacaagcaaggaagacauucaaagucucuccuucauuacaugcccuuggauaauaaucccuauugauaaaucauguuuugagguaaaacaaaugucuuuuuccuuugagaucgagaaaauauaguuuauuuucaaucaugcuuucagaaaugagaugaaguagaucauuaaacuuuaccaauaauguuaacauauacauuauccaaaauacuuccuggccaaucucaaagcuaauuuuaaaaaacaaaugaaaacugacugucuuguaaagcaugauugcauaacaaaggaaaaauuaaaauuuacccaggggcuuaaaaguuuaguaaauauauacucaauuaucugggaaaacaauauaaauuuagucuaccugugagauauggcagguuuguggccaucuuuuaggccagguauauccucauguaaauaugccaauccucuagccaugguuucugcaauaugacacaguucauuccaagagaccacauuagccuuaagaaagucugauagugaacccuaaaaaaagagggaaaaaaagaaacuuauguucuugacaaaggccauauguauaaggagacuuuucuuuuuaccuauaagagguugugaguuucccuuucagggaaaaauaauauccaagaaacaaucuuucuggaaugguucaaaugguucaaauuuccuuccauuucacauuaauaaacauuugaccagaaggaaauaccagagcuuuaaacuuuuguuacaagaauagucaacuuccaccaaucuauaagacaaguuuguuuuuuuuuuuuuuuaaagacuaguugaaaaucuaagguucuagaaaauauuuuaaaaguuaaaauauccugacuauagaguuguuauaucaugggacuagcagaacacaaaauaacaacauaaaauaacaacuaauauguagaau

SEQ ID NO: 13194 - RNA, 19533 nt, Homo sapiens
agacaaagacaugguuacuuuuuuauuugaagaaaaaaaaaguauguuuuaauaaauacugcggaaacauugaccaaacaaacauacacagugacuucaacaguuuaaaaaaugcaacaaaaguucugcuuuauaacaguuauaacuuauuuucuuuuuacaauauuuaaauacagaaagcacucgccagcuauuuuguaauacugcccaaagcauaaugcugcaucaaucaaagcauauuauguugguaaaaugucuguauuuuaugggaaaugacuggaaucgaauuuucuugcagagacaagacaaagugcuuguaagacauagaacugaguguuguaauuaccuuaaucucuccugccacgauuuaaggggagcacagcuucaacacuucaaaaacgaagcacuaucaugggaaagaaagcucguuuucaacaagcgccaacaauaaacaggucagaucugguuucuucucugaaagaaucucuaaaaggaacuggucaaaaauaucuguaaacuauuuuaaaugcuuauuauuuuacguaacaacagagaccaagugcugaacacagaccuuggcugcaucuguucagugagguuuuagcaaugacacucuagaaaugcccuaguguuaugucaggacugaaaguuuaucauauaaucuuccacuagggauucucuaaagcuuggguaaguggcaucuucucucaucaauguucauuuaaugaaaagugaaauaaaccaacagauuaucagaugcugucaguuuuggagcuucaacccaaaauaauaguccuuuugcuuuguauuuuugguaacuuaauuccagacagcuuuacucacaaacugugcuuucugcuacuauucuuuccuucacucauuaccuuuucuggugaaaacaguaacuaccuuuuuucucuccuuggaucauucuaugacaucaaaccaagacaccuuuuauuugacuuugcauuuuuaucaacgauggcaaaaaaucacacaacuucuaaacagcgcacaaaaauauuacauugagcaauuuaccacuuuuuaaugacaaucacaaugaagaacagaaccaucagacugaauaaaaaucgacauuuuuuuuccuauuugaucuaugcgaucuuuguagugcuggucuacaaaucuugcaagauugcaaaggcuuuccuuagaaccauccuacucagcuaucuucaggaaggcaagauuucaaagccucauaaaguuugccucuggauauaucccauggguccugauacaauuuccuuuuuaaugaugagcuagaaagaaauuagaucacauccucuagaaaacuaaaugcuaaggucacagugccaguucccccuugaggacgguauauuaacguauacuuuuuguaaaggagauuaaaacauuuaaaaauuaaaucaaaguggagauccaugaauagauuauaacaaaaaaaaaaaacccaaaaaugcaagcaccauucagagugugauuuuucuucuuggagguacucgcauccccccucaucuuccucuagcucauuuguaucucucauuuuuuggcauauuuuucaagucacacuuaaaaacucuuccauguauucacuucucaucacuuggucuacaugccgaaccuaaggucaggauuccaaaaagaugaguauccucucaaacgccuccuaagccucugguauacaugacuuuggcugugcacuucauuuagacuucaccuuuuuguuugcuguuguuuuuuacacuagauuccuuugucuucauuaaagauaaugaaagauucacaucacagugcagcucuucgcuuuguccuuucguaaguccguagcaacugccgagaguucuggucugcuaggcaugugugaaauccgcuuuguggcucucugugauuuguuccgcuuaacguuuuuauuugucuuauuuacacaugccaagguggcaacgugaaaaaugucucugacgcuauuuuccgacuguaaagcugagcauucgauauaaguagcugcuccaaucuguuuggccauauuugcccccugagaagcaaaagaagggauuuuaaccagcaauaagacuuugggggaaaguuagcuagcaucuucuaauaccacaaaauaauaacacauugcaaaacguuugcugauauguuaacugaauuuuccaagugucauugcaaaaaaaaaaaguuguuaaaauguaaacugccuuauuuauuacuucauaacuauuugcaguccagagcccaucccuaagaugcccaacucucauggcucauuagagguguuagagcucugaauaaaugcuaaaggcugaucuuaacaaaggaagacccugguuaucaaacacuuaacaugaggugauucaaagaaguguagaguggagcuaacgaagugauucaucuucacuaucaacugcaagcaagaguuaacugguuauucagguuuuccagggucacagcaagcauggaauggcgcagagaagcuuacuagugaaguaaguuagcugaaggucaugaacauaaacucugcauuuuccacacagcucuggccguggcgauguggccuugagaaccuguuccagcgccucauggugcacuucauuucucuuuucuugaggguaaauggcauucaagacuagugacuagguuguaccaaaaacaggggcaaugaaugaaauuuaaaaucgauuuugaaauguaugugauugugucuuacuuagggccgaaaugcguugaggaaaggaauaauacuauuguaacaucuguuacuuuaugaaacacaacauauguaauuucuaagugugaaccauaccaccaacguacacaacaauaagcaugugcacauuaaccaaaacuacuuauuuaaaauaccaaauuuuuugcuaaugagaaauggaagacuaagaagacugcgguauuuaaaaugaugauucuuaauaaaauuuugguauuucaacaugaacucucuuuagaaucugguuguagguuuuaugagaaugagcuuuugaaacugauucucauuucuaaauacuugggggaaaugcuuacagaaaugaagacucucugaaagaugguguuauggaguguuccacuuuacuggcaacagccuuauuauuguacugccgacuguaaaaucagauuaccccucuuaaagaguauuacugauuuugaccacauucucucuuaaaccuauuuaacuuuaaaccuacugggaggugcagaaauauacaagguuagcauaucaacuguuuauguacccgaauaucauguaauuacacuaauaaaugacagcauuuuaaauuucacaacugaccacugggugagccuuuagaaaagcagcuacuuuuuauuuuauuuauuaugagugauaguccauuucuuucacucuuucuaaaauccaguuuugcacaugggcaacauacauaccuggucauaggacacuggcgucugccugugauuggagagcucuacuaauguacuaacaucuguccgcagaucagacuugcagccgaccaagagcauuuugguauuuggacaaaauuccuggauuucaccuuuccacuaugaaagaaaaaaaaaaaagauuaaaaaugaacaaaguaacgguauccauaucaugaaaaccauuucuccacuggcugacauuagaaugaaacucagaaaagauguuaaaaauggagugucccuugagaugaagaagcaaacuuugcauuuaucuccugaacagaugugaaguuuuacuacuuuuuaagcauuagagaauaauuauguauauuaugauugauucucccucucugugacucaucuguugcuacugaaagagacuugguagauguuguccaaagguagcuucaauaaugucuuaauuauuggugugucucuuaaagauaaaugugucuuaagaauaauuauauauccuaacaagugaccacauccuucgauguguggaucugauccuccuucacuagaaggcuggggauaaggcagaggcaacacuagcacaaguaugcauucccugaucccaucaugaaacacugaagcaugccaccacgagcugaggcucuauuuuaaguaccugagauaguuaauaaaacagaacauccugccuugaaggaguuucuguucacaugguugcaucaacacagaccaugacauuugcaaaggaacaucucuugggucaucgggaaggcagcugguccuguagcucauaugccuucaaguuaguuuaaaacuauuucaaucuauuccaauuugucuaguuguuucaugaucuaacaagaauuauuagaaccuucagcaaugccuggcuuggaauuccaacuguccucuuuaagaacaagcaagcagcuuuuuguggcuucauuuccucaagcuugagcucugcaacagcaugggagucaagaguucagggcggucacaggagaucuuuggccuuugagggcagggccuagagaggcugagauggggaaguggcgccugacucuucccacccacauucacaaauauguaaguguucuacuaaguacuguggcagugacaaugaugacuaagacauagcugugucuucuggaaggaaauucacagaauacugggggugaugaagucauguauuaaguauaacacuagauaagagggacauccugcaagaauaacuuaaaagaucacuagaggagacaucuccaaaucuagggguguacuuuggguaacgaacucuagugcaaacuacaccagaggauucaaaggaguaauauacuuuccauaagagcccauuuuguccacuuauuccucccuuccucccucccucccucccuuccuuccuuccuucuuuccuucuuuccucccucccuuccucucucccucucucccucacuccuuucagaauuauguaggaacaccuaccacaugcuagguggcacuggcauuagaaguggaaggugaacuggaaaaaaaaaaaaaagaaauccucccuacuucaagucauucuaaccuccucuuugauagugaaggacuuaaaggguuccauuaaucaagacaaaccgcagggguuaucaugagccuuaaaccucacaggaauguaaaacauacucauuaauaucuauaagcccaaagucacuauucauuuggucuuagaagacaaaagcaaaauaaaacaggagaaaggcuuuucaucauaaauuaugcauagccugauacuacaucaaguaaaaucucuaguaaauaagcaaccccuuuuaucuccagacagaacuagacauguuguuauguugcucuucagcuguguaaugacuuuggccucccucugcaugucuagcaauuguuuacaagcauuaaagacaggaaagguguauuccugccuggauuugacaagcauuagcauuauuuguguuagauauguauuacucaaaauugaaaggagcuaaaaaggaaaaaagagucuuugaucuauuaagaaagagaucuacuaagaguuuuauugaacucuguuuguaauauuuaguagagacagaaggauuauuauacuucaaauccugauuucacaaugacacacaagccaagcaaucaaauauaauaggggaauguaaacuaauaaaaacacacaaaauacaaauaaauuccacuaaaaauuaaaaugaaaaaaacaaaaccaaccuagccacaccugcauguuugucuuucucaauccauaccauacucagacugggcugcaugggucaccccucaguugacacugccuugcucucagccacauccgguguugaagccaguguguggaggagagggagugcuccaacaaggaucugauucugaaaccccacagcacacaggccagggcugagaaaauagcuaguggcuaauaaaugcugauccauggacuaacacggcaugugccuucuacaacuaccuggaggcugagucucaacugcugaaggucaagaaacgccccuuccucccacuggccucccuaguuccugugacccauccuguaauagguccucuuccucuugaucucccccugguuccuuccaaccauagcuuccuuaguuagguuccuacggaaccugacuuaccuuugccuccauaaacuauguguacauuauaauauauaacauguuuacaagcacugcuuccauauuacuagaaagauaccuggucauaauuacuagacagauaccugaucaucagacaauucacauuggacacaucccuauuccuccuacacuaguuccauuucuguuucuaauaacaccauaacuaaaacacagcuucuuuguuaaaauagccauuauugcauuccuuucacuaucugacuugaggucaaauguaaaucuguaaacuaagaugcaaucuguugagucacugaaagaaggaaggaacacaugaauaugauaguaaucaaauauaacuguuguuagcuguaccauuuuucucccaaaggacaaacaugaaggcccuuaaaagguauuuuguuucagagcuucaugaaauaaaauuucaagcaaguucaucaucaaaaaguggaaaccccauuuuggugugaaaggguucuuucuaguguuuaauuacaaauuguaaggcagggaauugauuagagucuuugagcuucccaacaaaccccacguuucuauuuauacaucacccaguacugaagugugucaucauuucccagcacuugccuuuuugaggacacuguccagggucucuggucuacugaugucaaagcaaaucagcacagcauccgaaucaggguaagagagggggcggacauugucauaguaaggagaaccugagaagaaacaaagacacacaaauuuucagaugagaguccccuugucugucaugcauuaacucuacccuuuccggcuaaguccuuugacugucacaucacgacccaacucccacuuccccuaauucuuggaaaagaauucaaacagacacacaaaagccugcuuagaaauauaugaugaaugaagccucacaugugucugacauaaauucaagaagagggccaggaucuuaagugaaaucuguaugguucaaagacuagggccugaaguuaccugggugaaguagggaagcaccuggggccagguggucuuguguguaaaccugccuccaccacuaaaaagggagggggcaagguagcuuuaggacccugugccucugauucuucacucauaaaaugaagaugcugacaacauacauaccugagauuaaguaaacccaggcagggccuggcuuuuaguaagggaucaauacguauuaacuaugggcauuaugguuguauuacugcuguuaaaagcugagugguagcaagaaccauaaacugaacuacuucuugggaaagagaccaaaacucaagaucaauucugacagcaggauaggggugaaugagggagagaggaagaggaaggguucaacuaugcaaagagaaaccacaucaguguuacccaucuccaagauguaaguuuacauaggccauugaccuuugagcuugcuuauuuuaacuuaucgccaaacccuauauagauuuucuuccuguuacaaucaagaauguaauaaaugucguauaggaucaugucgcuuuuuuacagagucccaucucugagagugacacugaggcaugaucuaaggaucuuaaccugaauuaaguccaggguacccuaaagguucaaggcaccagccaauuaauuuaaccacagaacucucuagucaaucaaggaaguuucuucuauuucuuuaagaauuccaaaggaugggcaauuacaugaggccuauaguuaugaaaugauugacuagaaaacuaaauacagccugccaaaugccgcuuguuuaagaaaucauuuuccguaugcugacauuucacaagcaucacaugaaaaugauuuuacuaggcaaauauauacacacguauguaucugacuccagaguagaaaaagaaaaucuaaaccaccaaacucuuuuuaaaagucuauuucauuuugacaucacuuuccauuuugagcagaaaaacaggacauguugucccuugauaaaucaaaaccucaauaggcaaagucaggaagagagacuuaaaaagcagcuuuagaaaaaaugucacuguuuauauuucuaucaaaacaacauuugcuuggaggcuguucuugugaucuaaaaggcacuauagucagggggcaucgcccucuauucacacaguacacucugggucccuggcaucugcuauggaaccccaggcaacagugcagcuuuuucucuagcuccuuuacgauggagagugacaacuucaagccacgugugucugcuaagcaaggaagaaaagaauguuacaagaaucaggaagaaaagugugaauaaauagagaauuaagucagagcuguucaugagcugcagcagcugccuacccacaucuggaaccaggacccugguagagcagaggcugacagcugaaagauauuucccagaagcuuaaagcguuuagaguuuaaaaagucaagucauuuuaaguaugaagguauauuagaaugaggccgucucugaaaaugacaagcuguggcugccuuuucagucgcugaaaguacucugaggugaagagaauaauucacaaauaguucacccauuugaacauucgaaaggcaucagaaacgagaugguugaacacuauuuauggcuacauuaguauuuccauauuaguucuaagaaguucacacuuucucaacuagaaccuuuccuguuucuguguccaaagucuaacucuagcacggcaccugcuguaaacauuugaaugacucuuuccaaacaggcagucagaaaauucuagaucauagaguggagcuccaaauacuggacauauaaaugagaguuuccucuacuccucaaaguccgcgagagacaaccugaucccagacccaggaaggcaaagcugccaacaguuaggauugucagaaaccuaacgaggcuucagagaucuccuuucccagaaaucacucacauuaggaaaaaccacucucucccuguggagagcuuccaguacaagcagaccugguaucuuuagagaacuguuccaggugccuaccagcuccuuucaggauacgauuuguaugauguuagaguacucacugcuaauuccagauguaauacugcucuaugacaauggagaccaucuuuuccaaauaaaaaaauuaggaaaagcgauugaagaaauacaaagaggauaaaagaguuuaauuaaaauugagacugccaggaaaauccugaggaaugguuucaacauucaggccaccacaugacugcugggaauaccccuccccccuuuguggacuauguuucccgucccccacccauuuuauggccacaaaggagaucuggcuuugugcucagcccugagucaccugcuggagacugcuaccuacuaaaaucaagugggcuggcuucugugcuuagugcauauaucuaaauaucugcaaaauuuagacucuggccugauuuuaaaaugaaacggaguucuccaguuaaaccagauuuucagggaaguuuguaucugcuuuuguuuuuauccgguuaacaguauaagugaaaauacauauguagugcaaagguuuaugagaaauaaaccaccgugcuuguggagguagacagguaauuuuuaagagguuuaacaugaucuaauuagggaugacacuuugaucccauucuauuacuuuugcuaaugaacagugcugcuuuuagaucaacacgaguguccaaagguaauaguaaaacugauucccauauuucuuaguuauaagcauaauuugacugccaaugacaagaguaauuuauuuaaaauaacaagaccauuuauucacuauauuuuugauagguuaaguuuaucuugucuuagauagaaauaucuauugucucuauuuauucacagugaaaaauauugauauagaauuaucaagaacugucccaccaggaaagauguaagucaucagcucagcaggacuuucaggauaaaaaaaaaaacaaagcaaaacaaaaaacaaaaacacucacacacaaaaacaccuccuguguaacuuuacaguguuuacucuguguuuaagcacuuggaauccuuccuuuucuuccccauaaagcccaagagacugcacaaaggaaguaaggcaagcaaagcuggagagggcacgguggaaucacagguaugcgugagacaacgcaugccaaaaaaaaaggaagaggaauuccagaaaugacucugugaagugagaagcaauaaagaggggcagaaaugacaccaaaggaaggagcugaaaguaaguggguaaagcaggaacaauaccugccccuaacuccuauaucccuccagaaaagucuuacaacacccugugaagccaaacggcaaaaaaaaaaaaaaaaaauuaacuucuauagguguuuuuaaaagaugcacaugaaaaacucccaaggugcuaacuguagaacuaaacacagcacaagcaggagggcucaacaauuuuuacuaaguaugaaaguauucaacuuuaacugcaguacaugguagguauugauauacacagaguaugugcucuaguaccuaagaaugcacuaaaguccaauaacauuuagggacugcguuuggcuugucaaaugaaacucuuuuucagcauguggaauaggcuucaugcauauggaaauucucagaugcagcauuucucugguacuauaugaaacuuuuaagcucgcaacccuauuccaagguccuuuuuaaguaaccugccacaccucugaaggaaaaacuuagggaaacucuauauuguaaagaaacaacuacacuauauaugcaaaauguguaccccgcucacccagaaaauauaguugaaaggcuuugcuggggguagauuggaacaaguguacacuugggguucucugaguugcucaaguuuggcaaacaucagcaaaguucuagagagcuuuugaaauuucagaucuacccaucuuuguauucaagaucauuaauucugggugagagcaaaauuuccagccaaagaauagucacaacgugccucacccagaaacuaauucuucagacacauaccugccugcugaagucacccuuucgcaaauauagaacacaccauauauguacauaauuaaauguauauguaagaagauucaugcccaaaaggaaggcuuuauggaaccuuuugcaaaguaccaguuuaaacacugugaggcuuuagaggaguuggagaacugaaaacucuucuuguugaauauuucauaaauauaauuuauuuaacuugaaccuucaucugaaaagcuucccuuucccccuuaagaaauuuuuaccaagaagaguaagcuaaagcuauugcauauuuuuggcagagaaaaguagauuaacuuuugguauauuuagugaccaccaugagcacaucugaacgcagcagcagcuaacaugugagagggcaugaucugcccaauuauuacaagauugcauuuccucaugccaucucuaaucagaggaaaagguuuaaauuagcagcaaucucaagaaugugaaucaagucugggcagaacuuuuguaucugacucaguguaagacuguuuaguucuuguuucaaguagucugcacaacaaauaccaugccugcaaauaugcaacaaacacucccaggaagaauauguuuguuucuuccauggauucagguaauaggaacuaugaacagaucuuauaaaauuuugugggcauuuauguguugcuauuaaaauggaauaaagauuuucuauuucugggggcaauguagauacaaaauuagaaagucagacagguagauauguuuggccuuuaaauaaaguuuagcuuuaaacuccuaaucuuauugagguacuuaaaaauauguaagaaucaaaauauuuuacugacaguggaaccaugguuaagucaagagcuuuagggaaaagaguauauguauaugaauaugccuaaaaguaaauagggauaauggauucaaguuuuuguuucauaugauaucuaagaaucagauuucuuggaguagaaucccaugagugaauucaucuuuccacaaacuaugucaucaggcucauuuuucaaaaccaaugugcacaacaccuggucaaacuucugcgucaacuacauuccgugucaauaaaauguuugcuuugccaagggagacucugagaaagugaccaauauguagcaacugagaagucauuuaaaggacaucagaaaaugacugagccacgacuaauucauuuggcagagcccgccaggcaccaugagcuaacuggagaaaguauugguucuuggugucauauuuacaugcaaaagaacuggauuaaugaggaaacaucugguuauuucggguguuaucagaaugaccaauuuggaugcuucauugaaaugugcaacuuagcaagaaaccagauuggaaaaaaaacagcacuaaaugcggcuaaaaaaaaaaaaucuacagacagauguagacuuagaaagagcauucauacugcccccuccccuuuuuaggagguuccuugguuuaaauggaaauuacugcaugguggacaaaucuccaaaugcaguuuuauguacugcuuauuggaaaccaccauacaaacuaucuguuuuaccuuaacccaggucuuuuacauaagaguuucagugugaaaacucguuaagaauuaaaccuaguuuugaaacccuaagcuccaauggaucauuacuaccugaugaaaugcuugguuuccugcaauuucacaguugauauucaaaucccaagcauccaugcuucucuggcuccuucauaaauucuuaaccucuuccuuucuccaagaacguuaauuuaaguuauaauucucagcuuccagaaucuuguuuuaucugagagccacuaaauguaagcgaguuuccacguggaagaaacguuaaaaacuucuuagaacuuagucaacuucuagaaaggaagggaauuguggugggccucaaugaccauuaagucaugaguuagggagccugggcugcccuuguggccuucaagaacucuuuggaucuuguugcuccuugaaaaauccagguuuagaaccuccgggcucaccauccuauaaacagguauuacagcacuagacaggaggaagucuuucuauguccucuguuuguccuguggguauucaaagaagguugucagggaagaaggaugucuuuacccuguucaaaucucagucuacuggcaucuccucucaccuaaacaccugacacuuaauccgggcuucucauuugauuucuuuuguuaguuugggaaagccugaauauuuuaaauuuuauugucacucauguuuucaccaugucugucuuaucacauggugaaacugugaguaccuaagggcagaagcugcucucacccagcucuguacuccucccauagcaucuagcagauuguaugcacacagaaagcacuaaaccauguuuacugguuuuauaaucauuuuuaugucuugucuagauguguucauuuauaugcuaaaucaccaaaaaaaaaggggagggggagagagagagcagugauccccuuuuaagcugcuuuucuggauuaauuauauacuaaucuccaauacugcugaaccauuuccaucccuguuaagaaauauuucauuagagagcuugucaccaagaccauucuucauacuugauguacaauaaucuaaauauaacagcuuagauagacuucuguuuauagagaaguuuguccucauauuaaggccauuagguaacuaagauauuuuuccucucuuuuucucuaagaaauaaaggauaccaccuuaaguguuaguaaugcuaaaaacuaaaauaggaaguacuaacuuuagcacucagggcuuaaaagaaacuuggaucaugacaagauucgaaagaguguucaugaggcaauagcauaguuauuguggggaauuuagcagcugaauugaauauguuaaaaguaauaauaagccuuaaauaaaaugugcauuaacuugccuugguuaaaaagcuggaaugaaugauuauuacucccuaaaucacaugugcugaaauuacacugcaaucaaaucucuuaggaaaagauacagugauccuuaaaugacuacauuucuauuauuaguaggcauuuggcuucaugcuacaaauuacuucuaugcuuggcaaauguggccaauuuugaagcacaagauauuagaauuacuuuggucuuacuuauuacuucacaauugaaacuauuacccauuguuuggcagaaacucauugggugaaauuugaaaaucaaugggagcauuucugcaacuauuaagaauguucauuuuauaaugaaaaauauuuuuuaggaaaaugaagaaguuaugggccuuaaaaauucccucuuuuagaugauuccuacagcauuuuuacaaagguuuuguuuacuuuuguugggggggcuggaguacuguagcccuaagaauugacuggcaaaaugccuuuuguaguugcuuuaacuggugugugcaaugggcggggguggggggggcggugcggggguagcuguuuccuaucugaagaggauccagaggaucuauaagcccuaggaugucugacaaaggaaaaacauugcaaccaaguggaaaagggcacugggguucaaggaccugacaaaauuaggugcaucaugaguuguuaaugaaauacacgcuaaaccagaagagcuucuuuuucuccauuaccccaccugaacugucugcuucuuaggagcaggaccaugcuuaauuaacacuguaucucuaaggucuugacagagggccuguuuauaguggaugcgggaaaaaaggaagagauggauggagaaagggagaaaggaaggaaauauuaaguuacugugccuuaaaaagcaggaaauuauuuuuuuuucuuggugcaaagagacuucacauauccuacuuucacuugguagucuuucucacauccaaauuggcagaguuugccuaugcaugaucaugacugcugggggcaaaaguagaccccuuaugagaagcuguccaacuaaagaggccagauaagagaggaacuguuucugucuucuaaaugguugcccuucugcuaggaggguaaacaggacaggaaauaucauucaaaggacaauguucaucccguaucucucccuauauaagagcagucaggcacacccaauuuuuccuauauaagucucuuucacaaaguucuaggagggaaauaaaaagugcaauuuaucugacauuuagaacuuuacagacuuggcugggaucuuuucuccagaguuauauugauggccuuuggaaaaaauaaauguaucaagaggcauaaggcauaugcaauuauuuuuacaaucugaacuaaauaaauguuuuagugggcaaagaaaaugucaaacauuuaccaaaaaauaguccuguccagaaauuugccaugaaaagcuuggaauuaaauggaaaaauguuaaagauccuugaaauaauuaguugcugauucaaugguuccugcuagauauaaacaacaaaucacuuuugauggaaacaggcuauucuuagaauuuaaguaagcagugcuuggugacuguguuuaacuaacuaacauuucaccucaugaacaacauaauggaauucuaaauaauucccuuaugccucuuuuuuccauuuguuuaaaucuaaauucuaacuaagauuucauuaccggauaauuuugcaguacaaaauuuucuucaucacauuuucaaaccuuuauauuuuaguuaaacauacauaaguuuugguuucauuaaauaaaaagacaagugauuauuucacuacaaauucauuucagaugauuaucuuuaauucgaugaaaggcaauguuuauaaaguugccauucuuugugcacagguaauucagugugaauaaaugucagggaaccucaucuccuuggcaacuaugcauaucauuacucauuuacucauucaucagauuuuauuggauaacugcuguaugcaaggcauugugcuaugugugcagagucuacgaacugcagaguuuugauuaaaugcaugaagauaccugaagugguauuuaccugcacauacgaaggacagccuccaacuacaaacugcccacauuuugguuuauguucuagccuuuaucaaacaaugugccuuuucuccccuaaaagaaucaauuuagcccuuuaggcaucuauuccgaaauauccauuggugguccugucacucuugaagcuugagauaggaaauguauagcccagcauuccuauaagcccacccauucccccucccuguccagauggguuucauuccuaaauccaccaggaagccuggcucugcccagaaccuggcuugcuuugcaggcugugaaaaccccagcacgggaugccagauccccuaagacuaagagcugaagccaaccaacauccugggaaacaaaaagaccugccuguccagcguaauaaagccaagaaguguacagcugggagagauccugcacaucaucuagcucaguguccucuuuuuacagaugaugaaaaugagacccagggagauaggggauuugcacacagaaauccaugguaaccaggagcuaagaucuaaacacagcuuuguaucaacgacugguucagacacacugcuccaccccgugccaaaauaauuuuuaucgugcauuagguccaaacagggcugccgguuggggcagggaguacuggugcuuauuaucgguaccacaccagcugugccauccaguaggcauaacaaauacauaccaugauaugucugggaaucagagcccauuaaguaccaggcuguaaaauaauucugauaggaacuacugaaauaaggaaccacuugaauucugucuaccaacaccuucuccagaguuucgagucuguguaccauccccaacagaaaacacggcggcaaaguccugauucugcugcccuuggaacggcugagaaagagccugacuccagggggaaacaaaaucagcccuucucacugcagcagucggagcaucuggcaccgaccaugagaggcgcucgcucgugcgagacuucucgcuugccuuugugcugggacugccucuggcgacccugucagucugguuccuuccucuugcucucugaacccccgcgucccucgggggcuccagcgguucaagcccagcgguucugugggaagcucacagaaacaccuccacgaggccacuccccgcugggcgcggcuccaccucggggccuccccgccuaacagcaaaccugcuuguuggcacuugcgcguuccuccucgccaguuucacccggauuuggcucgguccgccagcaacccagcuccuugcuaaauucccagcccuaagcgcaggggccuuuacccagccuucccaguggguccugcuuuuccauagccgacacccuucuuggaaacaaacucgcuagacaccgcugguuagggcggcgggugccuaugucccagcccaagaccucagauggugccccccugccacuccccggccuuugaccuggccuaaaccccuaacucagccggggggccggaugccuucccaccgggaggguaccuagcccucccuaccaccgcgcgccagguaggugggugggcgcaugggaaagcaauaacccggccuugaaccucagacccaugaauauaacccaccgcggcgccaauaauucaaguagacuggaaggucaaaggcgaauaguguugcccgcggccuuggaggcaagccgagugggggaugcaauagaggucaggaggggcugguguggugaaggggaaacggacgugaucacugggauggagugggggaaaaagggaaaagcucgguacaggugggcaccgaggcaccgcgggcggccggcagcgcgaagaggagguucagcugcugcccggccccugcgccaccagcgcauuccuggguguaggcgucacgggcgccgcggcugccugcgcucaguuucuuucccucaacagcggcaauugcacguaaccgcgucgccucugggauuuucucccgccucccaucacccccgcggcgcuccccgccuccccgccaaccagcagguuagaucuaggaggggcgcccgccuugagccgggugguuccgccgaggcgcacgcagcgcccaugcaacaccccacaguaucgggccaccucggccgacccaaggcgacuugaccacgacuccgcgggcggacugcgccuggccacuaguggcuccaaccgcggggucacccugcgggcacacagcgcucuccucuccccacugcuaucuccucguccacgcugucgucugccgcccccacccagaagggauacaauuuucgcccaacagggaccgugggaaucccuugggaggggcgcagacggcuuguagcgcgcgguuucccgagacccgccgcgcaucccccagcgacuggaaacccgccccaagcgccacgcgguccucccacucuuacccgaagugucccacaggcucaacucuauucuuugugugucgauuucaaaacuggccguguaauucucaaacacuguaggaacguaauucuggauagacaaaaugggcaaaagaggaaggaaagagggcaaagagguuacguuuaaacgcacgacacccauugaacacccuuccccuccccgcuccccaguuaagaaagaaaaccuucacacaucagaccacacacuaagcacauggacccuuuccgaaaccccuguccuacuccccacucaccccacccggcucucacagaucugcugacccgaaucucccaaccccagguuaugcacacaggaacgaacaaguuucaggagcuaaccagcccaugugcaggcgcgucccaacccuaaaagcuuccagcgcacuuucccuuuccccgcagucuaaucaggggaaaguaguaaggaccgagaaagacuuuuuuuuuucuuuuuuuuuuuuuuuaagggaaaacggaugaaagcggggaggcccaccucgggacugggaucccacuggccgacccccucguggaagccgcggccggccacacucaccucggggaagcaguccuuggcgaagacauggagcagcgcaguuuuuccacacugacugucucccaccacaacuaucuugcauuucacguucugauuaggauccaugauagauuugcuggauaauuucuggcuggcucuucucuccuucauugauguugccuuauuuucucuuggaacaggaauuuucucuuaagaagaaaaaaaaaaauauauauauauauauauauuucucucuuuauaaaaagcagauauaaaaauaaaucacaaggcugaugggcaaccucugaaacgcggcgcagacgaggaggagagcgagaggagcaggcugguuacuccccuccaacaaguuuuaagccugacuccucaccgcgccucccaaguccaauuccgagccgacugcuuuguuucacgcucucugcgcggcuuuauacgcccggccuuccaauccucuucuuucucaaug

SEQ ID NO: 13195 - RNA, 19533 nt, Homo sapiens
cauugagaaagaagaggauuggaaggccgggcguauaaagccgcgcagagagcgugaaacaaagcagucggcucggaauuggacuugggaggcgcggugaggagucaggcuuaaaacuuguuggaggggaguaaccagccugcuccucucgcucuccuccucgucugcgccgcguuucagagguugcccaucagccuugugauuuauuuuuauaucugcuuuuuauaaagagagaaauauauauauauauauauauuuuuuuuuuucuucuuaagagaaaauuccuguuccaagagaaaauaaggcaacaucaaugaaggagagaagagccagccagaaauuauccagcaaaucuaucauggauccuaaucagaacgugaaaugcaagauaguuguggugggagacagucaguguggaaaaacugcgcugcuccaugucuucgccaaggacugcuuccccgaggugaguguggccggccgcggcuuccacgagggggucggccagugggaucccagucccgaggugggccuccccgcuuucauccguuuucccuuaaaaaaaaaaaaaaagaaaaaaaaaagucuuucucgguccuuacuacuuuccccugauuagacugcggggaaagggaaagugcgcuggaagcuuuuaggguugggacgcgccugcacaugggcugguuagcuccugaaacuuguucguuccugugugcauaaccugggguugggagauucgggucagcagaucugugagagccggguggggugaguggggaguaggacagggguuucggaaaggguccaugugcuuaguguguggucugaugugugaagguuuucuuucuuaacuggggagcggggaggggaaggguguucaaugggugucgugcguuuaaacguaaccucuuugcccucuuuccuuccucuuuugcccauuuugucuauccagaauuacguuccuacaguguuugagaauuacacggccaguuuugaaaucgacacacaaagaauagaguugagccugugggacacuucggguaagagugggaggaccgcguggcgcuuggggcggguuuccagucgcugggggaugcgcggcgggucucgggaaaccgcgcgcuacaagccgucugcgccccucccaagggauucccacggucccuguugggcgaaaauuguaucccuucugggugggggcggcagacgacagcguggacgaggagauagcaguggggagaggagagcgcugugugcccgcagggugaccccgcgguuggagccacuaguggccaggcgcaguccgcccgcggagucguggucaagucgccuugggucggccgagguggcccgauacugugggguguugcaugggcgcugcgugcgccucggcggaaccacccggcucaaggcgggcgccccuccuagaucuaaccugcugguuggcggggaggcggggagcgccgcgggggugaugggaggcgggagaaaaucccagaggcgacgcgguuacgugcaauugccgcuguugagggaaagaaacugagcgcaggcagccgcggcgcccgugacgccuacacccaggaaugcgcugguggcgcaggggccgggcagcagcugaaccuccucuucgcgcugccggccgcccgcggugccucggugcccaccuguaccgagcuuuucccuuuuucccccacuccaucccagugaucacguccguuuccccuucaccacaccagccccuccugaccucuauugcaucccccacucggcuugccuccaaggccgcgggcaacacuauucgccuuugaccuuccagucuacuugaauuauuggcgccgcgguggguuauauucaugggucugagguucaaggccggguuauugcuuucccaugcgcccacccaccuaccuggcgcgcggugguagggagggcuagguacccucccggugggaaggcauccggccccccggcugaguuagggguuuaggccaggucaaaggccggggaguggcaggggggcaccaucugaggucuugggcugggacauaggcacccgccgcccuaaccagcggugucuagcgaguuuguuuccaagaagggugucggcuauggaaaagcaggacccacugggaaggcuggguaaaggccccugcgcuuagggcugggaauuuagcaaggagcuggguugcuggcggaccgagccaaauccgggugaaacuggcgaggaggaacgcgcaagugccaacaagcagguuugcuguuaggcggggaggccccgagguggagccgcgcccagcggggaguggccucguggagguguuucugugagcuucccacagaaccgcugggcuugaaccgcuggagcccccgagggacgcggggguucagagagcaagaggaaggaaccagacugacagggucgccagaggcagucccagcacaaaggcaagcgagaagucucgcacgagcgagcgccucucauggucggugccagaugcuccgacugcugcagugagaagggcugauuuuguuucccccuggagucaggcucuuucucagccguuccaagggcagcagaaucaggacuuugccgccguguuuucuguuggggaugguacacagacucgaaacucuggagaagguguugguagacagaauucaagugguuccuuauuucaguaguuccuaucagaauuauuuuacagccugguacuuaaugggcucugauucccagacauaucaugguauguauuuguuaugccuacuggauggcacagcuggugugguaccgauaauaagcaccaguacucccugccccaaccggcagcccuguuuggaccuaaugcacgauaaaaauuauuuuggcacgggguggagcagugugucugaaccagucguugauacaaagcuguguuuagaucuuagcuccugguuaccauggauuucugugugcaaauccccuaucucccugggucucauuuucaucaucuguaaaaagaggacacugagcuagaugaugugcaggaucucucccagcuguacacuucuuggcuuuauuacgcuggacaggcaggucuuuuuguuucccaggauguugguuggcuucagcucuuagucuuaggggaucuggcaucccgugcugggguuuucacagccugcaaagcaagccagguucugggcagagccaggcuuccugguggauuuaggaaugaaacccaucuggacagggagggggaaugggugggcuuauaggaaugcugggcuauacauuuccuaucucaagcuucaagagugacaggaccaccaauggauauuucggaauagaugccuaaagggcuaaauugauucuuuuaggggagaaaaggcacauuguuugauaaaggcuagaacauaaaccaaaaugugggcaguuuguaguuggaggcuguccuucguaugugcagguaaauaccacuucagguaucuucaugcauuuaaucaaaacucugcaguucguagacucugcacacauagcacaaugccuugcauacagcaguuauccaauaaaaucugaugaaugaguaaaugaguaaugauaugcauaguugccaaggagaugagguucccugacauuuauucacacugaauuaccugugcacaaagaauggcaacuuuauaaacauugccuuucaucgaauuaaagauaaucaucugaaaugaauuuguagugaaauaaucacuugucuuuuuauuuaaugaaaccaaaacuuauguauguuuaacuaaaauauaaagguuugaaaaugugaugaagaaaauuuuguacugcaaaauuauccgguaaugaaaucuuaguuagaauuuagauuuaaacaaauggaaaaaagaggcauaagggaauuauuuagaauuccauuauguuguucaugaggugaaauguuaguuaguuaaacacagucaccaagcacugcuuacuuaaauucuaagaauagccuguuuccaucaaaagugauuuguuguuuauaucuagcaggaaccauugaaucagcaacuaauuauuucaaggaucuuuaacauuuuuccauuuaauuccaagcuuuucauggcaaauuucuggacaggacuauuuuuugguaaauguuugacauuuucuuugcccacuaaaacauuuauuuaguucagauuguaaaaauaauugcauaugccuuaugccucuugauacauuuauuuuuuccaaaggccaucaauauaacucuggagaaaagaucccagccaagucuguaaaguucuaaaugucagauaaauugcacuuuuuauuucccuccuagaacuuugugaaagagacuuauauaggaaaaauugggugugccugacugcucuuauauagggagagauacgggaugaacauuguccuuugaaugauauuuccuguccuguuuacccuccuagcagaagggcaaccauuuagaagacagaaacaguuccucucuuaucuggccucuuuaguuggacagcuucucauaaggggucuacuuuugcccccagcagucaugaucaugcauaggcaaacucugccaauuuggaugugagaaagacuaccaagugaaaguaggauaugugaagucucuuugcaccaagaaaaaaaaauaauuuccugcuuuuuaaggcacaguaacuuaauauuuccuuccuuucucccuuucuccauccaucucuuccuuuuuucccgcauccacuauaaacaggcccucugucaagaccuuagagauacaguguuaauuaagcaugguccugcuccuaagaagcagacaguucaggugggguaauggagaaaaagaagcucuucugguuuagcguguauuucauuaacaacucaugaugcaccuaauuuugucagguccuugaaccccagugcccuuuuccacuugguugcaauguuuuuccuuugucagacauccuagggcuuauagauccucuggauccucuucagauaggaaacagcuacccccgcaccgccccccccacccccgcccauugcacacaccaguuaaagcaacuacaaaaggcauuuugccagucaauucuuagggcuacaguacuccagcccccccaacaaaaguaaacaaaaccuuuguaaaaaugcuguaggaaucaucuaaaagagggaauuuuuaaggcccauaacuucuucauuuuccuaaaaaauauuuuucauuauaaaaugaacauucuuaauaguugcagaaaugcucccauugauuuucaaauuucacccaaugaguuucugccaaacaauggguaauaguuucaauugugaaguaauaaguaagaccaaaguaauucuaauaucuugugcuucaaaauuggccacauuugccaagcauagaaguaauuuguagcaugaagccaaaugccuacuaauaauagaaauguagucauuuaaggaucacuguaucuuuuccuaagagauuugauugcaguguaauuucagcacaugugauuuagggaguaauaaucauucauuccagcuuuuuaaccaaggcaaguuaaugcacauuuuauuuaaggcuuauuauuacuuuuaacauauucaauucagcugcuaaauuccccacaauaacuaugcuauugccucaugaacacucuuucgaaucuugucaugauccaaguuucuuuuaagcccugagugcuaaaguuaguacuuccuauuuuaguuuuuagcauuacuaacacuuaaggugguauccuuuauuucuuagagaaaaagagaggaaaaauaucuuaguuaccuaauggccuuaauaugaggacaaacuucucuauaaacagaagucuaucuaagcuguuauauuuagauuauuguacaucaaguaugaagaauggucuuggugacaagcucucuaaugaaauauuucuuaacagggauggaaaugguucagcaguauuggagauuaguauauaauuaauccagaaaagcagcuuaaaaggggaucacugcucucucucucccccuccccuuuuuuuuuggugauuuagcauauaaaugaacacaucuagacaagacauaaaaaugauuauaaaaccaguaaacaugguuuagugcuuucugugugcauacaaucugcuagaugcuaugggaggaguacagagcugggugagagcagcuucugcccuuagguacucacaguuucaccaugugauaagacagacauggugaaaacaugagugacaauaaaauuuaaaauauucaggcuuucccaaacuaacaaaagaaaucaaaugagaagcccggauuaagugucagguguuuaggugagaggagaugccaguagacugagauuugaacaggguaaagacauccuucuucccugacaaccuucuuugaauacccacaggacaaacagaggacauagaaagacuuccuccugucuagugcuguaauaccuguuuauaggauggugagcccggagguucuaaaccuggauuuuucaaggagcaacaagauccaaagaguucuugaaggccacaagggcagcccaggcucccuaacucaugacuuaauggucauugaggcccaccacaauucccuuccuuucuagaaguugacuaaguucuaagaaguuuuuaacguuucuuccacguggaaacucgcuuacauuuaguggcucucagauaaaacaagauucuggaagcugagaauuauaacuuaaauuaacguucuuggagaaaggaagagguuaagaauuuaugaaggagccagagaagcauggaugcuugggauuugaauaucaacugugaaauugcaggaaaccaagcauuucaucagguaguaaugauccauuggagcuuaggguuucaaaacuagguuuaauucuuaacgaguuuucacacugaaacucuuauguaaaagaccuggguuaagguaaaacagauaguuuguauggugguuuccaauaagcaguacauaaaacugcauuuggagauuuguccaccaugcaguaauuuccauuuaaaccaaggaaccuccuaaaaaggggagggggcaguaugaaugcucuuucuaagucuacaucugucuguagauuuuuuuuuuuuagccgcauuuagugcuguuuuuuuuccaaucugguuucuugcuaaguugcacauuucaaugaagcauccaaauuggucauucugauaacacccgaaauaaccagauguuuccucauuaauccaguucuuuugcauguaaauaugacaccaagaaccaauacuuucuccaguuagcucauggugccuggcgggcucugccaaaugaauuagucguggcucagucauuuucugauguccuuuaaaugacuucucaguugcuacauauuggucacuuucucagagucucccuuggcaaagcaaacauuuuauugacacggaauguaguugacgcagaaguuugaccagguguugugcacauugguuuugaaaaaugagccugaugacauaguuuguggaaagaugaauucacucaugggauucuacuccaagaaaucugauucuuagauaucauaugaaacaaaaacuugaauccauuaucccuauuuacuuuuaggcauauucauauacauauacucuuuucccuaaagcucuugacuuaaccaugguuccacugucaguaaaauauuuugauucuuacauauuuuuaaguaccucaauaagauuaggaguuuaaagcuaaacuuuauuuaaaggccaaacauaucuaccugucugacuuucuaauuuuguaucuacauugcccccagaaauagaaaaucuuuauuccauuuuaauagcaacacauaaaugcccacaaaauuuuauaagaucuguucauaguuccuauuaccugaauccauggaagaaacaaacauauucuuccugggaguguuuguugcauauuugcaggcaugguauuuguugugcagacuacuugaaacaagaacuaaacagucuuacacugagucagauacaaaaguucugcccagacuugauucacauucuugagauugcugcuaauuuaaaccuuuuccucugauuagagauggcaugaggaaaugcaaucuuguaauaauugggcagaucaugcccucucacauguuagcugcugcugcguucagaugugcucaugguggucacuaaauauaccaaaaguuaaucuacuuuucucugccaaaaauaugcaauagcuuuagcuuacucuucuugguaaaaauuucuuaagggggaaagggaagcuuuucagaugaagguucaaguuaaauaaauuauauuuaugaaauauucaacaagaagaguuuucaguucuccaacuccucuaaagccucacaguguuuaaacugguacuuugcaaaagguuccauaaagccuuccuuuugggcaugaaucuucuuacauauacauuuaauuauguacauauaugguguguucuauauuugcgaaagggugacuucagcaggcagguaugugucugaagaauuaguuucugggugaggcacguugugacuauucuuuggcuggaaauuuugcucucacccagaauuaaugaucuugaauacaaagauggguagaucugaaauuucaaaagcucucuagaacuuugcugauguuugccaaacuugagcaacucagagaaccccaaguguacacuuguuccaaucuacccccagcaaagccuuucaacuauauuuucugggugagcgggguacacauuuugcauauauaguguaguuguuucuuuacaauauagaguuucccuaaguuuuuccuucagagguguggcagguuacuuaaaaaggaccuuggaauaggguugcgagcuuaaaaguuucauauaguaccagagaaaugcugcaucugagaauuuccauaugcaugaagccuauuccacaugcugaaaaagaguuucauuugacaagccaaacgcagucccuaaauguuauuggacuuuagugcauucuuagguacuagagcacauacucuguguauaucaauaccuaccauguacugcaguuaaaguugaauacuuucauacuuaguaaaaauuguugagcccuccugcuugugcuguguuuaguucuacaguuagcaccuugggaguuuuucaugugcaucuuuuaaaaacaccuauagaaguuaauuuuuuuuuuuuuuuuuugccguuuggcuucacaggguguuguaagacuuuucuggagggauauaggaguuaggggcagguauuguuccugcuuuacccacuuacuuucagcuccuuccuuuggugucauuucugccccucuuuauugcuucucacuucacagagucauuucuggaauuccucuuccuuuuuuuuuggcaugcguugucucacgcauaccugugauuccaccgugcccucuccagcuuugcuugccuuacuuccuuugugcagucucuugggcuuuauggggaagaaaaggaaggauuccaagugcuuaaacacagaguaaacacuguaaaguuacacaggagguguuuuugugugugaguguuuuuguuuuuuguuuugcuuuguuuuuuuuuuuauccugaaaguccugcugagcugaugacuuacaucuuuccuggugggacaguucuugauaauucuauaucaauauuuuucacugugaauaaauagagacaauagauauuucuaucuaagacaagauaaacuuaaccuaucaaaaauauagugaauaaauggucuuguuauuuuaaauaaauuacucuugucauuggcagucaaauuaugcuuauaacuaagaaauaugggaaucaguuuuacuauuaccuuuggacacucguguugaucuaaaagcagcacuguucauuagcaaaaguaauagaaugggaucaaagugucaucccuaauuagaucauguuaaaccucuuaaaaauuaccugucuaccuccacaagcacggugguuuauuucucauaaaccuuugcacuacauauguauuuucacuuauacuguuaaccggauaaaaacaaaagcagauacaaacuucccugaaaaucugguuuaacuggagaacuccguuucauuuuaaaaucaggccagagucuaaauuuugcagauauuuagauauaugcacuaagcacagaagccagcccacuugauuuuaguagguagcagucuccagcaggugacucagggcugagcacaaagccagaucuccuuuguggccauaaaaugggugggggacgggaaacauaguccacaaaggggggagggguauucccagcagucaugugguggccugaauguugaaaccauuccucaggauuuuccuggcagucucaauuuuaauuaaacucuuuuauccucuuuguauuucuucaaucgcuuuuccuaauuuuuuuauuuggaaaagauggucuccauugucauagagcaguauuacaucuggaauuagcagugaguacucuaacaucauacaaaucguauccugaaaggagcugguaggcaccuggaacaguucucuaaagauaccaggucugcuuguacuggaagcucuccacagggagagagugguuuuuccuaaugugagugauuucugggaaaggagaucucugaagccucguuagguuucugacaauccuaacuguuggcagcuuugccuuccugggucugggaucagguugucucucgcggacuuugaggaguagaggaaacucucauuuauauguccaguauuuggagcuccacucuaugaucuagaauuuucugacugccuguuuggaaagagucauucaaauguuuacagcaggugccgugcuagaguuagacuuuggacacagaaacaggaaagguucuaguugagaaagugugaacuucuuagaacuaauauggaaauacuaauguagccauaaauaguguucaaccaucucguuucugaugccuuucgaauguucaaaugggugaacuauuugugaauuauucucuucaccucagaguacuuucagcgacugaaaaggcagccacagcuugucauuuucagagacggccucauucuaauauaccuucauacuuaaaaugacuugacuuuuuaaacucuaaacgcuuuaagcuucugggaaauaucuuucagcugucagccucugcucuaccaggguccugguuccagauguggguaggcagcugcugcagcucaugaacagcucugacuuaauucucuauuuauucacacuuuucuuccugauucuuguaacauucuuuucuuccuugcuuagcagacacacguggcuugaaguugucacucuccaucguaaaggagcuagagaaaaagcugcacuguugccugggguuccauagcagaugccagggacccagaguguacugugugaauagagggcgaugcccccugacuauagugccuuuuagaucacaagaacagccuccaagcaaauguuguuuugauagaaauauaaacagugacauuuuuucuaaagcugcuuuuuaagucucucuuccugacuuugccuauugagguuuugauuuaucaagggacaacauguccuguuuuucugcucaaaauggaaagugaugucaaaaugaaauagacuuuuaaaaagaguuuggugguuuagauuuucuuuuucuacucuggagucagauacauacguguguauauauuugccuaguaaaaucauuuucaugugaugcuugugaaaugucagcauacggaaaaugauuucuuaaacaagcggcauuuggcaggcuguauuuaguuuucuagucaaucauuucauaacuauaggccucauguaauugcccauccuuuggaauucuuaaagaaauagaagaaacuuccuugauugacuagagaguucugugguuaaauuaauuggcuggugccuugaaccuuuaggguacccuggacuuaauucagguuaagauccuuagaucaugccucagugucacucucagagaugggacucuguaaaaaagcgacaugauccuauacgacauuuauuacauucuugauuguaacaggaagaaaaucuauauaggguuuggcgauaaguuaaaauaagcaagcucaaaggucaauggccuauguaaacuuacaucuuggagauggguaacacugaugugguuucucuuugcauaguugaacccuuccucuuccucucucccucauucaccccuauccugcugucagaauugaucuugaguuuuggucucuuucccaagaaguaguucaguuuaugguucuugcuaccacucagcuuuuaacagcaguaauacaaccauaaugcccauaguuaauacguauugaucccuuacuaaaagccaggcccugccuggguuuacuuaaucucagguauguauguugucagcaucuucauuuuaugagugaagaaucagaggcacaggguccuaaagcuaccuugcccccucccuuuuuagugguggaggcagguuuacacacaagaccaccuggccccaggugcuucccuacuucacccagguaacuucaggcccuagucuuugaaccauacagauuucacuuaagauccuggcccucuucuugaauuuaugucagacacaugugaggcuucauucaucauauauuucuaagcaggcuuuugugugucuguuugaauucuuuuccaagaauuaggggaagugggaguugggucgugaugugacagucaaaggacuuagccggaaaggguagaguuaaugcaugacagacaaggggacucucaucugaaaauuugugugucuuuguuucuucucagguucuccuuacuaugacaauguccgcccccucucuuacccugauucggaugcugugcugauuugcuuugacaucaguagaccagagacccuggacaguguccucaaaaaggcaagugcugggaaaugaugacacacuucaguacugggugauguauaaauagaaacgugggguuuguugggaagcucaaagacucuaaucaauucccugccuuacaauuuguaauuaaacacuagaaagaacccuuucacaccaaaaugggguuuccacuuuuugaugaugaacuugcuugaaauuuuauuucaugaagcucugaaacaaaauaccuuuuaagggccuucauguuuguccuuugggagaaaaaugguacagcuaacaacaguuauauuugauuacuaucauauucauguguuccuuccuucuuucagugacucaacagauugcaucuuaguuuacagauuuacauuugaccucaagucagauagugaaaggaaugcaauaauggcuauuuuaacaaagaagcuguguuuuaguuaugguguuauuagaaacagaaauggaacuaguguaggaggaauagggauguguccaaugugaauugucugaugaucagguaucugucuaguaauuaugaccagguaucuuucuaguaauauggaagcagugcuuguaaacauguuauauauuauaauguacacauaguuuauggaggcaaagguaagucagguuccguaggaaccuaacuaaggaagcuaugguuggaaggaaccagggggagaucaagaggaagaggaccuauuacaggaugggucacaggaacuagggaggccagugggaggaaggggcguuucuugaccuucagcaguugagacucagccuccagguaguuguagaaggcacaugccguguuaguccauggaucagcauuuauuagccacuagcuauuuucucagcccuggccugugugcugugggguuucagaaucagauccuuguuggagcacucccucuccuccacacacuggcuucaacaccggauguggcugagagcaaggcagugucaacugaggggugacccaugcagcccagucugaguaugguauggauugagaaagacaaacaugcagguguggcuagguugguuuuguuuuuuucauuuuaauuuuuaguggaauuuauuuguauuuuguguguuuuuauuaguuuacauuccccuauuauauuugauugcuuggcuugugugucauugugaaaucaggauuugaaguauaauaauccuucugucucuacuaaauauuacaaacagaguucaauaaaacucuuaguagaucucuuucuuaauagaucaaagacucuuuuuuccuuuuuagcuccuuucaauuuugaguaauacauaucuaacacaaauaaugcuaaugcuugucaaauccaggcaggaauacaccuuuccugucuuuaaugcuuguaaacaauugcuagacaugcagagggaggccaaagucauuacacagcugaagagcaacauaacaacaugucuaguucugucuggagauaaaagggguugcuuauuuacuagagauuuuacuugauguaguaucaggcuaugcauaauuuaugaugaaaagccuuucuccuguuuuauuuugcuuuugucuucuaagaccaaaugaauagugacuuugggcuuauagauauuaaugaguauguuuuacauuccugugagguuuaaggcucaugauaaccccugcgguuugucuugauuaauggaacccuuuaaguccuucacuaucaaagaggagguuagaaugacuugaaguagggaggauuucuuuuuuuuuuuuuuccaguucaccuuccacuucuaaugccagugccaccuagcaugugguagguguuccuacauaauucugaaaggagugagggagagagggagagaggaagggagggaggaaagaaggaaagaaggaaggaaggaagggagggagggagggaggaagggaggaauaaguggacaaaaugggcucuuauggaaaguauauuacuccuuugaauccucugguguaguuugcacuagaguucguuacccaaaguacaccccuagauuuggagaugucuccucuagugaucuuuuaaguuauucuugcaggaugucccucuuaucuaguguuauacuuaauacaugacuucaucacccccaguauucugugaauuuccuuccagaagacacagcuaugucuuagucaucauugucacugccacaguacuuaguagaacacuuacauauuugugaaugugggugggaagagucaggcgccacuuccccaucucagccucucuaggcccugcccucaaaggccaaagaucuccugugaccgcccugaacucuugacucccaugcuguugcagagcucaagcuugaggaaaugaagccacaaaaagcugcuugcuuguucuuaaagaggacaguuggaauuccaagccaggcauugcugaagguucuaauaauucuuguuagaucaugaaacaacuagacaaauuggaauagauugaaauaguuuuaaacuaacuugaaggcauaugagcuacaggaccagcugccuucccgaugacccaagagauguuccuuugcaaaugucauggucuguguugaugcaaccaugugaacagaaacuccuucaaggcaggauguucuguuuuauuaacuaucucagguacuuaaaauagagccucagcucgugguggcaugcuucaguguuucaugaugggaucagggaaugcauacuugugcuaguguugccucugccuuauccccagccuucuagugaaggaggaucagauccacacaucgaaggauguggucacuuguuaggauauauaauuauucuuaagacacauuuaucuuuaagagacacaccaauaauuaagacauuauugaagcuaccuuuggacaacaucuaccaagucucuuucaguagcaacagaugagucacagagagggagaaucaaucauaauauacauaauuauucucuaaugcuuaaaaaguaguaaaacuucacaucuguucaggagauaaaugcaaaguuugcuucuucaucucaagggacacuccauuuuuaacaucuuuucugaguuucauucuaaugucagccaguggagaaaugguuuucaugauauggauaccguuacuuuguucauuuuuaaucuuuuuuuuuuuucuuucauaguggaaaggugaaauccaggaauuuuguccaaauaccaaaaugcucuuggucggcugcaagucugaucugcggacagauguuaguacauuaguagagcucuccaaucacaggcagacgccaguguccuaugaccagguauguauguugcccaugugcaaaacuggauuuuagaaagagugaaagaaauggacuaucacucauaauaaauaaaauaaaaaguagcugcuuuucuaaaggcucacccaguggucaguugugaaauuuaaaaugcugucauuuauuaguguaauuacaugauauucggguacauaaacaguugauaugcuaaccuuguauauuucugcaccucccaguagguuuaaaguuaaauagguuuaagagagaauguggucaaaaucaguaauacucuuuaagagggguaaucugauuuuacagucggcaguacaauaauaaggcuguugccaguaaaguggaacacuccauaacaccaucuuucagagagucuucauuucuguaagcauuucccccaaguauuuagaaaugagaaucaguuucaaaagcucauucucauaaaaccuacaaccagauucuaaagagaguucauguugaaauaccaaaauuuuauuaagaaucaucauuuuaaauaccgcagucuucuuagucuuccauuucucauuagcaaaaaauuugguauuuuaaauaaguaguuuugguuaaugugcacaugcuuauuguuguguacguuggugguaugguucacacuuagaaauuacauauguuguguuucauaaaguaacagauguuacaauaguauuauuccuuuccucaacgcauuucggcccuaaguaagacacaaucacauacauuucaaaaucgauuuuaaauuucauucauugccccuguuuuugguacaaccuagucacuagucuugaaugccauuuacccucaagaaaagagaaaugaagugcaccaugaggcgcuggaacagguucucaaggccacaucgccacggccagagcuguguggaaaaugcagaguuuauguucaugaccuucagcuaacuuacuucacuaguaagcuucucugcgccauuccaugcuugcugugacccuggaaaaccugaauaaccaguuaacucuugcuugcaguugauagugaagaugaaucacuucguuagcuccacucuacacuucuuugaaucaccucauguuaaguguuugauaaccagggucuuccuuuguuaagaucagccuuuagcauuuauucagagcucuaacaccucuaaugagccaugagaguugggcaucuuagggaugggcucuggacugcaaauaguuaugaaguaauaaauaaggcaguuuacauuuuaacaacuuuuuuuuuuugcaaugacacuuggaaaauucaguuaacauaucagcaaacguuuugcaauguguuauuauuuugugguauuagaagaugcuagcuaacuuucccccaaagucuuauugcugguuaaaaucccuucuuuugcuucucagggggcaaauauggccaaacagauuggagcagcuacuuauaucgaaugcucagcuuuacagucggaaaauagcgucagagacauuuuucacguugccaccuuggcauguguaaauaagacaaauaaaaacguuaagcggaacaaaucacagagagccacaaagcggauuucacacaugccuagcagaccagaacucucggcaguugcuacggacuuacgaaaggacaaagcgaagagcugcacugugaugugaaucuuucauuaucuuuaaugaagacaaaggaaucuaguguaaaaaacaacagcaaacaaaaaggugaagucuaaaugaagugcacagccaaagucauguauaccagaggcuuaggaggcguuugagaggauacucaucuuuuuggaauccugaccuuagguucggcauguagaccaagugaugagaagugaauacauggaagaguuuuuaagugugacuugaaaaauaugccaaaaaaugagagauacaaaugagcuagaggaagaugaggggggaugcgaguaccuccaagaagaaaaaucacacucugaauggugcuugcauuuuuggguuuuuuuuuuuuguuauaaucuauucauggaucuccacuuugauuuaauuuuuaaauguuuuaaucuccuuuacaaaaaguauacguuaauauaccguccucaagggggaacuggcacugugaccuuagcauuuaguuuucuagaggaugugaucuaauuucuuucuagcucaucauuaaaaaggaaauuguaucaggacccaugggauauauccagaggcaaacuuuaugaggcuuugaaaucuugccuuccugaagauagcugaguaggaugguucuaaggaaagccuuugcaaucuugcaagauuuguagaccagcacuacaaagaucgcauagaucaaauaggaaaaaaaaugucgauuuuuauucagucugaugguucuguucuucauugugauugucauuaaaaagugguaaauugcucaauguaauauuuuugugcgcuguuuagaaguugugugauuuuuugccaucguugauaaaaaugcaaagucaaauaaaaggugucuugguuugaugucauagaaugauccaaggagagaaaaaagguaguuacuguuuucaccagaaaagguaaugagugaaggaaagaauaguagcagaaagcacaguuugugaguaaagcugucuggaauuaaguuaccaaaaauacaaagcaaaaggacuauuauuuuggguugaagcuccaaaacugacagcaucugauaaucuguugguuuauuucacuuuucauuaaaugaacauugaugagagaagaugccacuuacccaagcuuuagagaaucccuaguggaagauuauaugauaaacuuucaguccugacauaacacuagggcauuucuagagugucauugcuaaaaccucacugaacagaugcagccaaggucuguguucagcacuuggucucuguuguuacguaaaauaauaagcauuuaaaauaguuuacagauauuuuugaccaguuccuuuuagagauucuuucagagaagaaaccagaucugaccuguuuauuguuggcgcuuguugaaaacgagcuuucuuucccaugauagugcuucguuuuugaaguguugaagcugugcuccccuuaaaucguggcaggagagauuaagguaauuacaacacucaguucuaugucuuacaagcacuuugucuugucucugcaagaaaauucgauuccagucauuucccauaaaauacagacauuuuaccaacauaauaugcuuugauugaugcagcauuaugcuuugggcaguauuacaaaauagcuggcgagugcuuucuguauuuaaauauuguaaaaagaaaauaaguuauaacuguuauaaagcagaacuuuuguugcauuuuuuaaacuguugaagucacuguguauguuuguuuggucaauguuuccgcaguauuuauuaaaacauacuuuuuuuuucuucaaauaaaaaaguaaccaugucuuugucu

SEQ ID NO: 13196 - RNA, 686 nt, Homo sapiens
uccuuauuuuugucacuucccuacaauuuuaucauuuuuaaagaugauauaucagcucaaauucucaccaccccuucgaauuacucaucauagaauacucccgugugugugcacuaugcacguuaauaaguuucuguuuguucuucgcuugcuaaucugucuuuucucagucuaauuuacagggucccagccaacgaaucuuaagugagcagcagaaaaaaauguauaaaauaaaacugaauuuuuuucuccccuucagaauaaaagggcaugaaugacagagcagccauuuuggagaauggagcugguggaaacaggaaaauaaaggaaggaaugcacaugggaaucgauucagaaaacaaguccucagacucagauugcugauuucaaauggaggccaagaugagaaggccaaaaaucuucuaggacuuuuguauaauauuuacauggcccuuacggcaugacccuuauuucuauaagucuuguuggaaaguaauauuucugcagagguccuacagagguagcuacagagguagcuauauggguauauauaagacaacauauuauuaaauagugacauaaaagacagcauauuagaugucccuuuuuccaagugucuggguagcuugcauauauuuauaacugaaagcaacuuuucuuggcuaaaugagauggauagugaaaaa

SEQ ID NO: 13197 - RNA, 65791 nt, Homo sapiens
cuuuaaccuuuagccccagugggcgccagccacucagaucgcuucuuguugguauguguagcggcaguggccgccggcggagcagucugagcccgacgaugaggccggggacgggagcugagcguggaggccucauggugagugaaauggagagccauccucccucgcaggguccuggggacggggagcggagauuguccggcucaagccucugcuccggcucuugggucucugcugacggcuuccugaggagacggcccucgguaagggaucaguggggcagggggaaggcggcacaaugaaaaacggagugagaaacaggaagcuuucuccgaaaggagaagaagauaagaguggacgaaggaagaacucgagauggugggauauguucugagggagagaaguggaggguggaaaugcacaaagagaaggaugugagacccuggaaguuccccgugggcuuggccuagacagaugcguggugaaggugcuggcucuugggcggggugagcgucuuggagcuuuaggcccgauuuuagcugggagggggaggcaggggcuugauacuguaagacuuuaacagcggcugccaaaauuuguuuucauuagucgucgggguggucugcagggggaacuguugggacaauuggcaggagauaauuaggugguuuuaauuuaaaacauagaacaauggacucaucgguaaagaaaguaguugucuuuuuaaacugcguuaaaaaggaugaauuaguuguuugcauuuaguguccgugagugacagaaccucagucuuugaaaauguauuuuuggcagaaggaauuuuaccugucuuaaagguuauguuaggaaauaaguuuguuaggagugaauugugccuggguagccauacuguuuguguuuuguaagaccgacucucaccugaguuaauuggauagagcauuuuaaaguuuaaaaucaguaguguuauaaaauaacaauagcuggcuaucuuuuauaucugcaugaaauaggagaguuguuguuuucaccauaacaguuuuaaaauuaguauucaauguguauccuccaagcuuagcaagccaauuaguagcugguuaagucagugcuuaaaaaaaagagagagaaaaccuaugauccagcgguccaggauucaucuuaacuuuucccauuuuuuuacggaauuugcaagcucguuuuaaauacuagcagaaugcguuuuguuugaaacaagguauagacuaauccaaugauguuauuacacauaagcuuaauauuaugucgcuucagauaacugaucuguugaaaugagauuuuugagaagcauuuaguauuauuugcucauuuaaaaauguucacuguuuuucagauggggcacccuggcaugcauuaugccccaaugggaaugcacccuaugggucagagagcgaauaugccuccuguaccucauggaaugaugccgcagaugaugcccccuaugggagggccaccaaugggacaaguaagacuguuuuuguuuuauuuugcauuuauuuauuuguuuuugccucagguauucuaucaagauuucagaaucuaggucaguaguuauagcuguuuaaugauuaguuuaugcccgaauaauuucaaauaagccaaauguuaaaucaugacuguaacggaaauuugaauaauggaaaagucuucugagaaauuuaaauaaugaaaaagucuucugagaaauuuacugaugaccucaaaacuaagaauuuuuuucuuuauuauuuaaaaguaaaguguggauccaggcuuuuauuuuuaaugauuauuuuuucaagaaugccaauugaaguugauggucuaaguaaauauuaucugauacagcaacauaacugauuuugguagaccauguaaauaaauagaaucugaaaauagcuauuguuuugguuuagagcgaauuuuauuccugaaauaucuuccucuuuguguguuggaggagggugagggaggguggggaguuugugcucuauaauucugauucuucauaggacagugccaauagguaguucauuuuccacuuauacuauuuuuuuuuaaugcuuguugcuucuacacuccugcuuaugagcugucccuuccaucucuagcauaaauuguaaauggacauuuuguaggagugauuuggaucaaaagguuuuaaugcugauucagugauuucgguagaacugaguuucuagagaagcauccaagaaagguaacagguucaguuaccaugaguaauuuugugcuucauguuaaguucuauaauagaucuuuagguggcuggguuauuuccauuugaguauuuccauaaaucaucaaaaauuuaggcuaacaaaauauuuuggaagccaauuucaugugaucuuuugcuaauuaguacuguuugauaauuguuuaagcuuucaugguuaaaguuauuggugaaauugcagugggaaaaggagcuugcuaugugucugucucuuuuuacuuaaccuuaagaguagaagggcuuaauguccagugauuuuccucuuuuuuuuuuuaauuuggaauauugcccuuaauuuuguuaaaaaacaaaacaaaaccuuuauucaaaggcaccagccccaaaagauucugcuugcaggaguucuuuaaauaaaagagccuuuuauucuguuacucuagaauaacacaaauuuuaaaacucucuaggugauggagaaacaacuuugauuccucuucuguuucuuuccaucucuaaggagcaaggagcucuucuuguuuucuugguagagcugcucuaacuagauaaugagcuuuaaaaauauuuauucuuuaaaugcucugguucuuauuuaaaauuaguuucuuuccacagaaagauaaaauaaaacaauuugcuacugccagaugcuucucucuuuucuggggccuucuguuuccauugggccaaucaagguaaguuuugcaagggauugaccugcuuacccuugcuguaauggugcuauugcacuaccaaaaccaagauaccagcuagucauaguucuaguuaaaaaaaaaaaugcagauuuuauuuuuuaaaaguacuuucauguaucucauugacauaagcuggucacaguuugcuuuauggcccuuucucuuuagcuguaucagugaccaucuuucuaguaaguuuacuugcuacucgguacacauccauucaaauaacugauuuuuuuggugugguuuucuucuacuuuuuccuaggcuaauauaugccacgugccuuuaaguagaccuaauuauuuagauguuuagaauucuucucccucugaaggcuccuguuaguauaauaaauaaauguuuuaguaggaguuaugcccugaaagucccaaaagaaucuccgcuguuuuugucagaauuauauaauucccuuuuauccccuuaauauuucacuaacaaauaugggucccaaaucuugguaaaacaaauucuuguuuuagcuuuauaacagacugggagagcauggauaauuugaauucucaaaucagaaaucauauuugaaacucuguaaacauugcuuuaaaaauuaaaggugauaauaaauaggacaauugauccuuuuuccugcauuauuucuucugccacucuuggaaguacucaggaggaauaaguggucagaagauaauugagaagaagcaggaugucugucuguaucauucacaguagugacaguugggaggguucugccaugcaauuuaaaaaagucaguucacaaauucuuuagacuuugggacugaagguuauaaaaaccuucauguguugacugguuugcaugaacaucucaugcugggacuagcuaaagacuaaaauugguggcagucuuacuugccaaauaauuguggucuuuggaauguuaccaauaugacaugaaacuguaaaacuuguuuguaaaauaauaugcagacuggguagcauaaugauguacggaagccaggguucauaauuucucaaaugcaucaagcuauuuagcuuaaagaagugguguguucaaauuuuuuuuuucuuaauucaugagaugaccuagagugccaucucaugcauuuaggcugacucuuaguaguaauaaauauuugaugauuaucaaauugagcuuaauauucuuucagguuuauuucaguuuucuaucuuguagauuaaauuugccucuuauucuauauaacuuuauaggaaagucauacuuuuagaguuauaggaucuuauagcugaaagggaccuuacagguuguuuaagcuuuaaauaauaugugauuuaagaugcuuugaggaucacugguuaaauguuaguaaagaaagauaaagaauuuucccugcuggauggcaguacucaaaaauuucccauugggaggcugaggcgggugcaucgcuugagcucaggaguuggagaccagccugggcaacauggugaaaccccaucucuacaaaaacuauuuaaaaauaagcugggugugguggugugcgucugucgucccagcuacuuagggggcugaggcagaaggauugcuugaaccugggaggucgaggcugcagugagucaagaucacgccuugcacuccauccugggugacaaagugagacccuaucucaaaaaaauaaagauuuucuguagagauuucuaucaauaaaauuaugugugaggcugucuucuuccucaguguccauaguaaauacuguuuucaugucuuuuguguuuucuacacaaaggacaugcagguccugccaucuuuaucacagaugauuaugccuuugccccagagucaugcuagcuggcucuuuuuuuuuccucccuauuugagucuuuauuuuccucuaucagugagaagaguagaguaauugaguuaaggucccuuucagcucuaacauccuaugauucaguucagaucauuugauaagaguagauaucagauuuuaugggaugauauggaaagaacagaaaauuccuuuaguaaugccucccuaauucuauuuauucagugcuuuuuuuuuuuggucuuuggucaguaaacugauaaaugaauaauugcuuuuuacaaaugaguuugauuuucuugcuccuauauugaguaaggcuggcucuaauagaucuuauuuuauuucaguuccugcuaccacaugagcccaagucgucacucucccaugccuagguuauucaacaguuuuugaguugaguugguuuucuugcuucaaggaugccccccugcccccacaaauuuuagauuucaauguguuaucuccuugcccaagaaucuccaguacuuucagugccuauaacauaguaucuaaauuccacagcuuaacuuuaaagaaccuccccauaguacaugucaaagcaggauucaaggcugcaugucuuuacacucccuaauuugaacuuaggcuggucuuuucacggugucuugagugauuauauuaguucacaacuucaaacuuaggcuguucuucuuacccuccugcccccagcucaguaucaccaugaaguuugcuuugcuuaccuauguuguacuauuucaaguccugccuucuccaaaaguuucucaaaaaugacuuuugccaacauauaccuccccuucagauuauuaaagaaaauauuuguaaucuacccauaacucuuaccguuucacuuauuuuggcaccuaguuauugacuuguuuuaugguuucuuaauuugcuuuaauuuuccaacaaguaauagauuguaagcucuuagagggcaggggcuauguucuguacuuuuuaagaagccuauaggugcugagcacaguucuuggcacaucaugggugcucaguaaaauacuuguugaaugaaugaaacaaauacacagguauucuuuccugcaguauaagcccauaagucagucaguguuaaaugugacuguuuccagugguuacuugugacuuuacguuguuacuacuuauucuuguuuuuagugucugccucuuuacucuuacuuuuucauuugacaaaaauggaagauaaauaagaugaaauaaauaauuuuuguuuggagaauaaaacuaaaauauuuccauuugcagucgacccucuguauccagagauucaagcaacugcgauggaaaauagucuuuaaaaaagcaacaacaaaaaaauacaaauuuuuaaaaauaaaguauaauaacuuuuauagcauuuacauuguguaagguauuauaaguaauguagagguaauguagaggaaaaaauaacaaaguaggauauaggccuugcagagaaauuuaguguauugguaccuuagacuuaccugacugauuugacaaauuuauuuguugcuguuccuucugaauuacccuuccuuuugaguagcuacaggauccaugccauugaauugggcauuagccagugacaaaaaagagauagaauuuuuguuuuuuaggucaucugcucauaauucuugaaucuggguaacuucuggguacauguggaugacucaagcaaguacuuuuaaaaaauaucuuaacucagaccuaaugucuguaaauucuugacucaaugugguuagauuuuugacaaauguuaauagugagacuacaaauacguuuauuuucauuaucuuuagauagcaguucauuuaaauaugagcucaucuauucacaaacuuaguguggaaagaucuaaggaggaccacaucaguugagaagaaugaccggcauccccugcuccccuuuugaaauucacaaggcauaauauuuacuaaagugaugagaagucuugcagaagccuuuuacaauuuuuacuuaguauuucugucuuauuugaccaucucccccauaaaucucccacauaaagcauuuguuuugcuuuguguagcacauuguaugaaauuagcauuuugugagaaaugcugaauuagggcccuuuauucuuuuaguuugcucuuuaggagaaaaaggcaacaucaaaauaaguuaguguuaacacacauaugcauaaacgaaacagcuuguguagugcaaugaauguauucauuagauaguggaucaaaagaggaaacaagucaauagauuaaccuuugauuuuuaaauuaggcuuguugaauaucaugauaagacuaauaguaguauuaauagauaguaaagauuugaggcuaggcacgguggcucaugccuguaaucucagcacuuugggagcccgagguggauggaucacuucaggucagaaguuugagaccagccuaaccaacauggugaaaccccaucucuacuaaaaauacaaaaauuagcgggacaugguggcgcacaccugucaucucagcuacuugggaggcugaggcaggagaauugcuugaaccugggagguggaggucucagugagcugagaucgcgcuauugcacuccagccuaggcaacaauagcaaaacugucucaaaaaaaaaaaaaaagauuugguacauaugcuacaccauagcaguguacuagggauuuugggguuuguuuguuuguuuguuuugagacagagugucugucacccaggcuggagugcaauggugcaaucuccacuuacugcaaccucauccucccagguucuccaaguagcuggaaucacaggugcgugccacaugccuagguaauuuuuguauuuuuaguagagucaggguaucgccauguuggccaggcuggucucgaacuccaaggcgcaagugauucuccugccuuggccuccuaaagugcugggaucacaggcaugagccgccuugcccaaccuguuuuuaaccuagagaaauagguccauguugugaagguuuauaaguaggaauuaauagaugacauuccaaguagaaauuaucagucucauucuuauuuuuuuccuuaccuuuauuuuucuuuuauucaguacacauuuaaguaucuugggugugguaccuaguguacaggugauguaugcccugcucucaaggaggucauuccugagaugccauuuugaacucauuuuugucuucuaacugcugauuugguuguuaugguauuuccguacauuuggaaaucuaguggcuaugaauauuuuauacagguugaguaucuguaaucuggaaaccagaaaugcuccaaaaucuaaaacuuugagugccaacaugacacucgaaauaaaugcucauuggaauguuucagauuuuugaauuagggaugcucaaccaguagguaaaaaggcaaauaucugcaaaucugaaaaaaucccagucuggugucaagcauucuguauaaaggccucucaaccuguauuugccuucuuucgcugucuggucaaguacuuguacauuauguaucacuuauuuuaagcaaguuaguuguacuuagcaguuauuagagaugugauuguuggaagugaauguucaguguugcaaagugaaaauagcacucaggcaaaaguuuucucagcaaggcaguuuacuucuguagaagggugugucuugcagauggagcaaucgugagauggacaagggaggggaagagguucuuauucuuaacacagcugguccccacuguugugucuuuccccuacuggcuaggguuggaccgcacaaucuaaagugacccaguugacuaauguuugaaauugaacccagcugucuaggcuggaagggaaaggcuauccauuaugacacaaugcaugucuaggagaaggaagaguuuaucugaauaagguggaggagagcugaggaagguuuuggugagagcuguuuuuauaagucuuugcacuaaacuaugaguacaggguaugauacagcauccuguaagaaugagcacaccuauaauggcuguaagagaaggauugaggcuaugauuccuuuucauuuacugaacuaccucucuagccauguugagaaaggguuaucgacuccagaauuuuuaguuaguucauuggauaaagcgguaagucuuuguaagacgcuuauuauguucccaguggggucaguguuguuugggauaaagguacaacagugaauuuuaaucauaacacaaacauccccuauuuuggcuaauauaucuagggccauucuguuuucucaggccaucuggcuagugggccccaauuguucuguuacccuuugacagcauccgugguguaauuauaaaccacugcugauuauaauaaauguaauuuauccaaucuacguuuuuauuaguugucacucacaaaaauauugacucaaauccugcagcuauuugaucucgaguuuuaaauuuaagagcauucacaucuugauauccugucucaguugccaaaguuuguuuuaggucuuuaacuucuacaauagcuaccuuggucuuuucauuagauggaggaggagcaauaguuuuguugugagagguuuuggaagaaggcuuaggggaaaguguaggcaguaggggaucaaugcagcauauuucaaaggauccaauagguucuguuccugaaaccucagcccccaugccauaaaacuggcuuaaagaagggaaccggcuuauagaaggggaagaacuuggaggguuugagauaauaaccuguauuggacaguacugguuuagcucacagcuaggggaagcuguuucuuuaguaaagugaauguauggcuuuaggaaauuacagcuacugguuggggcaguuuauccgugcucuuuaguggucuacagaacguuuacaacuacugguuggggcaguccaucugugcucuuuauuggucuacagaacauuggaccaacugcagcauaaaagcucugucuuggcgggguguggggggcaauacucccaguugacauuggggucuuuauugaaaccuuuccagacuaaaugaucccgauucacuaauauccagucugagcagagccaggaaggacagagguacuuuuuuggaguggagagcugcuucgacgugucaagucuccacaggguauaacaaggcaagcaucaaauauaauaguuugaggcgaaauugacucgguuacauuaauaaugaggugaucagcaauagagaggaaagaagaaggaguaauagaauagaugaaagagaguuaaauuuuccuuagcuuuaguuugguaggguuuuccccugggacuauggcccaugacucuggagggggcggcacuuuuuugacucgggugugauggguccauccuuuuuuugcugucuggacugugguuucaguaguuaggugcacuagguaugguccuuuccaggccaguuugagcuuuucguccuaguuuuugaugaggacgugauccccaggcugauguugauguacugggaacuccagggacagugccugugcuaggagaccuuugguuuuaagaggagagaaaguagaagauauaccaaguauauaauuuuuaaggaauuggucuuuuguuucaaagguaggaauguccgcaauggaguguaaauaaggcauuccauagagcaucucguaaggggaaagaugaauaucuuuccaaggggcaguuuggauucuuaacagggcaauaggaagacauuugguccaugguaaucaauucuccagaaccaacuugguuaagugguucuucagaguuugauucauucuuuuuacccuccgugaugaaggugggugucaaggaguaugauauucccaucuaaugucuaguguuugggauagcuuuuuaaugaugugugugguaaaauggguuccacugucugagucagcauuuucuauuaacccaaaccuaggcacuauauuuuuaguaaaggcuuuaacuacauuauuggcuguugcauuugaaaagggauagcuucgacccagugacugaggugaucugucacuaguauguauuuuagacgcccuguuggaggcaucucuguguaaucaaucuggauacuuuggaauggacugaagccuggacuccuucccauaagggguaaucuuuuuauaguuuauuaguuuucuuacaaacuaagcaacugucuguaaccuguuuggccaggguauaaauuucugugcucccauaaacugaggacuccgucacacauggcuuggggcccccaauggaucucuugaugcaguuaggauaagauuucccucauaagggguuuggauaacauuucucucugguuuggcgacauccguuuuccuucugaauucucuuuagcaccuauuguuauuaggguuuuuuuuuuucauuagaagaaaaagggggaucacgguaagaggaggaagguaaggaguuaagugaaaaauagguguuuuagaggaaacggcagccuguuuggcuaucugaucuguuagguuauuuccucgacuuucgaaagaaaggcuuuucuggugucuggggauguggacaauagguauuucuucuggcaacugaagguuauucaauacuugagugguuagcuccuuaugagcaaggucuugaccuuuacuauuaaugaggccucguucagucuaaauuuuucaaaauguaugagccacucaaaagguguacuuagaaucuguacagaugggucuuuucugguucugcaaguacuuuaagguuuggcugagugcgaacagcucgcaaguuugggcagaccaaucacugggcaauuuuuuuggcucucuuucuuugagaguuuuucugucaauuacugaauacccauugugucuuuuucccucaaucaccugggaggaaccauuuauaauaaguguccuccuguccugaagggaguuucuccuaggucuggucagacauuugugugguaaucgauuaaaucuaaaccuguguguuuuuucuuuagauuuggauccccuguuaggaaaccugcuggguuaagcaaauuaucagugguuaauguuaaaucagcuuuuuuuuuuuuaacggaauagccucauauacuuuuaagauucuugagucagcaggccaccucccugcuuucugauuuaagauaguucuaacuuaguggggcgugcuuacugucaauuuuucuccaaagguuaaguuuuugguuucuuugaccaauacugcuguagcuguaauggauuggauguauugaggccauccacaaguaacuagaucuaagacuuuugacaggaaggccacgggcugccgacagccacuguguucuugaguaagcacucccaaagcuaccgcauuauccauguucacaaaaaggugguacgcuuuucuagggaagguaaggcuaagacaggggcaguuaugagccuuucguucagcucuuugaccugaucgacuuccucagaaguccacaggagauggucaggcuuccccuggggaaguuuuugauaugaaaguuuacugugcauaugaguuaauccauaaguggcaacauccagcuaacccuaaaaauuuccugaguucuuguuuaguuugaggcaaggguagggacacaauucucucaacuuguucgggcccuagucugcacuuaucaaguggccuaaauauuuaacuucaggcuccacauacugaagcuuuuccuuugagacucguaaccccuugaacugcaaaugguuaagaauauguguagagaagccaguuacuuucuguauguccucaccagauauaagaauaucaucaacauauuggaguaggcauauuuguuuugggaugacaacuuuuucuaauacuuguucuaaaauuugaccaaaaagguuaggggagucugugaacccuuaggguaagacuguccaucgauaauguuguuuccgcccugaauggggaccuucccacucaaaagcaaauauaucucgacugucuucagccaggggacgugcccaaaaagcauccuuuaaaucuauuacaguaaaccauugaugauuaaauggaauguugcugagaaugguguaagaacuggggacaacgggguggguaguuuggacuauuugauuaauagcucuaagguccuguaccagccgguaugauccgucugauuucuugacuggcaauauugggguguuauaaggggacauacagggcucaaaaagcccaucuuuaauaagaccuuuaauuauagguuucgacccuaucauguccucuggauaugggguauuguuuccuccuuacaacuuccccgggggguuuuaccuugacguggacuggggagacucggaguuucccucaguucuccucuuuggaccagacauuaggauuaauguauuuuucaucugcagugaugaauagguuaaagagaugaggaauccucuugggcugacuuguaggccuaugccuaacuucagcauuaaaucccucccuaauaaauuagucccugccucagggauuaacaaaaacugaauaugagcugaucgauccugguaucugacuucuguguuuuuuaaaauuuuucuuuaaauccuucucuuuuuaccccaguuaccaaaaguucuguaggcaauauuagauggggggaaacaaacaggaaugagccaccccugaauugaccaaaaaggugauaagcucaugcuuaggucccgcuucuagauuuaucaagggcuccuggugggacucaagauaaaagagacagggccccugacccccguauucuuccucgaaagucaugaguggaagggcuucuuucuccuuuuuaaauucaggacauucugucuugaaguggccuguucuucuacauuuguagcaccuaucuugcccuuacccccucucaguucugggauucuuugacuuugcuuccccauacucuuuagagggccugguaaacaagguccuuaguccuuuaaaggaguauuuggacccuuuaugguucuggccccuugaagcucuguuuagaaguauauggguuuggagucaucuguuggaagguggauaacauaaguuuugucuuuuguuuuugcuuuucuucaugucuucucacauauacuuuuugagcuucccugagaaguucacuuaggagauggucuucccaauuuucuacuuuuguaauuuuuuuugagaugucuggccaucuucuagugacaaauuggaguuuuaauauuccuugcccaaggggaucuucuaaauugaggccugcauauugucucauuugcucuuucagucuauuuaggaaucucauaggcccuucauccuuuuuuuuuguuauauaucaaaugcuuuagagagauuugggguuugggguacugauuccugaauuccuuuuauuaucaucucccuuagguccugcauguuuuuauuguccaacugggggucucgggcggggaauuucugguucacaguaggaacuuuuugacugggaggacacucacguucccaaauuaccauagcagcccuacgaaucacacucccuucuuuuccugaaaagaggauguccaagauggacauuaacucuacccaaguguauaacugagguccuaaaaauugaucaguuugaucugucacuccauaagggucaucuugcaguggcuuaagcucuuucuuuaaauucuggaccucugaacugauuaagggagcauucacggagccaaugguucccccucuuuauggcauuucucuuaagggaaagagagcaggggcugacucuugaguuguagaggggaaagggaaguucuggauauccuuuuuacauugcucuauuucacacuggagucccuuuagggagggguccuuaggcugauaggggacaggcuccugggaugauaauuucuaaaagucaggauuguaaggaggaggaguaacaugaguaggugaaggaucuagagugggaucuggggcagcagcggcugccugaggagagggguuggggucacugagugggggaagauggucuaggggaucccaugugcuggagucuuugagcauuggaacuaacuuaccuaauuuuuccuuuugugaugcuagaucagguucuuuccuaguugucucaaagggaaaaaggaggacaggucccugccuccaacaaagagcauaguccauuuccucuuaagaagcugggcuuuuaucauugacauauugaaucaaaagcugacacaucgcacucucauuugaccuaaacuuuggccagaagauugaggguuugaggaugggucccugaguccaaauaaaacaguaauugcugcugcuuauguuuagucuucucauuaucuuuccagucuuuuaacaugagaccuaggggacuaucggggcaauaucuuuacugcuaccuuuauccuuuuuacuccuugucuugcuuaggguauuucccaugucagguccuaguauuagagacuucuugccuauucucuggaggcuuguuaaggcucagucccuuguauuagagauuucuugccuauccuuuaaccccgccuccuggaggauccuugcauccuucuuuugcuuuguccacucuggcuacuucccucgugggaauuuaggccccucuuggcauuggcaugccgguaugaaacccacagcaggauccgcccuaagcuguaugaagugaccacagaacugcagauaggacccacucacucugcacagcaguagugcuugguaccauucacacaagcagcaccgcaagcaguagugcuugugaucauucacacacacuuucauccuccagaauaucccaaccaccaaggaaauacuuugucaccccugcaacauuucuuaccuuggucugugcagaguuaccugguugcugcagcaugugagaauccuuuugccaagcugcuggccuguaucuuuucuuguugccgagagucuggguuuauuuguugcacuggauggguuccaaucucucacacugaggccacugcaacaaggcgaugggaugcgccuccccacaagaagugaccagagaccgguuccccggaggagaaugggaauccugggugggcccccaaauuguuggaaguaaaugcuuggugucacaaagugaaaauauacucaggcaaaaguuuucucaucaaggcaauuuacuucuguagaagggugugucucgcggauggagcaauggcaagagcacacuggacaagggagggaaagggguucuuauuccuaacagcuggucccuacuguugugucuuuccccuauuggcuaggguuggacugcacaaucuaaacugacucgauuggcugcuguuuguaauugaacacagauaucuaggcgggaaggggaaggcuaugcguuauggcguaagacaugucuaggcaugucagggcgcggcaagggcaggaaggguuaguuauagcauggauaacuacagaaaccagaaaaacgaaguggaagaacugggaauuaaaaccuuuugaagaggaauuuaucaucucugucaugauauuuugcauugguggauuuaaaaggaaagccacuucugcugcuuucuugcucaguguacucaaagugggaaucugaaucuucucccagucugaaugauucuguuagucaugaagaacuagugaacacugucuugaguugaaauucaguuugcucugucuuaggcuuugguuuuuguuuuuauuuuaacgaaaaucuuacauuuaucuuagacuuugauuuuuauuuuuuauuuauuuauuuuuuuugagacggacucuugcuuugucgccaggcuggagcgcaguggcgcaaucucagcucauugcaaccuccaccucccgaguucaagcaauuccuuugccucagccucccaaguagcugggacuacaggugcgcaucaccaugccuggcugauuuuuuguauuuugguagagacgggguuucaccauguuggccaggauggucucgauuucucgugauccacccaccuuggccucccgaagugcugggauuacaggcgugagccaccgcgccuggccaacuuugaucuuuuuaaacaaaauucacauuacauugugaaugggauccuugucauuaggucuuaaucuuaaauuuaggcuaagacuuuuaaaacuagcuuuugauaaaugaaugagcauuaaguucuuguuugcaaacacccauuuggccaugcggaaucaagaaaguuguuacuucuucgaaagaugauuuuucaguaaucucuaagucaucguguauuugugaucauauauuucuuagguauagaaaauuagacccuuauacugaaauaaaguauaaagauuuagcuugauaugcuacugaaucuaauuugagagaccuggggaaggggauaauaauggucuuguguccuuguacacuuuugucuaaaagaaggcuuugaugacuuuuuagaguaaguuuuaaagucauucuauauggcuugaggcaauacaauuuuuguguauccccaguuacgauuagagcuuuuuaaaauauaaagugauacaguucauugucauuuagcucuauuucuaaauugugucacauaauuugugucaagaauuauaacugucaccaugcuuauauaaacuuagagagauucauguagccuauugaauuugauccuccugacugaaaaguggauuggcuagauggauuggauguccaauuuacaaaugggaauaggaaggcucagagaguuuagugaguuauucagugacauugcagagccagcacuaaacaugaucuuaaucugagauugacuuauuaacauggauugguuucuauugaauauuaucaugguuuuacaauauuuucccuagacaccuuaaaagaacugaaguacuugagagcuagauaaggaauagaugagggaagggaugacauaagauauaccuugauuaaauggagagcacugauaaugccuauuauauuauuuauuaagcccguuucuaagugccacaucuguauuaucccauuuguucucuauaauaaucuuaucagauggguaauguuuuuucucauugaugaagaguuugagguccagagaggucaaauaaauuagcccaagaucgcaccuuuguuaauugggauaagaauucuuccagucuuccuucagacugcauuaucuauauauaucaguauaagauuauguaauugaguuaauuucguuagacccugaagggguugcuguacuucagcaguucuaaauucuguagguugagaaaguuuagcaaauuuugaauacuggcacuuguuuuauuacaugguaagguucuauucugcaugauaacaauuuguacaaauauugucuacccuuuauuuaucuaaauauuucuuaucaaaaaaugauguuuugaauuuauauugcucuagaucgggguauccaaucuuuuggcuccccugggccauuuggaagaagaauaauagucuugggccacucaucagauacacuaacacuaacaauaucugaugagcuuaaaaaaaaaaacagccaaaaaaacaauguuuuaauaaagcuuacaaauuuguguugagacacauucaaagcuguccugggccacauguggcccauggccugcagguuggacaggcuugcuuuagaugaagaggaaguagguuaaaugauuuccacaaaaugccaccaguuacuuuugguugcuaaggauauuuccauuuauuuccgaucgaaugaauguuuaguucucuuuaaagauucaguuugugcauuuauucaggauuuuugguauuuauuuauauguucauaaaauaauuuagugguauaugagauaguuguuuuaaaauacuaaacagccuuuguagguuguacuuaucuuacggaauuuuacuuuagcacacuuaugaagaaccccaaguaaaaagguagacaugaaacuuacuuagauuaucaauuugcugcuacagguuugcagcaagaaugguuuuuaaaaaaccaccagauuuaggaguuaauuuuuuuuucaggugauuuuguuuguaauacuagacaagagauacguccaauuguuugugauuucuuuccgguaggaaaaacuucaguaaauaacuaugaaggaaagaacuugugaaguccccaugugaaguucuucacuuuuaaggugcuuucuuuucauaucaugguaaaauuggaccaacugaauuuacacuuuguaaaauucacucacuguagcauugauauugcuucauuacuaccacuuuuuauuuucauuuuuuaaaauauguagagugauaaaugaaauauguuuguuuauaucuaacauuagaaacuuucugggaugcucagaaugacugaacagguugugugaugcucccuaguguuuuguucauuuauuuuuuauuuuccucaaacugaugauucuucugagaacaucuugauaauuaguuuuauacguauuaaaagaauaggaaacagaaaugguuuacauaguauaaauauacauaugguuggccacuuaugaauuguauaaaauauauaucagcuacguuuuuuaaaggugccaaauuguucauaauauucagauguuuaacauuuuaggaaauuuaguuuaugucucaaacaacuaaaaauuuuuaauuacagcacuuuuacauauaauaccaaaguuguuuaaaugggaauuuguaaagcaguacaugguuuugauuuuauaguaugcuucacauuaaguaaauaugaacucuaccacuuuguagccuuaagaaugauguggcucauggaauuuguuguggcguuauuguagcaacuaaguuaauaauuuuucaccuucaguauuuugaagcaacaucccauuuucauugaacuuaaauggagagacacaguauuacauuugugugccacauagugccauauugguaaaugacagacuacauacacaaugguggugcuguuagaucauauacuaccuuauuuuuacuaugucuuuucuaugucuagauauacaaauacuuagcauuguguuacaguugccuccaguauucaguacuguaacauguuauaaagguuuguagccuaggaguaauaggcuaugccauaauagccuagauguguaguagacuauaaccauccagguuuguguaagugcauuauaugauacacaaugaugauaucuccugaugacacaauucucagaacauacggucauuaaaugacacaugacuguauuuuaugugccccuaaaagugggaaaaaaaaaacaccuaaauggaaaaucugaaacuuacucaacagauaaaguugagacaccaaagggcuauacccuccauggaaagaagaacuauaccuaccaugccagaggagacaguaaagaaauuugaauguuuuaacucuuauuauugggaugagggaggaaaaaaucacgucugaggaguugagccguagccaauucucauaaguuugcauccuguauucccauuaacaguaaguguuauagauagcuuagaaacuuuuaauggucucagauugauggugcugccaaagugacuggcauaaaucaacacaaauucuuuaaaagauucagcuucaaagaaagagauuauaaaaaguaucucuauguuauguauauccuagaauuaauagaaaaugggaaucauaacauugccacaaaguagguuuuuuagacuuugaaaaacagacuuuucugggaugcucaguccucuaaaggaacucuaaauuucucaaauucuuacaauaguuuuucauacaaaauacaguauuuugcauauuugugguuuuguucuuugguuuuauguaaacaucacaguuuugguuuaaauuacauuaaugaaugaucgauuuacucucaggauauucaguuauauuuaauuuaggacuugcagauuaguuuguuggguaaaacaagauuaacuagucuucacccccaguauuuacagagauaccaagggagaauguagcuuuuuauuugacauuaaaucucauucuauaaucaauaccaugauuuccagucugaaagaacauuuuugagguguuuaaacauuuuagguaugggaagaagaacaauuaaagagagaacucugucagacucuauguucuucagugauuuucaauuacugccuacuggaggucucauuggccuggucuacuaaacucuuaaauauuuguuuuuuuguggcuuugguuuuaaagaagauuuuaucuuuaugugugugauaaagucaggauauuucaauuugaauuuauauuuauuuguacagucugcugcuaccauaagagaauuuuuuuuuuuuuuuuuuuuuuuuugagacgaagucucucuguugcccaggcuggagugcaguggcgcaaucucagcucacugcagccuccgcaucccagguucaagugauucuccugccucagccucccaaguagcugggacugcaggcgcgugccaccaugccuggguaauuuuuuguauuuauaguagagacggguuucaccguguuagccaggaagaucucgauuuccugaccucaugauccgccugccuuggccucccaaaauguugggauuacaggagugagccaccacgcccggcgagagacuguucuauugcauuaugcagauuuuacucuacuuuaaaaaauaccuuuaauucuuccgagaaguuacuuugauuaguuuuucucucuaaguuuucagaccuugaucucaauuuagcuuagaauucuaguuuugguuauguuacuagcuuuugauuuuauauguagguuacuuaaaguagcaggcaguuucccuguugccugucaugcaucuugguugcuuucccacacaaccaguuaccugauucagcguauuuuacauuggccuaaagcaaaauuaauuaugaggauauaucuguuggcgggagauguaugggcugggaguaagccuaguuguaguucuuucucauuugauuguuguauuuuuucuccuuacuuuguaaauuauuuaucugauucucuuagucuggaugauggaggcuugccagugcuucaguuuucaaauucuauaccuuagaaaaaaauacauauuauuuggaccauauuccaagucagccaccacauucuuauagucacaauuuuugucaaaaaguucuuguuuaaugauguuuagacaguuuauugguuguuuuuaacccauuaacucaaugcuacuuuauuuuaauagguacuuuagccucguuuagcuucauggguuacuuucacaaggaauacaauucaguguaugaauguucuuacauaccuuuaaaaggcuucaaucuauauguuccugcuggccauaugcuuauucuuuucuguuguuucuauuucucaaaauguucauuuacuuugaaauuguuuaauaacugguuaccuuguuccaauaccugugauuauuguauguaauuuuuguccccuucugaauuuccuuagaucuuuuuaauggucauuaaaaucaaaauuggaacgugggauuauacuaauauagaugaacauugggucaaauucuugagaaacuuguguuaauuuucaggauuuauauucaaacuuaguagaauuaauucauagauuugaaugguaguuauugguaaacuagauugagcucccaaacuaauaccuucagauauuuauguaugugccuuaaguuuucuguacaugagaggggauaaaugacgugugacuuaaaaaggguuuuuuuagauuauuuuuuaagucauuguuuggauauuaagcaccuuugaucuaggauuuugaaaugugccacauuguaaaauuuauucagugcauauauuaaaaaucaaaggugaaaaauacagaaaaaauuuuaucuuaaauucucuugcuccaaagaagugagaaaaauaugaauguuguguuauaacuaaaaggagauuaauguuuuuuuaaauucaggcuagaaauaacauaauaguccaaacuuuuaaauuuacuuguuaaaauaauuuugaccauauauauaaacugugacauaaguauuaaaauagauuaucgauaaaguacuucauucauucaacaagcacuuacuaagcauacuauucacaugguguaguguuuagugguuuuaaaucuuaaguuaugggauucuuaaagucauauuaagugcuuuggucuuaugguaaccuuuuuuuacuuuuauuuuagaugccuggaaugaugucgucaguaaugccuggaaugaugaugucucauaugucucaggcuuccaugcagccugccuuaccgguaaucaugugaaaauaacuauuuucugugaaguaauguuuugauugauugcuuuuauauauauggaauaauaucuauguauuuuauaggcaaucauguuagcuguugaagugccucuguaguacuguaauaaaauacaagaauuaccguggacuuucaguuucaguuucuuuucuuuucuuuguuuuuuugagacagagucuugcucugucacccagucuggaaugcagugagugucaugauaacagcucacuacagccucaaccucgugggcucaaguaauccuccgaccucagccuucugaguagcugagaccacaggcacgugccaccacgccgagcuaauuuuuaaauuuuuuuuguagagaugaggucucccuguguugccuaagcuggugucaaacuccugagcucaaaugauccuccugccucggccucccacagggaugacaggcaugagccacugugcuuguccuggauuuaguuucuauaacuacaaugauagacguuuacauuuuuuccuauauugauauuauauguacauccuuaauuacuagguuaauucuguauuaagaccagaauacugaaaaguauacauugugagccagaagcauuuuauuggucugauaacauuuaaguuuuaaaggguaaacauuuacuucacugaacgcuaauuaaaaauugguauaaugugauuuaauacuagauuuaggaaucaauauuuaauuggaaauccacguucugagacuucagcuguggcaaauuaauuagaaaaucuauugaacagccuuaccaccucugucggguaguauagcaauauaaauuacuaugaaauucaaguuaguuuaacuucuuuauucuuuaugugguugugguuguaauaaacagauguggcauacuccuuggggugguaaguuugcagugucuuucccaaaacccuaagaccagauauauuucaaaaauucuuuauaauacuggaaaguaacacauugcauauaauauguaaacauuuccugugggguccagggcaaugcugucuaacuuaauaauguuaauauuuuugcagcuaaacuaaacggauauucacucugaagugggauaaaugaagauguggaguuucauguucauguagggcagguuuugccacuauagugaguuuugguaccauacuugaaaaaaguuggcuuucagaggguuuugguuuccagaauuguggguaaaggauugaggaccuuguguacacuuggugaccauauaacauuuaaacuacucccguagucucgguugcugaucucuuuuacaauuuauagcaagcucggggaacugagaccacuaaaaguuuugcuaagaauaugagucagaggcuugaggauuauacauagcagguacugauuucacugugcuuuaugaggaacuuauauaaaauacacuuuuaaaaagaugaauaauacuaauuucauuuuucuucuuacagccaggaguaaauaguauggauguagcagcagguacguauacucuguauggugguauguguuagaccucauuuggacaguagcagcccuauuaugaggaguaaaagcaggaucucuuggacuuuauauaaccuccuuuuucuuuuuucugcaauaggaaauugggauaggauugauaauugaauucuguuuuuguuguuguuuuuuugagacggagucucacucugucacccaggcuggaguaaguggugcaaucucggcucacugcagccuccgccucccagguucaagcgauucuccuaccucagccucccaaguagcugggacuacaggcacaugccuggcuaauuuuuguauuuuuaguagagacaggguuucaccauauuggccaggcuggucucgaacuccugaccucgugauccacccaccucggucucccaaagugcuaggauuacaggcauggcccaccacacccagcgauaauugaauucuuaggaaauuuuuacaguuuuaggucaggaguucuggacccaauuuggucugcagauauacuuuggcccacacaaaguucuucaauuuuguaauuaucgcuaacauuuauagucugcagauuuugaguuugaauuuauuuugaaaaguuggaugaucugacuauucaauacuuaacaguaguccugucaacacaguaggugcucagagaauauacguuaaaugaacucugguugaguugauauuuguacucagcaaacacuagaaugacguaguggcuccauucuuuagguguuuagucugggcucuccuugggguucuagacuacuucagaguuacuuuucugucaucuccuuggcccuuguauuaauagccauuggaguaaauaucaguucccaauaacuggccauuuugacuagugagauuuuaauauauaauaguaaugccuccaguaucaugauuacauaguuuuccacauaaauugauauuccagaugccgaacuuuaugacacaauuaugacaauauuuuuuuuguuauaaacaguauuggucgaaagguguugaaaauguacugugugccuuucuguggguucaaaugggacuaaauugauuuuuuuaagauguuucacagauuucauuauuuaaaauguucuuaaauaccuaauacaauuauuuucuuuuauuuagauauccagagcuggguacuguuacccucaguaaucuuggaaaauuacauaauuuuuuuuuuuuaguuacuuuuaauacgcuuuggcucuacaguuauuuucuauaguagcuucuuuugaguguacucaguauauaugaacuuuguuuuguuuuguuuuacauacaaucuccgucuuuuuuuauuuacauguuuaaauuacuaguuucuaaaguuugagauuauuauuaggaguuuugugacuaacaugcauuucaaaaucccuugaguuuucuauaguaguauaggacaguaccaucuaauagaacuuucugcagugauggaaauguucuguaaucuguacugcuuaauacaguagccacuagacacauguaauuauuguguauuugaaguguggcuggugcagcugaggaacugaauuuuuaaaauuuuauuuaaucuuaauuuaaauuuuaauuuaaagggaugucuggugucugcucgcuacuguauuuuacagcacaaaucuggaauuuagauaaaguuaccaggaaucuaaagcuauagaaucagugguuagagguguuauugugcuuugguaauauacuuaguagagaaggaggaauaagaaagauagauaccuauuauaguagggaaaagagaaacaaaaggcuaaguugaauacuuaucaaacugccuccaagugaguccaaguaaguuugugcauugaaaguucaaacucugagcauguuuugcacuauagauguuuauuuugugggaaagauagcaagcacuuagguuauaugagacagucucaaaaucuuuagagaggaugaggaggaguaaguacuaugaauauaugaauaaauauuaaagcuauuaugaaggagagcaugauuuaucaugguguaaauauuuugccuguuuuuuauuuuuuagguacagcaucuggugcaguaaguacucuuuuaaccuuuguaauauuuuaauuuuacuauacuuuaaccuacuuuacaguuauucuuauuucuguucuaaggauuaucugcuaaaucuuuacauuaauccauaguuuuccccuuuuuuucuaugacaaggauugaaaaauugauuuauuuuaaaaucugguuuuggugggacuuaaugagagaugagaauuacauguaucaacuuuuaaaaggauuuaaauucuucccaucacaauuagaagggaagcagaacuuguagguacacagugcuuaaccuaguaauuacaaguuaagcauuacauuaggagauaaucuuuuuuuuuuuuuuuuuuuuuuuuuuuuuuuuuuuuuugagacacagccuugcucugucacuaagacuggagugcagugaugagaucuuagcucacugcagucuccgccuccuggguucaagugauucucaugucucagccucccgaguagcugggcuacaggcgcccgccagcaugcccgacuaauuuuuauauuuuuaguagaggugggguuuugccauguuggccaggcuggucuugaacuccuggccucaagugaucugaccgccuuagccucccaaagugcugggauuacaggcgugagccacagugcccgacagauguuagaugauaauuuuacauauauauauauauguauguauguauguauauauaaaugaaaauuuauguaccuuaauuuaaaaaacccuuuuguuauaccuucuuaacacuguguuagaaagaaaaauggaauauucagaauagcauugauuuuuauuuaggaaaggagagaauaauauuuaaagauagcuauuuuaugcuucuugauauuaguccaugcuuuagcuucaaggauuuuuuuuuuauuuugcuauuccuuaaagaucaauggaaggaagaguuuuguuuauaaucucauuuaaucauaacguuccugagagguagcuguuaugcuacuguuacaauuaacggaauugauugcaaauacguuauuuuucgcauuuggggagaaaauuuuaaauuaagaauuguauuuaaauguuuuuaaaacauucuugugucuuuugccuuaaaaguuaaaugguugcaaaauaucuuuuuuuuuuuuuuuuuuuuugcuuguuuguuuguuuuugagacagagucucuguugcccaggcuggagugcaguggcuuacugcaaccuccgccuuccagguucaagcguuucuccugccucagccucuugaguagcugggacgacaggcaugugccaccaugccuggcuaauuuuuguauuuuguagagaugggguuucaccuuguugcccaggauggucuugaacuccuguccucaagugauccgcccaccucggccucccaaagugcugggauuacaggcaugagccacuacgcccagcccauuugguauuauucuacuauaaguaccugcuuuuauuuuugagaaaggauaacuuaaugguuuguuuguuuguuuucuuauuuaaguaaugcaggcucauugggaggaaaacaaagcagacauaaguuaaaaagaaaguaaaauucauccuuaauuuuuugaccaugagggaaccaccauuaauaucuuaucugaagaucuuuuugcauguuacuuaagcauagacaaauacauacacauuuuacauaauugguucacauuacauaugcuuaaguuacuuguuaaauacacuuuuucuuguuuaaaacuuuauugugaaaaucuguguaaguuccuuaauguagauguaauuuuuuaaaugacuuuauaaaguauucuuugccauagagacacauuaaaccauucacuuauuaauggaaauucaauuuacauguuggauccccucccaauuaugaauuuuuuuuuuuuuaacaccuaagaaguauuccaggaauaacauauuuggaauggagaguauguaacuagucauguuguuuuucaagaauguaaaagacauaucuaauaaugguguaguaacaugucuuuuucuucaagaaucucuagcagcaauagccaguaucacuuauuugaauuuuagugaguggacauggguuuaaagugauaguucuucuuugacucuuaaugagauugaacauuuuauuugguauuuggauuucucuucuguuaaccuaucccuguccuuuccuguuuuuagguuggguuauuuuuuauuuuuucuuguaaauuucauuuuaagaguuuuuucuaauguuauugauguuaacccuuuaauaaucaugaauuucaaauauuuuucuuagucugucauuggucuguugauuuugcuuuuaaugaucuugccacacaaccuuuuaguauguuaaugugguaauuagauagguuaucauuuuuagcuaaugcguuuauugaaguuuuuacaaagguuuccucauucuuacauuuucuuggaagauucuuauugcuuuauuuaucauuaaguguuugauucaucuggaauaucugucuauaagauggauagccaguugugucagcuaucaaaaaauuuuuucugacuuuaauugaaagcucuuuauugucauaucuuaaauucucauauauucugggauuuauaucuguguuuccuuuuccacuguuuauuucuguuuguguuuuucuaaaccaauauuaauacuuuuccuggccaggugcaguggcuuacaccuguaacccuagcacuuuaggagccagaagugggaggauuucuugagcccaggaguuugagaucagccaggguaacauggugaaaccccaucucuacaaaaauacaaaaauuagccaggcaugguggcacacaccuguagucccagcaacuugggaggcugaggugggagaauugcuugagcccaggaagauccaggcugcagugagccgagaucacgccaccaccgcacauuaguagggagaccccaucucaaaaaaaaucuuuuuuuucuuuauuaagggguauguuuuucuugguuuccagacaugggacuuuuguuuaaaaaauagauaacuguuuuuuuagagcaguuuuagguuuauagcaaaauaaaguggacaguugaguucccagauuauaggcccccccaccccaacacauaacuuacugcucucccacacugucagcauaucacaccagauuggugcauacguuacaauuggugaauauacauugacaaauuguuaccauccaaaguacaguuuauaucaggguuuacuguuaauauuguacauucuauauauuuugacaaauguauaaugaauauguauguaucagcccuugcaguaucacacagaauaguuucauugcucuaaaaauuggugcucugccuauucauuucuuccucuucuacuccagcaaccauuguuuuuguuuguuuguuuguuuguuuuucugccuccguaguuuugcuuuucuaagaauuucauauaguuggaaucauacaguauguagccuuuucagauuggcuuguuuuacuuaguaauaugcauuuaaguuuccuccauugucuuuuuauggcuugauacuucauuucuuuuucucacugaauaauacucauuaucuggauguaccacauccagauccauuauguacugaagaacguuuugguuguucccaagauuuggucauuaugaguaaagcauccaugugcagguuuucugugugaacguaaguuuucagcuaauuuggguagauauuaauaacgaggagcacuauugcuggauuguguuguaagaguauguuuaguuuuguuaagaaaccuugaaauugucuuccaaaguggcugcaccacucugaauuccuaacagcaaugaaugagaauuucugguauaccacaccuucaccaacauuugauaauaucaguguuuuggacuuuugccauuuuaguagguguguaauguaucuugcuuuaauuuguggcuaauuauaugugauguggagcaucuuuuuauuugccauccuuacaucuuugggaaaguguuucuuuggaucuuuugccuauuuuuuaaucagauuguuuuauuauuguagaguuuugagauaacagguuuuuaucauauuaagucuuuugcaacuauuuucuccaaguuuguggcuuaucuucucauucuucagacuaucuuuaacagagcagaaguuucuaacuuuaaugaaaacuaaaucuguucuuucagccuaucaauuauuucauggauuguaucuuuggggaacuuuuuuuuuuaugagcuauccuuauugcauuaugaucagaaaguacagucuguaagauguaaaguucuuuacaguuuauuaaagcuucauguauguucuuguucagggcuaguuuuuaagaauauucugugugcuauauaaaguuacuuuguuauuccugcaucuuggcaugucuuucaucugcuuggaucuacauaagaagauagugaauuaaaaucuuuaacuagaaaagaugagucaucuguuucucccuguauuuuucuguugccugucugaauuucaagguuaaauugccauaugcauauguguuuaggauaauuuuugaucuguuacuuuuuaccaguauauagucucccacuuuuccauuaugauuuuuguuuuaaauucuguuuagguaagguaaauagguacccuauuuuuaaaguuucuguuugcauuguaaaaauguauuacaagccuggaaaacaaagugagacccugucucuacaaaaaauaaaaaauuagcccagcauagugguguguaucuguagucccagcuacucaggaggcucaggagggaggaucuuuugagcccagaagcuugaggcugcagugagcugugaucuugccacugcacuccugccugggcaacagagugagacccuuucucaaaaaaaaaaaaaagaaaaaguuguuacauugugaguacaguauuuuuccuauuuuuauuuuaaccugguuaucgucuauucagauuauuuuguguauuugucuuguaaccaaugacauuaccagauuuccuuaucaauucaaauaguauuuuaaaacuguaacuagauuucacuggaauuuuauauguguaaaaauagcaguaaaggcaagagaacuuuacuucuccaaaauuuacaccaguaauuucauuuuauugcugugguauauuugcuagaauuuuagugauuccaggcauguuuuugugauuuuaauggaaguggcuuuagggugauaacugauugccuuuuaaucauuuagguuuuuuauuucuuaaauuauuucauuugagcauuuugcuuuuauuuuuuuauuuuuugaauacuugugaacuuaguuuucugggugugauuugaucauacaaaguuuaauagugggaucacguguuuuuuuuuuuuuucauuugauuagauaguggaaauaauuucuucuguagauuuucuaauauugaacuacucuugcacuucuacaguaaauucugcuuggucagaguguguauguuguuaaauuuaaauucaugaugcucuucugguaucuuuucugcuucuuguuaauuaauggagagcauuucaucuuuuuuuccccauaaucugaaaucaugauguaacauugcaauucuguguucuuuaaagguuguauaacauucugcugugaaaccaucugguuuuguaucuuucuguugugucuguguuguugggauguucaagugugaugugcuuuuucuggggucaauuuugguuaagugauuugcuuggaaaucauuuucucuagguuuugauugguuguaaaucuguaucugugauuguauuuuuccucaauucuguuuauuauuuggcuuuuucuuuuuuuuuuuuuuugagacagaguuuugcucguuacccaagcuggagugcaauggugcgaucuuggcucacugcaaccucugccucccggguucaggugauucuccugccucagccuccugaguagcuggaauuacaggcgugugccaccacgccuagcuaauuuuuuguauuuucaguagaaaacgggguuucaccauguuagccaggcuggucuugaacuccugaccucaggugauuugcccaucucagccucccaaagugcugggauuacaggugugagccaccauaccugaacggcuuuuuaauauuuuccuuauuuagaguagugaggggauuuuucuauucaguguuuggauuuagccauuuuuucuaaguuuucauaaauucaguuuauacauuguacaaauguguguguauauguguuugucuccaugacacacagaagguugaguuugaguauauugaauuucuuuaaaacuguugugucuuguugacuagcuuuuucugacucugaagagcuuauuacuugugauaguuacauguguaugcuuuuuuccuuaugcccaguuuucuuugcauuucaaaugauuuuucuguauaaauuuuugccacuguaucauuuggcacugcauuuuagacauuuucuaucuuauuacaaauaggauaaucaguaauacgaauggaccauaauugaccuguuuuccuauggguguacauugaguuaacuguaauuuuucaccauuacacguaauauuauaaauaacguccuuguacauguuugcaacaauaugaauggaaguuuucagagugaaauuucagguucaagcggugauguuugcauuuuuaauauuuguaagaacugcugaauugccuuuaugcuaauuucauucccaacaguaacacaugagagugagaaaaaguacccuuuuucucacacaccuuucgcauuguauauuaauggucuuugucauuuaucugaugagcaaaaaguuuuuauuaaugugugguuuuuugauuggcuagugaaguugaacaucuaauauaauaacuguauucugucuauggccauguuuauuuuuccauuagacuguguuuucauauugauuguagauauaguaaggauaauuuuaucccuuauuuugcugauacacucccaguuuaucuaccuacucccccaaaaaaguuguuuuaauucaguucccagaacugcuguuucauaucuaauuuuuuuauuagcauaauaacuguugguaauaaaauaauuguggucuugaaaagcagcucgauguucuagugucauuucccaagucccuaugagcaaguuaccagccuugcuaaaccuugguuuucuuaucuguagaaagauagugauuauaccugcuuuguaguguaauuaguuauaaggcucaaauaaauaguuagagaauauuaaguugauuucuauuuguuuuauuagcuugugucuccucucccuccucaucauuuggucaacuauacaguguccuuuucuuuuuuauucuuuuaucuccuugugguuuugcugauuuugcucuuuccuugaugcuccuuagcagaugugacuugaaaaguugaacauagucuacacaguuuugcagcuuaugguagaacucuguuuaaguggugauggugcaguuuugagaugcuacugacaucauuaguuguuuuuaaaaggaaaauauaaaccccuuuaucugucuuaacaccauuuaauuugugaaauaaagcauuaccauauagucgaaguuuccacauuuguguuucuaauugcaccaccuuuugaugaaaagaaguuaaagcaggcuaauagcagaaagccagauuauuuuuccaccaccuguuuuuauauuugcuuuggagauuuuuccagcaccuguuuuauauuugcuuuggagauauuauggugauuuuauccauuuuaaagugcuagaauuuaacacagcuuuggaauuaucuaauuauccugcuacagcaugcagaaauuuauugcagaugggaccaucuaguugggagacagugacagaucaucaggcauuagauucucauaaggagcaugcagccucacaugcacaguucacgauaggguuugcacuccuaugagaaacuaaugccaccacugauaggacaggaggcagagcucaugagguaaugcgagugauggagagcgccugcaaauacagaugaagcuuugcucgcucacccacugcucaccuccugcugugcggcccgguucccaacaggccacggacuggaacugcuccauaguccauggccucgggguuggagaccccugcuguaauccauagugucugugaccuccguugucaggguagcaguugugcaugaguaaacagcaaaagugcccacaucaaaagaauggaugucacugguuucaaagaaaauuauaaaaguaauggcacucccuuaggagcuaggaauaaaaugauuauggugaaaaaauugguaaagaaaugaaucacauauguucagucacauucccaaaacagaagucaaaacuaggucagcucuuacucuuuaaaguugauaagaaaaaaauaaaaaaucagcguuuuaaauagguacaaaagacauuaagaaccaguaccagugauuuuucacuuguuuuaugauuuuuuuuaaagauauacuauauuaccaacguauuugaugcuaaagggcuuauauuuggaauauaauggauaucagcaacucugacacagaaagucucagugugaggaaauuuaagggaucucuuaaguacuuuauuugccuauuuuucucauuauguaugcauaaaagugguauaugguaaaauuaauguggaaguaagacuaacuuucaauaaguuugaaguaaaaucugguaaaaaagcauagggucauuugacagcgauuuuauuuuuucuuaagagguuuguacaauaauaugucuuagauuugagggaauauuauauaaaucauuuuuguaacccuucaagcauaguuaaauuugucaccaucuggaaaaucuggugcuugaaacuagguuuacuaccuuugauaucauuuaguaaaucauucauucaugaugccuuuuaaaacuuuuaaccaacuuuuaucugagggaugucuaguguugccuggaguaucauuagcaacuucuaguagguucuuaguguguucuguugaccuuaauaguggauuuauauucuguaguuucauucauguaaaauuuuaucucaccuaucuuguuuugaggcauucacauacacauuuuaucccuguuaaauuucaucuuguugauaguuaaauucugauuguuguccagaagcuguguuuugacagcugugucuuucuuuauggaauaucaauuagaacuuugucuaaguugauacaaguauuccuuggacuacaguagaugaauagaugaucacauagucaguucaaauauauuagcaucuaguuccuauauuuucuuuauccacuaggcacagauuuguauucugaaagauugucuuuuguauguaagcuauaaaguuacuguucuuaggagaguagucuuaucuuuguaauucagagagauccugaaacuugaauuuacccuugcugcuuuugaaguacucuaaaaaccuuguuuuucaguucccuuccuacuuguauugaugaauuauucuagauuacuuaaacugucaaaauaugcccaguuuuuacuuuugauugauuucuuaauauauuuauugccuuggaacuaaugauacugauauugucaauggcauuguuacauaauuuacaucuuuuuuaaucuuuauucuuuagaaaucaauguggacugaacauaaaucaccugauggaaggacuuacuacuacaacacugaaaccaaacagucuaccugggagaaaccagaugaucuuaaaacaccugcugagguaaaaguuugagagcuggaauucagggacugucaaguagacuggggcguauuuuuuaggauucuauaaguagucgauuaucaaagagcaguacugcuuaaaugucagaagaggaucuguaaagacauucagaaaaaaagaggguuaguauagucacaccaaucgggaagaagagcaauaaaacucaacagaauaauuuuauuuacugauuuuaccccugcuuagaaaaccuaguagagugggaucaauuuuaaaaaggugauuuaaagaauaaauuggaaguggggaagacuguuucuuugccugccgcuggcuuuuuuuucugauagcaaaacugggugauuuuaaaugacuucuacugaguucuuaaauuuccaguaggguuaaggguaguggagaugaaauuaaguuaccuacaaauacuuccuucucuuagagugggaaguuuucucuuugcaggaaaugcccuuuuaaaaaguguguuuuuauuuuguuuuuuguuacaaguuuuaccauucaaaauauacagauauugaagaaaaaguuaagguugaaggaauaaacugaauuaagcaaugucacauguuguuuaauuagaaacucuggggugcuaaguaaguaagaguugaucuggcacuccaggcuaugcuuaaguuucauccuagcuggugguauaccuuuuuguuuucuucucuuccuaauuaaggaauuugagaagguaaaaguauuuuccagguugcuguacuaacaugaacagcagugcuugggaggggaggucggacgauuuuuaaaaacauguauuccaguacugauuuauagccaaugauauuaauuacauacuuuguccaagacacucuguuuggauucacacuuugaauagauuucucauacuacccuaacagguuuuguuuauucgauuuuaaguauauuauaccuacauguuuucuuacauaauaaguuaauucguucauaaacuacgaaacugaaaucuaagcaugacuaaauuagauuuuguuuuuuuugaacuuuuaugguuuuccaacuaauauuaguaucagagaagucuguuaaauguggaugauaggccgggcgcgguggcucacacuuguaaucccagcacuuugggaggccgaggcgggcggaucacgaggucaggaguucgagaccacggugaaaccccgucucuacuaaaaaaaaauacaaaaaauuagcugggcgugguggcgggcgccuguagucccagcuacucagagaggcugaggcaggagaauggcgugaacccgagaggcggagcuugcagugagccgaggucgagcuacuguacuccagccugggugacaaagcgagacuccgucucaaaaaaaaaaaaaaaaaaaaauguggaugauaaucuugaccuauaauggggugugaaugguuacaguaaauaggauuugaaauucauauagaacugguuuugaaucuugucucugcuuuuuaaugaguauauuaccuuaaacaaguuacuuucugacuucaaguaacagucccuagauacagaauuauguuacacauuuugcaguguuauaaagauuaaauaauguauucaaauggcaucacucagugaauauucaauaauugauaguuuauauuauuaccaucaucucacgaguuuuagaauuguaucaauugguaauuucuagugaaaacagccauguaaaugaucagugauguuaaauauauuauuauuaacaaacaguuuuuuccuuuucagcaacucuuaucuaaaugccccuggaaggaauacaaaucagauucuggaaagccuuacuauuauaauucucaaacaaaagaaucucgcugggccaaaccuaaagaacuugaggaucuugaagguaaaauggggaaaaguaguuuucaauguauauguuuuacauauauaugccauucacuuugaaacaauuccuccagaauaggauuguucaaacaaaggccuuauuuuuuuuuuuaauuaaaugauuagaacauuuaaaauggcguauaacaguuuuuugggcucuuauuuucuuguugcuuuagaucucaguucuguagauuuuaaauagauuuuuauuugauuugauuccacugaaacuaggauaccagaauaccauuguugcuggaagucuuauuacaaaaucaaaccugcauggugagcugcuuugauaauucauuuucugucauacuuaacauuuuuauuagaguaugucacuaauauucacuaaccauaauuggauaaaucugcagugaaaaaucucuaagaauucuuuucauuaaaggguuauauuauaaaugagcuuguagcuuuuaaagucguacuuugguuuuuagaaaaaagaucguuuaucauucaauugaacaaggaguucauauacaaaauuuccaaguccuacuaugaguggugcauacauagaacauguguuuuaacucauuucaugguaauagauaguggagaaccuugaaucuguauccauuuauauuuuguuaguauauugucagacuauauauuuaaugcuaguuuuguuuagcacaguguugcaaaauagccuugauauguucuuuauggaagaauuaagguaaaccaaguaucaugccuuacuuauaaagggaaaauuuuucaacauuggaacuaaucagaauaacccuuaaaaaucuagaaauacuuaauacuaaauauaaaaccuaagacuuaaaauagagauaauaaguaaggauugaaaaucuaguuuuuauacucacuucuaauagaaucuagugucauaaauuauacaaaacuagaagcagcagauuguaggagaauggggcuaauaaaguagauagugauguggaaugacaucuggcaggaaaagagaauaaaaauuuccuaaaagacugucauauuaagccccuuuaccuuuuccuugugccaccucauuagauagauagaucaucauuguaucagaaaaauguuaauuuauauuauuaaugauaacuuuguaaguauguuuuuucagccauccuaaacagauuuucagaaauguuuuucuuuaaagggugauaaguuuuaaaaauuuuuuuuauaaagaguuaggcuuguauuauuacuuaauguggagaaccucauucccuaguaauguuaaauaaaagguauuuuuguuacauccaaaggaaaauguacuggaaugaaaaaugaaauugugcagaucuuuaaagcucaguuuaaguuaccuauacuagcauuggcuaauaauaauauuguagauagguagauucccaguugaucauuuaugaauuaucaagcucauuucugauauaacccuacuacaaauaguuggugugcguaacuaucuaucuacuugucaaugcuaguauauaugugcuggaauuuuauaauaaauuugaucccauuuugaauuuaguaucuuaaaaauauaucaaacuagucucaucccugaagaaaauacaguuuucauccagaauuaugcagauacuuucauagaguuguugcagcagccuuugggaaagcagcagcauggaauaagcuuuccuaguaauuacuguuauuuaaguuuguuguauucuuuauuugcuauacuagacuuucggagcaagaauuuguucuguaaaagugauuuuuuauuuuuuaggaugguaaaugaaauccuauuguaugauacuuuaucuucuuuuaaaguuuguuuucagugauuauauuuuaaaacuaguagaugacuuuuuuucucucuuuaauagcaaugaucaaagcugaagaaagcagguaagcaauuuuggacaucaauuuuuauuuacaaauuuggucucuccuaugauauccuuguguuuucucaauuuucauaauacaaauaauuaacauguuaggcuugauauuuugauguccuuguagcauuuuguugaggaaaaauuagggagggggauauuuacucaauuugauguuuugcuauacaguaauuauuagaauuuggacuguaucccuuaacaaauuaagaagacuguguuacagaagagucccaaauuccguuugaguugauuagggaauggacgaaauauaucuguguaucucuuccuuuauauaggguuuccucuaaaugggcaaacuggagaaaauuuaaaguucuuagagaacuuucuaauacaggucauuuuucgugguguaaauacagucugauagauuggguauuuuauaaaugugaacgcuuacugaacuuuugagugccuguaauacauuaccaugaauguuaacggaauuaaaguaguacaguuacauucugugguuuuaaaaucuuuuuuaaugggcuuggcauuucuugccguuuuuuccuucaauuauuuuucuuauuauuugauuuuaugaccauuuuaaagcuaccuuuauuuagcuuucugauuacaauaaugaaaugaccaguguucucuuuuuuuaauguauaguaagcaagaagagugcaccacaacaucaacagccccagucccuacaacagaaauuccgaccacaaugagcaccauggcugcugccgaagcagcagcugcuguuguugcagcagcagcagcggcagcagcagcagcagcugcagccaaugcuaaugcuuccacuucugcuucuaauacugucaguggaacuguuccaguuguuccugagccugaaguuacuuccauuguugcuacuguuguagauaaugagaauacaguaacuauuucaacugaggaacaagcacaacuuacuaguaccccugcuauucaggaucaaaguguggaaguauccaguaauacuggagaagaaacaucuaagcaagaaacuguagcugaguaaguuuaguaacuugucuucugaaaaucaguaccagauugcauuaaauaaaaguaauugccaguuuaguuaguggccauuaauaguuuaaauaaauuuuuuugagaaucguaauaucaccguuaagacaguugaucaguuuucaggccgaauuuuggaggguuaugccagcaaacuugaaaaauaguucagugaaauuuuaacaaguagagccaaggcuagggaguuggggcacaaaucuaaaagauugccaaaaaccuuaguaagcaagauacaucauauuuugaugcaauauuuuacaucagaucagugcaaaaauucaugauuaacaaacuaucaguauuuucaguuaagacagguguauuguuucuucuuugguuauugguguuuuggguuucaaccuccuauaaaucaguuaaaaaaauacagcuuuguagaaaaaugaauuaugggggaaaaaaaagcaguuuauggcugggcaugguggcucacaccuguaaucccagcacuuugggaggaugaggcaggaggaucacuugaggccaagaguuuaauaucaacgugggcaacauaacaagacucugucucuacaaaaaauuuaaaaauuagccagcacuuguaaccucagcuacugaggaggcugaggcaggaggaucacuugagccuaggauuucaaggcugcagugagcuaugauugcaccgcugcacuccauccugggugagacagcaaggccacccugucucucuuuuuuuuuucuuuuuuuuuuuuuggcacagggucucccucugucacccaggcuggagugcagugacgugaucagggcucacugcauccucgaccuccuggccucaagcgauucucccaucucagccuccuccugaguagcugggacuacaggcacacacaccaugccuagcucauuggccugccucagcgugccaaaaugcugggauuauaggugcgagccacuccaccuggccaaggaaaaaaggcaauuuacagagaaagaaaguugucuaggaaguauaugaaaagccauucagccauaauaauaaagaaauacaaguuaaaauaauacugugauuauuuuucuaagugaaagucaaguagagaaacauuuaaaagauaacaccagauacaagaaaacucucuuuucacucuuagugagacuauaguaauacaacuuuuuaauaaagcaaagcuguuaucugucagaguucacgguuuguguguacuugcauacccuguagucuaguacauuuuauauggcuaugcuuuauagagcuuuagaaagugaggucaagcuaaauuucuugacuuuaaggguggccugaauaguucaccauaaucucauuauugaaacaugauuauccaucuuaauauuuaagcauguugccuucauccauccauccccuauuuuaaguguucuuuuguuuuucguauguuaguuucccagagucaaaauagauuuuuaacuuuuucugauguuucaaaaguuuuaaaagaaaucuguaugguguauuugaaggcaugaaaaugaaauuaacauuuuguuuuauacuuucucccccuuuucucuacauuuaagauacacgaacauauaucuaauauaucagagacaucuuccacauugauagaaauguguacccaucaugucaaaugauggguuauuaucauuugauugugcauaaauggaagugcuccucuaucaauagauauuuaggcuuuuuggaauaacuuuauuuugcgucuugucauacugaaaguuuucuucaauguuuuccauaaguuuaacauuaaacaguuguuuccugcuuuuuuucauuccagcauuuccuugguauagugucugagucauaauacgcuuuugauuuuaauuacuauaacagagaucauuuuuugucaguaucuacuacagugucucuucgccuaagcguucuacuuauuuuuuuuucauucccuggcccccacccaugcauucccuuauuauguagaaagaaauguaaggcuucuaccauuuuuuucucaucaggaaaacccccaauuauuaaacaaguuaguaauucuggguaguuguaauuuuuguuugacaucaguguucagcaaacuuucaugaaauauuagauuggaaauauuuuuggauuauuugugucauacagucuuuauauggugacucaauucagcugugguagcacagucagcgauaauguguaaacaaaugaacgcgggcauuuucaaguaaaacuauaauuacaaaaauuaauaggcugaauuugucuaguggguuguaguuugucaauccugauuuagauugauccuuacaucuuauuuaucuucacacuugcccaaauccuuagaguuauuauagcacuaaugugaaaccacugaaugaguuuaauaagccauuuaaaacuauuaaccuaugggccagaggagcuaguguuuuaagucaguuaaauguuuauuuugucauuuguccagggucuuaaaaacugauuuaauaacugaacuuuuaggaaacgauuaucuuuauuucuuugucuucagauaaguguguuuuuagaguucauauagcuuuuauucuaaaugucaaauuuuauuucaacaucaaacauuuaaacaauuuagacauuauuuuucuaaaugaagcaaaaauuuauuuaauugauaaauaccacauuugaauuucucucuaguuuuacucccaaaaaagaagaggaggagagccaaccagcaaagaaaacauacacuuggaauacaaaggaagaggcaaagcaagcuuuuaaagaauuauugaaagaaaagguauuaauauugcagauuuuuauuguuucuuagcuuuuugacaucaagcauguauuauggauuuuuaugugauguguaauaauuacccaacaaaugacguuacucuuuaauuaaaccuugaugguauugauaauaccaaucucaugaacuguuguaacugaaaagcaacuaaauaugucuuuuuuuuuuuuuuugaaguacacuuuugugaaacuuucaacacaaaaacuauuguguacaagguacuacacaagcacauuucuacccaauauuuaauguaaggguuuuuuuuuaauucauaauaguuaucuuuuauccauagucuaagaaaaaagcauuuauguucuauuuaaauuucaguuaaaguuuucauuuuaguucauagguguauuacacagauuugccuucaguaaaaaacuauuuuuuauaacuuguuucaaacuccugcaaagggaaaugcuugauguuugcaguuaguauuauacucaguuuccuauuaugugacuuaaacuauucuugugugaaauuuuaauuuuucauuuaaauuauuuucagcggguaccaucgaaugcuucaugggagcaggcuaugaaaaugauuauuaaugauccacgauacagguaguacuucaacuuuuuauuuacuuuucacuuugagcauauagcaggccuagcacauuuaaaguuguguagaaagauaaaacauuuaacuguugacuucuguuuaggauaccaaguauagaguuguuuuaugucuaauaaccaaaaagucaaaggcuuaucaaacaauuugaguacuccgcuacauauaaaauaauaauuauuuuaaaaguagaaauuacuuucuacaaucauuuguaauaaauuuuugaaaauuuuuaaauuauauguguaaacaguuuuauuuuuuuuuucaaaccacuaauauuugauucuuuugccuguguuuacucuuacaugguauuuuuauauuagugcuuuggcaaaguuaagugaaaaaaagcaagccuuuaaugccuauaaaguccagacagaaaaagaagaaaaagaagaagcaagaucaaaguacaaagaggcuaaggaauccuuucagcguuuucuugaaaaucaugagaaaaugacuucuacaaccagauacaaguaagauguuuaguguuacauggccuauguuuacuacauuguuguuugugucauacuuuucugccaugugcaguagcugauccagagcucauuaaauaaaacuagaugauuaugaauguggaaacuugaugagguacaaaauaaaucuguaguuaaauguagaauuuaacuuguugacuuaauaaguuuuugagagacuggaagaaggggagaaagacuguauucaauaaucaaguuggaggccagacgugguggcucacaccuauaaucccuaccguuugggaggccaaggcaagcagauggcuugagcccaggaguucaagaccagccuuggcaacauggcaaaacccugucucuaggggaaaaaaaaaaaauacaaaaauuagccgagcaugguggcacgugccuguagucccaccuccuugggaggcugagguggaaagaucacuugagccugggaaugucaaggcugcagugagccauaauugcaccacugcacuccagggugacagcgagacccugucucaaaaaaaaaaaaaaaaagaaaaagaaaauuugauugccuuuuacuuaaaaacauugaaauuauugauauuuguggaguaaaaagaggcuauuuucauuaaguaggcauagcauuuugaauaauuguuuuauguagcauucuucauuuuagauugcuuuauuauguaaaauuguggguaauauuaaaauauuuuugauauguuaugaagccuauuuucuguauguauuucuuugaucuccucaguauuccagagaagucuguaauuuaguucuguaggcaguuugguagucuguguagcugccuuuagauauagagauagucuagacuauaagcagugccuaaugugaauuauccccucuaucucuaaggagagagggaggcauguguuuuuuguuuguuuguuuuguuuuguuuuguuuuuucauaauuauccaggaguuugucuuuaauauauuuaugaacuuugaauaggaaguauucauuuuguaguuuuaaauuuaguuuaaaaauugguuaaaauuaauuuuuauuguauaauuuuuuuuuaacagaaaagcagagcaaauguuuggagagauggaaguuuggaaugcaauaucagaacgugaucgucuugaaaucuaugaagauguuuuguucuuucuuucaaaaaaagaaaagguauucuuuauucuuaguuauugguauuuauagauaacacaagauguuuccucauucggaugaggauugguuuuauaauauguacauuuuucuggcuuaguuuauccaguuuaugugguauagcagauuuauuuauuggaaguaaaauuuaaugauggaauguauagcuucuguaauaaucuucuuuaucguucauguagcauauuaaguacugauguagacucaguggguacucauucaauuauuuguauugucauuaguuggcuaucuuaugcucacuuugaaaagauaccuuuuuugcucauuagguuuaaaaaugcuggguuuuuuugcuuauaaccagcaugauuguuacaagaaugacagcaacaugcaguuguuucuacuaaacuuacaacauuuuaaaauaccuauuuuacucaugucucuuuuucauugugcacuauuauauuuuauguuaucugguuuccaaggaacacauacagaugcaaguauuaucaaauuuaaacauagcugaaggucauugaagauuuuagcauuuaccugcaaugcgacuuguccauaguaaccuuaguuucagacugucuguaauacauagugguagaaagguuuaugucguaugggggaaaagccaaaaacaugguuuccagauucuggcuuuuagaaggagguggaaaauuugaagcuaaguaccaaagccaagcgcuuaggaaagagcauuagcaaagucagcaguguggccauuuaaaguaaaugaaauuuacuugaaguuugacuuaaccuuugcaauuuggucauccguuagaauauaaagaagccgucacuaauugcaauuuaaauaucuuaauuucuuggaacuuugaaacauacauauucauacuuuugcuauaggaacaagcaaagcaguugcgaaagagaaauugggaagccuuaaaaaacauacuugacaacauggcuaauguaacauacucuaccacuuggucugaagcccagcaguaucugauggauaauccaacuuuugcagaagaugaggaguuacaaaguaagaauaauggcuaaguaagagaaauaguuuuaaacagcguccuccagcagcaaagaauuauuuucacuuuuuauaugagauaacuaauugaauuuuaugcaguuguuuauuucugaaaaagaguuuuauuuauuuccaaauaggauauuucuuucugauugaguuugugauucaugacaaaauauuuuuucaaauuuaaaguagcuuuaucagguaauccuugaaauauuuaaauuauaggucacauuugaaauucugcuuagccguuuguauguaacuugguaagaacuaaaugaauuaccgcauuuuacucagguuguuuucuugagguaauaacauuauagauuuuguaaaaagaaaaaaauguauuagaauuaucuuaacauuaggcuucccuaaguacucuuucugaguuaaccaauugcuuuuuaaauuauagcuuuaucagcuaccccucuaaaaaucaugcuucaguagauuuuuuuauaggguguacaguucuauacuuugaaaagcuccuggaauaauuaugauauugcaaacagauuuuaucauaacacuuuucauuaguuuugccauaugcacguccuuuguuuuauccuaugacauguuucagaaugucuuuuauugaguucuuugugaaauuuuccuuaaaacuuuccuaugcagaugaucacaaaucauauuugaguuuaaauacaaguuuguuuguuuguuuguuuguuuagagacggggucuugcuguguugcccaggcuagucuugaacuccugggcucaagcaauccucccaccucagccuuccaaaguguugagauuacaggcaugagccaccacacccuagccuaacuacaaguauuuuugacaggugauuuugaaauuuugggggagcuaaugcaaguaaacuacuuuacuuguugacauuugacacucuaaauuuuaacuggcaaauacuuuagauauggacaaagaagaugcauuaauuugcuuugaagaacacauucgggcuuuagaaaaggaggaagaagaagaaaaacagaagaguuugcugagagaaaggagacgacagcgaaaaaauagggaaucuuuccagguaaaagaaaaagcucucuuuuuaacuuaguuuuauauuauauuuacugaacuuugacagugauacaaagaguuuugagacaacuguucccagaucauagacuuaggcuuugugaggacucauacacauuuaacucuuuaaguucuucagaugaacauugguaaaugagguuucgguugggaaaaacaacaggagagaugacuggaaacaagauauguguggugagucaguaguagaugauauuuagucucuggaggacaaagggacugcuaagguauaguuuggggaugggccauaauuucuuaaacacuaagaaaaggaccugggauugcauguuuuuuagguaguaguucguuuucaucuucaaguaucauuuuuauuuucagugauagaaaauaucauggagcaaugaauuuuuugcauuucauaucucaccuauuucaauaauuauaauagcuaauauucuuugauugcuuacugucaauacaauuuacauuuguaaucucaauuuuuaugacagucuuaccuuauaaggguacuuacuguuuuuguuauauaaguuuauauaacuaaggaaauggagaggugaagugacuugcccaaguucaacagcugcugaauagugaagccagaauuugaauccaugcaguuuugauuacagggucucuuccauuaaccauuguauuaggauaaaugcuagguuacaauggcuuaaauaaguuuuuuucuugaaguaacagucuuuuuggucuagggcagggcauauugccaucccuuaaggcagugguucucaaaauucaguguaucagaaugaaguggaggauuuuuaaaaaauuucuucuggccgggcacgguggcucaugcccauaaucccagcacuuugagaggcugaggcuggcaacugcuugaguccagaaguucaagaccagccuggguaacacgaugaaacccggucccuacuaaaaauacaaaauaauaauaauaauaauuagccgggugugguggugcaugccuguagucccagcuacucaggaggcugaggugggagaaccugagcccaggaggucaaggcugcagugagcugcgauggugccacugcacucuagacugugcaaaagagcgagauccugucuccaaaaaaaaaaauuauucgcgcuaugccaaagguuacuguguuaaacgucacagccaguagaaagauuucaguccuuauucaaugaaaacuuaacauuuacuacucuugauagguuccuuuaucuuagugacuuucuagacuugaucauguucuacaacgguuaaaaacacaaauuguuuagccuuaccugaagaauuugaauuaguaagucugggguggagucugaaaauuucauuucuaaauuuccaggugauauugauacuguuggaccauaguuugagaaccagugcgcuagcauguuaaccuucucugcagaguuagggguaugcugcccccauuucacauuuuaacuuggaaaaaguagaaagaacaguucuucuuaaagcuaaugauguagaaguucugcucaccuccuucauuuggguucaguugcugagaauuuagucacagggccacaacuagcuacacaaaggaggcuagaaaacuuagcuuuuagcuaagcagccaugugcccagaaagaaggggaggacagauucuuaggagggcuauuauacacucuuccacaacuuaagcuuuaaugucucugaugaagguuuugcagugguuuaaaauaaggagacauauaugaaaaaauaauaauacagugaaaauaaggucugggucauagaaaauacgagacuauaauguaaacaauauugaagauggagacugugaggcaaaauuuugaugugaaggcuguuacgguuccuuaaauaagcuuaaauguggcuuugaaucagauugcuaugugucuggcauaguuucugauuacuacuaauauaauugguguuaaguauguuguauuaauauucuuucagauauucagccugguaauuuuccuguugugcuauuucaaaagauuuauuuaggacuuuagugaaaugaauuaaaagagaagauuggcauuagacaauaaaagaucauuaauggagagcuucucaguaguuaugauuaugaugaugacuagcuuuuuauuuaguguucauuugcuaaucagaaaauucaucaugucugugacaaggaaacuaugaucuuguuuuucuuaugucuuaaaacugguauuugaagucaguuuugucuggaaaggauugaucugaggcuuucaaggagaaccagaggaauguauagugucucagaagccaagaguuuggaauuuuaagauagagcaugauccccaaaugcacagaaucaguaucaccugggaaauuaugaaaaugcauauucucaaacuccacgucagacuuacagaaucagauucuggaaaugggaccuaacaauaugauuuuuuuaaacaguccuucaaaugagucuuugagaaaccccugagguaaaggaauccaccuaaaguaacauguuaagaaauuuuuauggaaugaggacugaaagaauacuguuaaggguggcauuuaagguguuaagaguggcauuuaagguguuuagugaccauuggcaugguagggaaaguuaaaggucugccaaauaguugaaagauauucaauaagguaaaauucaaauaagcuugcaguuaagagaaaggcuuuucuuggguaagaggaaaccaguuaagagggagagaaugaaggaagaauugaaaaauaagggugagucucauuaaacaacaucucggaaaguugggaauucaagcauauauaugaauacaguuacauugagaacaguauauaagagaacaaaaagaaggaugaagauggagaaaaauuaauaccgauuuggaucuaagacaguggugcucaaccaagaaagauuuugugauugucacuauuuguggggaacaugcuacuggcaucuaguguguagaggcgagagaugcugauaaacauccugcaauguacagggcucaaacauaccccgcccucaaccaagagaaagaaagaaaaaaaaauuacgucauccaagaugucauuagugccacgggaagaagaaacaucaagcucagccaucuuugaagcaacuugcuuuccauaauguaaaaggcaaggcuuuuucaccccuaaaauggggcaaguaaaauagaauaagaaccauacaguuuugucagagugguuuucaaaccugaauucacaucagucaucuaauauuccaaauaucuggauauuaauucauauugcuuuaaaaaaauauuccucaggugauucuuucagguuagggauccacuauugaaauaauuucagucucacaguucuuugacuuuaucagacagaucucaccagucuggaaguguaagaaacacuagcaaaacagguaugauagagugagguaaguucuaagguacuagagcaucacuaaagaugguuuccaaacuauuuuagauacucagggagcaagugaggaagcuggugagcacaacaagagugguuaagacaaaauuccauuuauguugaaggguaaggguaguugacagaaggguagauacaggcaggguuugagaaaagaauuuccgaguuguaagggaguauggacauauuuagucuuguuugaagaggagugagugcaguuguaagugccugauguuacuuugggacagcucuauccaauaaaaaugugaaugccacaaaugcgauuuuaauuuccuauuuauuuuaguaauuuaacccaauauaaccagauauuauuuuaacacaucaauauuuuuaaaaauugcuaauauuugugguauuaaaucuucaagaucauuguguauuuuguacuuaacagcacaucacaacucagacuagcuacauuucauguaccgagaagcuacguuuggucaguggcuaccuuauugaacagugcagguauaggaauugugggaacagaauauaggguuacaguuucuuuuaggcacauuuguguauagcagcgguccccaaccuuuuuggcaccagggaccgguuuaguggaagacaguuuuucuugguggggugggguggggaguugguaucaucaggcauuagauucucauaaggaccacacaaccuagauuccuggcaugcucaguucacaauacgguuugcaguccuaugagaaucugaugccgccacugaucugacaggagguggagcuggggcgguaaugcuuguuccaccacucacuucuugcuguguggcuugguuccgguuccguggcuggggguugggauccccugguguauaggauuaaacucccugaggauuggguuggaagcaggaaguguggaaauugaaacuagauauggguuugaauccuaggucuccaaacuacuuugggaaaauuauacauccuccucuuaaggccccuuguuuuuuaaaaguaaauaaaaauaccuagaacacauuaggcacuauuuuuaaagacagaaaguauauauuuaaggaaacaugcauauacauucuuuagccucaucauuugagguagauauccaguaauuuaaguuaacuuuuaccuuuuuuuuuuuaaagcuaaaaauuagguucuaucuuaaaggguaggaaauagaaccuuaggaagauaaugugcaguuucaaaaguuauuuucucuaaaggacaaaauauuuuuuugccuagaggcaguuguuacuuugcccaaauagcaaauauucuuugugcccaaacagguuugggauaacauugguagaagaguuuuaacuaugucaaaguuuuuguguguuuucauguuagacgcuuauuucucauguacucgagaugacuuuccaaauauaauuuuucucccuagauauuuuuagaugaauuacaugaacauggacaacugcauucuaugucaucuuggauggaauuguauccaacuauuaguucugauauuagauucacuaauaugcuuggucagccugguaagauuauuuucuuuccuaauuuaccguuaugguaguaguugaaaugggccaaaugcaaaggugauuguguugggggaaagggugcuuuauuuuuguuuuuuaaacaacaaaguaauugcagcucuuugguuagagcuagcuuuugacuucuuuaguuuuuucauuaggaucaacugcacuugaucuuuucaaguuuuauguugaggaucuuaaagcacguuaucaugacgagaagaagauaauaaaagacauucuaaagguaaauauauuuauucuuaccuuuuaaccaauaguauaucuuaaaaguuaguacuguauuccuuugauuuaugcauuauuaauguuaagauuucuuuuuuuuaggauaaaggauuuguaguugaaguaaacacuacuuuugaagauuuuguggcgauaaucaguucaacuaaaagaucaacuacauuagaugcuggaaauaucaaauuggcuuucaauaguguaaguuauguuuucuguuguaaguaacuaguuuaguaguauaguuuuuaauuuauucagauaaaagcagcuaaguugcagaguguuggaauaagggaauaugaauagaauuuuacagagugguagccagucuuucagguaagguaaaacaaaaaacuuuauuuagaugauggauugauauuaaacuuccuuugcucaaauuaacugguauuauacauaaaauggccauuauaaaucaggccuugggccacacauaaaguacacuaacgauagcugaugagcuuaaaaaaaaaauugcaaaaaauccuuauaguguuuuaagaaaguuuacaaauuuguguugggccacauucaaagcgguccugggccacagguuggacaagcucguuuuaaacaaugcgugauuccuaaauuaacaauaaauuauuucagcuaauaguuaugauacuauuauaacugauuaaauaugauuuucuuaauaguuacuagaaaaggcagaagcccgugaacgugaaagagaaaaagaagaggcucggaagaugaaacgaaaagaaucugcauuuaagaguauguuaaaacaagcugcuccuccgauagaauuggaugcugucugggaagauguauguauacuuguuauuuuuuucuaauggaauucuuuucuuuacaguugagaaauuuaaaauauuuuuauuuuucauuuuauagccacaaaaauaagcuaaauuuauuuguagaauauauuaaauauauuuagaauauaauaaaagcauuaaaucagcuguugacucuguuuaggaauauuuguaaagaaugguuuggacuuuugaagggaggaaauaauggacuuuaaggggacugauucaucacaguuuucacuugcuguuaugauuuauuuuagauguaucguuguacuuuucuugguauucauauauuuauuuuguaucugaauuuuucagauccgugagagauuuguaaaagagccagcauuugaggacauaacucuagaaucugaaagaaaacgaauauuuaaagauuuuaugcaugugcuugagguaauuuuagaauucucauauacaaaauauauaaaauauaaacaaauugaagaacuuagaaugaugaaaguauguugcuuaauauucacugcuuuuauacaaauguacuuaccuggaugguuagagaaugguuuuuuuccuauaaaaacugcuuuuaaguaaaagaaacuauuaaguuuccaugggaauauaaagauuuguaugugaagacuguuuuguauuuuuagaaaguuuuagaaauugagcaguuuggcagccacauggauugauugacuaauaaagaaaacuugaaauuuuucuuguaaagcagauagaagacagcuuuuaggcacauuugagguauuauaccacauuagcuguguagaaaagaaaguuucuggaaaguaauggaauaaaugguaaguuuuuguuaaaauaagcaaugaaacaauaacaucucaggucacuuuaauagguaagguucacugggcacgguggcucacgccuguaaaacaagcacuuugggaggccaaggugugugcugaucaccugaggucaggaguuugaaaccagccuggccaacauggcgaaauccugucucuacuaaaaauacaaaaaaauuaucagggagugguggcgggcaccuguaaucccagccacucaggaggcugaggcaagagaauugcuugaacccaggaggcggagguugcagugagccaagaucaugccacugcacuccagccugggcaacagagcgggacuccuuccccaaaaaaaaaaaaaaaaaaaaaguauuuugaugacaguuucaguuaggcccuuguaaguaugcugaauugaccaauaauuauugaauaauaguauucgaugccuaugugggccaguguucuaauugcuuuauguauauuauauuuaugaacugaauccuuucaauaagccugugaaguuaauaggugaacaaacuaaggcagagagaaguaaagugacuuacaggguuggaagccgggcauguugaccuuggucagugcuuuuaacaaguaugccaugcugucaguuuuagaguagcuaauacuuuauaagcuaaaaacuaguaggugcuuaauauuacaguguugcauuguaaaugggcauaggucacuaaauugacuauuuccuauuucuugauuuauuguucuugauuaauauaauguuaaccacaguuuuuucuguaccauguacucacgaaggcccuguauuguuucacagcugccucuagaugugguccuguuggccuuuuuuuuuuuuuuuuuaaagcggggucucugucauccauccacuccuaggccagagugcagcggugcaguuaugggucacugcaaccuugaacuguuggauucaaacaauccuccuaaguagcuggaacugcaggcacgugccaucacacuuggcuuuuuguggggcuuuuuugguuuuuguuuuuauaaagaugggaucuugcuguguugggcaagcugaccucaagcaagucuccugccuuggccuccugaaguacugugauuauaggugugagcaaccaugcugggccucuagaucuuuucugugccaaauguagugcauaccagaagcaucugcauuaccuaggagcuucuuaggaaugcagaaccuuaggccccauggggcagaaauccugcgucugacuucauuuuaaccagauucccaagcauuaaaauauacauuuaauuuugagaagcucugcucuagauagugacuaaccuauuuucccccaguucaagagucuacagauucuuucaugaucuauacuggggguaaaguaguuaggugguaaauggaguaaaaaugguaccauagggaagggcugaacacauucagauuuuggggccuuaauaaucugaggcuugagguauuaaagaaagguagguuagcauucagugagaucaaaaggagaauaguccauucugagauccagauuuuccauuuccacuucuguaacugagguagaauuuauucucaaagccauagaaauguuuaggggcaaggagcuuguacuguagcaccccccaucacugcuaaccuaguaauuguuuuaauaaguagaaauccacaaagacagcauauggaugucuaacaaugucuuguuugaggaggaaggaaauggcuccuugggggaaaugaaagagggguagcagauuuugcauuuauucugacaucagccuuauauaucucaauucaaggauggcucucagguuguucuuuaucuuagugcuuggccuaacuugcugaccaaagccagauugauuacaaaaaccaugucugagugucauuguauuugacugucauuaaaagcagaugucacugcauauuacacuuuucuucuaaaucacaccauucucuuccuuaaaaaauacuuuuucaggcugggcacaguggcucacgccuguaaucccagcauuugggaggccgaggugggcggaucacaaggucaggagaucgagaccauccuggcuaacauggugaaaccccaucucuacuaaaaauacaaaaaauuagccgggcaugguggcaggcgccuguagucccagcuacucgggaggcugaggcaggagaauggcgugaacccgggaggcggagcuugcagugagcuuagaucacgccacugcacuccagccugggugacagagugagacuccaucucaaaaaaacaaacaaacaaaaacuuuuucagcugggugcaguggcucauggcuguaaucccagcacuuugagaggccaaggcggguggaucaccugaggucaggaguuugagaccaggcuggccaacacggugaaacccugccucuaccaaaaaugcaaaaauuagcugggcgugguggugugcaccuguaaucccagcuacuugggaggcugaggcaggagaauugcuugaaccugggaagcggagguugcauugagccaaaaucgcaccacugcacuccaaccagggugacagagcgagacuucgucucaaaaaaaaacaaaaacaaaaaaagcccuacuuuuucuacuaacaguuuuuaacauuguuuuguuuagaugucuaaaugaguggguauaggaugggcaagaaggaaaagaaaaaaaaauugacaauucuucacaguuucaagggauuacauuucuauauauuguagaguuuuacucuaagaacuuacuuccguagcuuuuuaaagauucuuuacagucugucuacaguaaguguaaauucuugaaauuuuuuuuuuguccccguagcaugaaugucagcaucaucauucaaagaacaagaaacauucuaagaaaucuaaaaaacaucauaggaaacguucccgcucucgaucgguaagggaauuuauuauauggugucaugaguguauuaaaguguuagcauuauuaugaaugaaauuauuuguguuuuuuaggggucagauucagaugaugaugauagccauucaaagaaaaaaagacagcgaucagagucucguucugcuucagaacauucuucuagugcagagucuggugagcauuucuauuuauuugauuaaaucauugacacugauauacucaaagucugacacuuuuuauccuuuugugcuacucagagagaaguuauaaaaagucaaaaaagcauaagaagaaaaguaagaagaggagacauaaaucuguaagcaagcuucuaauuuuuacguuucaccuaggcuuuugcccuuaacuuccucagagaucauagaaccuuuuucuaucuaguucucugcagcccaggacaguucaggugggcacauaaacuuagaguuuuguuguugcucuucaccuuaaucuuccauuaaaaucaauuguugagcuuugaaaaaauacacacaccaguguuaggauccccauccuggucuuuaaaauuaauauucuagaaagagacucgugugugugcaugugucucuguguauguauguauguuuguguguauguguagauugcagcuguuguugagaaccacaaguuuaaauguuaaaacaaccacucuacucuugcaguucuuauucuuagguguacauuaagauccaccuaaggaacuuuuugaaaaucugaaggccuggguaucaccacagaccuguugaauuacauucuuuuuauuugaauuugugcauaucuaaugaauaaccauuuaagcacuaacguuaaauuuuaaauaauuccuacucagcaauuucaagaaaauaauuuuauuaauacagcugucugccuuauguguuaaagcuaacagcaguauacuauguacauauauaaaccaauauuauauugaguuggugagaaauguaguaucugucuguauuuacauaauagauacuacacaucuauuaugugguaguaagucucaugagugguauuuuauccuucagaauauuauccuucccaagggaaagcuguccccaugaaucuuggguaaauuuuacuaaauccuugagguuaacaauucacauuuuauuucaucucucuaagagcacauaaccuguuacacauagauguucuuaaauauuaccuauauaacaaugguaucuucaucaaaaugcuaaccuguuauuuucuauucauacaggacucuccagaauccgaugcugagcgagagaaggauaaaaaagaaaaagaucgggaaagugaaaaagacagaacuagacaaagaucagaaucaaaacacaaaucgccuaagaaaaagacuggaaaggauucuguaaguauuuagaauuguuucaugccuguauuuucaaaaugcaaaaauguauucugugguuaaaccaugaugguguugaaagaauaggcuuuuuuccaggugugcuaccauugaagaaaacagugaaaauucaguuaaguacauuucacacaauaucauaguuuuuggucaugcaugauccuagauuuuauucuccuaaauuugauauuuuuuaaauauagcauuucauaacuauagccuuauuaacucacuaagaaaggauauggucacuaagaagugccacuggacauuuuuuaccuaauuuucaaauuuuuuuuuuaagugagagacuaaaucugggauucuacagaugucuacaguugucacuguuauuaaauccuuuguuucaaaagguagcaauuccaguaacuuuuagaaauacugauuugggguggaggaagggcaaauaaauaggagaggagaauauaagccaaaguuaguauuucaauaacagauuacauaauuaguccuuuucaaauauauguauauaugaaugacagagccuaauaaugcaaaugcuguggguuuagcaaggguaaaugccuaugaaucaucacuggagagcauaaacuauguagguaaaacccuauuagggaucucuggauauucugauucguugguauaggguggguuuuuuuuuagagcugaaacaggugagucugagucacaucguaagugaagagugaauguuuccuuuguacuuucuagcagcuuaugguggguuaaaugaaaucccuggagugaaugaaagaggacgauaugggaacuauccacuuuucaaagguugugucuuacggugcaguauuauuuuuguuuguucagccuaaaucuuguccugcucauuagucuuguguauuuauuuggcacaggaauccauaugcuuaaagcauacuacuucuguuucugugauaauacuuguggaaccagggggaagcuacaaaauuagcaaggaauaggccaggugcaguggcucacaccugugauccuagcccuuugggaggccgaggugggcagaucacgaggucaggagucgagaccagccuggccaacauggcaaaaccccaucucuacuaaaaauacaaaaaugagccgggcuugguggcaggcaccuguaaucccagcuacucaggaggcugaggcaggagaauugcuugaacccaggaggcagagguugcagagagccgagaucgugccacugcacuccagccugggugacaagaacaagacucugucucaacaaaaaaauuagcaaggaauguauuaucuaggaaaugaauaccuggcuuccauuaaauggaaauauugcuucauauucacacagucuuuaaacccugugaaauguguuucuuuggaagagaguuuauauagauauuggauucuuuuuucaaaggcucagcccguaaaccucugaguacugaugucaacuauaauuguaaucaaugucuuuucaggguaauugggauacuucuggcagcgaacugagugaaggggaauuggaaaagcgcagaagaacccuuuuggagcaacuggaugaugaucaauaaauuauaccaaauauauguuuacaguaugauuuaaagucugauucagaccagggacucuauuuuaaguucaacugaaauaacacuggguuuuaauuauaucacaggaaaaaaaaagugcauuuaaguauuguuaucguggacuuuauaaaagcaaaggaaauugaaaguaacuuuugauucuguaucaagaaucauauuuucauacagucauaacugucuuucugugacccuuucacagggcacuguaggauggauuaaagguggcaauuuacugauaacugcagaugucucuacuuuguucuaaaaucuaagucaugaggugauuugauuuacuuuauagaagcuggauuuugaagaucuaaugaaaaauuuuuugauaauauaguaguacaaaaaaagcaccagcaacugauaaaaauugcuuuuuugugcgcuacccaacugguuaaagccaaugugaucuuuuauggugaaacuccuaagaaacaggugguuuugcuggaaacuugguagacccuuaauuauaguggugcuaaugagcacuacuguaauauaaagccaccauuauuuuuuaucaaacaucugaauacauuuuacaaaggcuauugugagggcauuauuuugagcaucuauuuugaggugauguuuaaaaaaacuuuaacaucaaaucaaauuguaaauuaauuuaaauauauugccuuaaggaccuacuaaagaaugugccaccagacuuuaagugauaguugcaauauccuugucuaaaaaaaaaaaaaaaguugacuuaaacauuuucuuuaacaguugucuuuuuuuucuaaauucagucuuucucuugcuuuuuuuucccugcuauugaggaaguauuuugccuucccuacucacugagaaguauugacuucgugguacacauucuaaagcauuucugauuugaauauuuuuguacauuuuuaucaauuauuaaaccuucucuucuaguguguacuaguauuuauuucuacuuaaacugcucagcucuaaagaaauuguaugaucacuuuaaagguacuaaaucccugaaauuuugcuucaucuuacccacaccgcuaguuuacuuuccuuuuuuaauauuuaagaauauuauaaaucagugcauuugaggucccuagauuuguuuuucaccuaugaauuuuuuacagacuauuuuagagaggcugugguuugaagacagaauacucuuuacaugcuaacuuuugaagguugguaauguaauuuauacuauuuuccuucagugcaggagauuuuuuaaguaaauaaguaaauuuuagcaccuauucuucgguauuaucuguguuauucuuuuaauguguacacuugaagagauccuauuucaaaguugggauuuugaagaacaaaaaguuuuuuucuuacccauccuagugaguuuugaaagugggccugaccagaaugucucuuucccauuuugccccguuugaauuaaauauaaugucuacucuuuaaaggcugaaggggugggugaggggauuguuucucauuuugucucccaagucauuuuucugcugugaaauaugaccaggcuuguaggaagacucaucuuggagaaaaugugaaguaaucaaauugcuugagauuagucuccuauuguauauuagagccaaaacacauaauaacuuuggcaacagggaguugucuagacucaauuuucagaggucccauuguagugaguuaauauugcuaaucaugucaaucacuugacauggaagucaguggcaaaucuuuaaaguaugcauuugauacuggcaaauauauacuacugauguuucacaaaagaaucuuagaaucuguagaaaacauuaauuacuuccaugaauuauuucuaaaguauaacuuuaaaguuuugauuuuucuauuuaaauaaaaagcuauugauguguuuuagcauguccucaaaauagauuccuguauuucuuacagagauaaucuuacuauaaccgcaaaucccuacaacacaguauaaaguuucccuguaguucacccaugaaaauuauuugacuuaaaaacaaccauaguaguaagccaauugcaauucaaaaugcaacauccuugccauaaaagauguaacuuaagugacugugauccuuugucuaccuuucaggaucccaucaaaugggauuuaguugcuagaaagauacuugacagucugaaggcacaggugauaagauuuuguucucugugaauauuuuuaaacuaauagguuauguuuuuaaaucuucaauuugguaaaaaacugaaacgucuuggaauauugguucuauuagaguuaaauaugguaaaacaggaaagcguguuuauuuucagauaaggggaauuuauacuuuucauuaaagucuuggagucuuaggaaaauguugaggguuugucuucccccagugucauuaauacuaaugaacuauuagaucaaauucacuuauacauuuaauaucauaguuauucaaaaucaggacuuuaaauauuuuuuucucccaguucauauuucuuugugcgaaaauugaauuuguaugaaaaguuagauaauuaagcuaaucaaguaugaaguauacacucuuccuaagugaauuuaaauaauguaaugcuuuuaaauaaaagcaguggucccaccacauuuuuuucagcauaguagcuggcauuuuguuaucauuagccagaguagcuucagcauauaaguuauugauguuuuccaacuucaaaagugcauuuuaugccucccaguaaauuugauaaugauuugucacagcuuugucaucuuuugacuuuugcuuaugggccucacuucguacaacuauaacaugaaaaaggauuguccuaaaguaagggaaucaguuaaugguaggaugaagaaacuguaaaaacuccuagaaaaaaaccugugugcauuuuucuggaaaguuuucaaacuguguaauucaguuuucauucaauuauauaauuugguuauaugcuuuaaaaaacauuugucuaaauguucccgguuuucuucuggucuuagagucagcugagugcuggcuaugcagccacucguauuuuugcauccagaaaggaguaacucccuuuauaugaagauuuuuuuuuuuaagcuuagaugcuauguaagagaaaacuauuuguaaucacauaguacccagggaggagugaugaaugcuuuuuuaaaaaaggauauuuaaguauauuauguaauuuaaauauaaauuaucaaacuaaaaaacuucagcuuuuaaaacuuucuaaacaaaaugaagcaaaguacauuaauuccuucuaucuuaaaucugagacuuuuuauuuucccuuggguauauauuucucucaguguuagguagauguuaauucaaccauccuacauucucuauauaaaauuacacucauuuuacaugaaagcaaaauaaugucguuacuuucauggaacuguguucuaacaggcuuauaaucucauucugugcuucugguaauggcguauaccagucugaugauucuuaccauccuuauucuuacauuacucuuccaauuguuuugauuuuaacugguggucauguaaguuccucgguggcagggauuuaucugguucauuuacuguuauauauccuuguggaauaggacagugccuggcauauaauaggcacuuuuggaaugaauguaaaauacuaguugaaauauguauucaucuggcauccaugguacccaucaucuguauuaaagggcuuaaaaaagcaucauugcaauaaaccauacuaacccaccacuaaagucacagucauaauugaagugcacccaaaauaagguccagugacuguaccuuagcuuuuacuucagacauguccaaaacuugugagaacauacaauuuaaaguugaaaacucaucauuuugggcuauuuuugaauagggcugaaauauggugacaugucaggcacucaguuuuuuggagcugucuuaaaggugagguggaaagugagagaugauuuugcucuaauuacccacacauucucccuaacccuccauuuuaagacacuuagcuauaauagcuuaagacuaucaaaacugcuuuugugauucucaguaggaucuaguucaaagccaucucagugcuagugauugguaauuguuaauuugaugguaauuacccuacuuguaaaguugacauucauacuggcuaauccucccugccccuagucguggacaaugaaacagugaguggcuggugaauuagaucagauucaaacuaagccauuccuugaugcuauucuucacugcuguuccuuaggguaucuaaauguguuauuuauaaacauuuuugggggcuccugccugcaaacuucgguagguguuggucuuccccaccucuacaacugagccaaggacuuguucugaaaggugaguaauaaauaagggaacaagguuucuauuuucuguguuuguaauuaccagauuuucaccucuguuuauauauuauucugauguaaaagaaccucauaguuauauaaaauuagaccuuuuguaaauaaauauaauuuauuagaaaaaaugguaucuuuuacuaaauuggauuuguguc

SEQ ID NO: 13198 - RNA, 43855 nt, Homo sapiens
gggaggaggaggacggaggaaguuucugcgccgaguccuccgucgggaaaacucuaccaacuuccccaggggaagggaagacaacagugucccagcuucccgagcuuagaccgccucaccccguaggggguggggcagugggggucugccaccuucacccuccccgcccgaguuacguacgccccacaaaccugaggccgccagggguaggguggagggggcggggguaagcagccuguaguguuagcgguggcugggaccgaaugcgcgcgcgcggugcucgaggcggaggggaggaggcggggaaggcgaaaggagggguucggaggagaggguucgaucuccguacgcaccagguggagagcgcgcgccuggggaaggaggcgugucgaguagcgggagggaaguuguaguacggguggggagaaccacacuaaagggagaugggggugagcaguuaaggaaccgcgagagcgccagguagagaggugcccuuaaugggggaaccuggagaagagugugagcguaguggggaagaagggagaagacaaauagguucgggaaugugucuccgagggcgcgagcgggcgcuaggacccggcgucgaaaagaugaggcuuuggggcugucggggcgcgcgcucccguuggugacgcggggguggcggaggucuccggccgggacgaagccccgcagggaguggauacucgacagccuucggccuccgcucgcuucucccugcgcgcuuuccugcuccccuuuccggcuacagcccuggggucgagcucuggucgaagcgcauuccgccucuccuuuggcccugcggcuuccuuugcaacccgccgcccacccuugcucuccgugguuuaccccugggcucugaggccuggugguagcggccacugccgcggauuggcuguugcggacccggggcggggcaggugggagaggcucguucuccgcggguuucguuguguuucgcgccaugucguuugcugagagcggguggcggucggcucugcggcgccgcggucccggcaccccgggcccuguggcucggccaucguauuccuccuuuacucagggggacagcuggggugaaggcgaagucgacgaggaggagggaugcgaccaaguggcccgcgaccugcgggcggaguucucggcuggggcguggucagagcccagaaagcgcucggugcucccgccggacgggaacgggucgcccguucugcccgauaagcgcaaugguaucuuucccgcggccgcgggcagcagagcccagccucggcgguggccgguccagguccucucuauucucugcucgcugcucuucgccauucuucucgccuuccuccucgccaucgccuacuugaucguuaaagguauugaagccgacgccuugaaagucuguccagaguaaaguugagccaggguguggcucucgucuccacccaucucccuuucccucgcgcuaagcccucaggcuggcagcugcuuucacccagaguccucauuugcaucuuacuuugcucucccgcccuuugccuuuucuaaguggagcguccugauccaugaucaggagacguauuuuuaaaaaggaucguuugauuaaauggguacucuugaagaaauaucuucaaguccuugaacacuggggaugaaauauugugaagauuaaacaaaaugcgaaacacccaccauuaaaaggagacagugaaaagugcauauaauuaaaauaggccauguucaauggccuucauccacaaauaaagaugugcuguccaccaauuccucuacacagaaucuugagggacaaagauuuucaucgcauaguccaaauuucuucuuuuauagguaaaauaauuagccucucaguuuuuaaguuuguauccagguguagugcacggaguucuguugcagaaaguauaguccacucguccucuaauaauuuuguuuuucugucugaaguugaaauauuggccgguugaaguuuauugcaaggcauacgguuguauaauuuaguuggcuaguguauauuauaguggaaagaagcagaguuaaguuuaaauuuccauucucacuaguuugugaccuuugccaaguuacugaaaaaaaaaaaaaaaaaaaaaaaacaaaagaacuuuguuguaugaaaagcacccaaaacauugucacugaaguguuauuuuuguacuucauuaaauauaauuaaaucuauuuaacuccaguuuuuauuuguccucauugcuucccagcguuuagugggcuacagauggcauggcaucuaaaaccuuacaaugcuugauuuucauacagaagacacuuuggccaguugauguggguuuuaccucuucauaaaaugguaaacugaaugugcauaaaaugcaagcugucagucuuaaaugauuggcugccaauguuucauuuaucauuccccuccccacuuuuuugcccuuuuuugcaauucugauaguuuugucuccuaggugguuuauuucuguuuugcucggagacauugccuuuguaucauaaagucacaaaaccaugauaaguggaauuccauugcagaagacauugaacugugcuuauuuggaagaauagagaaaggaacugaacuccaccuaguaugcccuuuaguguuuaccacuaccuuagggaauaaacaguacucucauccuauguacgguauauagcuguuggcucccuuaguggucaacacauuaauuugcuugcugaaggucacauagcugguaaauugaaucagaauuugaacccaguucuuugugacuccagagcacuuuccacagcuccacaaugccuucacagcccuugaguuacuuuucaaauuauaguauugcuuuccuaccuaagucccucuuuguauuugcagaguugcaugcugagaauuugaaaaaugaagaugauguagacacuggacuauuagguauggacuuaauugccgcuugcuuugguuuugagcucacguuuguguuucuagaucauguuugaacuaacucugggauaaaauacuuaauguauuucuaugugcagucauucagucuuguuuuuaauuugcauauguuggugauaaauguuauuagauuuccuuuauauguguggaguauguguaugcauauaugguauguuugcuauaauuuuuuaauggggccaggugcaguggcucacaucuguaaucccaacacuuugggaagcugaggcaguagaaucacuugagcccaggaguuccagaccagucugggcaacauagugagacccugucucuacaaaaaauaaacagaauuagccaggcaugguuucacucauguuuguagucccagcuacuugggaggcugaugugggaggaucacuuaagcugggaaguucaaggcugcagugaaccgugauaguuacacugcacuccagccugggcgacagagugagacccugucugaaacaauaauaauuuuuuuaauggguacugguauguguauguaccacacacacuaguaauacauuuuaaacacaacugcaugugacucagguccagagaaauauuuaacauuuucuaauuaccuucuggaagaggcuucccacagcucuucucaggaauuuaaaaacaaaagaacuuccucacuauccuagcaaagguaaauaaugucuuauguaggcuucaggaggaauuuaaguucaaauaucuuuaugugcagcuuuuuuuuuuuuuaaagcauugaccauccuugcacagguaaaugacuaggagagucagaccucaguuucugcagugucuguagaaugcuguaguucacagguuuccagugaaaaagguuauucuauauuucucuccaccaaaaugauucugaagaguugaaaacuuuaccuguccagcauauuuuacuccuauuugcuuugaucacucuaaauuggggaggggagaucaaacuuaaucacucuacauucgaucacaugaaucaagucauuugaugugaucacuuuaaauuaaaucauuugauuugaucacuguagauaggugguugagacacuaugacacauguccuccccucucccauucuuuccuaaacucucuaaucuaccacuuuauggcuaaucacccuuauggugacacuaaguauaguguaccuuauuucagcagaaggggaaacaugaacccuuuaucuucaaauugcaaagaaguugguuucuuagauauugcauggaaacuuuugucuguucuugucaacaucuugcaugagaaaacauacuuuuuaguuacucauuuuaucaguguauguuuuuacauuguuuuaucucuagaaauaagccaagauuauuaggcuucucagagcuuuuauugaucugucaccucuugaugcaguggaaacagaaucuuaugaauuaggcaugaauucuaaaccuuuugcuguuuaaaaguuguccugauuucucauuuaggaguagaaugacgggcaguuguuaucugaaggaauggcuugcucaauaucaaaaggaaugugauaggucuuuugacaugguccugcuuccuuuuccacuuaggguuaaauaaucccauguugcuuuuagguaugcaugauagauacuuaauauuuuuacagcaaauaggaaaaucauuaagauuuugcuaauggcaugaauuuauugucaagagucaggaaugagcagaaaguguuguaucuuuauggugaaaaaaacccaacagcuaugccaaaacaaagcucauuauuuugaaccaauggucagaugagcuccaguggucagauggagaauaaaaauaguuaauaucauuuaaugggcuaauucaaucaguuuccuggggguuaauuuuaaagaauaguuauagcagauguauguauuauaacauauggauagagaauaguugucucuaccagaagaggauucuuaaaaaucuguuucagugaaacagggccaagaugauuaagcucuuaauaagauugaggugaucggccacgcgcgguggcucacacguauaaucccaacacuuugggaggccgaggcggguggaucacuugaggucaggaguucgagaccagccugaacaacauggugaaaccccgccuuuacuaaaaauacaaaaacaaaauuagcugggcaugguggcacaggccuguaaucccaccuacucgggaggcugaggcaggagaaucacuugaaccggggagguggagguugcagugagccaagauugcgccacugcauuccauccucagcaacagagcaagacuccaacucaaaacaaaacaaaagauugagguaauuguggcaacaccugccuuuuuuucuaagcugcaauucucuacuguuuucaagaaaaauacaaguuagccuauuuacagaauguuuugaauugacuccuguccucugguuaaaacuccucuugagauaauugauagcugaaaagguaggaugguucucucaaacuugacuuccaucuaaaucaacgcugaguugauuaacuuagauaucaagaaaaauugccucauuaguuuaccccugaggagaugccuaugaaguuacauccuuuuuacaauuaauaagacaguuuucacaugaagaaacaauuugaaauauuuaauaagaaaauguguugaagucauccauuacguuugggaaaaguaccaugcagccuuuuaucagaugauaacgauuuuauuauauuucacuauuuauuuugcccuguuuauuaggaaccucguagccaaauguaauaauguuugauuguuuuguauauuacucuuuauuucuuggcauacuuauuauugcccacacaugcuauuaucuuaauauuuccgugacucauauuuaaaauuuacugcaaauuuccucauucuuuguuugaaaguagguugguuuuuagaaaaagcaacgugagcacaguaacugcucuaccaugaaagaguucucuuucuuuuucuagacagacugacaaaaauuuuguacacugcagaauuuaauugcaauuuaauccuaguccaagauuggcauggcagucaguaagaacagauuauagcagcaauucucauuuugguauggguaacaaucacuuggggacuugcuuuuuuaaaagcaccuguagauuuuguuuuggccaucaugauuucgugauacagaacauuagaaguguuaaaaaaaguccaagagaaaggaugugugggagguggcccauucucuuaaaaagacacaaguugaguaaaacucaguuucauccuuacaaugaaaauugauugaaacucugaacuugaacuuuuuagccaguguguggacuuuauaauuugaaccuauacucuauuaagaaaguguuacagugcuaucuguggcugggugggguagcucuaauauuucaucuaaaaagucacaaauauccuauucuauagcacaauuuuuguaaaauugucuuaccuauuuguauuauucaagaaaugaugacuaaggccaaaaaaaaaaaaaaaaaagagagaaagccaaaaaggacuggaaggauauaaucaaaauguuaguuuaucuggguuuccgaauugauugguuguauuuauuauuuuuauuuucuacaauguauaaguguaacuugcaauaagaaaaacuuuaagggaaagcacaaauuuaaguuuagagaauaauguuucaguaauuaacaauaacaccauuuauugcacuuuuacaauaugccaaaagccauuaauuuguguguuauuuccucuaguauucucaacuacacuguauccaucaauguuauuuucuucuaaaccaaaacucaagaaaguauguauuauaauuuuuauaccauagauagucuagguaguauagcaaggcagaaaaagaauggguuaucagcaagaauuagccaugugcagcuaaauuauuagucaugaaauuauuacaggacucuucuuaacacauaaaagcaguaauaagaaccagacauuaggaccccuaaaucucaauaaauugaguugacauugugugguacucuguaguccaacuuuggugguugggagggacguuucuuaggcuaaugaagucaaaaguuagcuggcaucagaaucaccugaaagauaaauuuugcugcucuucacauggugcagaauaucugacucaguagugugagauggagcccaagaauuuucauuuuugacaaguuuugaguugaugcucugcaugcugcuaguuagggggcuauauauacuuugaacaccacuggccuaguaguucccaaaccugacauaaaaaaaaaagcaaaaaaacgaagacccuggagauuuucuuuuuuugcuuuuacggaaucuuagacccuauaauuaucuacugaaucgaaguaacuuaauuggcuguaugugucaguguacacuguacaaucagggcucauuggaccauuuuucauuucugaauuauuucgagcaguucuguuuguaaggauugaaauuucaugacuuauucuuucuuagggaucuucaaaagaauaaagaaaacugagcuauauuucucauaaaguuuauuugaucuugaaauuaccacauuggucuauuggacauuuuuuaauuuugaaauacguuuugggauuuuaguggucacauauuguucuuucucaaaacauucuccuauuucauuauuuuaguauuacucaucaauucucaacuauggucgaaagaauaaaauaauuaugauggaauuaggauuccaguaagacuuuccuaagacuuuaaguauuuuuuucaucuuuuaugaggucugcauccuaauuuauuugauacuguuuguaaguggacagaugcuaagggcagauguguauacaaaggugauuuggaaaaaaaaaugcaaaaaagaauuauuggguugaccauuugaauuguuuguaaucuaaaaaugaaaauauguuacaaauuauggagcaaagaagauuguuguccucuuuucgucaaaauaagccaugaaaggcuuaaaaauuccuucaaacauuguguuuuaaugacgcaagugcaaaaaaaaaaagcaggaauaaugacaagcuguaaccaauuugagauguaucugaaaucuggaagugguauuuacaagauggauauguuguagauucauacaugaaguuaguaagcaauuauuugcacucaggucgugcccauuuuugguguacaugacuuuagggaaacugggaauugaaauucggauuugcuguauuuauuucuuaugaaaauuuuuaacaaaguuuuuuuccugcugucuuuuugcucucuaaauuauucuucaagugucaugaaaauaaaggaaauaaaaaagccucuuuggacuuauaugauaaaaauauugaugacuguuuucccuguuauacugaagauuacaagcuucagaggagaauauaaauuuaacaggauugcccaugaauuaauuguuuaaagcuggaugauggguauaugaguuuuauauacuucucucaacuuuuuccuguguuugaaaugaucuguaauaaaaguguuggguuuuuuuuuuaauuuucccaugugaaucuaaugauuuaccaauguugggaacuacagguguuauuuauuuuugaaauuucagucacuuaaucugucagaggaucaccuuccucaucuguuucaacagaaagauguagaaaugcuacagucuggguugcagguggucgggcgauugggugaaggccuuaaccaguguaacugcuauagcuaccaugcacucugcacccacuaugcucauguugcauuggcaggagaggagagagcacuuuccucugcuccugcacuuggcuuugacguguaaagagacacuuugcucuagggauuuaaagacuugagcuaucuauagaaugugauuuagagaggauaccaaauuauuuaaaauaauggucauccucucaaguuagaaaacuauagaaucuaauaaaguugagaacauuugcuuacauaaacauuuaaaaauugaugguuaguuucaugcauaugauacaucuaaguuuuauuaguagccagcugguaauaguuuuuacaacuuuuaaaguuagcuaaguacagccauacaccacauaccauuuuggucaacaguggucugcauauaugccuguaugaugguggucccauaagauuacaguggagcugaaaaauuccuauuuaguggcauugcaacuguccuaacuugguaguacaauauauugcucacauguugguguugaugcugguauaaaccaaccuauuaccaaucuaguuuuauauaaccuuccagucauaaaaaaaaauacagcacaauuacgugcaguacauaacauaauucuugauaaacaauuauguuacugguuuauguauuuacuaugcuucuuauuguuuuagauuauauuacuucugcuuaaaaaaaguugacuguaaaacagccucaggcagguccuucaggagguaucccagaagaaggcauuguugucauaggagaugacaguuucaugcauguuguugcccuugaagaccuuucaguggaaaaagaugugacagugaaaaacagugauauuaccuugacccuauguaggccuaggcuaaugugugugugucuuagauuucaacaaagaaguuuaaaaacuaaaaaauuagaaauagaagcuuauagaguaaugguauaaagaaaaaacauuuuugcacagcuguacaguguccuuuuguuuuaaacuguuaguagaaaaggguaaaguuaaauuuuaaaauuuauaaaguaagaaaguuacaguaagcuaagguuaauuuauuaaugaagagaaaaauuuuuuaauuuagcguaaccuaaguguacaguguuuauaauagucuauuguaguggacaguaguguccuuggccuucaccuucacucaucagucacucgcucacugauugacccagagcaacucuuuguccuguaagcuccauucauuguaaguacccuauacagguguaccauauuuuaucuuuuacacuguauuuuuacuguaccuuuucuauauuuaaguauguucagauacacaaguacuuauuguuguauuacagucgcgugcaguauuugguauaguaacaugccgcacaggucuguagcauuggaauaauaggauauaacuguauagcucauagguguguaguaggcuauauaccuagguuuuuguaaguacgcucuugugauguacaaacaacaacgaaaucaccuaaugaugcauuucucagaacauaucccugucaucaguguaugauuguauuguauuuucauuguuaguaucauaaaaugcauuaguuacguaaguaauuuaaucucaccaggaaagauuccaacaauuaaagcaaaggcuuucaccgaucuaccugugugucuuuuuacaucuuuuucucuuuguuuacauauguauagucauuuaaaauacauguuuuuuucacuguuauaggaaaaauauaauuggaaucauguauauuuugcagccuuguuaaagugccuuuuggaguauauucuguauuaguauacauaggucuaccucauuuuuucaugacugcauuguauuucauaauauaaguauaccaguuuauuuaaacauuucaaaugucagaaucucuuacccaggacuuggaaauuacuaguauacagucacguuuaaucccauuguuuacuuaugaaguuuuaugaagugugugcaauugauugccuaacacuuauuuaauaggaaaccuuucccuaguauaggaaccaugagaguuuuguuuuuuucugguguauucugauuauauauaauauguguaaauuggugccucugugucugacuucauaaaacuucuugaaaguugccucauccccguaagcuaaaacuguuaaacaaaaugaaaauauuuagagcauauaacagccucuuuugcuggaagguuuuauagaaauaaaguugccagcauauuuuuagaagaguaacugcucccugacaccagaauggcuuauuuugaaaaauaagccaaaacaaauauacccuuagauaggugucuauaauauuccagcaaagggauugggauaggaaauuccuacccaucccuguuuuugcuuuggaugaaaacagucuuaagagguuucaauugauggaaaagauuaguauacaucauuucauuggccagacgugguggcgucugacugaaaucccagaacuuugagagccccaggcaggcggaucaugaggucaagagaucaagaccagccuggccaacauggugaaaccucgucucuacuaaaaguacagaaauuagcugaaugugguggugcacaccuguaguccagcuacucuggaggcugaggcaggagaacugcuugaaccugggaggcggagguugcagugagccgagauugcgccacugcacucagccuggcaacacagcaagauuccuucucaaaaaaaaaaaaaaaaauuaauauacaucacuuuggcugggcacaguugcucacgccuguaaucccagaacuuugggaggcugaggcggguggaacaugaagucaggaguucaagaccagccuagucaagauggugaaacccugugucuacuaaaaauacaagaauuagcugggugugguggcaggcgccuguaaucccagcuacuugggaggcugugccagagaauugcuugaaccugggagguggagguugccuggguggcagagccagacuuugucuguguguguguguguguguguguguguacacacauauaugcacacacaucauuucaucaacugaugaauauugagcuguagagaagaacgaaggauguguguauuuauuuaaaagccugcaaccuuugguagcaguuauucuggaaauuuguaacaucuauguccuuguacaacuguacccuuaaauacaagaauguuccuuggagcauuguuuguaauagagaaaagcuagaauuaaaaaaaaacacacacacaacagaacuguggcugugggugcugauaggaaaggucuccagaauaugugaaaaaagcaaaaugcagaaccauuuuucuggugagaaucucacuuguggaaaauaagcugagaagauauauauacguuuuauauauaacuagcuuuauauauguaccuguauuaccuagauauguauauaauuuuuggaaagaugcacaccagacucuuagcugaucacuuuuaggaaugaaauuggcaaacugaggaaggaagaauuucauuuaauaugcuuucauuuuuauauucuuuuuaaaguuguuaauucuuucuaagggcuuauaaaacaucaaaauuuuagcaugaggauucugcagguacugacuuguaaaaaauuuaguuguuggggaguuaccauuuucuguggcuuuucugcuuauuugcaaaugaauuagguaauuucccgaaucauaaacacuucuagaccacaauauugcaauguacuuuuuuuaccccuaucauugugaccugacuuacccaugaugcagcuucugauuaguuuaaaaugaacauaaaauaauaaaaaugcucaaugcgaaguaaguacuuagauuguggaauaguaauuuuggaaaaacucaagaauauucuuguauuaaauuugacagguacccuauuaaagcacucaagugaaaaaguucaacaggcuuuagaaagccucacauuugauuauuuuuauguuacuuugugucuuuccucacuuaucuagaaguuucaucguucuauagcaguccccaaacacuuuauuuuucuuaacuaucaucuuuguucuggagaaguauguuaaacuuugaguaaacuugucaauuauuuucuccccucuuuagacauagucaucuaaauaauagcaaauaacagcuauuuggcaguauagcaaccccuaaguuguaguuguagacuaaaucuuauaauuuuuuuuuuuuacccucuauccugauagauugguaggaagguuauucuaagguucuguucacccaauuccagguuggguugaggugcuagagguggauacugugccaggauauuggggugaaggugcagacuaauccucaagacauuugcuauagugaguauugaaguaucuuuuauuguggucaggaugguguuucagauguggcaacuuccagccacaugaccaugugguguuucuaugccaggcuuagggcagaggcaucugcaggcuuggcucuguacuuaccuaccaagauacuguacacagcuauacucccugugugguuuugcaugggcuuuucuagaugcuuuugucaggaagccccaguagcacuacucccuuuccccauuuacacacauaagugcaaacaugcauacaaccuacuuuauuuaaacuaaggaaaucuuucucacuugucgauaagccccucacucucucccuguuccacacaaacauuuuaucuguacuccaaucaacucauugucuuugcugugcauucaagacauauuguguuuauccacacuccuaucccugauuauaucuguacacugguuucuguaaauauugugcaauguaaaguagaaaaacaggcuauuucuucuuucugcuuugccacaucccucuucuggagaaaugaacacagagcccauuagcucuuuaacaggugggagaugggaggagggaacuaucaggagauauaauuuaccacacuuucuauuaauaauucuucugagucuguacuuuaacaguuuuuucagucuguuacugagcuucacaagauuuacaaacaguccauugcauguacuuuuuaccugcuucuugcuaaaauaagacugguggauaauuuguauagucaggaaauuugauaauucguaagucaucugcuaggguucucaacucuuccuguauucuugaggcauggaacacacucucagaaaccuguuuuaaagacgcaguuuaaaaaugaguccacaaagauucugauacgaccuccuugcugcuccucuguucaaaaaguacuaccugacugaauuuuuuuauuuuuuacaaauuuacuuaguucuauuuugaauagguagaauagucauaugggucaaaauucaaaaaguguaaaagaguauagacugaaaaggcuuacucuuuucucccaaccacucuuuccucccuccucagagaaccaauguuaaauucuuacauccuuccagaaauuuuuuaaaauaucuaaguacaauauacauuucuucauauauacaacauauguauauauguauguguauaauacauauuuuccccuuauuuauacaaaugcauagagcuguucugaacuuucaguuuuucagcucaccaguauauuuucaggaucuuuccauaucaguaccuaaagagcuuccucauucauuuuuauagcugcauaguauucuauuguauggauguacuuaauuaaccaauccuuuaccuucauuacugauaauuuagguuguuuucaaucuauguuauuaugaacaaagcuacagagaacaaucuuguauauacaucauuuuauacagguuuguauaauauacaaagguauauauauauaaaauuguauauuauaauauacagagauauauuguccuaaagacauauaaaguuacuggaguaaagaacauauaugugcaucauuuuaacagauacugccaaacugcucuccauagaaauuaaaacaauuuacucuccaaaacagccaugcaugaagaguuucuguuuauucacagccucagcaucagagaauguuauccaacuuuuugauuuuugucaguugaugaaaaaaugauaccuaauuucucugauuauuaaugguauugaauugagcaucuguucauguuuuaacauuuguaguuuuuauucugcaauugcauuuaacuuuauauuuggauuuuggauugcuggucuuuuuuuuuauuggcuucuaggaauuaucuguauuagcaggaaauuuucccuuaugcuguaaguugcaaagguauguuuuauuuaaaaauuuuuugucauucaauuugacauuuuauuuugcuaugcauauauaguaauauguguguuuaccuauauacaguugucccucaguauccaugaggaauugguuccaggacccccucuggauaccaaaaucuggauccucaaguccuuuauaugaaauuggauaguauuuguauaugaccuaugcacauccucccauuuacucucucuaauaccuaauauaauguaaauguuauguaaauaguuguuauacuguauugguuuugauuggcauuauuuuuauuguuguauuguuacuuuuuuuuuuuccaaauauuuuucauccaagguugguugaauuccagauacggaacuuguggauaggaagggcugacuguauauaguugaaauucugugucuuauaugagucuugaauuuuuguaucaugguuagaaaggucuuuaucucuccaaggcuauaaaugacuuuuccaguuuuuccaaugauugcuucuacaacuuuauauuuagauuauuugguacguuuuagaauuuagucugguauaggguaucugguauggaucuaacuucuuuuccuuuuuguaaguggucaccccauugaauuaguaacauuuuuuauuaaucuauuugggccuucuuccgaaucuuguguucugcuucguucuguuguuuguuuguuuguuuguuuuugagaaagagucucacucugucacccaggcuggagugcaguggugcugucuuugcucacuguaaccuaugccucuggauucaagugauucuccugccucagucucccaaguagcugggauuacagucaugcaccaccaugcccagcuaauuuuuguauuuuuaguagaggugguuucaccguguuggccagauuggucucaaacucuuggccucaaguaauccucuugcuucagccucccaaagugcugggauuacuggcaugagccaccacgcccggcccugucgucuauuuguauaucaguacacaccguuuuagguauucaguuccuauacuauuucaauauuugguuggacuagucucuauuuuugcuuauuauuucaugucaauuuuagaauuaacuauuauucuuccaagaaaaauaugcuuacauuuuccaucugaauucugauguuaccuccuuaaagugguaacaucuuauuuauucaaaauaguuaucacaauauauaguuaucuuguuaauuuacuuacauguuuuauuaucuuccuaucccacuagaauuacuucaugaagacagcaaucuuuuuuauuuugcucaucccuauauccccauuaccuagcacaauaaccaacacauaguagccccucaauauagauugagugggugaauaagugaguuaauuuauaaaauuuuugaaaacuugacaucaaaauaaagcuguacuucuuacuaaagggaguugaccacuuaaauaucaguauuuccugucuuccuauaaccacaagaagaagucauuauccuuuuauuauuauuaauggguuaugaauaguauccaaaaaccuuuaaauuagcuuacuccuuucuuuucccuuuaugccuccuauucuucucaaccguuuuuccuuaaguccauuauaauauuguucuuuugacuugacuucugugagaaaauacaguuccaaacucagugcgaauaaaaucuaaggucccacacauuuguaaaucaggagucaacuuuuguucauauacugagcaagguuaaagaaucagaauagguuuauaauguucauaagaaaacuguaaagaggggauacccccaaauugaggcaaguuucaaaagugcauggcguggaaugaaaggaaucacuuaguacuaaauaauaaagauagcaagguaugauuuaugaaauuaaaugaaaaaucugaugaacuuuuuuucuuuuucgaagcgggguuucacucugucucccaggcuggagugcaguggugcaaucuaggcacacugcaaccucaaacuccuggccccaaaccauccucccaccucagucucccaaaacacugugauugcaggcaugagccaccuugucuggccucaagacaucuuaagagucuugugaaauguuuugaccauguuuucuguaguugaauuuuauaaaacugaagauguuauguucuuguugaauuuacccuuuuuucccacguauuaucauuuaauuaaaauauucaaugauaugacuucuaguugugcuuuaguaauguacacuuauuucuacauaaguuagcuugcaauaaguucaaaucucuuaaaauaucagauccauauaauuuagaagaugagaaauauacaugaucugaacaugagaguacugguuuaauuuaaauuguuuugguguuaauaauguacuuuuuccccucucuuuuccuguuaaggauucuggacucuacuuauaauaucccuaacugcuggauucuccuguugcagcuuuucuuggacagugacuuacuuugauucuuuugaaccaggaauguuuccuccuacuccucuuucaccugccagguucaaguaaguauuccuguuuccuguuucuuuuuuaaaugcauuucaacucuugaaaauacuaaaauacucagaagcaagaggcugaucgugagguauguugagguuucagucuuuauaaagcacuaauaacaggacuuuucagcuuguaggcucagccuuuagauacaugagaauaauauuuaaaauucuauaucuagauaaugcuuuuuuuucuaaaaacugaaauucaggggcuuauuucacaaguaagaaccuuugauggcuauuuguccuuuuggaauagaauuugauuuaaaacaguuuauaaaggcaaaauuaauaccaacaauuugaaaguuuuacuagguucacacauggucagacuuacaagaacauaauaauuggauuggacuuuuccuuaggauuuuaacuuuguguaauaauuagcaaacauuuaugguacccaauuuauaugucuagaccagauuggaugcuuuucguaguggaacaguauuaaauuucuuuggucuauauuuuccauguuucagagaauuuuagaaaauucaguaguguucuaaccuaguuuauucaugccaggaaaguuccaauuuuaaauauaaauuccgaaauaagaacaucuaagaucucuaguuuauucuggaaauuuggggaggacaugaagacaagaaacuaaauuauauuaaauuuauguauguuauucuaauacuuacuauuguuacuaccaggucuagccuaccucauggacagguuguagagauaaaaacauuuacuugagagacuuuauaaaaucaaaauugugcuaguauaguuauuaauaaucauugguacuacuggccuucauuauuaguaaacucccaauuuuuuuugucucauaucuuuuaaaauuuuggcucgacuucaaaugaaaugugaauuuguauauauguguauuauguauauguauacauuuuuaguguuuuaaucccuauguguauaugaaauguaagucauaugcuuuccaauaaauuuuaguuauguguuuuugagguggauaaacaauaaucuaaauugacuaagaguuaagccuaacauuacaaugccaucccguaguuuacauggguaccacucaauuagaaguuuacuuuaauaacagguauaagucuaggguaaugagacucguuucaaaaaaaucaccaaaaaaguaaucguauuuuuuccuuuuauuuauaucucacuucccugaauucuagccacacauuucuugcuguuuaauagaccuugcuacccagauuucagaaagcauuuugcacuuagagugauuaaaacucugucuuugcuuugaagccaucaauauccacccauuucacucaccagagcuugaaauucuuauucauuguauuugucuauucaccaaguccaguccuuccugacuuuuuaaaugucauuagaaugcuuccuguuugcauuuucacuguuuuuguacuauuuaaggcuaguguacuugacuucuuggccuucuguccucuaaguucucacucuucuaauucacucuauauacagucagcccucuguauccaugggcuccacauccuugaauucagccaaccauggauaaaaaauauuugggaaaaaaauuacaauacaacaauaaaaaguaauacaaauaaaaaacaguauagacaacuauuuacacagcauuuacuuuauauuaggcauuauaaguaaucuagagaugauuuaaaguauaggggaggaugugcauacguuauaggcuaauaccaugccauuuuauauaagggacuugaacauucauggauuuugguguuugugggaauccuggaaccaaucucccaguggauaccaaggugcaacugaacugcugucuuuccauuaacaaaaagagauacagucacagcccucuauugguuaaaagccuucaguagcuuuccuguugccuucagaauaaaguccaacucuuaaguauagcagaacaguccuuccccaaaugacccuacccuacuuuuccaaccucagcuauuucccuacugcacccuauauuguagucacauaccagauuagcuugacaucccccucauaaacuaugcaauuuugagaagucaugauuuuacucuugcuguucucucucccuggauuaucauuuucccuuucauguugucuuuuaccacugucacgauucauuaaccuuauaaguguaagaagccucugggguuagagaagguuuuaguauucuguuaaagaucugcuauucugagggcauuuaacuaauuuuaaaaaaaauuaucuuugcauuuuguauuaaauuagaaucaauuuaauaaagggccucaauuuuccauguauuuauuaauguauuagucuguucucaugcugucuaauaaacacauacccaagacuggguaauuuauaaaggaaagaguuuuaauugacucacaguuccacauggcuggggaggccucacaauuaugguagaaggccaaggaggaacaaaggcacaucuuauaugauggcaggcaagagacugugcaggggaacugcucuuuauaaaacugucagaucuugugaaacucacucacuauuaugagaacagcagcauggggguaaccacccccauaauuuaauuaccucccacacggucccucccacaacacaugggaauuaugggaacugcaauucaagaugagauuuggguggggcacagccaaaccaugucauucugccccugaccucucccaaaucucauguccucaccuuucaaaaccaaucaugccuucccaacagucccccaaauuucagcauuaacucauaaguccacagucccaggucucaucugagacaaggaaagucccuucugccuaugagccuguaaaauuaaaagcagguuaauuacuuccaagauaacaauggcgguacaagcacuguaaauacacccauuccaaaugggauaaauuggccaaaacaaaggggcuacaggcccaugcaaguccgaaauucaguagggcagucaaaucuuaaagcuccaaaaugaucuccuuugacuccguaucucacauccaggucacacugaugaaagagguggguuuccaugauguugggcagcucugccccuguggcuuugcaggguacagccucccuccuggcugcuuucacaggcuggcauugagagucugcagcuuuuccaggcacauagugcaagcugucaguggaucuacuguucugauggcccucuucucacagcuccacuagguaguucccccguggggacuuugugugggggcucccaccccacauuucccuucugcacugcccuagcagagagguucuccaugagggcuccaccccuauagcacaccucuaccugaacaucuaggcguuuccauacauccucugaaaucuagguggaaguugccagaccucaguucuugacuucugugcaccugcagucccaacaccacauguaagccaccaaggcuugggguuugcacccucugaagcaacaguguacauugaccccuuuuagccacgccugggacacaggguaccaaguccugagacugcacaaagcagcaaggcccaugaaaccauuuuuuucucauaggccucccagcuugugaugggagaggcugcugggaagaccucugacaugcccuggagacauuuuccccauugucuuggcaauuaacauuuggcuccucauuauuucugcaaauugcuacagcuggcuugaauuuugccucagaaaauuguuuuuucuuuucugucacauagucaggcugcaaauuuucugagcuuuuaugcuuuucuucccuuuuaaacauaaguuccaauuccaaaccauguuuuugugaaugaauaaaacugaaugcuuuuuuuuuuuugggagauggagucuugcucugucacccaggcuggagugcaguggcgugaucuuggcucacugcaagcuccgccuccuggguucaugccauucuccugccucagccuccugaguagcugggacuacaggcgcccaccaccacgcccggcuaauuuuuuuuuguauuuuuaguagagacgggguuucaccauguuagccaggauggucucgaucuccugaccucgugauccgcccaccuuggccucccaaaguacugggauuacaggcgugagccaccgcacccagccaaaacugaaugcuuuuaagagcacccaagucaacucuugagugcuuugcugcuuagaaauuuauuccaccagauacccuaaaucaucucucucaaguucgaaguuccacagaucucuagagcaggggcagaaugcucccagucucuuugcuaaagcauagcaaaaaucaccuuugcugcuccaguucccaauaaguuccucaucucuguuggagaccaccucaaccuggacuucauuguccauaucaagaucggcauuuuggucaaagccauucagcaagucucuaggaaguugcaaacuuucccacauuuuccugucuucuucugcacccuccaaacuauuucaaccucucccuguuaccuaguuccaaaguuacucccacauuuucagguauguuuacagcagcaacccgcucuaccgguaccaauuuacuguauuaaucuguucucacacuguuaauaaagauauaccugagacuggguaauuuauaaaggaaagagguuuaauugacucacaguuccacauggcaggggaggccuaacaaucauggcaaaaggcaaaggaggagcaaaggcacaucuuacauggcagcaggcaagagagcaugugcagaggaacugcccuuuauaaaaccaucaggucucaagagacucacacacuauuaguggaacagccacauggggguaaccacccccaugauucaauuaccucccaccaggucccucccaugacguggggauuaugagaacugcaauucaggaugagauuuggguggggacacagucaaaccauaucaauuaguaauuagcauuuuuuguuuuuggguuuuuugagacaaggucugguuugguucuguuauccaggcuggagugcaguggcaugaucuuggcucagugcaaccuccaccucccaggcucaagugauccuccugccuccacccucuaauaagcugggacuguaggugugucagcaugucaaauaauuuuuuuauuuuuuguagagacaggauuuugccaugugcccaggcuggucccaaaacccugaguucaagcagccugcccaccuuggccucucaaagugcugggauuacaggcaugagccacugcacccagccuagugauccaguuuuaauaugaaauggugucauauuagagccuuagauuauguacuuauuaauaaaucuaaaaaugguuuugaaauguauauaaaauauauguuguguaugcacaaaugaauacaaaauauaaaauauaaaauauacacauucauuucuauacauacaaaauuuagauguguauauauauuuguguauguguauauauuuguauauaaauagaauauauacacauuauaaauguguauaaauacaaaauaaugcauauauauauuauguaguccuagcuacugggaggcugaggcaaaaggauugcuugagcccaggaguuuauuauacaaaauaauguguauauacauuuuguauuuguacaaaauaauguguacauguauacaaauauaaaugauauauauacccaaauauaagugaaauauuuacacacacacacaaauacaaaugaaguuguuuuauagucaaaacccugcccucuaguguuuauggaaaauaugccguuauuucagaaaugucagauuaaguauauucucuaugucaccaguagagugaguccuuguacagggaaacaacuucuccacauuuugagaaaguugaaaucuucagacuuuuauuuucuucaaaaucaaauugauauauuuuaucaauaugcgacaucauacuuuuauaaaaauaucuuugugacagguuauguauuuuaucaccuaaaauaagcaauaauauuaauguaagcauuuuuccuaauuauauaaaaguaauucagauucuuuauugaaaauuccaaaaaagaaaaagaaaaauggaaauaaucaaggaaaauuacugcugacauuuuaacauauauuuuuccauucuuuaugcauauuuuaaaaauugaaauugggaucacaauguauauacuuuuuuguaagagaguaaaauaaaucauauauaacugguuuguuaaaauaguagucuuuugcuaucucugcagacuuaaguaccuggguuuuuuuuuuuuuaacagaauaguugaagugggaaaaccauuugagaagaccauauuuacugugacuaucaauuguguuuccuuagaaacaaaccccucagaggaagaaaaaaaguaacauuuauuacuguuuaguaaauauuaggugacauauuuaaugaaaucaucaguuugggucaauaauucauaagaagagguugagauuagaaauaaaagcauuuuccuuuauucaaauuuuuuauguuuacuguuauauauuagauaaaucuuagcaauuuucacuuuuacguaagcacaagauguuuaggaaauacaagauagagaacuuugcaagauauauuuccagauagguacuuaauggacuucaacaggcauauuuuuuggaaagaugguuccauguauuuguaaacuucgcuaagucaaaagguauagugcaauaucacauauauaaacuugucaauuaguaagcuauccuuuucuuuguguauuuaauccaguagacuggauggaaagucuuguuuugguuguuauuaaagguuuguuaacaguguuaaagaacaagaggcagaggcaguaaguuuagauuuuuuggaauaucuaaauaggcauucccauguuucacuauguuauaauucauuauccugcuucuucuacacuaccuacucaacaucuccaguucauuucucaucacuuuucccuguucauugucuggguuuugugagugauuuccaagagacaaauguaacaguguauauauagucaguauuuuaacauuuugguuaucagcuuuaauuauaguuuucaggaguuaaugcaucuaacuauguuaccuacccguggaaaaauacugcaugcaaagaaaagcuagaacucuaaagauaaucgugggcugggcaugguggcuuaugccuguaaucgcagcacuuugggaggccaaggugggaggauggcuugagccuagaaguuugagaccauccuagucaacauagugagaugcugccucuacaaaaaauuuuaaaaaguauccagguguggugaaaugagccuguauuccuagccacugggaggcugaggcagaaggauuguuugaucccaggaguugaaggcugcagugagcuauuauaucgugccacugcauuccagccucagugacagagcaagauacgcucuuuaaaaaaaaaaaaaaaaaaaaaaagaacuuugggguucauucuaggcuuggccauuggcagcagaacuuuaaaguccucuugauugggaaaauguuaguuauggauaccagcugugccuuacaguacauuuuccugaacaagucuaccuuuuaagcuaauauucuaggauuucuagggaugucuuaagagaguccuauuaaacauuaugggggaacuaaugcccuccuaagccacccaucucguagguguuacuauuagucugguguuuccauuuuuuaauagaugaagaaaccaagucucagaaguuuaagccacuugcacaaagucaaguaauuugcaaguaacauaguuugcaacugacuguuuauuuuuauucaccauacuagcuaacuuaccuccucugcauuaugaaauucaucaucaauaggaggaauuucacuaauugaaacagcaucauuuuauugacaauuaacaggcacucugagcuuuugcuauguggcaguuuugcccccacaguauugcuaaaucaaaagacuuucucugucuuuuccauuguuuucuccuaguaccuguauuccacuuuaagacugcacuccacgguucacaucaccuaugcucaagcuucaucuaguggugaaaguauguagcugcagguuaauaguuauucagugugcuagaaauaaaaaccacucugauaauaaaugucacaucuaggauagaaauguuacucuauaguaauaagcuuaguggaaaaaugauaacaugagugaugggucguauugcugacaugaaaaaauguucacuauuuagaucaaacgucaaauuuaacagcauauacucaaauaaccuucacaguaggacauuaacauuguaggaauguaaaacaaccuggggauuccaaaauaagucauucuuggcaaguaaaguugguuuauuaauuuuaagucuaguuaauuuguauaaccuaagcauacagaguaaaguggcaagcgccccuagcauguaaugauuuccguagcugaaaucauugugaagggaguuacuaugccaaggaagcuccuuaauaggacuauuauuuuaugcuaaagauauccauagauauuuauuuccaaggaggaaaaaaaaucaaugcuuguauuuaaaguugugaggauaguucaacuauauaaauggaaauaaaguacugcuggaaauuucaaauugcaagcuuaugcugaucaaagguauauaaaaguaagauuucuggugaauuggauaucugaauccaaagcuuggauuguugaaucauccagugagaaacugauuuuaaauaauuuucucucuguuuugagaaaugcuauagaaauagcaugucuugcagucacagcauuguaguuuuuggagcaugucucaguucuuaaaucuucaguugacuucuaugcuaagagauuucuuauccugaaucuuacaagugaacaugagucuuuuugaggcauagauugaauuguuuugaaaagaaaucuccaccuugaguauaacucuguucaguuuaaugaccucgaacaucuauguuuaugcuaaaaauauuuuugaaaggcaugauuuaaaauuuuccuagauagcuuuuaaaagagaccaaaaccuucaaagucaucucacagauagucauuuugaauuaccagaagucaaacaaaauuauuauauuuuuaucauaacuagacucaguuuuaagcuacaguauucuucagguguccuuugaauaauuacauuugugcauuuccuaggcagauuggaagacacaguugaaugucuauuuuauagaagucagcaugaauuuacucuuacauuuuuagagaaauuugaaguuugguaucuucucuuuagauauauuauugguuguauuuauggcuuauuugauauaggguucauggccaaaaugcagggaaacuucaguuauuaguguuauaucaugauuucuaggcauaugccaagguaaagaguggugucuuuuuuucacaaaugccugcuaaaauauaaucuaugagauuagauugggaauuugcauuauuucacaguuaauauacaaaucagcggguaucugcuaccuuccucaugcuaucaaucuuuauugucugaucacuaugaauuauccaucuuuccauuucuucuucuuccaaccacaaauaacauuugauaaauauccagacacucaauuuuagaaaacaugcuuuuaauuuaauuuuuauuuaauguaacauuauuuauaugcauccuuguuuaaaaaaauuguauugccuuacaaugcaaucuggaaucugcaaaauaaauuguaagugagaaagaaaagggaacaaguuaauuuuaguuugaauuaauuuuugguaaauuguuuuuaguaacuauuuuagagaguaacaugaucuauuacucuuuuacauguguuacuuccuauguaaagcguucuguauguaauuagaugcuaacauuugugugugagaguguguuguuaacuguaguagggagcagcagauaguaaaauacuuugacaugugaauuuccuggaacauucaggauucaguauuggcauccuguauuauaauguuacuuuucuauucaacauuaguuugggucuuuaaaauauuguuauuaggguuuuucucugacgucuucacauugaggguuaggaagauagagaacaaauaaaacaguugaaucauaauaugcaauucaagaaaagggaacaaguugauuuuuguuugaauugcuugaaauuugaaauuuccagcagcacucaguuuucuuuaauacaguuagccuauccucauaacuaaauacaagcacugauuuucccuccuuggaaauaaguauauguggacaucuuuagcauaaaauaauauacgaguguuacagguucuuaacuugggcauauauauaagccuuggaggucaaaaacaguggguuaguuaguauucaaauuagaaauuucuuuuccaugcagacuagauuuaacauugagcacagugaauugacucuacuacucuuugauacagauuuuggagagcugccucuuugucgaaucagauucuuuauugccaugaacuaaugaaacagaugucagauggcuaauugcaguaggagagaaaagcuacugacaaaagagaugguucaggaacuuggccuugauauuugaguaucaugaaaucucauuaucuggggacuauucagagccaucaauuacagugcugucacuauuaaugaauauauugauggcauugcaccgcggcuucuugaaguaaaggguuaaaguacaugcauauuguguaagauauauuucauuacuguucugaauggagauaugcauagauauaacaaaauccucuaggaaauuguauuaacuauugguuuuauuguuuccauaaagugauacagcuaaugagugcuugcuuuguaccuuuuuuuuuuuuuuuuuuuuuuuuuuuuuuuuuaaagacagguucucacuuuguugcccaggcuagauagcaguggcaugaucuugggugacugcaaccuuugccuucugggcugaagcgauccucccaccucagacugcugaguagcugggaccacagacaugcgccaccacaucuggcuaaucuggcuaauuuuuguauuuuuuauagagacgggguuuugccauguugcccuagcuggucucgaacuccuggguucaagugauccaccugccucggccucccaaagugcugggauuacaggcaugagccaccuugcccagcugcucuugcuugugcuauuuacaguguuauauaugaguagcugaagagggacaaguguccauaugcccagagcaauacugacaagaaauacuugagagacagugcuugccaauuuuguacuuggaacccuuuuuguuuguuuaacaaccuauaaauuaccagaggcagccugauauaauuaaaaagggucuugaagucaggagagguagcuuccaaauccaaccuacccuagcagaaggacauuugagcaagucaguuaguauauccaagcuauaacuuccucaucucuaaaauggaguaaaaauaaugguacccucauaggcaguaaguguaaguuuacuaaagcaacagauacgucagaugauaaagcagacauagugucagagguuuucuuuucuuaagguuuuuugagcuggaagucugaccauggccugccacaaguugccaguuaucuuuucuuggauaauuguuauuuauccugagauuuuauccuuucuuuuuuuuuuuuuuuuuuuuuuuugaggucuugcuuuguugccccaggccgaagugcagaguggcacaaucauggcucacugcagccucaacugccugggcucaaacaacccuccugccuccgccucccaaauugcugggacuacaggcgagugcugcuaugccuggcuaaauuuuuuauuuuuauuuuguagagauagggucucacuaaguugcccaggacagucuugaacuccugagcucaagcaauccuccuggccuagucucccaaggcacugggauuacaggcgugagccaccacgcccagccaacaacuaauuguuaauauuaucucauuuaguuuuaauaagaacacuaaugaaaggaauuauuauccucauuuuaaagauugagaauuagauuuucugguagguuaaaauaguucugugacuaguacagccaugacuaaacuccagugaggagagagcuagcuuuccaggucuuucauucugaucauauuaaacaauugagcuuccuauucucuccauugucucuugcuucugcgcauacuguuagguguuuagaacacuaaaucccucauacucaauuuuaguucagguauuagcucuucuuuggaauuuuuucuccccuucuacaagcugaauggcuccuuuauguuccaguaauacugccugcaaaacaaucuacuacgucacaagauucuguuaucuucgaaggcaguacugacuccuuacucauuucucucucuuuuuuuuuuuccuuuuuuuguugguuugagauagucucacucugucacccaggcuggagugcaguggcaugaucuuggcucacugcaaccuccacccgcuggguucaagcaauucuccugccucagccuccagaggagcuaggauuacaggccaccacacccaacuaaguuuuuguauuuuuaguagagaugggguuucaccauguuggccaggcuggucucaaacuccuggcuucaagugauccacccgccuuggccucccaaagugcuaggauugcaggcgugagccaccaugccuggccaaaauuuuuuuuguagaaacaaugucucccuauaugcucaggcuggucuggaaucccugaccucaagccauccuccugccucagccuuccaaaguguugggauuacuggcaugagucaccgcauccagcccuacuaauuucucuaucuccuguauguaauuuaauaccugauaccgaguauucuguaaaucuuggugaaugaaaagggaauugagaaaguuauaaagaacuuuagaguaaaaaguaagaggcaaagucauguguguuauuuuuuccuuaaggagagacauagcaaagaagugaaauuagggaagcauucucuuuaaaauucuaacccugauuucuuaaauaacaauggucaaguucauugaaaucaacuuugucugcucuucagcaauuucuaacaaguaauuuuuaggacaaaaggauauaauaaaguuaauguaguuuuacguuucuaaaaaggaaaugcuuuuuaaguuaauaaaauacgguguugcuuguuuuuuuguuuuguuuuguuuuccaaguuucagguuuaguguuaagaucuuuugauuccagauaaagaacuaacugauaguaacuccaaacaaagcuuauacagcuuaaaaacuuuuagcaauuggagauuccugggcuagggauagaaugagaaaacaaaggcagcucagaugugugaaaggggaauagauuaguaccaucuugcucaucccuucucccucugagccaaucagacacagaaacgaauagccaguugggucuuaagaugggccuuuaacauaucuucuuauucuggcaagcacagagcgcuuucugcuuaaagcaguaucagcuggaaaugaaguuauuauuuuaaauuacaagaguucugucauaaaagcaucucugacaugugggaauaccugugugggaaagaaaauacaggaauaaauauggcauggaacaauuauucuaacagaguggagucugguguuuaguauuguaguauagagauucaguucagaucaaccaaaacuagcauaaaaacaauaaacaaccugaaacaugacaagagaccugcucaguucuguuauucugucucuaacuuuuucuuuuuaagguaauuuauuuggaauuuuuggaaguugcuuauucagugcuuuaauuuaugcuucaaaauauaagaauguagucacuuaaauugccaaagucauugaauucauuugaaucuuauauuuuaaauguauuccauuccugaaaaaugaaaauaauuauaauucuuuuauaauauauucacuuugcaaguuacuauuuaauaguaaucuaaauauauugcuagacauuauauuuucacagaacaaagucuagauauaaauaauggaagucuggguucuccagugaauuauaaaagaagucguuauguaggaagaggguaauaucaagcagaaacacacacacaaaaacacacacacacacacacacacgcacgcacgcgagagagaccuuuaauucucccauuucuuucuuccaucuacuucuuggguuugcuuuuauacuacuauuguuuguuucuuuguuuugguuuuaaagcaagcuuagguuuagguguuuuacuuggaagggagaaucuaaguagauggucagaagaauuuuuaaaaaucucuucuguaccuaaguuucuuuacuauauagcuaagauguauugaucauuuacuaugugccagacaccugguauucacaacagcuuuguaaggguagauucuauuuuuguuuccauuguauggagaagaaaauugaaggucaaagaggucaaacaauguugccaucuucauaccccuuguaagaggcaaggcuggcacucagacccguguuuaucuaaucauagagcuugaacucuuaaccacuaucagggacuacauaaguacuucauuguagaauuuuuuauuauugaaaggaauucucuagaaccagaaaaaggucauaccuucuauauagcuuaucuuucaggauauggaaguagaucuaaagaaacguucugguuuugccauuggguacucuauuuuacuacuuauucuuucauauggucaaaugaagagucacaucuuaacaauguugauuuagcagguuaaauuauauccauuaauuuucaucauagauaggucuccuuaauugacucuuugggacuaaaauauuuauauccucugcaucauuguucuaguuuuaaguacagguaauguugaccaauaaccuguuuuaauagguaaaaaacuguacauaaucuuuuugagguguuuuuuaggauuauuucuugcuaccugggauacuuacagaaauguagaacugagaccgagcgcaguggcucacgccuguaucccagcacuuugggagugcuggguggaucaccugagguuaggaguuccagaccagccuggccaacauggugaaaccccaucucuacuaaaaauacaaaaauuagcugggcauggugacacguguguuugugaccccagcuacuuggaaggcugaggcaugagaaucguuugaaccugaaaggcggagguugcagugagccaagaucacaccacugcacuccagaccaggugacagagcaagacucuguccaaaaaaaaaaaaaaagagagagagagagagaaaggaagggagggagggcggaaggaaggaaauggaaggaaauagaagcgaccuuagguucaucugguccaguuuuucuccugagaagcaugaaaucuuaaguuggaguuccacuucugguucuuuucuuucccuuuacacaauguaccucuuuugucugucaguccauugcuguaccuuuuaaaaccuggguuaaagcuuguaucauuaaggaaacuuaaccuuguuaauaauauugugugcucugcucguuuacauuuuauauccaguuaacacaaaagcauuuuaaagcaaaggaauguuuuaggaaaauucaucugugcaauguauuuaaguacauggagagaaugucagcaacuuagaauuucuuugugaauuuguuuuaaccugucacauucguauaugcaaauaauaauuguaguaacaucuccacaaauagucaugccauuuucaaaaauauauaagccuuguaaauuuugaaguaaaauggaaggucuucaaagugaaacauuucuaugauguugccaugaaaccgugggauuuuuuuucuuguuuuuuucuuuuaccucauucaguaaugcaguuuuaucuacuacccacuuuugaaguuuggcaguauuaauaauaaauaaugcuguaguuuuacuugaauggaaauuuuuuaauuuuuaucugaucaaguuucccacguuugacuuuuuuuuuauuuuuaguugacacauaauaaucauauucauuaguggaauacagaaugaaugauagucccauacaauguguaaugaucaaaucaggcuaauuagcauauccaucacugaaaacauuuaucauuucuuuguauugugagcauucaaaaucuucucuuaaagcuuucugaaaauacgcaauaaguuacuguuaaccauauuuacccuaaagugcuauagaacacuagaagucauuccuccuaucugaucguaauuuuguauccguuaacuaaccuccugcuauccucucucaccccacccacugcuguuucuuccccggcuaccccaccacccuucucaaccucgaauaaccacaguucuaccuucuacuucuaugagcucauuuuuuuuaagcuuacacaugugagugagaacaugugauauuuaucuucuuaugccugacuuauuucacuuaaugucccccagacucauccauguugccaggaaugacaguauuucauuuuuuuuuaauggcugaauaguauucuguuguguauauguaccacauuuucuuuauccauucaucuguugauggacacuuagauugaguccauaucuugacuauugugaauggugcugcaguaaacaugggguacacauaucucuugaauauacugauuguccuuucuuuggguaaauacccaguaguggaauugcuggauuauaugguaguuucauuuuuagauuuuugagaaacuucauacuguuuuccauaauggcuauauuaauuuauauucccaucaccauguuagacuauuacacagaauuucagaaauuauagucauuuugcuuuauugaucuaaauuacguaauaaagguaaguugcuucugaucaggcuuauucuucugggauuagguccuuuccuuucccuuaucuuucucuucaugaaauuguagaagaaccaaugaauaaaaauuacauauucucuauucagucuuuucaaaccccucuacccuucuguuaccauuugccuaacaguguuuuccugcuucagaguauggaaauaaaaagucaugaccugcaauaauaagaaccauuuuggaauccauaguagacuccaugaugaaacugaacaaaacugaaaccaagccugggcaacauggcaaaaccguaucucuacaaaaaaucagccagguuuggucaugcgugccucuaguaccaggguuacuuuuaggaaugccuugaguaaguuguccaggucguuggcauuuugaacaaagaauugaacaaaacccucaaaguaacaaaggaacaaaauacaugaacgaagcagcgacagcagggauuuauuaaagugagaaagugcuccgcaggguggaauugggcccgagcaagcggcucaagggccugguuacaaaguuuucuggguuuuaaguacuccuuuugaggucccuguuggcugccucucaucuggaugaaggauuuggucuuuugcuaauuaaaggcugaggugaauaggcacccuaugcaggauguuugcccuuuccaucugagauguaguggaagcgagaagguuguagggagaauaauagucuuugauccuuuguuacuccgguguggggagauggggcuuuuccuuucaguuuagcuuuaagaagugugccuuaauuggcuuuagguucccugcccuagacccagguguuuucccuuugauugaacuuuaggaaauuggccuuagauucccugcccccagaucuugguguuucucuuuuaggagguuagcacagauuggccuuagauucccugccuccagacccuauucuccugccucaccagcuacuugggaggcuggagugggaggaucaccagagccccgagagguggaggcugcaacgagccaugaucaugccacugcagucccgccuggguaacagagugagacccugucucaaaaaaaaaauaaaagcaggagacugaaaggaagccaccauucuuuuuacuccauguagauaugacagcucuuuugaaaauaagcugaaucuugauuacuucuacacugcuaaauaaaaaacugauucuuaggaauagggaggaagggaccuguaaagaauuaauuauagguuuuguuccucugaccuaaaaaugccuuauugguaaaacaucucaucaccaccacccacauacauacgcucagaaacauagaucuguuuuuagaugcuguagucuauucagaugccuuuuuuauuucuguaucaguuuacuucuuuuuaaaauuacuuugauuuuagguuaugauuugaaauuuuagaauauuuauucuuuuugcacauuuauuguaucaguugaacugaguaucaaaaugccaauuuucuaccaagaaaaauccuauugaacuacuacugagaucucauugaauuuauagguguuuauuaaaaaaaaaaagaaauugacaccuuuacaaugcugaguauucccagguuaugguggagaccucccuucauucagguccucuuuuuuuuuuuuuuuuuuuugacggagucucgcucuguugcccaagcuggagugcaguggcgcgaucucagcucacugcaagcucugccuccuggguucacaccauucugccucagccucacgaguagcuggcacuacaggcgcucgccaccacgccacgcccagcuaauuuuuuguauuuuuaguagagacgggguuucaccauguuagccaagauggucucgaucuccugaccuugugguccacccgccucggccucccaaagugcugggauuacaggcgugagccaccacgcccgguccagguccuuuuuaaugucugacaguaaaguguuuuuuuguuuuuuguuuuuuuuuuucauauaauuuacauaggauaaaacuuuacucuuaaaaugauuaaguauuuaauauuuucacuaaaaacuacugaauaacaauauucagcaaccaucacugcuagaacauuucuaucacuccaaaaugaaaaccccauacccauuagcaaucacugcaccauuuccuccugccucuauccccuggaaacccauagucuacuuuucgucucuauggauuugccuauucuggacauuucauauaaauggaaucguacagauuuuuuuuuaauguagucuuuuguguuuacuccuuucacuuagcauacuguuuucaagguucauccauauuguggcauaugucaguacuucauuccuuuuuaaggcugcaugguuuuccguauggauauaccauuuuuuaaauccguucaucaguugauggacauuuggguaguucuacuuuuuuacuauuaggaauaauguugcuaugaacacucagguacaaguuuuugugugacuuguuuucaguuuucuuggauauauaccuagaguggaauuguugggucauauguuaacucuguguuuaacuuuuuaagaaaccuccaaacuguuuccuacagcagcuguaucauuuuacauucccaccagcaauguucaggacuucugauuuccccacauccucaccaacacuuguuuucuuuuucuuuuuuuaaauuauaaccauccaaguagugaguaagaugugcuauaucucuugugguuuuuguuuuccauuuccguauaacuaaugacauugagcaucaucagcuuuucauguccuuauuggcuauuuguauguaugugggcggcaagccacccaggugccaaggcaagagaccgagggcaugagcuguuccacuauaauaaaauauauaaaauaagaauaguuauacuagauauagaucauagaugugauuauauaugaauaucauuaaucauuaguuuguagcaauuacucuuuauuccaauauuauaauaauccucucucuacaaucauaaccuaggaaaaaccaggccauacagagauaggagcugaggggacauagugagaaguaaccagaagacagaaugggagucuucuguuaugccuggccagggccaccagagggcuccuuggucuagcgguaacgccagcaucugcgaagacacgcguugccaagcggaccauggucuagcgguagcgucaaugccaagggaaaacaccugcuacuuagcagaccgggaaggggaguuucccuuuccccgggggaguuuagggaagacuguacuccuccaccucuuguggagggccugacauccgucaggcccgccugcaguuauccggaggccuaaccaugucccugugaugcugugcuucauuggccacgcuccugguccacccacuuucauguuccauccuguacaccuggcucugccuuuuagauagcaguagcaaaauuagugaaaguacuaaaagucucugauaugcagaaauaaugacauaagccugucucucucucuuccucucucucucugccuuggcugccaggcagagaagggcccccuguccaguggacacgugacccacguaaccuuacauaucauuggagaugagucacacucuuuacccugccccuuuugcuuuguauccaauaaauaacagcgcagcuagacauucggggccacuacuggucuccgcgaauuggugguaguggucccccgggcccagcugucuuuucuuuuaucucuuugucuugugucuuuauuucugcacucucucaucuccacaaauggggagaaaacccaccgacccuguggggcuggacccuacauguguauaucuuuggauaauuguuuauucaaauccuuugcccuuuuaaaaauuugacuuuuugucuuuuuauuuuuuacuuauaagaguuauuuuauaucuuaguagacucuaucagauauaagauuugcaaauauuuaccuccauuuuauggguuuucacuuaauaauguccuuggaagcacaaagguuuuuaauuagaugaugucuaauuuagguuuuuucuuuaguuucuugugcuuuuguugucauaucuaagaaucuguugcuuaauucaaggucaugaagauuuauaccuauguuuccuucuaagaguuuuauagucuuaguucuuguauuuaggucuuuggucuauuuugaguauauuuuguauauuguguaagguagaggaccaaauucauucuuuuguguucaguguccuauaacacaaaaaauacacauuaauuugagaugaauuacagauuuaaauaucaaaagaagaaaaguaaaaccucauuaagauacagaauaucuucauaaccuuggaguagucaaagauuuaaugaaaaagccaccaaaaaagcacuagccauuuuuuaaaauauuaacuggacuuuauucaaauuaagaacuucuguucaucaaaagaucuuauuaagagaguaaaaaaagacacaccauaauaaacauuauuuacaacacguaucuuuaacaaaagauuuguaucuagaauacguaaagaacucuauaaaccaauagaaaaaaaugagaaaaaguuuugaacacaaacaucaaaaaagaggcuuucugaauggucaguaaguacauuaaucaucagaaaaauaaauauuaaaaccacuacaacauacucugcagaccuacuaaaaugguuaaaauuuauaacacugauaauaccaaguguucauggugauguggaacaacuuaaacucauacguugauaguggaaguguaaauugguacaacuauuuuucauacuuucuacuaaagccuaauguauaucuaccuuguaacucagcaguucuacuccuaggaucuauccaagagaaauaagugcagauucccaccacccaccgaagacguguucauaguaccuguauguauaggagccccaaacuggaaacacccaucaguaguaaaauggguaaauacauuuugcuauauacugcaguagaaaagaacaaacuaauacuacauacaacauggaugaaucucacaaagacaguacugagcaaaagaaggcagacgcagaaaaauauuuauuguaugaugccauguagauguaguuucaagagcaagugaaacuaaucuuggugacagcccucaguauugcaguuaccucaagaucugcaggagguaaguugaauauuuaaaagggaucuuuuugcagugccagaaauguucucuaucuuuaugugguuggugaguauaugagagucuaccacaguaaaaaugcauugaacuguauauaaauguuagacauuugcauuuuacugguaugcuuuaauuaaaaaagugaaaugcauguauagauauagauuggaugagguagacauuguauuuaauuaucauuuauugaagauauuaaacucauuaauugaagauaauauuuucauuuuacuugagucaauuuuaaauaaguccucuauagaguuuugacaaaggagaaccauaauuccuucagucuuuguuaacagacuuuagagaucacaaaugagagucacaagagagaaagccugcagggauugucugucuuccuccaaagaggaaaaucauggugaauauuuugaaaagcuuuaaauuaaagcaagugauucuucaaagauuuaaguccuuuaccuagcaguagucugugacaauugcuacaguguucccagugggaauaugguacauuugagaugacaaagacuaggaaccacuacucccgagcauuuuuucauugccauuaaaaugcauugcuuugccugcuuaguaaggaagucacugaacauuugagcauguacaucucaguaaaauucaauucuaccaacauuguaguugucggcuuaguaaacugaacuuuaaagguuuuucuauuuuugugggauugugaggaucacaaacuacuaaaacagaacaauuaacucuggaaaccuuuugaugauuaacuuuauugggugaguacagucaucccccuuuaucugugaaggacugguuccaggauuccacacagguaucaacaucugaggauacuugaagucucauucaaaaauggcuuaguauuugcauauaaccuaagcauauccucucauauacuuuaaaacaucuccacauuauuuauaauauuauaccuaauacaauguaaauguuauauaaauaguuguuuuauuguucagggauugacaagggaaaaaaguguauacauguucuguacggaugcauuuuuuuuuucaaaauauauucuaccugcuugguucauuucgcagauguggaacccacugauauggaagaccgaacuguauuaauuuaaaaguuuuuuggaucgucacuaaauauuuuaugaugaaugauaaugcugauuguucaacuuuagguuucuguucacuagucaucaacauauauuugaggaauuucuuuuuuaaagggacaaagcauuauaccuauuuuacgauguagauagguaauauagguagguagauuaacccuuaauaacacaugagaagcaucuuugacuagcccuaguuggguaaagaaagguugagucgaaaguaaauaauaacucccuuggaacagagcagggaaccaucaggaagcaucagggucuauguagcuucagaugaaugcaaagggcucuucuuugaagaauguaccuucuucaaucucugccacagauauugugcgacuggaaucacuaugaggugcucuucaaguguuaguucacagcuaagugcuucucuggcuuuggcuacuccuuaggaaaggaggagaggauauggguauuuaugaccgucucaguccagggcccuuacugcuuuugucuuuuggcuuuuacuucugcuagugcaccuuccuguguguccucaauuuguuuugcuccagaaaggagaguauucuguucugccuucuagagagucucaguuggauacuaccuucuuuucuuuuuaauaugucugauucuuacuaggauaagcaaauaguauuauugcaauacaguuagugggaaaaacuguuguaagauuguuacaagauaaaggaaacaaaugucagggaauauucaugcacauaagaguuauuaaacuaguuggcacuccuagcaaucauaaaagagaugugucuuugcugauucuuaagaacucauugaaaaccacuucaauuaaguaaccuauuagaaugauagcugaaauaucuaugaaagacauagggaguuccuucauauaaccuaaaaguggugcaaacagaacaaauacuugaaauaauauguauuuuaagucaaaucaaaguaagaacagacagcauggaaacacaccgcuaauuaaugaaagaacuguuuguaaaauaacaaaacuuauaccuuagaauuagguuauggcuacacacagugacaaugaaacacaguaaagaaauaauagggaugaaacucagcauuacucaucaguaaugauuugaaacaacuguaauuguuaaccaguacaguuuugacacaggacuuaauaagaucuauccacuauuuauccugcagauguccaauauucuuuaaguuuuguauucauaugugaacauuugggaaauacacuccaaggucauaaguauuuucgaugaaaacuuuuggugucuuuguuauaccacguuacauuuuucuuuuuugauuuguguuuuucuuuuuuucuaggaaacugacuggacauucuuuccacaugggcuauagcauggcgauuuugaauggcaucguagcugcucuuacuguagcauggugccucauguaaacccacacuggagcgauauuguuggcaaaacuuaaucaugauuguuuuguaauaacaagaaggagcaucacugucuacucagaagacugagaaaccugcuguucauuauguaguucagauauuuaucacaaucauccucauuauggaagaccuuuuaaagcauuguuuuagaaugucugaguauuaagauacagauuaauugggaauaucugaguauuaaguacuuucuucagaguauaagauguuuaccucaucuuuuuacuuuuguguguguaguucuuucaaguuguaggaaacauuuuaauggaauuuaaacucaaaaacuugaauacaggacaaugcuugccuuuucauguauguacuacauuuuuugcuaagaaauacugauauuucuguuuaguugagcuagaaauacuucuuauuuauacauuuaggaaagcaaauaaugccuacuacuccgacuuuuauagaagcuacuuuuaaaucagaauauuuaauuuuugauauucauauaauuaauagaaguugcauuuauauuuuuuauggggcauaguuccuuauguguuuuuuuaauguauuuucauacuacauacugaauuuguauguuuuuaaaauuguuacaucuagacaacuguaaacauuauuuuuuuagcuagugcaaaccuaguaccugccauuuuuacuaauuuuugucuuuaaaaaaagcaaaaaagcacauugaccuaaguugaaaauuaaguaaguuuauuuuuaacaaaaaaugccugaaaaaagcuaaauuauuuaagucauuaagauauugagaaaaaauuugaaauuuuuacuauuucuguuuccacaauuccaaauauuuaucuugguguauauauuguuacuuuaacagaacuugcauuauuuuguuuuuaauaaauauaaacaugaaauuuuuguaugugagaaugauugaacuaguuuguucuuaaucucaaaaauuuaguuaccaaaguagaaaagguauuuugauacuagauauuaaaaacuacauauaguuaauauaauuuuauaauuuuuguaauuaaaugugcuccuguaauugugauauuuuguuuucuaaguaauuaagccuuaauuuuuccccuauguuacuaaagacuuuuaauguuuagaaaguuaccucaguuuuagaaagauggacuacuuacaaagcuguuuucccuggccauaggaaaacuuacaauaagaaaccauuaaguagucaaacugcuuauucaggcuaagugggaaaugaauuugugcaguguguucccuuaauuaucuacugaauguuguuaccgacuaaacaagguuucuaaaagucucgcauuucuuuuacuauucaaaacucuuugguuggaaaugacuaauacugcuccaauuuaaauuaucugaaauguguguguguguguguguaucuaaauaucaaucccauggcuuaaguauuccuaccagaguggugguugccaucagucuauuuucacucccugccuuccuuccugcacgcuuaaacucuucacccuuugacuccaaagagcccuuucauugcaaagauguacacaaguaacagaaucaauuuaucuucucuccaccacucuguauucccacgcaccaccaaugugaguaacucccuccagauugu

SEQ ID NO: 13199 - RNA, 1827 nt, Homo sapiens
augaauuguuuuaacuuuguaagaaguaaauuuuuauuuuuuucauuaucauacagcauuuaagaauaauaaagccauuaugagauuucaaauuugagauaucuauggcaaguuuauaaaaguacauugaucaagauauaauuuuuaacauuaauauacacauuccauaaucucaauccauuuaacaugaacacuggccuuugucauuguuauuuuuuucucccugcaauauugccugcucuguaggacagugguucucaguuggggguugacucugccccccaggggcaucuggcaacaguugguauaauugugggugucaugggagaggggugcuaacagcauccagugcgcaguccagggaugcuguucaccauccuauaaugcacaggacggacccccaccacaaagauuuuaugcagcccaaagguuaagcaacucuugucgagugagacucaauucccauuuuaugaacaccucugugcccacuuuaauucugaaaacagacugugcuaauuggcaaauacuacuuaaaagaagguuuaaccuaaucaauaucucuuaucaaaagcaauggcugacuugaaguaucaacauauuuccagaauggauaaaccacaccaucaacucagaaugauacaaauuaggguccauaucauuuaauuucccuugaaccugcuaugcuaguuuaaucuguuaauaugaaguuaauuaggacuguuuugaaggagcuaagcaauaguuuccuuugcacauuuuucugaacuaugauaaaaauuuaacgauacauaaagcaccuggaaaauaacagugcucugcgagugcuccggaaauguuuaucacagcuuacuaaaaacacggggcuucacucauuuguucaaauuugccauaagcaugugugucugcacagguuaaauuuuuauuugcucucacucauuucacaauaaucucucauaaaugucguuuagaagcagaacacauauacaaggugugugauacaaaauuauaaguuauuuuuuuccacacaaguuguaaaguaucaguguauauaauacauugaugauaguaaacuaaauuuaaaugaaaaaagucauucuaaauuuguuaaguagagaaauuuuucaguaaucauucaccuacauauucacauucuguauauuuucucauggucaacaaacugauucaaaugauuuaaguuaucccaccauuuaaagagaaaagccucugcaauaauuugaaaccaugacguuaucuuaauuucacaauuggcugcuuuuuuccccaaguucuuuuaguucuucuuuugacacauaacaauagcuuuuaaucucacugggaucuggauucaaaguuacauucuuccucacaaacaaaauguaaucaauuucauguucaccucagauaccauccgacugagcuuuguagugaauuaguguuaaauaauuaauuucuucuggaggaaccucuuccaagggaauuccuagcucagcuuucagcugccucugugcugcucuccucacuccaaggccaucauuuuccucaaguucaccugguuuacuuaauagauaacuacaacaaguauuaguaaaacaacuuggaaagguaaucuuagcaucugaucuuugcuguagcagaagcuuauuuucaguguugaauaagaagacacuaaaagcucaaugcaauaacccuuucucaauguucucagccccaauuuuauugucauuuucaucaauaaguguacacaucucugccaggaguugaaccuguugcucguugagguggucaguguuuauuucaggcaucauuacacaaugucugaucuguccu

SEQ ID NO: 13200 - RNA, 1827 nt, Homo sapiens
aggacagaucagacauuguguaaugaugccugaaauaaacacugaccaccucaacgagcaacagguucaacuccuggcagagauguguacacuuauugaugaaaaugacaauaaaauuggggcugagaacauugagaaaggguuauugcauugagcuuuuagugucuucuuauucaacacugaaaauaagcuucugcuacagcaaagaucagaugcuaagauuaccuuuccaaguuguuuuacuaauacuuguuguaguuaucuauuaaguaaaccaggugaacuugaggaaaaugauggccuuggagugaggagagcagcacagaggcagcugaaagcugagcuaggaauucccuuggaagagguuccuccagaagaaauuaauuauuuaacacuaauucacuacaaagcucagucggaugguaucugaggugaacaugaaauugauuacauuuuguuugugaggaagaauguaacuuugaauccagaucccagugagauuaaaagcuauuguuaugugucaaaagaagaacuaaaagaacuuggggaaaaaagcagccaauugugaaauuaagauaacgucaugguuucaaauuauugcagaggcuuuucucuuuaaauggugggauaacuuaaaucauuugaaucaguuuguugaccaugagaaaauauacagaaugugaauauguaggugaaugauuacugaaaaauuucucuacuuaacaaauuuagaaugacuuuuuucauuuaaauuuaguuuacuaucaucaauguauuauauacacugauacuuuacaacuuguguggaaaaaaauaacuuauaauuuuguaucacacaccuuguauauguguucugcuucuaaacgacauuuaugagagauuauugugaaaugagugagagcaaauaaaaauuuaaccugugcagacacacaugcuuauggcaaauuugaacaaaugagugaagccccguguuuuuaguaagcugugauaaacauuuccggagcacucgcagagcacuguuauuuuccaggugcuuuauguaucguuaaauuuuuaucauaguucagaaaaaugugcaaaggaaacuauugcuuagcuccuucaaaacaguccuaauuaacuucauauuaacagauuaaacuagcauagcagguucaagggaaauuaaaugauauggacccuaauuuguaucauucugaguugauggugugguuuauccauucuggaaauauguugauacuucaagucagccauugcuuuugauaagagauauugauuagguuaaaccuucuuuuaaguaguauuugccaauuagcacagucuguuuucagaauuaaagugggcacagagguguucauaaaaugggaauugagucucacucgacaagaguugcuuaaccuuugggcugcauaaaaucuuugugguggggguccguccugugcauuauaggauggugaacagcaucccuggacugcgcacuggaugcuguuagcaccccucucccaugacacccacaauuauaccaacuguugccagaugccccuggggggcagagucaacccccaacugagaaccacuguccuacagagcaggcaauauugcagggagaaaaaaauaacaaugacaaaggccaguguucauguuaaauggauugagauuauggaauguguauauuaauguuaaaaauuauaucuugaucaauguacuuuuauaaacuugccauagauaucucaaauuugaaaucucauaauggcuuuauuauucuuaaaugcuguaugauaaugaaaaaaauaaaaauuuacuucuuacaaaguuaaaacaauucau

SEQ ID NO: 13201 - RNA, 158852 nt, Homo sapiens
accccacauuuaaaauucugcucuuaucucuaaaugaggcuguggaaauaguuacugaaguauucuuuugcuaagaauuaguugacuaauuguaaacacucaaauuauacuguaauuuuuuucaaacuuguuuuaguauuuauuaguuaggaaucucaaaaaguacaaaauaaaaugguccaggcaucucucaaauuuuacaaggcuuugguauugcuugaaugucccacaggauacaaaauugagcccauuuacaugguuguaaauugcuuuggcauucugaauuaaagacauccuacaaaugucaaugauguacugaagaucuagcucuagaaagauagauuggcauuagugccaaagggaaauaaauggagaaagcuguauuaguuuccuauugcuguuauaacaaauugccacaaacuugguuguuacagcaaugaaaauuuauugguugacaguucuggaggccagaaguugaaaaucaacaucacuaggcugaaaucaaggggucagcagggcugcacuccuucuggagacucuagggagaauccauucuguguuucuuccaguuucugguggcugcagaccuuucuuggcuugugucugcauuacuccaaucucuguauucauggucacucugucuucuauucugcugugugcauacaaucuuccuauuacuuuucucuuuuaaggauaaguaugauugcauuuagggcccacacccauaauucaggguaaucucuccauuucaggauacuuaaucacaucuccaacucccccacuucuccccacugcugggcccaauaagguaaaauugacagguuccagggaucagaaugugaauaacuuuggggaggccauuauucagucuaccauaguguagcuucucagucuuugcuuuagcucucauuaggcugcagacuuugcuuucuaccuacugcaacagcaggacccaaaaggacacccuauguaaagugaaaggauacccuauguccagggugggccucauggugaaaaaacuagaauuucaaccuccagcauucugagacccacuuuaggaaggccaccuuugugagggcaggacuuuugcuguauuucaauacuauaagaggaccagguugacagugaagaacacaauaaaaauuggcuuguaccacauuugacuauugaaagauauuuuuuagaauacacauuacucuagauuuacuagaauaaaaaaguuucuagaugcccugacaccaguuucuagcuauuucucauaugucaaguuguuucauucucagaagcuuggcuagcaguuaggcaggaagggaacaggauuauuuauuuacagcguggccuagagaauuuuuaaauaauacacuucccauuaaauuguaaaauuucuccuugauggauguuacauuuaaccauucucuccuucuacuuuacgccucccuaaagagcucuuucaaaaaugaacuuuaauuuguaacugaaggauaacagaacaaagauucucugcuuuccugucuuccauuuuucaggcuuuauaugaugauuuugcugauagaggaggaaugaaggagauuugcuuuucaggccaaggaacagcaccuguuacccucuggccuaugcucugugcguguaaaaaacuuuccucuuggcuuagcagaaauuaggucaaugccuacauguuugaaggcuaagauacaacauccucacuuuaaagcuaaucauguacagacauaaauccugucuguugcuauuguuaugcuguuuuugcuauucaaauucauucauuuucuuuuuuuaaaaucauguuauaacauuauaaacaguggucaaguuuauuuuaagcauuuacugcugagauuuaaaccauuuccagguuauauaaaauguauucagaugugggacugaacaaaucuccaguuucuuggguuauuuaccauugguucaguuaccucuuucacuaggaugauaacuaagcuuuacucugaaaagcugaauucucuauuuuguuucagcucccacaacagaacuuaauacuuauucauguucucugcaagaguuucuugggacauuucugcuuacccacacuuuccugcuguuauuaaauagguggcuauguuccagagacaacauuauugaguuuacauuaugaaaauuuauaaaagcuaguuuucagugcuacccugucccagggacaaaguggauuccuguuuagggaaggaauacacauuuccuuuacccucaggccuuuaaaucuaaguaaguuucuuggugccacuuuauauugaugcuuuagacauuuauuuuaagaauacauucccaguucuuauaaagcagaaauaaaacuuaaaguacccauuuaaaaauauauuuaguauuuuuauuucaucuuuucaaggaucauauauuuucacuucauucuugauucuaacucuuucagaaucacugacauggaaagauuuucuguuggauauuuuuagaugucuauaacucugcuguuaagaauucguguaucaaguagguggagaucuaccaaaugagcuguucuuaucuuaagaucccaaagugauuggucugauccugcucaaggauuuaagauuuucuuggacagcacuguuaaucuuuuagauacucuauauuaguuuuguuuauugguaaguaguaaacuuguagucuuuaauuuuugguuaacuucuuaguguuugcaacuauuguuaacaauggauacgauuauguuagaugcauauauaacauaacuuucuaauucauguaaacuaccuaaacuguacccaaauuaaagaauauaaugaaaaaaauaugugaacauacaaagcucagaacaaaguguuuuggcaggauaugcuugugaucuagggaggaaaacugacauugguaauaguucuauugacaacuuauauaccaggcauuuuacaaauauuaucccacucaaucccaguuuggccaucugcuagguguggugucuucagcauauuacuuaauagguuuguaccuuaauuuccccauuugguggaaugaaacaaaagaaaaaaaaacagaaaaacaaaauacuuacauaguuaugcugaggauuaaggauuacaucaccuuguuaagacuagugccugagauaaaguaaacaccauaugaauguuugauauuaacauccuucacugauaaggauaccgagguucuggaaagcuagagaaccagaccaugguugaagaacuuacaagagaugacuugagcucacacaguguucucuauaccaagcaguuucucauuuuagucuuggcuccauguuuagcuaauguuguaauacugcugagcuuugguuuuguuucuuagaaaaugaaagugugggguuaacauuuacagcccaguucaguucuaguauuccauacauuuuacuuugagcuuugguaaccaaugaacacuuaccuggcuaugggaaaaauuuguuuuucucuagaaaugggcaaggacuaaaauaguuggcucuagacauguggugaucauuaaaaguacaugguagacucaucacuggaaaguacccacauggugggaaaaggucaaucccagaagcugcguuuaagaugucuuaguagcagguagccuacucuccaaguuugggaaggaaaaaacuucuugcucauuuuguuacaccaggauauaggugacaaccuaaauucgucugacaacacaacaaaaacaagauaaaugaaugguggaccaacuuaggcuucuguaagacagguaugggugaaaaagggaaagcuuuucagauuuuuguggccauaugaggaugaaaacccaugacuguccuugaguuuucuuaggcacaggagaaaggaguuagguggcaccaaaguuauuugacaccagaaaucugaaagacaguaaacauaguuucauuccaaaugcugagucauucuuauggggaagaagagaaacacuuaagacucucacuucccugaggucuuggucuucacuagauugccuucugcugaaauaauuacuucauguuuuaaaauuugguuauggucauuguuuccuuucucauaaccccacuuagucuuccuacacuuuuaguuuuaaaccucuuuauuuguuugauuugguuuuaauacuauaagcaaaaaagaagcaguagcaaguguuuguugagaagggaagguuuuuguuuuuugcuuuuuuuuuucaauauugucuguggagcuggcauaguaauuacugagagcaauuccuaaauuaaugauuaucucccacuucuccaugaaaguaucuuaauaaugaaaagaaagugcuuaggcauauaggaaauuguguuccuguuacauacucuaaucagcaaccaaacccuuucaguggaauucuuguuauauuaggagcaagacacagggcuagagauagggaggcagaaagcuacuuagauacucauaaaaagaauugucaaaaaaggcuuuaaaguguuauguauuaggcuagaaagaaaaauuuguuauuauauuuuauucucuuuagaaaagauucauggaauaaauagggcauaguguuuuauuuuauacgugucugcgugucugugaaaucuuuuuuuuuuuuuuuuuuugagauagagucucgcccuguugcccaggcuggagugcaauggcgcaaucucagcucacugcaaccucugccucccggguucaagcaauucuccuaccucagccucccgaguagcugggacuacaggcgugugccaccagaccuggcuaauuuuuguauuuuuuacuagagacaagguuccaccauguuggucaggcugcucuugaacuccugaccucaggugauccuccugccuuggccucccaaagugcugggauuacaggcaugagccaacgugcccggccaguaucuguaaaaucuuaaaagaaugaucauaaaccucuacauuuugaaauuaauauucauuaaaaauuuuuuaauuuccauuuuuauuuuagauucaggggcuacauguguagguuuguuucaaggguagauuguguggugcugagguuuggacuucuauugauuccaucacccacauacugaacauaguaccaaauuggaaguuuuucagccccugucccccucccuccuuuuggauuccccagugccuauucccaucuuuaugucugagugaaaccaugauuuagcucacacuuacaagugagaacaugugauacuugguuuuccguuccuacauuaauuugcuuaggauaacggccugcagcugcauccauaugcugcagcugcauccauguugcuacaaagugauuuuguucuuuuuuagggcugugcauuuuuaagaauuaacaacuuugaaaauaugcucuaaauaacuuaugcucuaauugcaagucagcaauguuuuauuggagaaaauuaucuacuauacaacaguuuccuauuuauuuuauucaagucaauaguugagauuagaugugugugugaagagugggagagugggaacuauagagcagaggugcacggucuugaaaaagaagauucagaguaaauuguaugcugaucaggugaagcuucuuuccuugucugugccaauugaccccacucucaugcacaccuuuuuccuucuguguccuuccugaaucccaccagaugccaacaucuuucugcuguccuuugguuguucugggccccaaauuuggcaagaggaaucacguccagugcuccugacuuuucucaggaaaaggugguuagugaaaccaccuuugcaaaauuaugaccuagacagugaaagagaucuaacuuaaccgacugcaacuuguuucuaaccuacaagcuguccuuguucauuccugggcguaggcugaacuaacuuugggaaaaacuuaguuuacaguuuauaguuuuaacaaaggugguaacagcccauucccaaagcagaccucccucuugccuggggacuagauugccuuuguaggacuaacagccacaaaagauuagaaacuaugguuaaggagucauucugacgcucccuaaacugcuucuaagaucagugcuugagauauuuugcagacccugcacuugacggaucagcugguaccaccuagaucaauaaacugacuccucugaccuuguggcccuccacccaggaacugacuuagugcaagaagacagcuccaacucccuaugauuucaucccugagcaaucagcacuccuggcucacuggcuucccccaacccaccaaguuguccuuaaaaaauccgcuccacgaaugcuccggagucugauuugaguaauaauaaaacucuggucucccgcacagcuggcuuugcgugaauuacucuugcaauucccuugucuugaucaaucgacucugucuaggcagcgggcaaggugaaccccuugggcgguuacacuagcuagcagugugacuaggacuaguggggaaaauaaucagcugacauaguauggauuggaccagaucgcucaccuaagcauucauuucaaaucaagaaacauuuaaacaucaguuauauucaggcacuaugcuaggcacuagaguacaaaagugaguaacugauggucccauuucccaagcacugaacugaucugggauaaucagugagaaggaaauccaggacuggcacccaacucaaccagauuauuccuuuucuggguaacauguugcauuucuagauaaaugaugaggguuugaaaaaaaugauaaaaauauugguuugauuugucaaacuaaagaaaaaagaacugaggcauacuuaauauaaccagucucaugauguugcccagucacaaguuuuuauuuauuuauuuuuugagauggagucucacucuguugcccaggguggaguucaguggugccaucucagcucacuguaaccucugccucccagguucaagugauucuccugccucagcuuccugaguagcugggauuacagguguuugccaccaugcccggcuaauuuuuguauuuuuaguagagauaggguuucaccauguugguuaggcuggucuugaacucuugaccucgugaucugcccaccucagccucccaaagugcugagauuacaggcgugacccacugcgccugcccggccacaaggaaguuuuuaaaggaaaagaagaggcaguuucuaaauuguuuaccaauaauuuacauaaaaaaacaaacuauuaauugucuauagauuguucuucguaucacaaauuccaggaacaugaagauaugguuggguagucagucaugaacaaaaugccuuuaaacaaucgccucugagcaugaguguggggggugcaacuuaugucccauauucaaggucucucugggccugauaaauuuugcauaccucacauugcucaaaugcucugaacuauuuuucuuuucucaacuacaauuuccuuuuucugguugcucaugauucaacugggggagcuuuuaaaccgugguucucaaacuuuaaugugcaucagaacuacccaaagggcuuguuaaaucuggguagcucagccccagccccagagucuaugaaucaggucacuggaguacaguuucugucaaguucucaggugaugcugaugcugcgggcuccagugacuacacuuuuagagccaguuuuaaaauacaaggacuugcagaucccacguccagacugacucauuggacuuggggauggaaaucuggcauuccaccccucccugcccccuccccccaauuuuaauguguccaagggugagaaucauugcuccucuguggacuauggaugguucccugaaguuacugaguuugggauuuaauaaauauaugcauuccucugggucaacuacaggaauucugcgguauuuaaggacauuaaaugagugacuuaauacuuuauuuaaaaaaauaccacugcuuuuugguucacacuaauuuucuuccuucuuuuggaaaggcauuuccguccaucuccuggauauuuuccaauaccacgauagaaagguuauuaguacagcacccagaggucuucggagcaaagcuguuaaagaagugggguccauuugagccccaacuuugccuuccuuagguccccuugggcuugucuagcccuaggaguuccaacaaguaagcugggcaugcucagugggcagggucguuuuuuuuuuuuggguggcgggggguugcaagugggaagccugcuguucagcugccggggcucuccgccuccccccaccuguaugaggcugggucuggggaaccugugcucagcauuccacccccuggagcuugggcuuggucuucccugcgggucccugcgcugacauucaggcggggagccaggaggccuggcgcgccuccagagcccgccgggggagccgggcgaggguucugggcucugacggcggggucgcagggucgcccgccuccuggacacgucuguaggccuagggaagccugccggccgggagguacagaguaggagaagccagaucccagggcggacaacgagaagucgucagguaagccagccccgccagcgugccggcggacgagugucuccucucccgcaggcagauggccagggcggcccgcaugggcgagggcacaggaaaucggacaccgccaccgucuuccccagccuggccuagcucaggcuuuccaguccgccagcccgcuggcaaggcggggcggaggucuggaguccggcaucgccgaggcacaaagcaggaacugcagccaggggcgagggcccuugcguguggcgcugcgcgaccccacccggcggcaggacccgcguccccgucuagucacguucauugggccacggagaccaccucgcucgccgcccgcuguuggcuuuucccucccacacccccgccaaccccggccccgguucccgcccccacuuccgcguuuccccgcugggccggaggagccugggcccgagguauccgggcaggagguggcggccucgccgcccuggucaggccuccgggagggagcaggcgcgggagcgggaggaggaagucgggaagagggaaggcgggggcgcggcccgcccggcgcucgaguuacacccgcccagcccgccucgagugacagccccgcgcgccucgcugggagcacccgggccgaggcucugauucuggggggaggccgacuccacccuggcuggaggaacugggugcuccugcccgcuggccccucgcgcgugaggaucuaucucaggugugugcuuccugggagaccccuucccccgccucuaguauucuagggggggaguggucccuuucugacccgggcgaguguucugggacuccagucuuggcgguaggugguggcgggaaacgggaaagauuuagaauuucuucccaccagcagaagauggauucgcucuucucuaggguuucguuguuuauguuuuggaggcggcauuuguaaaauaguaaaguggcaggacuuuuggggcgaggguugguaccccauugaaaguucaugcaaacuuuuagcuuguagaugcggcuagucugauaaggauuguugcucccuuccgaagcaagagugagaacgagucuggaggagggcugaggcuucuuugagaaacucagcugcuggcgugugaccguccuaggaggaaauggaaggugcacacugauaacuuaaaacagccuccacucccuauguaguaacuucuaccagcaaaaauagauuugcaaagagugcuuuggcaggaagguguagcugggugaaugaagugcugcucuuagcagauggucucuagucuggcuuccaccuugugcaguggaauauucacucccagaagaguuccagaguaauuuacaaacacaaauucuugcaaaguguuagugacaugggcaacccaaaucacacacaacacauuauaaauaucauaggaggcagcuauagaaauagcagcuagucaacuuauacuuguauaaauaggugagggaaggaaguuaguaagugacagggagucuuuauugcuaaaacaaaacuguuaguauuuugcauguguuccaaguuuaaagagaugugaaguuucuuuuuggcguguggacggugcuggcagcugucacacugggcccaggcacuucuucguagcuacugaccacucuagucccaguccuacaguucuugcuggcuaccacaugacaucuggaugccauugcccaauggagaccgugugcagucuggggaaccuugugauguggauguugaaaccccccucuguuucucacaggggcguuaugucaaauuacaacacucccuugacuuuuacaaaucaacucgugaaauaauacagcaauauuuuaaugaauaaauggguaaauaugggguuuuggguuugagaaccaacaauggauucauugcaacuguccauucucauagcuuauagagucacuuuauuuuauaaagaaauucuaaacagcauuagagcucugcuuccuucuuucucccuugugauucauucaaagaugcaauggcuugguucaggaauugacaaaagggccacaguguuaccaauuguuagugaguguuaccacccccuuuaguuuuuuuuguaacuauuuaaucucauuguagauauuuuaaaagauuugaugauuauugugcauaacucauguuggcaaacuauuauaacucugaacuuauccuguuugguuguuuucuuucaucucuagcguguaaguucuaugagaguagcagggcuuguucugucuugcauacuuucaaaacucuaaugccuggaguggugacuagcuuguaauacacccucaauaaauguuuucucaaugagugaccuccaaugccuagaggggugacuagcuuguaauacacccucaauaaauguuuucucaaugagcgacugaacuguggaacaaacuccagcugaggguaguuguggagcggggagccaaagacuuuggccuuaggucaucuuuuaaaacucagccucaauugucucauuggcaaaauauggauaauaaaugcuaugacguguguaaaauugcuagcaauguaccuggcaaguaguagacuucaaaagacuagcuuccauccuauauuuuuccuucuuauacucaaguaggaaaauaugggcaaagaauguaguuagcuugaaaauuugggcaaagaauucuugcauguugugcaugaauuauccguacauuuuuuucgguuaguugaguguguugggauggggagaggagaggcgaguuagugguagcuaugguuauuagagaagggaagcaauuuucagaucaguaucuaauuucucaguuuuaguuuuugaaugugaugauguuucuguuuagguuuuccaaaacuugauucuuucuguuugucaacaccuggacucauggggcuauccuaagugcagaaacaacacuucagaaagaggacuagaaaucaaauauaugaacacuagucuucuuaaaugaaauuuucuguauucuugugcagcauuauauuguguaauaagugcuaaauaaaaaaauaguuaaccucuuuugagaagcuuacaguuguuuaacaagguaaaacauagauggaaaacaauuggagaccaacauaagaccucguacaaucauuuuuccagugguaggauguuggccagaacugaugugauuaugaaggaaaagguuaauauuggcucaaguaguuggagacagcuuccuggugaagggaaugccacuucaguaacagagagacuuaacauguccugaagacuauuggaaagaucaccuuuguuuuaggaauguuugcuauuguguacuucauuguaugaaaaagccaacauaaucuuguacuuucaaaaaugaucuuucuguugaaaauuauaugggaaaucuucaguaaaauucugcauaugcaagaaaucaauacuugucacuaugucugugaaguuuaaagcucaggauuggcgugaaaaugguaacucuucauucuuguccaccuuuaacacacuugcuuaaaaaugugucagauaggccaggugcaguggaucacaccuguaaucccagcacuuugcuuugggaggccaaggcaggcagaucgcuugagcccaggaguuugagaccagccuggacaacauggaaaccccaucuuuacaaaaaaauacaaaaauuaaccaggcaugguggcacgugccuguagucccagcuacuuaggaggccaaaacgugagaauugcuugagacugucucagaaaaaaaaaaaaaaaaaaaaaaaaaacaaaaaaaaaaaaacaagccaggcaggcacagugacucacaccuguaaucccagcacuuugggcugggaggccuaggcaggcggaucaccugaggucaggaauuggagaccagccuggccaacauggcaaaacccugucucuacuaaaaauacaaaaauuagccgggcaugaucgugggcaccuguaaucccagcuacuaggaaggcugaggcaggagaauugcuugaacccaggaggcagagguugcagugagucaagauugugccauugcacuccagccugggcgacagaaggagaaucugucucaaaaaauaaauaaauaaauaaauaaauaaagugucagauggccugccaguuauucuauucaguuuugacaaugggguauauuuuauauauuuuuuaccuggaguauaaggagaaaauuauuagucaucaggguugagaccccucaacccgcuaaauucaaaauuguuacuugggagauagagaagaacugaauggaacuaaacuaagaagauauuauuaaguaaguuuuaguugcucaucaaaauacuuaaauaauuccaucaugucuuaagacuuuugagauaagaagaaaacuuggaagugguauguuaggggaagaagaaacuaauaaaguguguuuuacuuuucuuuguuuuagaauuguugacaugaugcgugaaagaaauguaugaggaagauaugaucaaacucaacuccaagugagaaagacaagggccaaugugacugcaagccaggaaaucucuaacaauuuuagaauagacuucuuccuguacuauaugaccagggagugaucucaggaacauuuaagaaaaagaaaggaagagauguugaugguuugaauaccugaggauguuuagauaaugauuguggucagaaugcauccagaauucuaauuuguguccugaugugaaugugaccauguuuguuuguuuguuuguuuuuguuuucccuuuggcuuguguucugggauuugaucucucguuagagacucuuacuaguucuuugaguuguguauuucuuucuauaucauaucggugcucuuauuuccuauuuuucaguagagaauuuuauguucuuucaaaaccaaauuucugauuuaugcagcaaaaacaugauuucugauuuauuuaggucaagcuucgguucaauuaguucacaaaauuagugggaaaaauugguuaauagaugucucuccuucucaaguacaaauguauugugacauauugugauauaguaagaaagauacuuguccccaguucugacuaaagaacuuuuaagacccuucgaaucucuggaaugaugagugucuuuuucuacacugcugagaugacaggugacucuugguagaacccuagauagcuucaggauggagaugggagcuggugccagaggaaccaacuauguaauuagaggguuggaauuucagcuucacuccagaccuccggggagaggagaggggcuggaaauccagucagucaccaguggacaauaauuuaaucaaucaugcccacaucauggagccuucauaaaaaccuuaaauuuuggaaagcuucugaguuggugaauacauggaggugcuggaaggaaggcaugcccagagaggacaccccuucucccauuucuugcccuguguacuucuucaucuggcuguugauuugugucuuuuuuaauaccuuuuguaauaaacuguuauauguaaguaggccuguugugguggcucacaccuguaagcccaguacuuugggaggccaagacaggaggauaacuugagcucagguguuugagaucagccugggccacguggagagacccugucucuacaaaaaauuaaaaaagaaaaaacuagccagguguggugguccaugcuuguaguccucacuacccuggaggcugaggugagaggaucucuuggggccaggaggucaaggcugcagugagcugcguuagugccacuacgcuccagccugagugacagagcaagaccuugucucaaaaaaagaaaaaagauaaaaaaguaaguaaauuucuguuagccacuauagcaaauuaucaaauuugaggaugggguuguaggaaccccugauuuguagcuaagucuaacagaaguguggauaucccggggcccacuauuuuugacuggcaucugaaguggagggcagucucaugggacugagcccuuacccuguggcgucugcacaaacucugggcaguuagugucagauugaguuaaaugguaaaacauucuaguuggugccccuagacagagaguuucuugguguggaaaacccauacauuuggugucagaaguauugugacuagaggaauaaguuuucuuuacauauguauugacaaaacuuaaagacauuauuuggguacaucuuuuaauuauucaggcaaaaugaaagaauuacuuauguacuguauuuuugacagugagauacugucaaagucuggguacuuuagaacaaugauuguuugauuuagauuuuucaagccuuauguuuuuugaauacuaguauguccucuguggaaucucauauuugauugugcacauauauccuucuauaaaaggguuuaauauagugggaaaaacaaaccugacaagcuaugacagagagacuguuuucugaaaucgagauuucuagaagcugcuacugucaaaugagauaaccucugaguauuacuuggugacaauggggugacaugcuuagaaugcuuugcuacuuguaucugcugaugaccaccaaggccaaguagaaacuuuagauagcuauauacuuauguggaacaaaaguuuauguucaggguaaacuuauuaggaaaaacuuuggucaagauuucaagaaaacauaaaauaagcuucuaaguguacuucaaaagugaugaaaauaaugcaguucagaguacuagguucucaaaaguuguuuucuuuucauuuuaacugaauaaaagaaaggauauuggcuaaguguuggcucaugccuguaaucccagcacuuugggaggccaagguaggaggaucacuugagcccaggaguuugagaccagccugggcaacaugugagacccugucucuacaaaaaauaaaaaauaagcugcgucugguggugcgugucuccuacuuaggaggcugaggugggaggauccuuugagccuaggaggccgaggcugcagugagccaugauugcauuacugcacuccagcuugggcaacagagcaagacccugucucaaaaaaauaaaaaaguaauaaaaaauaauaaaaagaaaggauguuuuguuucauugugguaaugcccaaacugcuuugaucaugucacucucucugcuccaugcuuccauggauuacucugcccuauuugaucacguucuaaauauuugucuuggaauuaauucagagacuccuucauucucacccuaauauuaaggugcuguccuuaucuucucuaugauccagucauauuggacugauuggaauucccuaaauauaaaaguaggaauucccuacuguugucccuauucugauguucuuccuucuauuucacuuuuugaaauccuaacaaaccuugagugcccugaccccuggcuacuaguuuuaugacauuuucccucacagccccagucagaaaugucuuguauauuuucuaaacccuuuagcuacucuuuuuaugcuacucauaauucccuuauagaugcuugucuccuguaauuauuugcaagcaugcauaauuuucuuuccuauggaagaucaugcuggaucuuacacaauuuuguagaccucacaugccuaauccaagugccuuucaugugggugacaccuaguaagcaguuguucauuaaugguugccccauaauucagucauccccaauucagcaauaagugauaagagugugcugggugugauuggacaccagauaccacacaggcagguguauuucagguaaucuauucaacuggauacuuuaagcuucaucuuuuuuuaggcaucucccucccuacacauuuggcaguuuuaaucuuuuuauuuuuauuucaaaauuuuuuucccucccaaggugcugagagguuuaauaucuuaaggauauuuaggagagggaaggggcgaagugacauuauaaaaggaauccuugaagaaaaucaguggaggaaucuacaaauaaggaggccacuuaauguccacugaggacucagcaccucugucaggacaccagggcuuccuucucuucaccaauuucucccuucccccuacuuacccaccuaauccaaucucuuaagaaagaaucuggaaaaugaauuccuaacaagaugacuuacaaaaauuaccuugucccccuuaucaaaggcguuggauucuauggggacagcgcauuggggaccauuuaugugggcuaggucaaaggugggcagugccuacuucugagcaucccugcagccacauuauagccacucaaguguggcuuuggucacugucuggaccuuucacuuuucuccuugucaaauaagguggcuggacuggaugaauuugaaguccauggagagcaugaaauguuuauuucucuuguccugccuaaaaggaagccagucauggccacuggguucuguuugccucuggacccuggccuagauuuuccuuuuauuaccuggaguuugggguuuccuugcucucagccucuccagguauagcauucacaucuagaggcugccacauuccuuuuaucucucuucaggauuaugcucauaggaccuaucauaacaaguauauuuucacuuuuuucuuucacuguguuugcuaguauuaaccccuuuuccccauccccauccgccauuaaguagcugggauacuuaucuaaaaaauauagauuccgcagggggcaguggcucaugccuguaaucccagcacuuugggaggccgaggcagguggauugcuugaggccaggaguuugagaccagccuggccaacguggcaaaacccugucucuacuaaaaauaccaaaauaagcuaggcgugguggugggugccuguauuccuagcuacucgggaggcugaggcaugagaauugcuugaagcugggagguggagguugcagugagcggagaccacgccauugcacuccagccugggcaacggaacaagacugucucaaaaacaaauacacacacacacacacacacuaacauaauuuuauuuauuauuauuuuuaaagacagagucuugcucugcugcccaggcaggagugcaguggcacauuuauagcucacugcagcuuugcacuccuacgucacgcgauucuucuccucaaccuccugaguagcuagaaugacaggugugugccaccaugccuggcuaauuuaaaaaaaauucuuagagacagugucucacuauguugcccaggcuggucuugaacuccuggccucaagugauccuccugccuuugccucagaagugcugggauuacaggcaugagccccugugccuggccagauucacagaauuuuaaaauaggaaggaguuuagcaauuuaaccuaacguggucuuuuucuuauuaauaauaaacagcaaugacaaguauuuauuaagcaguugccauuuucuaggcacugugcugaguacuuugugcacauuuuuuaauguaucaacagugaacccugucauaucagggagcaaaaaggcacagagaaguuaagggacuuaaagccaugcaugugguuauuuucugguauggcagaaacucccuuaaaaacuguuuuaaaaacaauagaaucgagagauaauccuauuccuauuucuguaauguauuucuugacuuuugcaacauuguauuccacugcccaaccauugaacugugccauuuaacacuuacacuuccuaauacuuuaccuuguaguucaccaguuuucaccaaugaugcugaacuuguuuaaauaguugcauacauagcacagcaugccuauaaugacauugcuuaugauuugacuuguaggaauccacgaaguuguuaaaauuuucuuagucuuaauggauguagaagcaaugugcaacuugguaucagucuucuuuucuacuccuauacuuggguuucugaugguuauugugaaaacgaaaaugauuauguguauuggagauguauaaaaauguauguucuccagccuuagucaugagagaguuaucuuaccuuuuucuacacaauaccuuuuucuauuucuugcuguaguuuuuuucaaacuuucagcauuuucuuugagucuuuuaugucacccaggcauuucuuuauuaaaagaugaugguuagugguuaggguaggcucaaccaucauaacugaaaggccugaaaauagauacaagcucaagcacaaguuuaauuuuugcuuauaucauggucuuuguugguggaucacuuuccuuucaaugauucaggcacucuggauucuuccauuuuaugacucagcaauuccuuagggcuuucuuuucaacuacagccagccaguggauggugaaagggaaaggcaggaagcauaucuacuuucuaaacacacacuuauuuuuuuugagaugagucucgcucuguugcccagguugagugcagugggacgaucucagcucacugcaaccucugccuccugggcuugagcgauucuccugccucagccucccaaguagcugggauuauaggcaugugccaccaugcccggcuaauauuuguauuuuuaguagagaugggguuuugccauguugaccaggcuggucucgaacuccugaccucaggcaguccgcccgccucaaccucuccaagugcugggauuacaggugugagccacugcgccuggccuuaaacacauaaucuugaaaugaaugcauuaguucuguucauauaccauuggcuggaagucuguuguguagugauacuuagcugaaagggagauuggcacauguagucuagcugcaaguccaggaagaagagaauaugcauuuuugauaaugacuuagcuguccccuucacaguguccuugcauuuuuuuuuuuuuuaagauggagucuggcucuggcacccaggcuggaaugcaguggcacgaucuuggcucacugcaaccucugccuccuggguuuaagccucagccuccagaguagcugggauuacagguacgugccaccaugccuggcuaauuuuuauauuuuuaguagagacaagguuucaccauguuggccaggcuggucucgaacuugugauuugccugccuuggccucccaaagugcugggaucacagacaugagccacagcacccggcccuugccuucuauuauucugagagaauugaaauaacaugucaaaucuuaaaauuuuucuccuuuccacaucauuuuuauaucugaauccaucaaccccucauuaauucuugacuuagaggugguuauccgaaguugaugcuuucccccguacucuggaucccccauucccuucagaugccuuauucuaugacauuuuucuaugcuuaccugcauguauuuauuuguuuguuuguguuggagaugcugagaugcauuucaaauauuuacaagaaugcucaagauucucccauuacaaaaacaaacaagaccaauaaccaacauugcaccugugccccauucugcccucuugcuacaugcucucuuucuccuuuccuucaagcuguucuuccuuaaaguacuuuuugugcauuauuuuucuacuucuucaccuuccauucccuccacaacuguuggaaucugucuucgaucucagaugaaucucucucuuuuuuuuuuuccugagacagggucuuauccugucacucaggcuggauugcaguagcacaaucauaguucauggcagccuugaacuccugggcucaagcgauccuccuacgucagccuccugaguggcugggaccccagguucaggccaucauaccugauugauuuuuacuuuuuuuauagagauggagccuugccauguggcccaggcuggucuugaacuccugggcuugagcgauucucccuccuuagccucccaaagugcugggauuacaggugugagccuggcccaacucugcucuuguuaugauuaugaguguccucuugacugacaaaucaaugagauuuuauuauuuaaaauuuccaugauucugcucauucucuuuucugugaaacugaguuuucacuaggcuacugugacaucuucucuuggauuacuccuuauggaucucucugcagguucuuugccuugauauuggaauucccagggucugucuuuaguucacucucuuuucucuguugaugcuuuuucaacaaguucaucaauaucccugauuucagucaaucccaagucaacauucuugggcagacuuauucgcugaacucaggcauuuccacuugcaugucccacaguugagucaggacccauaauuucuuccugcuuucccaugcuauuccuuuccuuauugacaaaugccaucaucuuuucucucacugccuacaucauccauccauuuguuuguuaggucuaucaaucaccuaauaugugucagcaauuuucccuuuuuuuuuuuuugacucuugcucuguugcccaggcuggagugcaguggcaugaucucggcucauugcaaccuccgccucccagguacaagcaauucucugccucagccucccgaguagcugggauuacaagcaccugccaccaugcccggcuaauuguuuuguauuuuuaguagagacgggguuucaccaucuuggucaggcuggucuugagcuccugaccucgugauccaccaccuuggccucccaaagugcugggaugggauuacaggcgugagccacugcgccuggccuaugucagcaauuuuucuacaaauaagauuauagugguguacaaaacaaacacaguuucuguucuuguagaauuauguuuuaguggggaacaaagaaauaauaaugcuuaaauaaaggagagacaugagaagauaagaguuguaugcauacuuuggauuugaauaauuugggaaggccucucugaggacuugacauuuaagcugagucgugaaugacuggaaggagcuugccaugcaaaguugaggagcagagcauuccagguagaggcagcuggccccaaaacacuaauaguaauccugauuugacagacaucagaaggcaaauaaaucuggaacuuaguggguaagagugagaggugucuguauugguguccuguggcugcuguaacaaaugaccacaaacuugguggcuuaaaacaacagaaauuuauucuuucaucauucaggaugccggaaaucugaagucaguuucacugugccaaaauuaaggaguuagcaggaugugcucccuucugaggagugaauaugguccuuaacuccuucagguucugguggcuucuggcauuccuuggcuguggcugcaucacuccagucucuacuucuguggucacaucauugcauucucaucuguaucaaaucacccugucuucuucuuacaaagauguaaagugauuacauuuaggguucccccugguaauucagaauaaccuuucccucuuaaggucuuaauuuaaucacauuggugaauuuuuuuuuuuccuuauaacauucacagguuccagggauuaggaugaggauauguugugggcgucauuauuuaaccuacugcagugaagggcuggauccuauaggucuuuauaauccaaggugagauguuuagauuucauucuagggugcuagaaaccauuagaggauuauaugcaggcaagagaaacugugugguuuugcuauaaaguagucuuucuuaauuucuucucacuguaccuuuccaagaagaaaaauuaaauuaaaauuaauuaauuaaaaacuuaauuucuccccaacaagagaguacugcuuaaaugcuaagaagauuuuguuggguagaguugaaguuuggagggccacagacaauuguaauaugcaauauuuuuucaccugccaagaagcaacugugggugauauugcucucauugagaauacaugccaucaaagauuaugcuggcugcuacaaguaaacagaauaugggaagugggaguuaguuagucuguuuugguugcccaaccaagaacuuauuauugaauggacaaccauuguauuaaagauagaaaaaaguggccugggcgugguggcuuaugccuguaaucccagcacuuugggaggcugaggcgggugaaucacaugaggccaggaguucgagaccagccuggccaauauggcaaaacuccaucucuacuaaauauacaaaaaaaaaaaagccgggcaugguggcacaugccuguaaucccagcuacuagggaggcugaggcaggagccuugaaccugggagguggagguugcagugagccaagauugugccacugcacuccagccugggugacagagugagacucugucucaaagagaaaaaagcauagaaagaaguggauagauucaggauauauuuuugagauagaauuaguugggugaacuugccugcuagauuauuuggaggaaaggaagaagaauaaaagaaaggcuugcauuuucuauuugagagcugguccacuuacugagaaggggagagcugggagagaggcagacuugauggaagauauaaaguguucugcuuuggcuaaguuugaagugauuauuagauauuccuuuggagaugucagacaacugggugaaugggguuuggagauucugagagggguuuggcugaggauacagacuuaggaauuauuugcauauagguuauauuugauacuggauggaguuaccuacagagaauguauauagagagaagcaggccauugagcaacuauuauauagaagagaaggaggaguugccagugggaugggauggaaagcagaagagcguggugucucugaggcuaagaauucaaaagauauuaaaaaagagacgguucuacuauguuaauuauagagauuacauuuggugaaaugaggucauuugugauuuugacaauuugacauauaguuuaagaagaggcugggacaaaguuuauuggauuaaauuguggaaguggagacaguucuuauagacaacucuuuuuuuuuuuuuuuuuauugcucauucuuggguguuucucgcagagggggauuuggcagggucacaggacaauaguggagggaaggucagcagauaaacaagugaacaaaggucucugguuuuccuaggcagaggacccugcggccuuccgcaguguuugugucccuggguacuugagauuagggaguggugaugacucuuaacgagcaugcugccuucaagcaucuguuuaacaaagcacaucuugcaccgcccuuaauccauuuaacccugaguggacacagcacauguuucagagagcacaggguuggggguaaggucacagaucaacaggaucccaaggcagaagaauuuuucuuaguacagaacaaaaugaaaagucucccaugucuacuucuuucuacacagacacggcaaccauccgauuucucaaucuuuuccccaccuuuccccccguucuauuccacaaaaccgccauugucaucauggcccguucucaaugagcugcugggcacaccucccagacggggugguggccgggcagaggggcuccucaccucccaguagggguggccgggcagaggcgccccucaccucccggacggggcagcuggcagggcggggggcugacccccccaccuccuuuccggacagggcggcuggccgggcgggggugcuccucacuucccaguaggggcggcugggcagaggcgccccucaccucccggacggggcagcuggcagggcggggggcugacccccccaccucccucccggacggggcggcuggccgggcggggggcugacccccccaccucccucccggaaggggcggcuggccgagcgggggggcugacccccccaccucccucccagacggggcggcuggccgggcgggggucugacccccccaccuccuucccggacagggcggcuggcccggcagaggggcuccucacuucccaguaggggcggcugggcagaggcgccccucaccucccggacggggcagcuggcagggcggggggcugacccccccaccucccucccggacggggcggcuggccgggcggggggcugacccccccaccucccucccagacaggguggcugccgggcggagacacuccucacuucccagacgggguggcugccaggcggaggggcuccucacuucucagaugggcggagggucuccucacuucucagacggggcggccgggcagagacgcuccucaccucccagacggggucgcggccgggcagaggcgcuccucacaucccagacggggcggcggggcagaggcgcuccccacaucucagacgaugggcggccgggcagagaugcuucucucuuccuagaugggauggcggccgggcagagacgcuccucacuuuccagacugggcagccaggcagaggggcuccucacgucccagacgauggguggccaggcagagacgcuccucacuucccagacuggguggcggccgggcagaggcugcacuccuggcacuuugggaggccaaggcaggcggcugggagguggagguuguagcgagccgagaucacgccaccucacuccagccugggcaccauugagcacugagugaaccagacuccgucugcaaucccggcaccucuggaggccgaggcuggcggaucacucgcgguuaggagcuggagaccagcccggccaacacagcaaaaccccgucuccaccaaaaaaauacaaaaaccagucaggcgcggcggcgcgcaccugcaaucgcaggcugaggcaggagaaucaggcagggagguugcagugagccgagauggcagcaguacaguccagcuucggcucggcaucagagggagaccauggaaagagagggagagggagaccguggggagaggggagaggggagagggagaacucuuucaagaaguuucauuaugaaggaaagcagagacguggaaaaguucuuggaagaggauauuggucaagggaggguuuguuagaacuagaggauaauacagugaauuucuaugcugacaaaaugauuaaguagagaagaggagcugaugaagguaggagagagugguggguaauuguacaaauaaaauuucugaagagccaggaaggaaggggaucuaguguacaaauagaaugauuggucuuuacuugaaacaggcacauuuuauuaguaaaaggaaggacugcagagagaaugaguacagagguggauaagucaucauuuggguggugggaagaugaaauuuuuaccuaguugcaucuacuuuacuuucccagugaagugugaugauauugggguguggaggggugaaacagguuugggaaaagagauuucaaauggcuauuuugaaacauccuggggaaauguaauaggauugugggucaguguggauugcacauuaaugauuugcagcuaugaauuuaaauugaggccaguugugguugcauguuuuuuuucccaggcaguuucuucagcuguuuggguggagaugugaaacaggcagauaguuggguuuaacugguuuggggguuugccaaguaaaaaugaagcaugaagagaggagcaagggaguuaagggugcuuggaagggagaaauuacagugauggaccuaauuuaauucucagcuaggcagcaggagaagugacugauagugaagcaaauaguagggucaauggacugaagggccagauaaugccaagaugguggaauggaaauuccagacuacaguagauaaacugaagaaagagaaggugguguuuacaguguagggugcuugaggcuggagucugcggaguugauauaaauaguggggaugcccaaaucagagguuaugauaaugagguagggucaaacaaaggucaucagaggugaggugguugaggaauuggagccuucauguaguuguagaaaacagcaaugauggccgggccuguaaucccagcacuucgggaggcugaggcggguggaucaccugaggucaggaguuugagaccagccuggcuaacauggcaaaaccauggcucuacuaaagauacaaaaauuagcugggcaugguggcacaugccugugaucccagcuacuugggaggcugaggcaggagaaucgcuugaacccgggagguggagguugcagugagcugagaucacgccacuucacugcagccugggugacagagugagacucugucucaaaaacaaaaaacaaaacaaaaaagaaaacugcaaugaugaagacagaugagucuggaaagggaaauagguaugaaggucaucagcaaauaaggggaaauagcaguaguuggguagaugacagcgagaagggauaaugggugguaaagucuaauggcauaaacuucagacagguaagacuuuugaaagaggauagaagagaaauuggaaggugagcuggagagacacuuaauccaccucuagguuaggggaucuugggguuaugaacagagucguuacucaaaguguuugacaacucaugugaaaugguaaccugcugaugucgguguuccaucaggagcaggguucugggggccuuuugugaagcuagauguuaacucuuuaaucucuugaucauagcuaguugucaacugguugagagguauuuugauacuuuagcaacugccauagccauccuuguuuauacuggcugaaacuagaccuaaguaugagaauauagggccauguguggugucucaggccuguaaucucagugcuuugguaggccaaaugggaggauuacuugaggccaggaguucuauaccagccagggcaacauagugagacccuaucucuaugaaaaaaaaaaagugauaauauaaccaagcuucucuuuauaugauaugggaaaauaguguuauuaguguucagcaucugaaauucagguuaaaucuuacuuucuuuauguuuucaagguuuaguuuggugaaaggaacacucagagaagagaauuuaauggaauuugcuggggauagaguuuaaguaccagagggcagagugggagggagggaggccugggaaggugagagauggggaagauuggucuucuggugaugacugaggaaaagagggcuguggagcaugcuaggguuaguccuggugaugucuugggggaaauuggguagguaccauguggcagcuccuguugcuuaguggccaggggugagcaaaagccuucuuagugugucuguagccuaggucaucuccugaagacguaguggccaguuggaguauaaaggccuccuuggggaccagcugcccuucaguggcugauagcaugaggugcucuuagggccucuucucagccaugauggugguguaacccugggggagagggaggggucuucuguuugaaggacuaaggacugcugcucccagggagcagucaucuuagcaauucucccuccaaaauggauuuggacuucgugcuguccccucuguaaugacugugguugucuuaguauggacucucaggaguugcguccagucuccugacugcccugaauccagucuucugauuuccuuacucccagauucauguucuuuuaguuuaucugucaagacugcucuggaaaauuaggaaugagagaauggucuuuuaaguucaaccaugguucuaucuaauccuacuaggaauguuaugaagaugaauguaacauauauaaauugacuagcacaguccuuauaacacaguauguagccaaagcauaugcuuaaagccuucuugacaauccuuugucuaaugacaaaguccaaauuccuuugacucguauauaagauuuccagugauucuucugccuugcucuauugaguuucauugccuccuuacuuaggauuacucauuccacccuaugcccuagucagaccacacccucuuguucuugaaaaugauguguugucuuauaccauuaugucucugcucauagucacucuggacauaauacaccuucacuguuaaaguuacauauugccuucccuagaaaccuccccugaugcuuccugccuucucuuuccuucagggguaaguaaucccuuagcgccuuguccuuauuuuuaucauuuuuguuuguguuagaaugcuucucucuaagccauuaguuuuuuaaaggcagaaaccaguaagugauucaucuuuguuuacccauggucuaauacaguaggugcccacaaauguuuguugaguaaaugaaaacucacugcauauuugaguuuccauauugccuuuguuuggugaaaucuaaauuauauauuuuuugcuucuuucuuuuaacagugcaggaaauuuuucugaugaaguaguagaugagugcagaaaaaaacugauguccauguaguuauuuaggaugggaaacagacuucauccuguguucuuuuccuucuacugagugacuuuuacugcuugauuuauccagugauuuugcucacuauugccauuguuuuuuggugaauuguaaucauuaacguuuucagugguacaccaaagaaaugcaaacaaaugugauuuucugguuguuuaauugggcauuuucuggugcccacuuagaauugugggauugggguauggagcauucuagaauguuggugaaaagucuaguccuuuagguuucuucaaauguuggucuucuugggccaggcgcgguggcucacaucuauaaccguagcacuuugggaggcugaggugggcagaucaccugaggucaggaguuugagaccagucuggccaauaugacgaaaccuugucucuacaaaaauacaaaaacuagucgcaugugguggcgcacaacuguaaucccagcuucucuggaggcugaggugggagaauugcuugaacuuggaagguggagguugcagagaucacaccacugcgcuccagccugggcaacggagugcgacucugucucaaaaaaaaaaaaaguuggucuucuugauccuacaugaacuaauuaauucuguauuccaaagaauuaagauaaugcaaaucagauggcagcagaaugaaucaaguaagagugggaagggcaaaugugaaaugagggggcaggagugagucacucuuuuguguagauggauagggaaugcuggaaaggggagggugaagguggguugggggcugugggagagucugagcaauaaggagauggcguagcauggguaaaggugguuugggcgacacagugguuagcaagcucugugguuagcauguucugcaugagugaccaagcaaggcccauuuuggcacuugagaugggaucacugacccucguuccccaguucucauuguaagguuaaacaaagaugcaguguaugcuuucauauuuugagauuaggguaucauucuagaagggacacauucuugagaaauagcuugauuucuuuaaaaaaaaauugacucauagacuguuuccauggcauuuugauuuuuuauuaguauuuuuuccuaagguacuuagaugguguccagaguuugugacagagccagaaagcaacuccccaccuucucugaaauaaaaauaaauaccaagaaguacuauucuaaauagaggaccagaaacuacucauaugggucaaaguugucccaaugacuuggguuaacucaggccacaaaccuuugcucaggcuucuuacagggaauauuuuuaaucugccaauugacagacuacuagagauagagguauaaacguuggacuccaugugauuagagccugaucugaagggaaaauccucuugccuccuucugaccucuguaacagguaaucugugacccagaaauagaucugcauuagauguugggcuugauauggguuuauuuuugauagaacacucugaaauaagaguguccauucuauuugagugaauguuuauuugggggaaagaugcuagagauaugccagaagaggccgccugccugugucuuuucagggaaacaaugggauuuauuuccccaaccugugaguguuaaguguacuugguuguucagaacaaagugcugguuaggccaaagcaggguuguggcccgauggaaauugguugguugcuuuugcucucucguaacaauagucuucuauaucccaauuccacgugcaaauguggacaaugugugaaaaggccagagcuuauuguagaugcucaguaauguuauguauuagcagugggaguuguuggauagcagauguauuuuuaugcuuuacuuauauuaccucgaauucucaguauaacuugugacaaaagagauuuuauaaaugaggaaacuaaagcucauagucacacagcuaguaaguggcuaaguuggaauucacccagggcugucugugucuucugucuccuacacuggcugccuccugcacugaauuuucuccugggugucauuggugucauuugaauaugccgaggacagcagccuaggacuagcaggucccuggcugugccuauaggaguagcuguguuccugcaggcaagcacuaaauuaucacaggguggggagagagagggaauguuggcccccauuuuaggauggucugucucuucucugugcaucuguggacuuccuuuagggccuggcacaguggaggggcccccuggguguguuaacuaaagagauucuguaguuauggaguugaaauuugggaaacacccaauuccaggaagguugaucagcuuugcaguuucugguuugauuuguuguugggauuuccaguguugcauuaaaacugcaaauccccgaggggcuguaaugugcaauaacuaaaaauguagggcgaguuuaggugcagcuuaacucaagcuuaaaugguuauugugucccaugcucaaggcaaauucauuuuaguuaggguggagauuuuucuagaaugaggcagauaauucugugacauuuuccaguucuuacucaaagauuccuaauaaauuguaaaggcaaaguauucuuuuucuuuuucuauaugggucuuuuacuguaguucauuaaagaugagaaaaaguuguauaacaggaaaaucacucaaguaauggucagaugauaugggauuuggucaaaugucagcuauccaucugcauggugcucuuuggaauucuuuuuuuucaggucucuuucucuuauaugcaugcacacguauauuccacauuuuuuucuaauuacaagaauaauucaugcuuauuuuagacaucuagaaaauaaugcacacaaggaagaaaauaaaaaugauucauaauacuaccauucaaagaugagauuuuuaacauuuugggguauauucgucuaaccuucacuugugaguguguauguguguguauguacauauacuuuaaaauagaaauauauauauauauauauauacacacacacaaagauacuguuuuauuuacuuuuguucucuucauaauuaauuuucuacuuguccguuaccccaucucuauccagaguguacuuaacucagaaaggauuaauuccuacaaggugaagaaauucuagaaugucuaacuuauuuaagggugccauuuauuuuuuuagacuuuucuuuauuaugauucuuuucaguaugaaaguguugcuuuuucaagucagaguggguuaaggggauguugauggcagucauuuggcauggugagugacuuacgccuacuguccgguuuaggugguaaaaauggcagaaggccuuggagugccaaaggcaaggguuauggguccagcaguaccaugaaaaagggaauauaggcugggcgcgguggcucacaccuguaaucccagcacuuugggaggcugagguggguggaucacgaggucaggagauugagaccauccuggccaacauggugaaaccuacuaaaaacuacugaaaauacaaaaauuagcugggcaugguggcgcaugccuguaaucccagcuauuugggagccugaugcaggagaaucgcuugaaccagggagucagagguugcaguuaacugagaucaugccacugcauucuagccuggcgacagagcaagacuccgucucaaaaaaaaaaaaaaaaaaaaaaagaaagaaaaagggaacauauagaagaucucaaucuuuuacguaaggacauugaaguccagggaagucugauggcuuuguucaggcugagacuaucguaggguagacugacaucucagguugcugacugcccauucuguaaucucugcagagcacuuggcugccacauaguauaaucugaaaaacuggcagcugccagacgaaugacugaaggaguaagcucaagugcacuaggugaggucaggccugaaggucauuggacugauacugaaccuggcguuuugacaggaauccuauuagaaaugccacuuagucacuugccuccugacugcuucaugguaggaacagaggcucaaacuauggccugaauuuuuuggauuaaguuuaaguuuuacuuaauauuaucccaauuuuaucucagacauuaucucaaaauuauuucaaaauuuaugguugaagagaggcuguugaguauaaauugcuaauguacucugcugaauuccaucagcuaugugauuugacugagaacaguacgauccuagcccacuggggucuggugaauugcaucugcucagucagaguguuccuugagcuggaauugaaaugcauggcccuuuaguuuccagugugaugccaacacuucaggcaauugacuuuugcucuucagucuccaauagggggaaaauuaugaaauaaaauggggauaggccaggcauccucaagauucaaacccauaaauauaaauaacuguaauuaaucauaugcagucucucuugccuguuggaaauuuauacucagcugggucaauaagcuucacacagcucuuaacuuccuggccuguaguuggugggaaauguucugggugcgucagccuuuagagaugugaccuaggguucuuuuccaauauggguccaaaaucagugcaaauuauaaugaguuguggggugagaaaagucaccuggaaacaaccccagcccaaggggaaauagaaauauaaaaaagacuucuguuggcauuuaagaggcucucuuagaugacacugucuguucauuguuguuagccuguuagacugagugagaugaacagucuuucaaguauguaaguucaguacauauuuacauucaaguuuaucccuaaaguauuuguuucccuauuauagaaucuuguagauugcaguugguauuuuugccuguuuucucauauaauuuguuaacucuuucccccucucccauuguguccuuuuuucuauacuugcaucuacucauuaugaacauggcuaaugguauccuaaugaaaaagcaacccucucucucuccugggggucauuggugucauuugaauaugccaaggauagcauccuaucacuagcaggucccuggcugugccugugccuauaggaguaguuguguuccugcaggcaagcacuaaauuaucacauuaucucucucuaucucuuuuuuuuuuuuuuuuuuuuuuuuugagacaggaucucacucuguugcccaggguggagugcaguggugggaucucagcucgcuguagccuugaccuuccaggcucuacuuuuacucuuauuacccuaaaaggcauccucuauacugcagcuagggcauuucuuccuuucuuucugaaauauaaguuucaucguaucauuguacugauuaaaauucuccacugacuuuuuuguuuguuuguuuuugagacagggucucacuuugucacccagguuggugugaucguggcucacuguaggcuccaacuccugugcucaagcaauccuccugccucagccuccugaguggcugggacuauaggugcauguuaccaugcccagcucauuuuuucuauuuuuuguaggcacagggucucacuauguuacccaggcuagucucaaacuccugaccucaagcgauccucccaccuuggccuccccaagugcugggauuacaggcaugagccaucauguccagccuaccccaguuauccucuaaccuauuauuucaucuuuauuuucuccuaguaauucucacuuucaaaauacuuaauuuuuauguuuguuuacauguuuauuuuugucuuuuccaauccaugagaguagaggaauucccagccccuggaacagugcuggggaucugccagguauucagucaaucccaguugaauguauguuaccugaaccaaugcuccuccuccugucuucuucacuuggguagguccuucacggauacuuuccugaguauuugauggaacucuugcuuugguuauauucuaagaaauuacaauuuuaaucuuuccuuugcuauugguauguuuucaauaagccaguucucaaggaauuuucgaguuuuuuagaagcagcagauggauuuuuuugguccauuuaucugcaaauauuucuuuaaaugcaggagagcacagaaaaauauacuaauuguuucuagcacagaagcagagaguguugccauguuuuuucaagauaauguggaucuauucagaugagguagaauugaaauaagaauuuucuuuuucuaaggccuggacucugugcauguaccugguuugacauucuuuuuuucuuuuucuuuuuucuuuuuugagauggaguuuugcucuuguugcccaggcuggaguccaauggcgugaucucggcucacugcaaccuccgccucccggguucaagcaauucuccugccucagccucccaaguagcugggauuccaggcaugcaacaccacacccggauacauuuuuuuuuuuuuuuuuuuuguauuuuuaguagagacgggguuucuccauauuggucgggcuggucucaaacuuccacccucaggugaucugccugccuuggcuucccaaagugcugggauuacaggcaugagccaccgcaccuagccugacauucuuaacucuauguaagaggcugggguaguuuguuucauucacaguguguacagcaaaauccagauguuuucuaguaagcuccacuaaccugaaacacauaaaagaaggggguaaaaagaucccugaagaguuagagccagaacauugaaaaccaaguguuaaaauucuaguaaguagcuccuuuagccuuacuuagagcuauuuacuuguauuugaaacaguuaaacuaacuuggcucucauuuuucuaaccacagugguaacaaugacgaguuaaugggugcagcacaccaacauggcacauguauacuuauguaacaaaccugcauguuguguacauauauccuagaacuuaaaguauuaaaaaagaagugagcucaaagauaaacagggaagauuaucaucagccugauaguuuggaagaagcaggaaaauuguaggaagcagagagaggaagaauucauacaggaacagacugggaccugagaccacuaaguaaaggcauuaauaguguugucacuccuauuauuccugaggccaucaccauaucauagcauguacauauggauggcuguaagucgucaauaauugaauucaugguuaauauuauuuaagaagccaaagugugacuuacauucuugaaauauaguauuuuaauccaaaagaauacagaauuuuuuuuuuaacuguauacuccacucagauguaaacucuuggaaugcagggauuuuuuuguguguguucuuuguuugcucagugccugacacaugauggaugaucaguaaauaauuauuaaauaaaaccaugaaugcaaguuuuaauuaucuaacagugcuaaauaaauaggacauuaagauaaugccacauuuaaugcaugaggguuguuuccccuucuucaucuauugaaugaagaaaaaccauaaaguaauaaacuuuuaaaguuaaaauagcuuuggacauuuugaaggcuagcucauauauaguuggagugaggaucagcaaguucaagugauuugccugaaaucgcagagcaaguuaguggaagagacagaauuacaagcgugucuuuccuuccagaauacccccugaugauuuucuuuuuuaauuuagaguuuugggaauacaacauagagaauuauauauuuuugggaaagacuauagaguucuuuuuugaaaaaaagaucaaugacagcuucaaaaggaauauugagucgaacccuuuauuuucucuauuuaugcuauuuaaauuuuagaccugucaccucugugcuauuagcucuguaguguugauaccaaacaucuuaugcagaauaacuagacuauaguacuugaaugcuuuucaugaggguuugugcuagcccuuuuaaagaagaaaagaaauaucuuuuucuuuaguuuggaaaggaugcguuauucaacugaggagaguaagaucuuaugaccaagaucauuuuagccaaaaugacugagauagaaauacagcuuuccucauuauuuuugcauaggugaaggaaaauguaguauauuuucuucacuuuuuuuggaguggggauggagcauuuaggaaauacauuguuuucacuuacuuuaaaugggaauuuuguuagcaguaugaauuacuucaaucuguuucucucaucugauucuuauuuccuugugagucagacauuuuuaggaaguguaaucaguaagcuaaauauucuaauacaugauuauuuucacuacaguacgucucagguuuccuuuuucauauaugcauuguaucuguacuuuggcucuuuguuguaguuccauuuauacuuguggauuauuagauguacagaggaguaaauuuuaaauguaaauuucaacagguuacaggagaaaaaagacugcaggauggaaaaacuagucagcuuuuuuccuagggaucuucucucuguuaaggaaacagagugacuggucuucccaccacagcgcacuucuugaucucuuauaacucucagucaccacuuauacauuaaauauauguguagugauguuuauaauagagcuguauucaaauugagaacuuucuuuuacaaugaacugaacaauaacugaaguuauugugcuauaacuaauuauuauuaaaaauucagucauaauuuaaaaaaauaagcucaggauuucuuaaaccaucuucaacagauacuuccccaaauauauuucuaacggcauauaaugcaguugcaacaggaacuuuugaaagaauugguacauuuucuuuucuuuuuuuuuuugagauggagucuugcuuuguugcccaggcuggugugcaguggcaugaucuuggcucacuaaagccuccaccuccuggguucaagugauucuccugccucagccuccugaguagcugggacuacaggcacccaucacaacgccuggcuaauuuuuguaguuuuaguagagauggggcuucaccauguuggccaggcuggucucgaacuccugaccucaagugauccacccgccacggccucccagagugcugggauuacaggcaugagccaccgugcccggccuggacuuuguuuucuuacaaaacauuuuacaguauguauucaacagccaugauuguaguuacucuguaaggcuuuguuaguuuuaauaaauuuugagggaaggcuugauauguuuuaaucuuaagacagacauuuaaaacucuuugauuugcagcuuauuuuauagcaagguaaaggacuuuuucuuuucuuuucuuucuuucuuucuuucuuuuuuuuuuuuuuuuuugagacaggaucucauucuaucaccugugcuggagugcaguggugcccucauagcucacugcagccuugaauuccuggguucaaacaauccucccacuucagucuccugaguaacugguacuacaggcaugugccaucaugcccagcuaauuaaaaagauuuuuucuguagagacagggucucgcuucccagguuggucuugaacuccuggccucaagggguccuccugccuggguuucucugagucugggauuauagauguuagccacccaccacuccaggccuuuuucuuguuuugauuacugaaguagauucuguaacagcauguaaaauguaaaaagagcguuuaugcugccaaaggaaugucaaacauuaucuuaacccaauaaaggguuaguaaaggggcggaaagacugaaagaagcacaggacuaguauggucuguuugacuaaugaacuucuuuugaauguuaucaaugaauguguuucauugauaacauuccugccuccucaaggcagauuuaaaguuuuucucccuguugugcuaucuccuuuucaugcuaagucaaccauuucuuguuaguugauauaaaugcaaguuuguuuaauucuguacuaggcauguuaucuacucagcuccuuaaccugacuuguguuuuuacaagggguuggcauuuuugugaaggaaugcuucaaguuuucacuugggagggacauuuuauuuuggggcucucaggguuacccucaauuauguauaugguaagcaaagaaggcagagauagauuuuaauggaauauuaaagauaggauuguacgacuuuaaacacaaauccgugaauauaucuggagugauacagaguauauauuaacuuugcuuuuaaaaugaauuuaaaauggaauacaaauucacuugcgugcacuaacuauaguucuuuaugacuuuuauagcaauuguauggaaagcaaacauaauagaaacuauucuauuaugaauuaagcugugguuauuugcauuuaaugaauauaaugagcuucauugauuucuuauaauucuauagugaaccucaugaaauaaagaaaaagggucaaauuugugacuauaguuccaguguguauuuuagaaaugguagaaagcauaaguauguuauauggcaauugccuuggaaauggcauauauuuuguaaaaaaucgggucuuaaauaaugcaucacuacuagagugcaaacguguauccuuguguuccucuaaggcucccucccuuucaaugcauuuuuuguuuuagaggacuuugugaaauaaaugcucgauuaacaguuaugacauuauuaaacuuaaccccccaucacacaucagaaaucccauguaauaauguuugcaacaaauuuuuuauaaacagagacuuuuaacuggcucacuuaaaauaguuauugaccuuauuuucuccuucuuuuguaccuuuuacuugcauuuuuugaacucugccccugaaacuagcucaacucguuucuuagccagcuucuccugucaagcuuccaggcuccugcccuccuuugaggcugagaagugguccugggccaaccucguucucacuguugguuugcuucuaaaaugauauaauugacauaaaggugacccagggagacucagaauuuucuagcuuuacacuaugugaauugauauaaauauaguguuuauuuucuuucgcuuucucuuuguuucaugauuuuuuuuuuuucucauucuucuuuauggaaauacucuuccucugcuaaaauuguuuacuuucucuugggcuggggugggcccuucuggcaguaauugccuggggaaauaaauggauuggaagugaaagaaccugcccuucuuggaagcaggcuggccuuuugauaggguguggaagucagggacaaagcuagagucuggaugccuucccagcaaugugugaguguguugcuuuagcuucuuccaccacaguccaaaaauuuguguauuuagaaccugaggauuauguuucacacauuucuguugacuuuuacuugguuuuuugauuuaucuugcguuaucaggauaaugcuuuucucagugacuucggaaaagccuuuuuguuuguuguuugauauccuguucaguguauauauucuuuacaacuauagguuguuauuguuguguuuguguguuuuugcuuuugauauaauagagaaaaggcuaaagaaggugacggaaggauaaaagugucuucuguuuucuuaggacuugauacauucacuucuuuccauagggauugucuuuugugaagaacccuugggucaauuuccuguccagucuuggccuaaauccuuuuuaaaagcaacaacaacaaaagaggagaauucaccuucaguuuacagaauagaccuccucucuguuuccagagaacaggcuaaugugccucuucuguuugacuguuuuguucauuuaggucugauagcuuucaaaaaguacacuugagggcucucuguguguuucuguaggaaucacauguguaagauacagguguguaaguccuucucugcuuggcuggggggaaugcguuugcaggcagaguacuaaucaugauccccacaguaaaguaaaacuuggggaaagaguaguacaugguaugcuuugauuguuacuugucugaguaagcacuguaucagcauauguuuggugugucugaacuaugagauaccuccuucaagggaauuguacaaaacauuuguuaucacauuaauuggaauaauaaaagguuugcuugcuaaaacacaucuaguucaagccacccagugaucuugacuuuuauaguuaaaagggugcugcugggagggaagaggcuuuugagcucacuccuucuucuguuuuacuguggacuugcugucaagcuauccaugauuacagacccguuugcuaggaccuucucugaugagguucuauaugcuuauuuuguaagacucaugcacuuuucuucaauaagucacuggauuuguaugcgagugugaggccuggcccucugaguugugccuuccaugggugugacagugugacacgacucaaaauaguugaaggaguggguuuugcaugcacagcuacaggagcagguggcugcacagaugaaguguaaggagcauuugcuaccuuuggaccacaaaaggcuuagguaaagggcuuagugauuaaagggcuaccucuagguuacaucuugggguuuuuauuuaauguuugaaaugccuuguacaucuggauuucucaguguaggugauuggaagagcauggaucgcuuuuauuuauuuuuaauuucuuuuuucuuuuuaauuuuucuggguacauaguauguauacauauuuuuggguacaugagauaauuugcuacaggcaugcaaugaguaacaguaauaucaggguaaauggguauccauuaccuuaagcauuuauuucuuuguguuacgaacauucucuuaguuauuuuuaaauguacaguaaguuauuguugacugcagucacccuguucuaucaacuuccagaucuuauucauucuaacuauguuuuuauacucauuaaccauccccaccccaaccucacuaccaucuccaaccuuugguagccauccucuacucucugacucucugucuccaugaguucauuuguuuuuauuuuuagcucccacaaaugagugagaauaugcaaaauuuguccuucugugccuuauuuauuucacuuaacaugauguccuccaguuuuacccguguuguugcaaaugaaaugaucucauucuuuucuuuuuugagacggagucucucgcucugucgcccaggcuggagugcaguggcgugaucucagcucacugcaaccuccaccucccagguucacgugauuuuccuccugucucagccuccugaguaucugggauuacaggcacccaccaccacgccuggcuaauuuuuuuguauuuuuaguagagacggaguuucaccauguuggccaggcugguuucgaacuucggaacucaagugaucugcccaccuuggcaucccaaagugcuaggauuacaggugugagccacugugcccggccugaucucauucuuuuuuauggcugaauacuacuucauuguguauauguaccacauuuuuguuauccauuugucuguugauggacacuuagguugauugaaaaucuuggcuacugugacuagugcugcaauaaacaugggagugcaauaugggaugccuuuaugucuugcuggagaaugcaugccccgaggacagcaaggcuggucguugaaauuacucuucuguaauugaucuuugagcuguacucuccgccccuccauuggucaugcuuguaagggauggagagaaauaugcuuacuucuaugcuggcauaagaaucaaaacccugagaaguucuaaacuaauggagagcauggggauuagaaagguaauugagguuucuauauaagaaaccagaaagauaggagaguuuuuguaaacaugaagguguuacaggaaggggguccccauccagaugccuagagaggguucuuggaucucacacaagaguuaagggugaguccauaaagugaaagugaaggaauaaaagaaugacuacuccauacacacagggcugcugguugcccauuuuuaugguuauuucuugauuauaugcuaaacaagggguggcuuauuuuacccagcuccuauucaagauggaguuccucugguucacacgccucugacaaagggacccagggcuuauuccacagaggagugacaaauguauuugcauggaaucuuuuucuuuuucuuuuucuuuuuuuuuuaagacaggguuuugcucugucgcccaggcuggagugcagugguaugaucauggcucauugaagccuugaccuccugggcacacaugauuccucccacuuuggccucuugaauagcugaaacuagaggugugcgccaccaugcccagcuaauuuuuaaauuuucuuuaauagagauggagucuugcuuuguugcccaagcuggucuugaacuccugauaucaaagaauccuccugccuuggccucccaaauugcugggauuacagguauaagccacugguccagcccauuugcaugauucuuacuuaugcuaaauuuguauuuugauaaguaaggcuucuggaagagagaagacagggagaugaguaggagagugaguacuuuuuaaagagauuucagaggccaggaagugcgaucugguucuggaauaaauuugcuugugcauaguugccuugccuaugaaugggaggagguagaagugguggaugcacucagggacuuacaugaaauaggaugugaggaguuguucuuuguuaaaagucacugucuauaaugggagcccuacaaggacaucuaagaauucaucugagccagauaaguugcagcagucagguacaaacaaaggucagcaaacuuugagaaguggcaaauuuaguuuuuguuugcuagcaguaaguacauuuuguuguguagcaauuacaucugucaguucuaggcaaaauuuucccaaguaccuauuacucuugggaguuuuagacccaaauauucaucugugcuguuuucugaguagauguuccgucaagaucucaaauuuucuuaguugcaagcugagcuucucuucuuccuuaaaccugcuucucuuucuagaucuuaauauugaaaucuuggggucauuuuccagcugcccaaacuaaaaccacuuauuguguucagucucuuccugcugccuccuguaaucgguugucaggucuugucaugcugucuaauugagugcuguccuuagacaguugugcaaaacaucagucucuagauuugcacucuuuaauguugccuuaaaccaggcucuucucucacaugggaucuauuucauugcccucuaauuggucucucugucuucguaagcuucaacacuaaaaaucuacuugaacagucuuuacagaacguuagacaaaacaucuuacuuccuuaaucuacagccucuacuccccguugccaacaggauaucauagaaauauuuuacuucacguguacacagucuuccucucucuucccucuggacuucuuuuuaaacaccauuucuagcuguacaucaucuccagccaaacgagauaacuauuuguaugccuagaacguaccaugaugcuccccuuucuccaccaauugucuuucucuauaacguucccuacucacuccccuccaaauuuuuuccccuucaagacccuucuccaaaauccugucuucacugaagccuucuuuaauucuuuuagucagagucaauuucuugcaacauuaaaaugauauagcaccuugcuuuuuuuuucuaucagacuauaacacucaguauagcacaacuaguuauaagacagagugcagaguuacaagacacacuuugauauuuaauccuacagauagauuaauugcuugugggcaguuaguugauaaacucacagauauauuuaguugagcaccauuuguuuagguuuugccaacugagcugguguucuccuugcaagaauuagagcuagcucuggucuaugucaaugcagcagcugguccugaguaagcauauaugugauuuaauuaaaaggcuauaaaacauggauuugaagcuaugauaaauaagcuaauucuauuuuuuaaaauuuuuucaccucugguuuccuugaacauuuauugcagaaguuaguaaagauuuguguauauuuuugguccccuucuuugcuaguuuucuaguaaagcuguuacuuagaaggaaauaaucuuuuuuuuuuguuuguaaucauugugaaaacguuucuccuuacaaugguaaauggguacauguuguccacagcauuugguuuauauaguucuaaauuucauucuuucagcauuaaaacaaaguucuuuuuuaaauuuuuuauuuuuugagacagggucuuacucugucacccagacuggagugcaguggcgcagucucggcucacugcagucuccgccuccgaggcucaagggauucucuugccucaggcucccgaguagcugggauuacaggcgcaugccacuacugccuggcuaauuuuuguauuuuuaguagagacaagguuucagcauguuggccaggcuggucuugaacuccugaccucaaaugaucuacccaccucagccucccaaagugcugggauuacagaugugagccaccgugcccggcccuaaaacaaaggucuuacauuaccuggcagaagauuacuaguagauacuuugcuagagacuucuucauugccuuggagauuaacccaaaugccaagggacugaacauuugggugacuuugagaauagggccuucuuuugggagugacaacaaaauaugguauagcuuuuggggagaaguugccuuuugagaccaaaggcaggacagaaccaccagggcucaagaacauaaacucagucuuguuuucucacuuaguaggcagugacuuuggggaaaucccccauuuccucugagcuaccacugccccuuuuaugaaauuagauguugugagggugaaaugagcugauguguauaaagaauuaaaagcacaguaccuguuaccuaguaaauaauaaaugguggugauuauuauuguaacauucauaacaauaacaacacucauaaugauaaucuuaggaaagucaaaugaaacuggcugauucuugccuuugacuuugagcuagccagaugaccguacagaaggauuugaucacaguagaaauaaugagcccucaagcauacauuauuuuuuuaaauuauggaaaaaggaaaacucuuuauugauuauaguugauauuauugcuaacucugcaagaugacaugagaauguaguuuuuugauaguauuaguggcucauugggaaaaugcaugaaaauaucuuccuuugcaaguuuuggucucugacaaaucaaauuaaaacaauacuaucagguaggcagggaacauagggacccacacauuuggaaauacuagcuucaaacuuaacuggcugaaugaacaccucugagaaugaaacauuuucauugacuguguuguauauaacuucccugaguuggccauguugaugugugguauccuuugugaggucaacaaugacauuaucaacaagacagaagcaaugauaagucaaucagucacaacacucauauccuagggaccaccacacugcuaugagucaggcaugugcguuguuuaagguaaauaguaaauagaacuaggacuuuauucucugucuccaguugucagaggaacccaguuagccuugagauagcaugcuaucucuuggcugcuagggcuuacauuguugugugauaggcacccaugugaauguuuacaacaguacauugauuggugauagugagcuaugacaaauggguaccugcuaaguuaggguuuuuacuaucccagcaaccuaggauauaagguuuugccuaggguugacugaaugaugaaugguggccccuagccagcauacaccaacuuuccugcauaauuugggaaagagaagaugguugauauagcaaagggacaguaaagaagagaccuccagcagcagaguacauaugcuugugaaauauuuuccuaguaagaaucauuaaaauuuuuuuuagagacagagucuuguucugucucccaggcuggagugcaguggcacaauugcagcucacuacaagcucaaacuccugggcucuaauccugggaagaaucuuaauuaaaaagauaaaguuuagaauuuaggaguuugucaggaagaaugagaucagaagaaaaaaauuuuaaaaaugccaccacauaucaguauauaauuuauaguauccuaaaaugaguuuucuauaggaucauaguuaucaacuauauugcaauucuuuauuuaggauaguaugauaauagauacaguuuauucaguauggacccaaauauuuaaccguaucauaauuuauguugagauacuguuuuuuuaguauccuaaguuaaaacuaccuucauaauaaauuguuuucuugaguugugagcuaucaguagaauguaacguguguuguccagacaggccagugcuccaccccuacaaggaaauaggguaguggcuucccuguuucccugcuuuugugaauguaaagucuuaggcaggucaaauuacucaacucuagaauuuuuuuuaguugaucacacaggauuaucuuuuuacguuuaacaguaaaagcggacaaaaggauuuuugauggaauuuucauuuuuaugcaaucuucuuaguuucugaaagaguuaaagaauaauuuuuaaguccucaucaaaacuuuagaaaauuccauuaucaguccaguaguggaaaacaagugagaggaaagaaaguuaagagcuaagacaaugcagaacuugagaaauauucaguggagcagagugugggguggcucauguuuguaauccuagcacuuugggaagccaagguaggagauugcuugaguccaguuugggcaacauagcaagaccuugucucuacagaaaaaaaaaaaagaagaagaaagaaagaaaaaaaaauagccaugcauggcggcaugcacuugguaguaucagcuacuugggagaaucacuugcccaggaguuugauuuuauaguuugcuaugauugagccacugcacucuggccugggugacagagccagacucagucucuacaaaaagagagaaagaaaaaaauauaaauacagagagcacaaauauacagugagugcuugaucuggaggguuuucucuuaaaauuuuggugucaugcaacucuggcuagaagaaaacuuuuucuguuaaguuccccuaaugaaaggaauuacagcagguuaaauuggucaguuugugaaagucuuaaggcauaauaccucugacuucuuaucuguaaaguauacucuuuuuuuuugagacggagucuagcucugucacccagguuggagugcaguggcaugaucucggcucacugcaaccucugccuccuggguucaggcgauucuccugccucagccucccgaguagcugggaucacaggcauccaccaccacggccucccaaagugcugggauuacaagugugagccaccacgcccagccgacucuuucaauaauagaaauauaacacugcuggcuuuuggcuguagugaaaacuucauuagaaagggaaaaacuugggaagggagucuuaccacaauuugaauuaaacacuugccaaagaaccugaagcaagcugauguuuauugucuuguugagugacccaagacuucuuucugcugguucuccuugaggagaggauuagguguugagcaaauuuacaaguauagcaugcaguuuuguuaaauacccaaugacauuucuuuucacaguucuuuugacuuuauacuguuuaaauauccucaguuaucucuuaauuugcuuuucuuucuuuaauuccugucgaaccagaaaguaacuuuuaugugaucaauucccuugucuagaauuuuuuggcuauuuauuuugaguugcaguauacacauugguuuguuaguaauuuccuuauuuuauguuuucuuuucuaguuuaacaugguuucauaaucuacacagugucuuauuauugggaugguuaugcgauaacuaucccaauuaacuucuuuuuguuucuuauuuuucuuuguaggcuaagaaauggcauuucaaaaggcagugaaagggacgauucuuguuggaggaggugcucuugcaacuguuuuaggacuuucucaguuugcucauuacagaaggaaacaaguaaguaacuguacuuguguugauuacaguaugcaacuuaaaucugcuaaagagcugucuauggggaaugugugcacuaacgguuuuguuuagaaauuacuugugaaguuucucaguuugaucugaaagauacuaauuuagaacagugccuuaaugauccuggagaacuguguguaucuccuuuuuuaaaaagugaauuucuuuuucaggaagcauuauuuagccuguguuuuggcucuuugguuuuuaaaagacugcuucauuuauaagugccaggauuucuucauuuagacuuuccuugucuaauucaucgaaaugucuggauaccuucuauguuccugccaaaaguuugucuuauuagaaggcaggcagcugagaaaggaaauggaaaagaaaaggcccaacugaauccugguuuuauuucuucaagguuuaguuacuuaugaaguauuacuuuguguuagguaaaaauuuaaaugaaggaaagccaggaaaaugagauugguaagaaguuuccaaauauuaugaaguguucaguuuguuuucuuuuuuuuucucuuuaccuuacaacugugacuucccauaguucaaacugaugcccggaaauaauuuugcugaauggcuuuguucuuuucaggcuugaaaugcuggcaaccaccguaguaguuaguaucagucucuuguucccccaucccaugucauuaggacauuuugugauacuagcuguguagugcauuucuuucucaaagaugaaggugaaggaauuuggcaaacaauuuguaacugagugauucauuuuucacauuuuuguggcugccuuuaagccaugguuugucuuauacuucuuguuucuguuucuuugugcuacaaggugguggagccaggcgcauugcuugcaaucccauauccugaaugaggaucacuuuaaaaacacauauuauggccagguucacugacucaaaccuguaaucccagcacuuugggaggccagggcaggcagaucccuugagcccagaaguuugagaccagccuggacaauauggugaaacccugucucuacaaaaaaauacaaaaauuagcugggcgugaugguguacaucuguagucccagcuacucuggaggcugaggugggaggacugcuugagccuggaagguggaggcuguagugagcugagaucaugccacuguacuucagccugggugacaaaaugaaacccugucucaaucaaucaauaaaaugcauaaauaaaaucacauauuaggaagaauuaguaugcuggccuaucauuaaaaaacccaacaagccaauuuuuaugugauucuugcuaaagaugggugauaccgaaagucuuuugauuagcaauagucuuuugauuaguguuagucuuuuucugcauucugaacugugaggacaucacucucaaugcauguauguugcaguuuuuauuuuuugaauugacacauaaucauuauacauauugauuggguucauaguggaguuuugauacguacaaugguauuauuaauucacugacuugguauugaaacucuuccucauccauugaucaugcuugauguacuauuucuuuuaaaagauugccuugguuccuuaaaagcaagugugaaaagauguggcuucugcugaggcuauuucagaagugcacuucuguuugggacaugggcauuaagggauuagauuacuucugccaucuuuacuggugcuaucugaaaugauacugaaaaaugccgaugccaaaggucacaauaucuaauaugaugaguuguugcuaaauuuauaugugguuuauaucuuuuaaccacaguaagcauguucuacuucagaguuuauagcuuaaauuuguaccuagguaacacuguuuuaucccuuuuuuugguuugauuucucucuaauaauugaucuuaaagaauagaauaaacagaagagacucuggccccaagcagucaaguuauagguggauuuuauucaguaaaaucaaggcaaaauaaagaccuauugauuccugggacauuuugucauuuuaucuuuccugaguuagacauccugaccacccuaauagccaaaugaaauggauagcagcagcuugaagucauuuauaauuuuaaccugacaaguucuguugaaaaagauuacuacaggcauaugcaaucaaugaguugcauaagaaauccaacuaugugcauuucuuuucuggugauuccugucccuuuaagauacugccauuagcauguauuugggggguagcaggugcgauguagccauagggacuggcaaaaaauaauaauaauaauaaaaaauaaaagcaagaaugagaagaggaaacaaccuauuccagacauugacauaaaaugaccacaggccuccauuaacucagcuguccucucucagaaaauaucugccaauaagagccauucuagcgggggggaauuuuccugacuucaauagucaaaaaaaaaucugcccuuugagauacauuaauuggcuacacuuuuguuuguagaagcuggggccuuaaaugugacuagguaugcuccauuuuucugcagagugauguuuaaguauuggcuuguuacagguauauuuaccuacuguauuuuuguauuuuuucuaguuuccuaagaagauuccaacugauaaacugccguuuauuaagaauaaguuaguuuugaaaccccaaguuccugauguccuagagagccaccuauugacuuugguucuggcacauuuugcuguguucuugcaugcucugucuuccuggccccuggcuugugccauuugguacucccaggacaaagcuucuucccugaaauaaaagcaggggcuauauucuaaauacaaauggauugaauauaaaaguugguacauuguuaaaacauuuuuggugaugagauaguacuaugaguguuuaggugccaggucagcuccugaaaaccuuugagucaauucuguaguuaaauuaccuuauauauguaaagaaaacaauuguauauucuuuaaaaauuaauuaaacauaagacagauugaaauugaauaagaugugguuucacuuaccuuuaaugcaguugccugaaucagagccauuguaggugggagaauagaggccuccauggagacugguguuucugggagcagguuagggguuagaggugguagcaaugaugcuuuugucucacucuacuucauaguauggcuuuucuucauacaagcauauuaacaaugcuauuacuuagguuuaucaaugaugaauagugcccacuguugagccaagugaacucuagagguuuauuauuuuuauuuucuaagggaaacaggucagauuuagaagagauagaggaaugugaggguuguuauagccuaaggagagggcaauuauuauuauuauucuuuuggagcugagcagccuaaaucuucaauuccaaccaaggaaguugaugaggaaaggagaugaagguuggcugacuucuuuugcuuguguccaccugcagagguuuguggccacagauaacauccacauuccaggccuuccucaguuaagcaucugagggcuuuuagcguggucuuagaguggcuucuucuucauuuucuuguccccuuuucuuuauuuuccacccauaagcaggugacaguuuccacaaagggagcuugaguuuucuucuccccagaccagcuguaugccaaggaacaagagucuuaguacugcgauauaagcauuuuaccacucaaagaaaccaaccccacugggaauggagcaagcagagacacucuguggugguguggagauuuuuuagaucaaguugauugugauucacuauuuaguauagguugguuuaauaauacacuuuuaauuggaugaaacuuggaggucaucuuauccagucuaaggucuacugaaaggaaguagcacuucauagaggagucuccuuuuucuaauuccaggcuggugggagaauggaguagaugaagagggaaauuuaaauuaggaaaaggggucaugggauacuuuuagaacaaguaaaccuuuuugagcaacagcaguagagagcauuaaagucagggcuccaugaggaguccucaggaagaugggaagguugggaugggaguggccagggagaaugaaacaagaauagagugggaaggaguacagggauuucacacggggcuacccuagucuuuuuucuuuucauuauagcccaacggcacuguuuaacacuuuuuuuuuuaaguuaacauuuauuucauaccuucuagguccuaacuggaaaaacugaugugaugauguaggcuuuucuuuaaccucagugaugugguugauaugacaaaaaucuauucgggucagaagaguggucuuucucacauaacacauucuagguuuguuccuuccaugaccuggucugaaggugugguggcuuugggcuuugugagccgagguaaaacuugagaaccacugagagcuuucucaaagcccggaugugaaaauuuuuuuccccccugcaccauaaauaggcaaggagugagcuucagaauaugaaaaucaagaucucucucucuuuuuuuuuuuuuuuuuccugagauggaguuucacucuuguugcccaggcuggagugccaggggcaugaucucagcucauugcaaccucugccuccuggguucaagcgauucuccugccucagccucccaaguagcugggauuacaagcacccugauucuaagaagaucauuccuccuaaggucucuuuuuaaugggaggaauuaucuucuuagaaucagggaaguaagaaauucucauugauuggugugccauucauaagcaacggaacaaaaaggccaagagcguuaucuuuagagcagucucugcagacugccugcaucuaacaccuagcuguacuuuucuuuuuugagguauguuuccuuaccuuuauuuauuuacauauuuauuccuuuauuuuuguuugacaugucauaauuguacauauuuauggaaugcagaaugauauuucugugcauguauacaacauguaacgaucaaaucaggguaauuagcauauccauuaccucaaacauugaucauuucuuuguguugugaacauuaaaaauccucucuuguagcuuuuugaaaauauacacuaaauuauuguuaaccauauucagcauauaguguuacaaagcccuagaacuuauuccaucuagcuguaacuuuguguguauuaaccaaccucucccugucuucccccuccccuccccuuuccagcuuuuaauaccaacaguucuacucucuauuucuaugagcucaauuuauuuuagcuccuagauaugagucagaacaugaaguauuugucuuucugugccugacuuauuucacuuaacauaauguccuccaggcucaucuguguuguugcaaaugacaggauuucauucuuuuucuuuuuuuuuuuuuuaaauagagauggggucuugccauguugcucaggcuggucuugaacuccugagcucaaguucacccaccucggccccaaagugcuggggaucacagacgugagucauugugcccggccuauuucauucuuuuuaauaacugaauaguauuccaucauguauacauauaccacauuuucuuuauucagucaucuguugauggacauuuagguugauuccauaucuuggcuauugugaacagcuaguucuguaucuuuauagcugagugacuauaggugauuuucuuaaauucucucagccucauuuucucccuucuaugaaauagggauaacagugguacuuccugcacagguuuauuaaaaagcagugaagccugggagaguuccuggaacauaggaagcuuucaaaaaguguuaccucuuaugagauucccaagggauaugaauauaaagugcgguuguagucagcaagcaaguugcucuugucacuagagaucuugcauucacggauacuuuguuaaaacuuuugggauuaguagcaaaugauauauccuucauuuuagguuauagaagaauggcucaaagacagguguaccaacacucuucuguuuuccuuucuccuugcuuccggaucugaggaugagcaagaauaucaacaccaauuguugacuuaaccucucuaacuguuauaauaaguuccuugaauuucccacuguuucuuucuuuuuuucuauguaggcuuauaugaauuauggcauacuugauuuauauaacugauauguugcuaaaaaguuacaagaauauaguuccuuugauaaauuaauaucagugccauuuauuggaauucuguggugaaacauucuuuaaaaacaggcaauauuagggaaaaaagcucuaacuuuuuuugggggggauaaaucugaauuuucauauaucauuguagcuugaaauggaaugcaauuaaacuaauuucuucuuucccaaagucagugauguucgagcauguugauauuauaauagguguugaugacaggaucuucaugauuugcaaaauagccucucacuuuguaagagacaucaauucucuaugcuugugaguggcuuaggaaauacuauaguucacucuguuauauguguuaauuaagggaauaugaaaaaaaacccugauaacagugauguguuaggugaguugaaauacagguaagccuauacuaccuuuguuagugucagcaaaacccaggaggaaaaauauuuaugcuaaugagaggcaaagugaugcauggauaauuaaaaucagcaggaauuuugagaacguuguuuuaacuuguaauugcaaucucucccucuccauaccuuauuuguaagagcucuaacgaaguagugcuuuuugauuaguaguaccaaugacucaaaaguuuuaaaggcaguagcaaaagauaagauuggacaagaagcaaaaaacaaaaaaaaaacaaaaaacaaaaauaacaaaaaagaaugaucaacucuagucaaaauaagaucuaauuuaggauuuauuugaauagaccccaaauaaagcaacauuuagcuuccugaaugugucuguuaugugaauguggcuggguuuuggugaaccuguuguagcguguguagguuauaaaaaauuucagaauuccaauuucuucauaaaauaaagauaauguaacuuuacuuacaggcuuuuuucucugccaagcacuaagucaauacauacaaaucagugaucacaguaccuggcacauagcaggucuucaguaucugcuuuacuucuuucccuuccccugagguaggauaugaacauuugaaauagaccuagccuugucaggcauaauaagaaagauauaacaucagaguuuaaaaaaaaauagcugaacuuuugguuggcacacuuuugcuuauauugaugacuaaacagauaaacugguagaggguagagaaacuugaaguucaaaugaguauuuguugaagagaaaucaaaaucauaagcauaguaucuaagauaugaugucaguuaggaaacaauuuaaucuuguggcaucugcaggaaaaaaagaaaauaaagaaacaauuuaaauuacaaacauuccaccuuagcauugcuuuucagcaguuucuuuguuugaauauaacaauuuguuuaucuuuugaacacccuuaacauuuucgaucauuuaaccucaauuagaaacauucuucagguucuugaacuaaggaggaucuguggguuugaaaucaguguaacucuuccugaacguugauguagcuguagcugaaacuaucacaugacacauuuauuugcuugcuugcuuuuuuuuuuuuuuuuuuuuuuuuaccagauugcuuuuaacuuuguaagucaauucaggcuacuagacuuucuuguucucccagaguaaacaauauucuaucugcagaggcauuuugcacagguuuguaagcaaucuuuccacuccccuccccgacuuuuuuuuugagacagugucucacugugucacccaggcuggagugcaguggcgggaucucggcucacugcaaccucugccucccggguucaagcaauucuucuugccucagccccccaacuagcugggauuacagucgccugccaccacggccggcuaauuuuuguauuuuuuaguagagaugggguuucgccauguuggccaggcuggucuugaacgccugaccuagggugauccgcccgccucggccucccaaagagccgggauuacaggcgugagcccagucccaaucuuucucuuuaaaaaaaaccuuaggaaaugcuauaaaaacgaauguuccuaaauagucuuuguuuuuuuuccuguaccuguugauggcagaauaauguugcuuuuuaaaaauucuuuccuugauggccaguugagguggcucaugccuguaaucccagcacuuugggaggcugaggcagguggaucaccugaagucagaaguucgagaccagcuuggccaacauggcaaagccccaucucuacuaaaaauacaaaaauuagccgggcauggugguggaugccuauaaucccagcuacucaggaggcugagacaggagaauugcuugaaccugggagguggagguuguagugagccgagaucgcaccacugcacuccagccugggcaacacagugagacugcaucucaaaacaaacaaauaaacaaacaaaaacaaaacccaauucuuuccuugagcauaacugaaacucuguaccccuuguucaacaucugcucacccacccucugcuuaccacuauuuuacucucugcuucuaugaguucgacuauuuuaacucucauguauaagugagaucauacaguauuugucuuucagugucuggcuuauuucacuuagcauaauguccuccagggcuauccauguugucagcaaugucaggacuuccuucuucuucuuuaaggcugaauaauauaccauuuuauguuuauacuacauuucuuuauucauccaucuguuuagguuguuuccauaucuuggcuguugugaauacauucugcauaggauaucuaacacuguaguucccaccuaaauguuaaaaucaaauaaaauggccauuucugaugguggaagaaggaacucaugguugagucauaagcuaccuguuuugcuuaaagagccaucagcguuaugucaaaugugaagguagaaaugucucugcaccauggcuuucuagggcuugcauuugaugaucuguccuucugagguguugucuguauggauuuauuuccuaauuuuuauuuuuguaaaugaucaugccucauccauucauaguccauucucuauuguguauggacuguaugcaauguaggcgaguuguaaaucuuggguuguaaaacuaagcacaugucaaacuuguguauuaauugaaguaagcuaauugguauaauaaccaauccucaaagcucaguggcuuaucauaaugcacguuuauuuguugcucacauuacaguucaguguggauagguggggaaccuauuuccugcaauuacccaggaaccuaugucucuuuauucuagugggucugccaugcuauaggggucucacccuacuggaucauuucuacuccacuguaugggaguguucucuggaagaaaagaaaaaguuuuguuaagcauuuagccauuacauaugugucuugaauuuaguuucuaaucugguggacaaaugagcuauauuucuuuugaugagaauuuuauuguuaggguuaugccaaagacuguaucauucauuugccucucuuauuuagaacccuuugcauggauuccuggaagaacuguuuuucucuuagaaauauaacuaaauuugugggaaugugucugauaucuaaagcuugaugaggauucugaauaaucuguauuuuagauaaggccaguugaaacuauucuuaacuacucuauaugguuaacuguuuuuucagagacauguuucaucaaagcacuaaaauuaugcagacagagcuggaaauguucucugaagagcauccuaucaucuuccuuauaauuuugguuuuuauuuaacacuuagcccccaaaguggggccauggcaauaucuuugaguuauaacucacaucaggccuucgaggaguuugugaugcuauuuuguugcuggcauacaaaaucagugagguuaacuguacuucuauaggucacucagugagucaacgacugagcuaugauuaacguugacagcuggugagcugcuaggcuguugcuaacugagcaacauugacauucauuuugauuugacuuugcauuucauuuucaacuaucuauucauuuuaaggccucuuuaaaaacuuuuuagggauguuguagacggaggaaacuuucuauaaaugcuuuggggagaguccuuuagcuucccucuccccauuccccauccuucagcuuaauaguuaaauuauguuuaugcuaggaaagcaucuucuagguaguuuuagaaauagaugauuuaaauagaaguuaggcgauuccaauuuugcuuuauuuguuuuguaauuugugauuucaacaaagaauuucuguaaacuaauuguacaauagugaguaccaacuagaaaaaucauauuuauauuugaugaaauaauucacagagaaaugaugaguaugcauuauaaauuuggccaaaauguauuuuugaacauagguuaaaguguagcugaaggccaucuagauuauaaagcuuggaaccggcugguuggcucaguugggcaucauuuuauucaccugagagggauggggaaagagugagcccucuuuaacuucuggaucuacuuccagaugcuuuagggaguuuauuaagaaaaagugcuggcugggugcauuggcucaugccuguaaucccagcacuuuaggaugccaaggcgggcagaucaccugcggucaggagcuugaggccagcuugaccaauguggcaaaaccccaccucuacuaaaaauacaaaaauuagccaggugugguggcggggggcgccuguaaucccagcuacuggggaggcuaaggcaggagaaucgcacaaacccaggagguggaaguugugcuuuggagcuaaggucaugccacugcacuccagccugggcaacauggugagacucugucucaaauuuaaaaaaaaaaagugcuauuucauagaauucugugugacaacuuaacugcccaaugugguuggcuuuaggugaggcagaugcccuaggacuucugaucucacuaacugccaucaacaguucugcacugcugaugccagaaaggcaggcagaucuagaggcccaagugaccuauacauauaggcaaagaugaccuagcagagcugaggacaugagauuuggagucaaaccugggaucaaauuuugauucuucgaauuacuugcucaagggauaacuaaagauuuccucacuggucaaaagauuccuccuuucuauggaaagugugagugacaccuaaggagcuaauguuaggggugugagcuggcagcuucuaggcaacuaaugguucuauuucuucuuccuucucuaucuaccccaaccucagacuuacucuccagguucucugacuuucagugagccaucagaguugaaaagcaagcauauauucuguuuuaaaaauauuugaaaaccuaucucccaaaucucagcucauauagucaauuacguuguuaacuuauuugaaguacauauauucagacagagccaagggguuuuccucaauuuuuagcuauaaaaaguuugauaauuuaaguguuuggauauuuucuaauugcuauuaaaagaacuucugugugauuucucaaaggaaucacagucacuuaaaaucuggacaguaccuucaaggggaacuagaccuucauucucagcuaccccagaaggaugggcuccuuuuuuuuucuuuuguguggaccccaguggagaugacaguguaaccauuggcaacucuaucuacagagugaucaugaaucccucaccgaauauguuuacacugagaaauguugcuuacucucauguaagugcaggaaaaaaaaugucaguuuuuagaaucacaaagugauucaggaagugaauaaaggccuuuaaaacaucuuaagauucacugugaggagaugcuuguuggauuuuccuuuuaggaauauauaaauaugguuagucuuuuuuagugacaaaaagcaggaagcaguuucccuuaaaucuuacgauuccaucgaucgacucauauauuaugggagagagugacgguugcagucugaggugauuugcaugagacccuacuuuauacuccaauuauuacuguacaugauuacaggacaaccugguuguuaauugccuguggucuuuaaauaugcacuucuuucagaaauagacacuaauuauuagaucuuguuuuuggucucacccgaaguuguaaaugucuaggauuuuuuuuuuuuuaauuugcaagucuaaugauauacagacauaguaaaacugaucucauucugaauccuguucagggugaacguucucugggauguaaacuaucaaagauugugaacuuggcuuucaguucuuuguagguguucaugugagucucuugacaaaaccuguauguuugcuaucagaaugcugaaggaauuuuaucuuucuaaaauauagaugaaaauugguaaacaaguugaaaaaaaucuacuucucccauaauuaaauauaauagaaauaacaucaaaguauuauuacauauuagauauucucccaauuccaccaagauaaaaauuuuguguuugggagcugugguuggaauuaugcuaggaaaaaggcaguuuguuuuguguguugggcucuccucuuuucuggcuucaauggcugaauuagggaauugauccugaauuugauagagcugcaguuguuccugucuuuaagccaagguuggugaacucaugugucuacaggggauagagugaugagguacaagugugaagccagugagcaggaauccuggacuaacaagagugcacaagccuugccuaaggauggcagcugcuacucaguuuuagcagauuuaucucagauagaaauucugauuuagaugugaaauauagcaauuuaaaaauauuggauguaugauuugguuuuuaagaaaguagugugcuaagcagagaaaacauucuagugcgacuucuaguuuuaacacaugcucuucccacuuccuuuccugguuuuugucacccagcuaaugccuauuacuuuuucucuacuugauuuagcugcauguuccaagaagccuucuugggucuguauaagaggugccuccuguggcucuuguagccucuuuucuaugccuauauccacuuuuaaacaauguuauaauugcuucuuuaucuuuuuguuuuguucccugggcuauagaauccuugaaggccuccacaaaauacugauuggaugaauaaguuugaugaauaaaugauggugggcccaggguuuccucaggacauagaguuuuuuccuuccuucuuccuuccuuccuuccuuccuuccuuccuuccuuccucccucccucccucccucccucccucgcucccuucucuucgucccuucccuccucuccccuccgcuccccuuccuuccuccccucccucuucccucuuuccuguuuccuccccuccccucccuuccuucuucccucccuuccuuccuuccuuccccuccccuccccuccuuccuucacuacccuccuuccuucucuccccuccccuccuuucuucccucccacuacccccucucccugacgcaggguuucggucucccaguuaauauagggccuauggccauuccaaggcuucuccuagaaccuccagaucaauccuucaauaaaaucuguaucccaaauuccuguguaaucaaacugccuuagaaaggagggugaacaaagggagggcaggucuaggaagauuuggaacccaaagcccucuugucuuaaaguguguuguuaccuguuuuauucuugcugcuuuucuccuuuuuauuuccccucaaucaacauauucuaggaaagguagagugcagauguguuuuugugacucaaaaccauaugaagccaaaaugagucuuuuuccugucauaauuauaaguagggccuuaggcuguguuuacugccucuaaaauaaacgugguacuuagcuucucaguugcaacacuucccagcuuuuauggaaaaaaaaaaaaaacaaaaauaaaauguuauuuuaaaaaguagugucagaaaguaaauaaauuacccuuaauagugcuguauguuuuaaaaaaauauuuuggagggacuguucaguaaaaccuucaaaacaaaacuauaccaaacaaacuacuuucuagauuuggcagcuggucauaucucacucuauuauaacuagucagucuacuuuuuaaauuuuuuucucaaauuauguguggugucagagugguauaguaguguaacaccuagucucuguugccaggcuaaguucaguuuucagcucuaccaugaacccgcuguguacuuagggaccaauugcuuaacuucuguaugucucagauaguucuguaaaaugaagaucuuaguaguaccuaacucauaaaguuauugugaggauuaaaugaguagaaaaaaagcaaaacccuuaaaauaaugucuggcacauaaaugcucuuuacauaauucacuuauuuuuuguuaagucaaguguauugagguauaauuuguaguauaaagugcaguaaaauuuacccuuuauaauuuacaauucuaugaguuuugauaaguuuauaaaauuuacccuuuauaauuuacaauucuaugaguuuugauacaguuauguaaugagcacugugaucaagcuguagaacauuccuaucagccucaccauucuuucaugcccuuuguagucaguccuuguacccccauucccagacccuggcaaccacugaucuguuuucagauucugugcuuugcuuguacagaacaugauauaaacagaagcacuggaaucauguaguauguagacuucugaaucuggcuucuuuugcuuaguacagggauuaguagacuuuucuguaaagaggcagagaguaaauguuuaaggcuugcaguccauauagucucugaugcaacuauucagcucugcuauuauagucauggacaacacauaaaugauuggauguggcuaucuuccagugaaacuuuguuuacaacaacagggagcagccagauuugggcugaagaccauaauuugcugaccccugauuuagcauauugcauuugaaguucauucguguugcuguguguagcaguagcuuguucucuuuuauuuccguuuauuauuccauugcuuacacaguuuguuuagucauucaccagguaaaggauguuuuaguuuuuuuuuccaguugaggacgauuaugaauaaagccauuguaaauuuuugccuacaggcuucuguaugaacacagauuuucauuucuuuuggguaacuauccaggagagggauugcuugguuguguaguguguguuuaccuuuauaagacacuccuggccaggcacgguggcucacaccuguaaucccagcacuuugggagcccgaggcugguggaucacgagggcaggaguucaagaccagccuggccaagauagugaaaccugucacuacuaaaacuauaaaaauuagccaggcgugguggcaggcaccuguaaucccagcuacucaggaggcugaggcaggagaaucgcuugaacccgggugacagagguuggagugagccgagauugugccacugcacuccagccugagugacagagugagacuccaucuaaaaaaaaaaaaaaagacacucccaaacuguuuuccaaaauagcuguauaauuuugcauuucuguaagcaguguaagagaguuucaauuguguugcauucucaccaccacuugguauucccucccuaccuuuuuuuuuuuuuuuuuuuuuuuuugagacagaauauccucugucaccuaggcuggagugcaguggugugaucucggcucacugcagccuccuucuccuggauucaagagauucuccuaucucagccuccugaguagcuggaacuauaggcgugugccaccaugcccggcuaauuuuuguauuuuuaguagagauggguuuugacacauuggccaggcugaucuugaacuccugaccucaggugauccuccugcuuuggucucccaaagugcugggagugagccacugcaccuggccuuuuuuuuuuuuuuucuuuuuuuuaaauuuuaaccauuguaaaagaccaugaagauucuuggaaaccugaauaaagcuauauucaguuggaagcucuugaaggguuuuauacauggaaaugacauuauuuggguuuuuaaaugaucacuccgguuguaauauagaaaaugauauggaaggaggcuggguaaaugugugaaggccuuugggagaauaucauguuaguauaggggagagggaagauaccuugauuugagagguagcaguggagaugaagugacuagauauggaaauguuuuagaagauggaacugauaaacucagugauugagcagauauaggacuuaagagacggggagcucucaagguuguuuccacauuucuggcaccagcaacuacauuuauaaugacacccuuacugagaugaggaacauugacagagaaaaagguuugagaagauaaaguaauugggucaauuuugagauauauguaagacauccaaauggaggucucaaguaggcagugugagaucuggguuccugaaugguggaacaaaauuagaaauuauugugguauaaaggauauuugaugauaugggguacauaagauuuucucucucucucuuacugucuguugaguuuagugauuugaggagagugaauuggauagaccuaagaggaaauuugguguuuaauuuugggcaguagagugacucacaaaggaagcuaagagagagugguucaaagaggcuggagagagagagaguugucccccagaugcccaggugagugaacaaucauuugugcauuuauuggauuugguggcauaguuggcauuuagucaguuuugugguuguugguagugguuggauguaugugaaaauucaaauuagggugagugugaggaguaaggagugaggcaguagaaaaaaaacaagauuuacaggucuaucgggaauuuuuaggauaguuguuagagauacauguaagagguguuuauuauuguugagacugagauagguuagagcuuggugaugagaaggacaagggagggagugaauauaggagaaacuguuguuaauggaaugagauccucacacacuagugaugccuuucagauccagcaaacuugaugaagggaaaacucagucaagauuaauguucacaguuagaguagaauagaggacuuuuaguauuaccaaguucuaaugaacuauaucauaauauggucuuuaaacuuauuucucaaguauuucucgaaaacuuaccaagcagaaaaugucagcaaucuuucugaugugugaaaaugcucuggcgguuuagucacuugucagucucauguccaaguccuacccaucuguccuggcgcaauugaaacccucaaaugaaagacucucccucccucaucugaauggccauagccugguguuuuuuucccucuaggguggcauuuauucuuucuauguacuuguuauauauauguauguguguguguguguguguguguguguguguguauaauuuuuuuccucauuagauggaaggcaaagaccauaauugaaauauguuaauguucucuguaguaccuacugguuacauuuauuuaguuaacaaacuaaauguauauaaagguaaaaaauagggacaugguuauuagcagauaauuaaaagaagcuauaugaaaaauaagauuuuugugguuuggugucagaauuuguagccugauaauaaguuuuuguuuuuaugaaauuuaguaaaacauguuuugaaaguuccuaaucauaugugacuaaaagaucaaauuauuuaacagagugauaacagcaacaacucuggugguuacuuugucauuuaccagugacuuucagauuauuauuccauucagacugaggauaauccaaagauacaaggagaaaucacagggauuuuugucaccauuuuacaagugaagaaaccagagauaaugagucaacaguuacauugcugguaaccaggugcuaaaucccaggcugggaucuucugauccuaauguggguuucuuucaguuuacccaauggcuucuagauuuacuuucauagaaauccaauuggccugauaauaauuaaaugcaacugcaggggguaaguggguuuccuuuauuugaaugaauuuaaaaaaucacuuauuuugggugauuaggauaaucucuugguaacgccugagauuaccuccucuugcacaugcuuuggccuguuggccuagagcuucaaauggggcuccugcagcagaaugggaaaaacaccaccaucauggauugcaaugaugcugugauuugaagaaaagaaaauggaagucacauaucuguggaauacuaauagagcaaugcuggccaguacuguuugcuauagugaacaaaccuaguauuagcauuuuggaaaaaaaccaaacaccauuuuccuggguuucugacucugccuucuggcaacuacuuauuuuuaaaguccaggaucauuuuuuauuuaggaugaaaagcuacauucuuuaagaaacuagaaauauggaaggucauuauuuuuuaggaggacuaugucagggccuuuaauuauauuauuguugaaguuucauaaaaacuguaauaaugggcugggugcaguggcucaugccuguaaucucagcaguuuggaaggccgaggcagauggauugcuugauugauucuaggaguucgagaccacgcugggcaacauggugaaaccccaucucuucaaaaaauacgaaaaucagccaggcuugguggcgcacaccuguagucccagcuacucuguaggcugagguggcagauucaccugaacguggggaggaugagguugcaguaagcugugauagugccaccgcaccccaggcugggcaacagaaugaagccccauaucaaaaaaauccaacaaacuguaaugguauauuuauauuacuuucaauguauagaaucuaugguuuuauauuaaaauauuuaguauggaagucuuugacuaaauuuuucugaaaaauauaauucucauuaaacauagcucauuauuuaguaccuucuguuaaauaaauucuuuuuaauuguacugacuuuaacuuauguacccccaaacucuagaauauaguuuugucaggagaacugaggaaugaagaauguauacuucugagaaaguguggaaagacaugaaguccuuuuuccuccuccuucaccacuuuaauaugucaucugaaugaauugcuaguacuggguaaaaaaaucuccuuauguucccuuauaaauugccuuagauaagguauuugggaauugcuauacaguguugugaauaauugaacuuggcuguauaugaagcaguugagacauugaaucugaaaccagguguccuauggcuaaauaguugugauucaugaaaagaaauacaccgagaaauguaaggauuguuuucccccaaggcaguugguccuauaacucuauguggacuguggacucucuuuagcucuuauauuccuuauuucuauuagaaauuuccuuuuaguauauuguaaaauuuguuaaauugacauuccaaauggacaacugaaagugaucugcuuuuacaucagaugaaccuggccuauguuaaagcagcagacugcauuucagaaccaguuaacagggagccuccuuccagagaagcucagcuacugacuuugcaaaacacaucugaauuugauauccuuguuauuggaggaggagcaacaggaaguggcugugcgcuagaugcugucaccagagguaagucuuuuuuuuuuuuauuuuaauuuuaaguucugggguacaugugcaggaugugcagguuuguuacauagguaagugugugccauggugguuugcugcaccuaucaacccaucaccuagguacaagcucagcaugcauuagcuauuuauccugaugcucucccucccccugccccaccccaaaggccccaguguguguuguuccccuccauguguccauguguucccauuguucagcucagagguaagucuugauguggauaacacuucauccuuucucccaguaaauacacaauaugcagucuauaguagugaggacacauuucucucuuguuuccagauuuuccauccuuaaugaagcaccuucacaguuuuugaaauauaggcacugcacaacuuuaaaaugaaauauaacucauuucacuucaaugaauuuguuuaaaaagaaaacuauauuuuaugaguuuauauuuuaugaguuuauuaauuuguucugguuuuuuuuaaagcacauauuuauauuuauauaaaauaaaaacauuuuuauaucacuugaaaucacauaucagucaaugguagaaaaauuuauuaagcugaaguaauuuauuaaaauaauuaucuuuguucauguaucucuuaaaaucaucucuucagugaaauauggacugcaguuugcgaaacuuuaguucaugcgaauaaauaauggaaaauaucacuaaucuauaguucugucucagucauucugucuauuaguggaaaggcaugaugaaaauggaaacgagacauguaaugaaagaaauuuuaguauagaacaccaaugcucuuggauauguuguguuuaauaaaauacuauguuuguuuuggcuguggguauuagcguggaauuuggagucagggaaaucuggguacuuauccuggcuuaacuucuuuaacagauguguauguguugguggacggggggcaaagcacuuaauuugucuaagguuccuugucuuucaaaugaggaaaaaauaccuucucugaaugauuguugugagaguuacauguuaaucaugaagagacuuagaacggugcuugucacacaaaguagcagcucaguaaauuauagauaguauuauagcuacuauuacuaacaugaauguaaaagacuuucagaaccaauugucuuggagaaggacuccacugugguauccucagaugucucgaauuggguaggauacugcugcaaggaauuuugacuguggaauauuuugguugcuauauaaaguucaauauuuauuauauuuuaacacugaaugggaaugauuuauuagauggaauaauucuucucagaucaauuaaauuacuacugcagccacucuugauuuaguuacuuuauguaccuggcagaaucuacucuuauggaaaugaaaugaauuuaaugaggucuacacacacacacacaaaaguacccuagaugacugauuucacaggauccacacucagguuuugguccaugcagaccucacagccuaaguuguuuuugucaaugcuaaauaauggcaaguucaaaauacaggcacaggaagucuacucuguuacaaaguugaccccaauuuucauaaaauuuucugucuccaaccaugaaauauaauuugagccagauuaaccuugauacacuaaggccuaaaggaagaacaguuugagaauaguuuuugagaauagauaauuugaauucagcuuuuuuccccuugaaggccugggaaagaagguggaaagaggggacacauucccaacauaaugggaggucuuguuuggaacuaccccuccaagaaauuagaauuuacuaggugauaauuuuguauaucaaagaggaucauuuccccaguaggauucaggaaaguguauuucuugguaucugcaggcauuuucaugcuaugcacuaaaauauguagccauucuuuuuauuuuaguuuuacaaauauaugcugagugccugcugucugcauggcgauaugcaaggugcuacaaugagcauacaaagaugauagaguugguaccguuagugugcccacaguucuauagugcuuguuugcacagaccacauuacaugauagagaauaugugagccuuuuaaaaggcucagggccauuacggacacugaaacaugaggguagucauaucuacauagaauggucaggagugggaaacuuuacuuaugcuguuuggcauagguaacauuuuaauaggcaaacauugcuugcucaaaguguuccagucugagaaaaugugcaggaggaacagcguggaaucaguguaugugggagacagcauguguuguaauuuggagcauugaggcuauauaugagagaacacaugagagaagaguggaaaggcagggcugggucugguaugcuaggggaaagccuuugggcuuuauugaauagaucacuuggagauacugccuuagguuuggugauggggaauggauacacgauacugaaggaacagucauaagcauaggcuuucaagagauguggagaaaaagaaaauagaaaggagguaacuugauggugugguaggauauaaagaagggagacaguauguuucacggauuuuuuuccuuuuuucuuuuuauaaagauaagaguaaucugaauauuucuguagacucaggggagaaaagucagugcuaggggagaagaaccuuaauaugcaaguauuagguugucauuacuuuuaaaugucauguaccaaccuaauaguagaaggcaaacauaaggaacaaggucuugugaaaauacaaggaaagagauaucagagauguaucuugguuuuagcaggaagguaagagacuuguuucucagggauagaaacaaaggguaaauucuaagacauaaagaguuugugugaguaugaagagcuacucuuaaacaaauacgaggugagauguucuacuuaugggugggaguaagggaugucauugcagagaaugugacaggaaaauagggguuucuuugcuguuagaaaauuuuaauuuauuauccacaugagacauuuauguguguauauauguguguguuuguguguccaguauuacugagaguagagguacagaaaauagaaagucacauagaaucuggaguugagaacugaguggauaucaaugaugaaaagaaaaaaugagacaagauucuaugaaaacagaggaaauuguugaaauguaggccuggagcugauaaggggucaugaaguuacaaagccaggcuucccuggaagaguuaaaggucagauugcaagacuucaagugcaguaauaauaaggcaaucacuaagugacuuuuauucuuuuucaccuucugaaaagucuuacuauauuugccuuugugcacuuuguauauuuauaguuuuuaaaaaaauagacaagauuguauuucuuuuuugcaguguguuucuuucaaauaguaguguguuuauaucaaucuuuacauuuauauaguauucaugauuuuuaaugggaaaauuccauuuuauuuauuuucauuuaauaacuuuauggaaaaacucauugcaaugauguucuuauuaauuauucuuuagguuguuuuugggugguuuuuuuuuuuucuauuuaaaacaaugcuauuugucaaucaaguucugaaccagcucugagaauaguaagacuaguaagauguggccuugauuucaaggaacaacuuagcaguuuauuacuauuuauugaacaaauaaacuuuuucuucuggcagugaagggcauucuguagugaucaagguauuagcuaguauauuagcagaugauugugggugaugauaguugugguggugaugauaaggaugacaauuuugaauaguuaagaguuuccagagccugaaaguugaucagguuuuuaauuuuuacaguuaacaguagcuaagaaaacgauguauuuuuaauauaucuuggcauauuaauuguggucuuaaaauaauugccugucuuauuuuauauauguggaauuaugauuuauaaaaaggaugggcaaacuuuagcuuguauuucucuuauuaugcugguagcccucugggaguagcauuuauaauuaaaauuuauaaagagauggcugaagguaaucuauauuuauccuuuuacuacaauuccugaucauaucaguggcccucugaagugugaaauaaucaugggcauuugguuaaugaauugugcauuguugcuguucauucauggaauuugcucuuuuaucauauuugaugcuucacuuaacaacaaauuuugcuuucucugcauuugauauguuuuuaccaaauuauuccugauuguauccauuaaucuuuagucacauuugacaaaaauaaauuacugugaucuuuuaaaguuaccaguaauaauuagauuuuucaggacaucaaaguuuuggggggaaccacuagauguuaaaggacuuguacaaaaauguuugcaugagcuuuuugauaaaauacugugcccaaaugcaauuuuaguaauggauaaacaaagacuauagaggacagacaaaaagucauggagucuucauaaugaacauuuauuugcauucuuaucaucugcauuuucuugggaaucaauuuucauuuguuucauuugggaauauuauuuuauaaacacaauaugcagacuucuccucacguucuccugcaggucucuaggaucaauagaaauugcuucacucuuuaacaccucugugucccguucuaggacagaagcaugucccaaaagcccaguugugggcacuuugcucccaaaggaagcuggaaaaggagaaucuguuaaauauauucacucccacagguucuucaagguguucucuuuagcuuuuuauguucuuuuauguaacuuuaccuguauguaucugggauuaucuaguacauuuuugguuuaaaaucugauguauuugcauucuuggugggccuguagaaaauaaaauaagaucugauguauaaaauuuaaccuuuaugucuucaguucaaauuccagagaagacugccucuuucuggaggaaaauauuaauuguaguucucuuguuuacaaauggagacuuuuauaaaugguauuuggcuagcaauucuugaauucccacuauaauuccuaaggcaguauagcgcagugauuaaggacacauauuauggaauuagaaugaacuugggucaugucuuggcuucauugcuuacuaccucugugaccuucgacaaguggcuuaaccuuacagagagccuuaaguuucucaggcauaaauggaggauaauaauaacauucuucucuauaaauaaacauuugggaaaggaaggagaugugugcauuguaggauaaaugcagaaaagggagagccuuggagauagugcauucugagaauuauggucuccacccauccaccaugaagguaggagaaaauucuacuucagaagguagaauugcaggaaguaaaaguuugcucuuugcuggacacagcuaauuagacuagauugcaaauuucucuuaaaauuaaucuggagauuuaacauaauuuuaauuaauguagugcuuuccuuuggccagggucagcggaaucgacuuaagaaacuguaaaacuuuaagaagagaacuacgccugugagauuuacuagacugauuuugaaaaagacuacugauaagggaaguagagaccuaucagauacuaaaguguauucuaaaacuacuguaauuaaaauaaucugguaaaggaacagagaaucagucauggagucuauaaauuagucuaucagucuuuaaauacaugaaguuuagaauaugguaaaggcagcauuucaaaacugucaucauuaguuacuuaauaaaugauguugggguauccacuccccccgauuuauauauaugcaugugugugugugugugugugucuguguauguaugcaugcauauauauucuguuuuaucauauuccaugugaaucaaggauguaacuuuaaaacaucauaaaacuauuagaagcagguauauguaaauuuuuuuuaaaaauuggguaggaaagguguuuuuaaguaugacagcaaaaagccauaaaggaaaagccugcuuuugauuuuauaaaaauuaaaauguauccauggcaaaagauguaaaagcaaaaaggugaaauuugggaaauauuuacaaaauagcaaacagacaggguuuaucucagguuuuuauuucaaguuuuguuuuguuuuguuuuuggagacagagucucacucuauuacccaggcuggagugcaguggcuccaucauagcucacugcagacucaaccuccuggguucaagagacccuaccaccucagccuccugaguagcuggaucuaaaagugugugccaccaggccugaugaguuuuuaaauuuuuuguagagaugaggucuugcugcauugccaggcuggucuagaacuccugagaucaagugguucucccaccuuggccucccaaaguguugggauuacaggcaggagccucugugccuggccauucugcacuuuucuaaauccuuuuguuauguuauaucugugauaaauaguauauagcuagauuauauuuauuuguuuuauuucuuuuuacacuuaauagacuaugucuuuuaaucaguaaauggaauccauuuacauuuuuuuuauuccaugugcauuugcuuuguauuuuuuuuaaucuuucaugcuuuuuauuuugcuucuuuucccccuuuucugcccuuauuagaucaguuuuguuucaugcucuuuuuccauacccucaacucuguaaguauaguaaugaccaugagagacuuuucuuggaaccaaaagacuccugcccuuguugauuuuggggaccuugcagacuagcugcugagacaaguggugccuuggcuguggugcuggugccaaggcugugucugucuuucugcuuccugggcccagagaguggucaagagaagcuugucaaccuccuugcacaagaggcagagacuuucuucagucccagcaaucaaaugcuccucuggcuuuuuuaccuuuccuuguaauggauauuuauauuccucuuacccuuuuggaacugagaucuugauugccuuugcccauuuuuagaccuugaaccuagcaagagagaagcuuuuggucuaaacauucugcucugaguuucuguuacauuucaaguccauugaguuuuaaucuuauuuuugagucaauuauguccuuuaaaauauaugcauauauaauuuucuguguuuuuaagaagaagaagaguucaaagcugagcuuacaaugucauacgggucagaauuuuauuuauaacaauauuuauaauggcaaaaaauuggagucuggcuuaauaaauuggauauucaguuauugaaaagagauagauguauaaguauuuacagggaaaauggcuaagauguguuacaaauuuuaaaaaagcaaguugugaagaaugagugcuaauuuuuauuuguuuuuaaagcgagaugguaucagauaguguucuuuaguaagcauaaaaaaguuucugauaaaauauauaagacaguuuuaauaguuaacauuguuuaccuguggauuuuguaacuaggaaaccaggaggccauuaguauaguuuuuuacaucauuaucuuuuuuugccuuucuauauuauuuggauauucuuccucucuuugaacauuggguauguuugauaauaccaaaguaaaaauaaaacgcaacagcagcaacucccuuauuccucaaaauuguguuauugcaauuguuacagccuaguacaguuuugugacuccauaaucauguguguacuuaacaaacauuaaaguauguuaaugauguguucuaacaacaucauaucucuauuaaucuguuuucuaauauaucuguuuucuaauauaaacauagaaauaaauaaccaacucaauaucauauauuuauauaaaaugcuaauauucacuuuuggaaaauaccaggccaaagcauuguaucgugaucgugaggauuaacaagucaggauuacuuugcagcuuuacaagaggauaauauuuuagaggaauugauccuucccauaaaauguucagccuucggguuagucccuuuucuuauuaauggcaauggcugucugaaauccaaaguuaagugcccaaagcuuuucuaaagaaagauaaacucaccuuuaaaaaaaaaaacuauauuauuuuuccuacaugcagcauguggcuuuaauaccuguucuuauggugcuaacauacaaagcaucuuaaauuuuuugauuuuuugugcuauuaucuuggugucucugauacuuauuucagagugauuauucucaccuuucuauuuagaaauaucuuaauagugacauuucuuaaaauuuguucuaaugauauaauuaaagauacaaggaguuuaaaugaaaauauaaucuugcagcacuaucuguaauagugaaacaaugggauaauccaaauauucaaaaauaagaaauugaauaaauuauuaaaauuaauagaauauuauccacauguuaaaaaugaaauuauagaaaaauauuuauugacauggguaaguguuuacaauaaacaguguuaaaugaaaaaaauuaaaucaaauauaccauaugauccuauuuuuacaaaaauguacauaugugauuauauacaugcauagaaaaugugaacguuuaaauacccaaaugucaacugugguuaucucugaguggugugauuacaggagaguuuuauuuuauucucuuugcuuaucugcauuuauuauauugagcauguuuucaugcauaauaagauaaucaguaaaagguauuaaaauauacuucuguucuauuucauguugugaaaguuaaaugucguaccauuuuuccucuuagauuguaauuauccuucuauauucauccaacuguuuugauccaugaauugguuuaguuggaaguaauuagaaauucucacucaggucagaaaagacaaagcuguaaagagcuguguuaguucauaacucuugccccaccuagaagauacaauuucaguuugcuaacagaugagaugauaaauggaauauagauuucaaguugacuuuauucuucuacucuaacuaaucuuguuauucugccuaagauuucagguaauguuacuccaaauauuaguauuuuauuacugucgcaaaauuccccagacuaccuacuaaaaguaaucaauaauaaaaacaaagccuuaaauaaugauacuaccacucccacuaaauguucuguuucaucuuaauagagauacagcuuauugcuuuccauaaaaaguagcugcuaacaagaaaaaagaaaaagaaaaacaaacuuacuauaaaaucuugaacuaauuuagugaauuaccuucacuacauagagaggccagcccuucccugccuguaauguaaggaggucacucuuucuacuuugagggaagaucucuccccagccuccucaaauccauaguaaggaguaguuucuugaauccugggugcauuauuuuuuaugcccuucaggcuuaauuauuuuaccuaagaacacaaaaugcuagcauugaauaucacuuaauacuauucacuaucugagaagauaaaacaccucccucuuuucacuuccuugcuuuauacuuaacauaccagaaaacugaacucuuaauuugauuucaguaauuuuugaggugaggaaacaauuuggauuuuugagaauugaaacagaaagggacagauuagauaacagaaccacagaagaaccucaaaaggcuuuuaaaaauguuauugucuucauugcaguugguugguugguuaauuaguuaagaaauaguugaguugcagcuaugacuucuaauaaugucuugauuuuauuuuccuccuuucuacuucucauucaacaaaaaugagagauuuaaaacauuuagcauauaauagcaguugaaaauuaaagaaaauuuuuagaguuuuuugugguuuggaaaacuuucaguaauacuuuuauguuacauggcauuuuaauauaucaauuuagcuauaacuuuggaaacuaaaauuuuaaguuuuugcucuggaaggagcaguaucguuucuuuccagaaauucugguggguaacuugauaauuugacacuagaaauaaugggacaagaaaaacagccugguuugacagagaggcccauuuuaacuuuuguugguauucacuaggguuucucacauaaguacaugugauaacuuuuaaaauguccaauacuggaaaaagcaguuuugagagcuuuaaaguguuagcucucacuuaaauauccugaaauauccuccugagauggcuugcuaauuccuagaguaguucccugccucacacucugucaauuugggaaauuaaaaaaaaaaaaaauccauccugacaacacagcccauaaaauuuucucuuuauaucacccuucaauaccaucucugccuucugaggccggauucuucauugccccaacuccuguuauaugacacugguccuccaaaaggucuccugccuccaguccuaccucuaccccucauuccugcagucagauuaaucuuuucugaaccuuaaucugauuucucagcugaaaacauuuugauaguucuccugacagucagcauaauaguauuucucaaaacaauaucugaggacuucuagaaaaaauuuaaauguuauuccuuuuuuauaauaauaaauuaacaagcacacccugguuccccagaauggauagcuuguaacuguguaaaauacuaaaaauacuaauauuagugcuugccugugcaugcuacaucuuuuuuuuuuuucuugagacggagucucacuguaucaccuaggcuggagugcaauggcacgaucucggcucacugcaaccuccgccuccuggguucaagcgauucuccugccucagccuccugaguagcugggauuacaggcaugcaccaccgugccugacaaauuuuuuuuuuaaguagagaugggguuuugccagguugaccaggcuggucuugaacuccugaccucaagugauccucccaccccucccaaagugcugggauuacagucaugagccacugugcccagccacuuuuucuuuuucuuuucuuuuuuuuuuuuugagauagggucucauucugucauucaggcugaagugcagcagugcaaucuuggcucacugcaacuucugucuuuugggcucaagccgauucucccaccucagccucccaaguagcugagaaaacaggcacaugccacuaugcccggcuaauuuuuguauuuuuugguugauacaggauuuugucaugaugucuaggcuggucuugaacuccugggcucaagugaucauccucccgccuuggcuuccaaagugcuaggauuaugugagccacucacaccuggccacaucuuguuuuuuucugaugaaacauuuguuucuuaaacugauccaggacacauagcuguguucucagaggcaucuuccuuuugaggagauccagauauuacuuacuugugagaaacagugguuaacaggacaagauccaaauaccugaauguguaagaagagcccucugagaucugccuugcccauucuuuguaccugcacuccaaccccugagugacaagcagccccuggauaagcuaggccacaugaagcguuugccuucucuuucuuaagcugggcuuugucgaugaucuuucccuuucuucacuccaccugcccugaacacguacuucucuguagacuuuucuuuccugaugacuccauccccagguacaaggaaaacucccaucucucccaucuuggcuauaguuaaucuucacacagggaauugugucacuacaaaacuauccccaaaacuugguggcguaaaacaacaauuaucaucagccaguuucaguaagucaggaaucugggugagccuuagcuggguacuguggcucugcaucccucauaguggacagugcuuucuaauaacucgcaugguuguuggacugaggucucuguuccucaccaccuguugaccaggagccucccuuuguuccuuaacucacaacaugacagcuugcuuuaccagagcaagcaagcaggagggcaauagagaauacuggaaagagagagagcacuucccagucuuuaaugaccuaaucacaguaguggcacaucaccugcucauuagaagaaaggugcuagucuagcccacacuccagggcagggggugacauacuaugcaguugggauuacuggagacugucuaaguagucugucuaccauagccuguaggauaccuuaggguagguaucccuaaggauaggcccaggugaggaagcugugggcugugggggaggcugcuuguccucucucaaccuuguuucccugccucucauggugugggcaucuugaugccaugacagugauuccaggguuuaaagagagguauauuuuaaauaaucuggcucuuaaauaucauuugaaagucaacucccucgucugaucuucagcugaagaaaaaauggucuauuuuagugcuagaagaagaacucuguguuggacuuacuaagaaaaggugauauagcucacugagauagugcauucuuaagagauuugcagauuuaauuuuucuggguuuauauccugaauuuaccuucuaacguggaguaugaugagagucuucuggauuuucaaacuuggccucuauuaaacugcugcacuuuguauacuugcuuuucuuugagcggggagauaccugacagccuaguucaugccuaauucacuucuaauaucaggauuuuggcucucaauauucuuaaaaauauguacuaauauuuuucuguguucuuagaauauucacuacuaaauucgcuaggcauugcuaggguuuuaauagcugagaauuuuacaggucuuucucuggcauauauacuuaaaaggagugaccuggggcugugauaccuguaacuuuuguguuauuuuucuagguaguuaaggcauuaacaguuuuugcccuugaaucaaaguucucuacuuuucucuccacagcuucuaaauauuuuguccuuuugagucaagggaauugcccugauuuuaugaugacauuuggguacgauauuuaaacuguuaaaaguuauaaaaacgacccuuugguauuaaauguaauaaguggcuuugaauugaauacaugcacagguucuccuaaaugaacuuugugaguccaaacugcucuaguuacguauucucauuguaacuggauucuaugacauucuuucauccuccaagaguguuccaggccaugaaaacuccucauggcuuggugucgauguauucuuugggucuuuuggcguauuggcuuucaucucucaacuccuguguggcacuuguaguacugauggucaucuccaguccugaagaggcagggugucucugcagcaaaacaaaacuaguuaucccuaggagaucuauaacagcccucaaguaaagggggcaugggcaacuucuagaacugaccuaucuuugcucagccuuuccuuaucaagaauauguucuucuuuuuuuuuuuuuuuuuuuauuuccugagauggagucucacccugucacccaggcuggagugcaguggcaugaucuuggcucacuguaaccucugccuccuggguucaagcgauucuccggccucagccucccgaguagcugggauuacaggcgcaugccaccaugccaccaugcccagcuaauuuuuuguauuuuuaguagagacagaguuucaccauguuggccagguuggucuugaacuccugaccucaagugauccacccgccuccgccucucaaagugcugggauuacaggcauaagccacuacgccuggcaagaauauauucuuuacucaugguuacucugcacaguguucauuuuuacuggcuuggauuucuuuguaauucuaaaauauugucauguucaaagguuuuaaauuagacuauaaacaccucaauaucagaacuuauucucuuucuuucuuucuuccuuucuuuuucuuucuuuccuuucuuugcuaucucuccccauuguauaucuaccauaauaccacuccagaugcauuucucaacagaagucaacacacagaaggaagucuagucuagauuuauucaugaugcaugcauuagaguagaucagagaugaggggcugcgacaggucuggacuguugugagagaugaacgagaguucuagaaggcuuugcaacaacauucaguuaacucuucauggguagaguugggugcuagucucuccuuugaccuucuaagugcaccagaguauguuacugccaugaaauugcacuguaauauuuucuaguugugauucauucacagcuuaauaugcuucuaguucuggcuugacuuuucccccaggaagagccuaaaaucucuucauuauaauauagacaguguacugcacuuugaauacaaauuuauccauguucagaguaauuuuucuugugauugucucuacccuggagaagugccuuuaaugaauuacauacaaauuguguaauuuaagaaguuaauuugguuuucugguuacacaggacuaaaaacagcccuuguagaaagagaugauuucucaucagggaccagcagcagaagcacuaaauugauccaugguggugugagauaucugcagaaggccaucaugaaguuggauauugagcagguaauuguguaugcugguuguuaaacaaaaauugcaacugugcuuuuuucuacccaauuaaaucagguuuuuuuuucuuuaauggcuuaaaagcauuucuuccuguuggaaauaccuauuuaguguauucugcuggaauaucuuucaggagaggugugucaguucuuuccuguaguauuauguuuauggguaaucaggggcuuuuucuucacaagcauguugaaguagcagauuuacaaaaucacuuuugaauguguugccuuuuaacaauuguguuuggguuuuugccaauggcuaccaaauugcuacuuugcaagcacuuucaggggagcuauguuguaaugcagggggagugcgaaauugauccucuuaacuacaacugcagucauaggcucauauugucacugacauauucugaaggaaaagaugaucugagucaugcuuuucuuaugucacacuuuauuguguccagccugccaccauuugaaaacugccaaggcaguguggaagaugacauuucccagagggguaaaaaaaaucagcugaacuuccuaucucuuuuuguacaugaaaaacacaguggcacuggcuugacauugucaaguuuugaaucugucucuuuuuuuuucuugacaagucaguuuugaaucuguccccuuauauuucucuucagcaucaugauggaggcaaagaaaacagcauaggauuuagaaucagcuaacuugugauguguucaggcuuauuuacucaaaaucuaugagucuguuaucuuauuuguaaaauuaguguuauaauagcaaugcuggcuuuuuagagaggcguaaugaggacuacagcaguuaagacaaaagccuuuuuauaaucuguaaaauacugugcaacuguuaagaagcaucauugcuugguuucaugaaggcaagauggaaacuuuuagcaugaauuugaacaaucuguuaucuccuacacagaaaaaauauuauggggaacugagaaagggagacaauccagaggaugcaagauaaauggcuacaauaaucuuguaacucaagucaggaaaauaucuuacaccugggaacucugacagcauguuuuucuccuaugcaaauacaguuaagguuucuaaaaaaucuuugagguugacagcaugauguauuauuagaaauuugauuaggagggagcuauccucacucagagauagaagguuucuguguaucaaucaguuggcagggugucuauuugccauuugaaaauauuaugaucuguuacugccaaacuaauuuucucuguuuugccuuucaguauaggaugguaaaagaagcccuucaugagcgugccaaccugcuagaaauugcuccccauuuaucagcuccauugccuauaaugcuuccaguuuacaaguaagccuuuugauaucaccuguaugcauuugcuucucugcggucaauagaacaacaguuuuaauggaaauaaucccucaaugcauauuucauaaugugguuuuaauugguccuaaucuuuaauccuuuugaaguauuuuccuuuguuguauuuaaaaguauggcuuuucuuaaauuacucucuacuggccuaucucuagauuuuaaaggcaaaggaggucguauucuguauuuguaauuaguaguuucuuacuccaguuucugagaguauauagaugagcaacugcauuugcauuaaggaacauaagaggaucaugugcagacuguaaaugguugagcuaaaguauccuguuauaaaauguaaacauaccacauaccacuugaaacccaaggcauuuugagucauguuacgugucugaguuaaccaaggcugaaauuugguuaggaagugucagauuauaaauuauaaaacuuaauuuuccuaauguuuuuagagcuauccaugaaguugccuuacauuggaauucagguaguaugaacaaguagauuauguaacucuuuuagccacauuaguguuguagggggcuggaaacagauuuuuuauaauuuuguucauccuucaucauagaucgcuuaggacuuccugaaccagugauucuuaauccuggguguacauugucaucauccaggcccccacccuagucuaguuaaaucaguuucuggauguaugaggcuuaggcaucaguauuuuuaauguuccccagagaauucuaauauucagccaguuugagaacagcugccucagagaagauucauuuaaaaucucauugauuuauuuuacuuauagacuucagcuagguuggugucaaaaacaguugcauaagucuguuucuuuugcaguccacuucuagguaugcuuuguuuuucuuaaaugaaagugucuuguaguguaagguaauauucuauaaugcuauacucuguuucugaagaacuuuccccccuauuuaugcuguaggugguggcaguuaccuuacuacuggguaggaaucaagcuguaugauuugguugcaggaagcaauugccuaaaaagcaguuauguccucagcaaaucaagagcccuugaacauuucccaaugcuccagaaggacaaacugguaggagcaauugucuacuaugacgguaugugauguuuuuuuuuuuuuuccucacaagauacuuuucucucacucaugacccguauaguguauucuuaaggagauaguuuugcaucuuuaaauacuaaucuuacacaacacacaaacacacgugcacgcacauauucaccauuuucucuaacgguggcugaaaaacuaaccauaccauuuuaccuuuaauacuguuuauuuuacauauuuguuuucuucuuugauuucuacuuugugucucaugguugguuugguccauuucucauuauuaugaauuugguccccacccucaugccauguaauuuguuauguguuugcuagugaauauuugccuuaugaauauauuauaauguugaaagcagcugaggauauguuagguuuucuagaugaaaccuccauuuucaagggguuauaaaccuagggggaaaaaugcccugugggcugaaauugacauguuuguauuuugcacaggacacaauucuugaauguauaauuuauaugacgaagguagaugaacauugcaucuguuaaacugcucugaguuuuuauugcuuauuuuauuguuguuagauguuuucuaauagugacauuacauaguggccauuugccauguguucaauguucauucuuuuuuuuuuuuuuugcauguaugcaauauaguuuuguacacuuuuauuugaaggaacacuuaauguaucuccagaugguccacaaaacaacauaaaacaaaacaggcaaagccauuuguaaaauuuuacuaguaguuuuaaagagugugugagauuggaauauaguccaaggguguccauuuauaaggaaauagcugaacacagauaauuauacauguucaaaaaguccuaaaaauuuugugaugcagaggacagcuuagauuuuauaccucagugagccccccacccccguuguauuaucuuuucuaucuaguauuagauaucuaaacucuuagcaagaagaauuuguuguuguuuuauuuuuuucaggauacuuugauauuuauacugaauacuaugggaugucccaaaggcuaucccuguguuuuuuucuucuuuccaguguuacauuucugaaccaauucagcugucaggcuuucauauauaaaugcaaaaaguauauguacagagagggaaaaggggaccaaacucaagaaaauguccuaggaucaacaauauuagaaaaauguuaagggucuuagguaaacauuaaaagcuagaaaauucacaguuuacagugcuuccgagcaucugaacaccacaggggggccacuuaacuauuuuuuuggugcccuugauugagucuacauguuaaaggacaaccuuaacugugaauuugcuuucucugcauuggacccuuaauguuaauccauuguaguuuauugggugauuauaguaaagagguuuuugguccaggaggaguaugaaggcauucuguaaauagcguccugcccauccugacauggaaauguuuguggccuuucccucuuauuacuaaucccuccugcacaaacccucucacauacuuacucauuuucuauacuuugugaucuauuaggcacuaaccaauuuuauuuguaagcuugucaauaucugaaucuuuuaaaaauaaguauuagugggcuggguauguugguucacaccuguaauccuagcacuuuaagaggccaaggcagccagaucacuugaccccaguucaagaccaacauggcgaauccucaucucuacuaaaaauacaagaaauuagccaggugcgguggcaugcacuuguagucccagcuacuuggggggcugagguggcugcagugagcugagaucccgccauuacacuccagccugggcaacagcaugagacccuauuucaaaaaaaaaaaaagaagaagaagaaaagaaauauuagcaaaugucauaucugaauuugugacauccuguuuuacauugguuugguauuguugugaauuauagauucuuauuuggaauuguugugaauuauagauucuuauugauucuacauggagaagccaagggaaaccuuuguuacacaaggcagaagaaagauuauucucuuagaaucaugaggaaaaagaauucuuuaaucuagaauugaucuuuauagccuguuauagguugcaaaauuaugagcuuagcaaaaauuccugaaaaauuuaaaaaguauuuaaaauauuuucaaauugcucuuuggaaauuacuuguaaaaucuuaagucuugaggcaaaggaguaaaaauaaguauauucuacucauuugauauaaauaauuugucuuuugaccuuguucugaaaugguacaggcccaacuauaucauacuugaggugaggcaaaacaagcaugugcaacaguguaguuuugugguuuuacaacuauauuuacauguggggcaacucuuguuuuacauaauauggugugaugaucaaauugaauaucgacauggaaacaaggugacgaggagcauguagguaaaagaauuaaaugaguaaauccaugcucaacaaaaggaaugaacgccuuuuuucccuuugacuggaaaaauguuauuacaguaucauccugcuacuaaaguauuucagagaggaaaauauuucaaugugaacuuuuaucauugcaaacccaagucuaaacaugguaguuuauaagauaagcuuuucuuaacaaggaaaauacauacucuucauaaaucaccaugaugagaauauaacaauagucacugaagugauuucaaguugcauucaggcuucuugaaauaauguugaauuuacuuuaaaaauaacauauugaggugaaauucaauaaaauucaauuaaaauuagccauuuuaaagugaacagaaauaauuuuuauaacucccaccaagggagaauuuugaaucugaugagaaaguggcguaaguaaucaaaugaacuuuuaauuuuaauuaauuaaguuuuuugagacagagucuugcccugucacccaggcuggaaugcaguagcaugaucauagcuucccacagccucuaaucuccggggcucaagcaauccuccugccucagucucccaaguagcugggauuacacuuagcaugugccacuauaccuggcuaguuguuuuuuacuuuugcuagagacaaggucucccuguauugccuaggcuagucuugaacuccugagcucaagggauucucccucccuggacuuccaaaguguuggaauuauaggcgugagccacugugaccagauaaucaaaugaacauuuaaugcugcaagaaguuuugcuaacuaaaaauucuuauuaguaauaucuuauacacuuacuucagcaaccaugaaaagugaaauauaaugaugugaaaauauagugggacaaacuaauaaauguugccauuaauauggaccaggcacugagaagaucuguaagguaucuucaacgcagagauguuagggcuguaagagguuuccucugaaguacaaaauguacaaagauaaaaauuuuaauuucucauaaacacaguucauccuaauuaaauucuggauggcuauugcauaugaugaaggcaaaguuuguucucccacagaaguucauagagguaauaaagaaguuccaugcacucuucccuccaacauuuuauauauuuuuuuuaauuuuuauuuuuuguagagacaggcuggucuugaacuccuggccucaagugauccucccgccuuggccucccaaaguguugggauuacaggcaugagccacuucaucuggcccuucauacuuuuugauguaguaauuauaguuacuguucugugcaugacauaaguaugaucuguaccauauuuuauuguuaaccacugaaaaacaaauucacauaaauggaggaauaacugucauauuuuuaaaugcagacagagagaaucucaaauuucucagugaaauccauaugaaaugaaaauugggauaguaaaugacauaccaguuuuuccuccaguuguauuuccuucuuauauucuguuagaguaaucauauagucaacucacugguuuucugacugagacauguccuagcauuuucuaacuugccuagaagagacccacagcuggccauuacugcugauaagggaguuaucaaguagagaguauggugaccaggccaacuuucucaagucagaagaaaguguuuagggcauggcaugccugggugacuugacaggcugugagauuaugugaaccagcuguuagggguagccaguuuucucaggaacuuauuuuuuuuuuccucuauuuguucccagaguggaucuuuguggcuauucuaguuagacuccagucauccaaucuaguacacagaaaaugagcuauaauuaaaaaucauuaaauauuaaaaaccauucaauaccuccauuaagccauuauaaaaugaaacugaagaacaaaauuacagcuuuaaauucuuccuuucugagagucaagacauugacagagaugucuguuguuucauacccgacgaugcuucuaaguauuccuuaugcacauaugaaaauagcaacuauaagaaauuacauugccuuuuccuaauguaaauaaaaguugguuacauccauauuucaaagggggaauuaaagcccagguuucacuagaauauucauuuuuauuccaaccuaaaauucacagcauacaaauagaugaauucagcucgugagagagcaaagccaauuuaaucucuggcuccccugagguaaauguaguucacgguccugcccccaccccaaccucagcuauaaucccuggcuccuggagguaaaaaugcacugaagugaggaaaauucugcagcaggauauaaugauccaaaaugacagggacaauaaugacaaugaauuucaugucucccagucacgagcuggaggugcuugacuaggcugacuuauacaauuaaauuguuacagguacagcaggagaugcaguuagcuguaugcuuuggggaacgaugccucuggcaaaaggcauauuguggaauccaggcucuuuuguuaggagcaagcuauuacuccucuaggcaugcaccugcaauuguacacuuuaauaaaagaaagcccggguuaaagacaaguauuuuaagguguugauuuuaucuacuuggaaagcuaaaaaaaucaauuaccaguaucacaaaagugauuuuuuuggucuuuuuguuguuuguuuuuucauugaguuccuggaacauaaguaaaaucuuaagauggugccuuuaauccucauuuacacuauuuguaaacagaguuguugaaugaauuggguguuaccuacuuuaaaucagacagauauuaauuucuucaaaauaauagaaauagauugaacagauaacugaacaauguggauuuacaaacagaauauuaauagcaaguccuuuaagcaaguuugggcuacuugcuucuuaaugcaauucuugugaauuggagugguaaucuccauaaucuccaaagugaaagaugugagccucaugaggugcacacacccauccacuaggguauaggaggaacacauuagaacuucuacuucgauauguuuuuaaaguuuaauuccuuauaaauuugaaaugguucaaaugucuauaauauauaaaaacaguaauauguacauuauguaauuuauaaauaaauauacacauauuggagauacauacugauauuuacuuuuggaauagucaguuuaauuuuuuugggggggggccacuaguaauuugucauuauuuuauuucuuugauaauuggcuauuuaaauauuuucaagauagauguguuuagugagaggacagauugcuuuggaagaguaaacauaaccaaaucccuuucuucaucucccaauguuuaauuucuaugaaauuuaauugagguggcugaaaacauaaaaacaaagaacuauugaauaagaggagguauuggcaugauacauuaaaauuguguauuuaaagaaaauuuucaucuuaacauaaugcauuuauuuuaaaauguaaaguccuauuugccaacaauuuccagggcuccuacccuuuuuguauccuuauuauugugcaaccaagguuuaaaauuauguaaauauugauacacauaaaagaauacguguaacacguauguaaguuguaaaguuagucauuaagauugugggaucugcaacuguccuuaaaaccuagugagauaggagaguugccuggacccuucgugggacuugcgacagggguguggcucgauuaccuggccgggugcucaaaccccuugugggugggggagcacccaggcaaacaggugccugggccagggugagugccuuugggcuccagccccauggcagcaucuagggguguguuaugauuaaugcucuuuuggcaguugccauccaagauggcuaaguauuaagcagcucaguggagagucagggugacagccuuuuacaccuugccuucuugguacccagguucuugcccagcaucugggaagaaucaggucauacagacuuggaggauggugaaugcagagguuuuauugagugguggagguggcccucagugggauggggagcuggaaaggggauggagugggaagauaaccucccugucuccaaccguccagcugccucuucuuuucucucauucucugcuaugccacuccacuccucugccgguggaauuugggguuuuuauagguacaggauggggguguugugggucagggugguuuuugaaaaaacaacauucgggugggaaaacagggauaugaaguucucauuuagggccaugggcccaggcuuguggauggggccauugccggggaacuacccucugcuacccaguauuucccugccuccuguccaauaucacuaggauauuaccaagacauugaagccaacugugacuauucaccauuucauuuccuugucuucccuagaaauaacugcuaugcugaauuguauuauuaggguuccuggucuuucuaauaaucuuauuauauguacauguauuucuaaaguaauguauuguucaguuuuauuuauuuauuuuuaaaauuauuuuuauuguuauuuauuuauuuauuuauuuauuuauuuauuuauuuauuuugagauggagucucacucugucgcucaagcaggguccaguggcacgaucuuggcuuauugcaaccuccaccucccgggcucaagccauuaucccaccucggucuccugagcagcugggauuacaggcacgugccaccaugcccagcuaauuuuuuuguauuucaguagagaugggguuucaccauguugcccagggugguuucgaacaccugagcucuggcaguccgccugccucagccucucaaagugcugggauugcaggcgugagccaccaugcccggcuguucaguuuuauuuuuaaacuuuguaaaaguauuaugugaugguuacauaaggugauauaaauuuuguagagcaguuggacaugccuagaaaaguuggggguacauugugaucuaguaauuuuauuaguagguauaugccuuaggggaacuguugcaugugucuaccaggguauauguacaaaaaguucauagaagcacuggguauaauuucaaaaagggaaguaaugcaaauauccaucaagaggaaaaugaauauuuaauauauggucuguucacauaauggaguaaaacacagcauugaaagugcaugaacuguaaacugaacaacacagaugaaucuuagaaaaauaauguugaaaauggcaugauaaauuguuuuggaauuguaagcauugcaaucauacuagaaagcuacuuuccaaaguauuguagggucuuuaaaucaaucagcaauauggaaggagaugacuuagguuuacaaacuuaacugcacuuugagcucugcauuacacaucuauaaauuuaggcuuaugacaccuaauucacaggcuguuuugauauuuaaaugaacuacuauaauaaaugcaaaauaauuuauaaguacaaaacauuacucccguauuauuuuuggggggucaauuucauggauacucuauaguccaccaaauuucuacuuuuugugaaaauauuccaaagugaagcaucaguuccacaagcauccccuuguauguuuaaaauuugaagauucuucuagaaaaacuugccaaacauucuuaggauaaaaggaaaaaauauugcacauaugaacaugccucagguaaguauaaucuuugaaguuuaagaauuaaaaaccauaacauuuuaauagaacuuccucuaaacauuccuuccucuuagacauugauuuaaaacauauuugcuuuuaauauuucuccuuguucauaugcaauuuuacacuucuaaacuaaaugaauaguuuuaaucuugauuuccuacugucagcuuuccuguuguauuucuccucuuguuuucuaugaguuacauaaaugaaacugacaucauugcucauacagcaggcauauuuuuuuuugcccccaaaugcugccuuuuugcuauucaguguaucuggauaccagcuaaugcuaaaugaaguuugacauguaccccuaagaaacaaaacuuauaaauuguggcuucaaaggaaaccuugaauaaauaggacacacuguguccacccaggcuaacauccagcauauguuuuagcuuccugaugaugagauagagcaaaauagcccccaggaaacuuugcaauuguuuauugcucacuugcccagcauguauuaaauaccaggcuuucauucucuuauaauuugcuuuuuuuaaaauuaaaauccaccaaaguagauuugaucagguauagcaagccgagauaguagucauccauauuuguacucuguauauaaaagcuuaaagacagugcuaaaaauucuccaguaguaggauguauguaaguuguuugaacagauaguucuaguggguucauaguaagcuauuuaccucucccauucugugguucaguugacccauuuaaaaaagauucaggaucaaaggcagaagcuauuguaucaaaaaucuuuguccacucuucucuugauuuacucauucauccaaaaaauauuuauggaaccucuacuauuugccaggcauuguacauauaugccauauauuuugccaaauacauggucccuaccaccaccaauguuuuacauuuguguagcagagugugguuuuuuaagcuuuuuuuuuuuuuuugcagaaauuaucuuugaacuaacuuuguauguaugcugggauaggauauuaugaucucuauuuuacaggaaggaagaggaaucauagcuaaaaaucuacauugauaguuuagauacauggggaugugaagauaauuuuauuuuuuagcuaaaaagaggacuuuacaaaaugaagauuauagcaucauggcuucuuucagcuaugauugauuuuuuuuuuucuuuuuaaagacuuuacuuuuuuagagaaauuuuagguucacaacaaaauugagagaaagguacagagacuuccucuuuccccccugcucccauacauguuuagacucucccacuaucaacaucccucacugcagugaagcauucguuucagucaaugaaccuacauggacacaucauuaucacccagaguccauagucuacaugaaguuucacucuugguguacauucugucggcucugauaaauauauaaugauauguauccaccacugccauaucauacugaauaguuucgcuggccuaaaaauccucugugcucugccuagucauccuucccccuccccuaaccccuggcaaccaaugaucuuuucacugucuccagaguugugccuuucccagaaugacauguaguuggaauccuacaguaugucagcuaccauugauuuuuaaguucguuauacacuuuuaaaaaguagccaaauaguucaacaaaggcuauccaauuuuauuauggaaaacucaaauauaugcaaaauuaaugagaauaauaaaauuaacuuucaauuuuagcacuuauaaacucaugaccaaacacuuauaaacucauggccagucuauacucucauuuccccuuucccccacuccccacuauaacaaauguuuuauccauggauauuuagucuguaucuuuaaaguuaagaacucucuuucaaacacagccacaccuaaauuguucaacaauaauuucuuuucuagauagauagauagauagauagauagauagauagauagauagauagauauuuuauggagauggggucuugcucuguugcccaggcuggucuugaacuccugggcucaagugauccucccaccuuggccucccgaagugcugggauuccaggcauaagccacuauacccagccaacaauaauuucuuaauaucaaauaucugguuauguucacaugucccuuauaaucucauaacuuuauuaggcuccugauuuuaaaaaccaacucauaaaaaauagacaaaaucuuacauauaaguugauucauucuuuuuauuguuguuauuauauuuuagauucaggggcacauguacagguuuguuacauggauauauuauugcuuaauggugacguuggggcuucuagugaacccaucacccaaauagugaacauuauacucaauagguagcuuuuuaacucucacccucuucccacccacccccaccuuuuggagcccccaguguggauucauucuuuuuuaacugauagguuuccagucccuuuuuuuguuuccugaugguuuuauguaacaguuucccuuugauguaaauugguagacuugucucauuaaucuguugcugcauaagaagcaacaccuaagcucaguggcuuaaaacaaugauugguuauuucucauaguucugaggauggaugggcucagcugggugguugucacuugggguccuucuauauaguuauagugagauggcagcuggggcugaagucuucuaaaggcuucuuuacuuuccuguuuggugccuggacuuggaaggcugggguggccacaacuuggucuggcaccucuuucaccauggcuucucuguauggcuagcuuggacuuuuucacaggguacagacuucuuaugugguggcuggcuuaccccaugagcccaccaggagaccaaagcagaaacagagggcuucuuuugaccuagucuuagaagucacacagugucacuuucaccacauucuguuaauuaaaguaaaucacaaaagcagccaaacuuaaaagagaggggauuacaaaaguaagaaaagcagaaggcguaguuuacugaggagaggugggacauauuuggugacuagcaacaaaaaggcuagaucaaauuguuuugucaaaaauacuuuaugggugauguaaauuuccaucacaagucuguuuaccucuuuuuaauuuuuuuaaauuaguaauuauaauuauugccuagauaauuacagcauuucauuagagguuaagggguuauaaaauguuacuuuuauaauucuauuuuuccuucuuuauggguuaguuggauuacuuauaauuucccuguaucaacuaucugccuaccuuaagguauauuguauauaggaaagucuggauaaaugcuugauucuuuucauuuauuuguacucaaaaauaaugaguuagcuuuuuuaguauccuccaaauguaaugagaucuuuuucugaggggaagcuugucaacauaaacucaugaauuugaaguauuugauagauacaugucaauccaucagaauuauugauguucauauugcccaucucuggcccuggggcacuuccugcaguuggccccugagcccuuuugauacccugucaguggucuaugaugauuucugugcuguuugcuaugacaagauacuccgguuucaucuugaaacuuuccuucccuaguuuuggaagcagccauuucuucaguaacacuugacucccucauguggaaaaugguaacuagggaccauaaucuauuugcuaugaagguucauugcuacugguuggucauuauuucuaggccuuucaauagaaaaaauuaggaaaaaaauuaugugaagaagaaaaacauguugaguuuuuagauacaguuccacuucaaauuuaguauuacaugguuuuuauuuaacguuaucaaucagacuuccaaaacaguuuaauuuuauuuuucaguuucguuguugaauggggacauacggacaaauuacugucuuuuaaagugacuuaacauauuuauuuccuauaagugugguuaugucaccacuuaauacaacagauaauuucauuuugcuuuagaugauuaggaauuuauuuuuuuaaacugugcuucuguuuuauaaauuauguaaauaaaguguuuuaaaguaaaaaauguaaacaaagacaauucaaacaaggcuagcuucuuuccuuguucugcccuauucccuccuucuuuaaaauuaacuuaaaaaauuuuuuuaggauuuugguauguucuuuuaacguauguaugcauauguguuuauuauauguacacuuguuuuugcucugccuaccauuuuguaggugguaguagugccaugcuuuuuucaccuaauagaguagauacugcuuuccauaaguauaagaggccacaaaauuuuaaaaggugaauuuaaaagcagggaccaacuuuuauggaauuacauuucauagccauguuaacugcuuagaucaaaauauaccugcucauacagccuuagccaucaauaaaccacacuuucaaauuauuuuucuuuuuauaagugaaaauaaaaucuuauuuccuuucuuuggauaccacaaaacaaugacacauccacuagucugaucuguguagagagcuuaaaauuaaucagagagucucaaaugcuguuauuaucauuauguaaaauaugcugugauuuguucaaauuugcuaaaaucugguucauaacauuugcuugcauugaaugcuaauaugcuuagucagacuaagugcuucugucaauuauagucuuuuaaauagaugagucugucuuauacuaauaugugaaauuauacuucuugguaaaauuuguguugauaugcuuuauauuaauggugcauuuuuuaaaauuuagagauaaagcuaauuaauuguaguuuaagauauaaaaauuugagggacuuucugcuuuuguuucaaagacauucggagaacacaugcccaagaaauguaagccaugcuuaaaaauacugcauuuugaagcuugcaguaacuaucuaaugaauucgucucagagugauucuccuucagaaaaacaaaauuuuauaggucacauuuggaaacaaggagaggaggaaauaacugacauugcaauauggggaaauaaaugggaaauaaaaggccauaaugauuggucuucaggaagcuguaaggauuguucuucaggaacuaauuuuucuugcuacuuuauuguguggacaauauaaugccucacguaucuguuggcauagucccuaguuucucucugcuguacccauucuucacauauuuucuagcauucuuucaagaggaucaggagucuuugcccagauaccuguuugggaaaaggaagaaagagaguaaaaaauuaauaauuaaaucaauuuuggaguuauucugcagaugacacacagcagcuuucuuaguguaauggaaagccagccugguauuaagcaucuaaccucacaaagaauggcaguaauaaaaauaucucuucaauuaaaaagccccacacuuuaguuucaacuaccaagccuuggaaauguaauaaaaaaaaaacugugaaaaaaagucuucgguacauaguuuuuauaaauauaacuaacaccuugguguagauuauauucucuggagccaaauagauuacuauuuuagaaugugaaguuucaaacuaguuucauuauuacuauuaauacuuacucauaucacacuuacauuaguaaaacccucuguagaucauuauauccacucaagcaugaaccacacaacaccuauuuuuuuuaacucaucuuugcacauuaaaaaacauacaggcacacgcaacuaaccucccacacaaguuaaauaacuauugcuccuuuucuguucaaaaccaaauauauacucuugcauucacuggaaaguguuacuaguauaugauuugcuaucuauucagaagaauagauauuugagaauaaaauaaaaaaguauauaauaaugaaagcaacuaccaaauuaaaagcaauaucaaauaauuuguacuugauauuuuuaugucaaagaugauuaacauguaacugauuuaccugggauagaccagguaaaucaguacaccagaaacuucauauuucccaggaauuuuaaauuuucuuaguuuuuaacccgagaaauccuacaaagaauggauuuggugauuuguguuuuauuuuccuuaagaagguugaagucugaaaaagguaacugagaagcagcucacaggcaguucucucuuuuaauaauuccccgugugcaaagcauuguacuucaauaguuaccucagaaccauuuuagugaaaaagaagguaaaaauacauuaucauuaaaaaacuaaucugaauauagucaggauuuacaaauuggauaaacugacuacucucauucuaauaaaagaauaaaauaaacccaauuuauuauuuucaauaguugccucuuccaacagcauuuaaauuaauagauaauaguccacgcuaauuguaagaaacaugucuauuguauaaaaccggauugaaacaugucuauuauauaaagccagauugauauguguauuuuugccuuuuuccucugucuucuacuuguauauuucuuuuucucaucacagauuuugguaaaauugguauuuucauuauccuuaaguaugagcaaagagagauaaacauauuucuccacucaauuaugucaauuuuuuucuuuuuuucuuuuauuuauuuauuuauuuauuuuuauuauuauuauacuuuaaguuuuaggguacaugugcacaaugugcagguuaguuacauauguauacaugugccaugcuagugcgcugcacccacuaacuugucaucuagcauuagguauaucucccaaugcuaucccuccccccuccccccaccccacaacaggccccagagugugauguuccccuuccuguguccauguguucucauuguucaauucccaccuaugagugagaauaugugguguucgguuuuuuguucuugcgauaguuuacugagaaugaugauuuccaauuucauccaugucccuacaaaggacgugaucucaucauuuuuuauggcugcauaguacuccaugguguauaugugccacauuuucuuaauccagucuaucauuguuggacauuuggguugguuccaagucuuugcuaucgugaauaaugccgcaguaaacauagugugcaugugucuuuauagcagcaugauuuauaguccuuuggguauauacccaguaaugggauggcugggacaaaugguauuucuaguucuagaucccugaggaaucgccacacugacuuccacaaugguugaacuaguuuacagucccaccaacaguguaaaaguguuccuauuucuccacaugcucuccagcaccuguuguuuccugacuuuuuaaugauugccauucuaacuggugugagaugguaucucauugugguuuugauuugcauuucucugauggccagugauggugagcauuuuuucauauguuuuuuggcugcauaaaugucuucuuuugagaagugucuguucauuuccuucgcccacuuuuugaugggguuguuuguuuuuuucuuguaaauuuguuugaguucauuguagauucuggauauuagcccuuugucagaugaguagguugcgaaaauuuucucccauuuuguagguugccuguucacucugaugguaguuucuuuugcugugcagaagcucuuuaguuuaauuagaucccauuugucaauuuugucuuuuguugccauugcuuuugguguuuuagacaugaaguccuugcccaugccuauguccugaaugguaaugccuagguuuucuucuaggguuuuuaugguuuuaauucuaacguuuaagucuuuaauccaucuugaauugauuuuuguauaagcuguaaggaagggauccaguuucagcuuucuacauauggcuagccaguuuucccagcaccauuuauuaaauagggaauccuuuccccauugcuuguuuuucucagguuugucaaagaucagauaguuguagauauguggcguuauuucugagggcucuguucuguuccauugaucuauaucucuguuuucguaccaguaccaugcuguuuugguuacuguagccuuguaguauaguuugaagucagguagcgugaugccuccagcuuuguucuuuuggcuuaggauugccuuggcgaugugggcucuuuuuugguuccauaugaacuuuaaaguacuauuuuccaauucugugaagaaagugauugguagcuugauggggauggcauugaaucuguaaauuaccuugggcaguauggccauuuucacuauauugauucuuccuacccaugagcauggaauguucuuccauuuguuuguauccucuuuuauuuccuugagcagugguuuguaguucuccuugaagagguccuucacaucccuuguaaguuggauuccuagguauuuuauucucuuugaagcaauugugaaugggaguucacucaugauuuggcucucuguuugucuguuguugguguauaagaaugcuugugauuuuuguacauugauuuuguauccugagacuuugcuuaucagcuuaaggagauuuugggcugagacaaugggguuuucuggauauacgaucaugucaucugcaaacagggacaauuugacuuccucuuuuccuaacugaauacccuuuauuucuuucuccugucuaauugcccuggccagaacuuccaacacuauguugaauaggaguggugagagagggcaucccugucuugugccaguuuucaaagggaaugcuuccaguuuuugcccauucaguaugauauuggcuguggguuugucauggauagcucuuauuauuuugaaauacguuccaucaauaccuaauuuauugagaguuuuuagcaugaagcguuguugaauuuugucaaaggccuuuucugcaucuauugagauaaucaugugguuuuugucuuuaguucuguuuauaugcuggauuacauuuauugauuuguguauauugaaccagccuugcaucccagggaugaagcccacuugaucaugguggauaagcuuuucgaugugcugcuggauucgguuuuuuaaaguagcaaacaaugcuguuuguuuauuuuuuauguuuuuagagacagugccucacuuuguuuccugggcuggacuugaacuccugggcucaagugauucucccaccucagucucccaaguagcugggagugugggcaugcaccacggugcuuuguuuaagacucuauuuucaaaaaaccaagcauaaacauuauuaacacaaacauaaugaaauacauauacaauuuagaguaauauuuaaagugauguaaauaucuagaugcgauuaaacacuucacucacugaaguuuaauuauuuuaauuugcuacauuugcuguuuaauguuacuuuggucuucucuucuccccaucccaucccaaauaugcauaguuuuaauucaccccugcccccuuuaaauauauauguauuuaaaauccacagauugguguuaguguugggaagggggauuucugcugaaacuccacaugugcuccuuacugcugguugaugcuuuugauguucucauccccugaggucaggagaacacagacaggagaguaaguggcaacuguagcaaccccaggcuuugugacacuucucuccagaagaugcaaggguauuuucugcacaucagcacuggcccugacaguagagaguuucuuuucauuuacuuuaaaaugguucugacaaaaaccggggucucucauuugcaaaaccagcugucuguagcaaagccggaccuuaucuuaagagccaggcugaggccacagaugucguguggcaccugcauguggaggccacgaguggcccauuaaccagaucugggcugaggccacugagucugcaccauggagcucacuccuggaggccagcugcaauauucccaccuggccaggaaggacacugcccuucucagucccagaaugguaaucugagggcccuccacaacacaauggggccuucagccuaggcauggaccacuguggugcuuucccucucuccauaggacaaauggagggccacagguuccagcaaugccuggagcccacuugguccuuuaauaucccaucuugucacuucucaggccccugccuacuccaccaaaagggcuggggaggcaguccaaagauagggguuauagauuuauguuaauaaauauauaauauauauuaauauguaauuuuauuuuuauuuuuacuuuuuuaagugacaaagucucguucaguuguuaggcuggaguacaguggagugaucacaacucacugcagucuugaccucuggaguuuaagcaaaucuccucagccuccgacuagcuaagacuaucguugugcaccaacacaucuggcuaguuuuuauuuuuaaaaaacucuuugcagagacaaggccuugcuuuguugcccaggcuggugaugaacaccuggcuucaaguuguccucucaccuuggccucccaaagugcugggauuacagaugugagccacugcauccagcccccagauuuuaauuuaguuuuauuuucuaccuuuuugugauuaugugucucaguuuaacaagccuuuaguuacaucuagguauaaucaagggccuucugugugcccagugguuaucuaugauuggacuuuuucucuucuccccaugugcucccccaccauuaaauuuuaaggagguacuuuuuccuuguuaccugcacuuuuugaacaauagguuucagacaacuuacccuuguaaauucccuuugaauuauggcauuuuaaccauuuuucacaaauauugaacuugaaauuuuagagccaucaggaggggcugauccuagcagcucuuuuauugaaauuauucuauugguggcaauaggaguuacuggagggcacugccacccagaaacuggaugaaaccaagucagaaauucugaguauaacugacaaaugcuuuauaggaauuuagaaggacauuggguaguagagggcuugggaaaaaguaaauucccuaauuuccuccucugugacccacauuugauauagaaaucaugauuugucuaguauuggacagaaucacaaauaaggauuaguugccauaaaaguuuuucuaauuuauauugugaaagagcuguagugcugcaucagaaaggagucucuguuugcuagaagagcuaugucagcaggugaggccuaaagccuaaaggccugagggguggucagggaugggagagaaugaaguuacuccagacuuucaaauuguuccucacccuucacaagacgggaaguuuccuaaggcugaaggaagcagcagucacugagugcagaauguuucucuuggugcaguggguugugaccacucucauuguuguuuucuuccuguccagagugaaacagguauccuucagaaauuucauagcauguagcccugaagagcacuuagcuagauuguggugguuucuauauguguaauugguuaaucuguugaagagaaauaaugaaaagcugagcagucuuuuucuccuccaucaacucaugagcuaugagcuaugaguucucgagaaauguuggagcauuugacagcaguauuugaauucucccuuguguuucuguugcugaagcugcagcuuccaaaauugcagggcuucuugaccagccugcgucucaccauucagccuuuuaguccauugaauaaucugauucugucagcaaggccucagguuuagaucuuauuagcucuagauaguuuuuuaaaaaucugcucuccagaaauuugcaggaagucccaagauaagagaaaacuuccugucaacagugcugaauuucauggugugugauuauugggaagaaguugacugaauguugauaugugauacuucugaauugaggugugcccaauguaggucuaggcauacauuauacuguugcugcauguauguaaaauuuuaaaauuggaaugggagaguucucugaccccccucgcaggaugugcaauggguguggcucaucuguucggccaccaugcucaaaccccuuaugggagggggagcacacagaagggcagcugcaggagccagggugagcgcuuuugggcuccagcccacgguagcgucuaggggugggugucugugacuccugaagccccagugggcaugucacaaugcuccuuuagcucugccaucugcagaaagcuaaagcguuaaccagcucagugcccucuugguacccagguucuugucugguauccaggaaguaucaggucacacagacaaauugaaggaugguaaaugcggggugucuuauuuccagguggagguggcucucagcagauggauggggagcuagaaaggggauggagugggaauaugaacuucgccuggaguuuggccguccuguggccgaucuccucucugaccauccacagccaaacucuucuugauguuuaaaugcccuuucucuucucuccucugcugugccacucuucugcuucuuugcucuucugcuuaucuguuaucugcucaucugcucgaggagccugggguuugggguuuauaaugguacacgaugcagggaugcagcaggccaaaaggaaauguuugggugcaaaaacaggaaugccuguucccauuuagggccauggguuuccaggcuugaggguggggccuuugccagggaacugccuucuucuacccaguauuuccuugccuccuguccauaucaaaaugaguaucaauacucuguaagauuuucuuuuguuuacuucuguacucuauucuucaauauuagauuuaauguauuagucuugggauuggaaugacuauaaaggaagcagcauuuuguauaguaaguugaaagaaucuguagguuuauagcuuucuaaguaagauaguauucucaguuguuuuuucacaugacuagcauuuacauuuauuuauguauccaguaauuauaugaauaccaucuauaagucagcuaaugugauagguaauggagaugaacagaauaacaugaauugcuuuuucuuaaaaaaaaaaaaacucuaacagaggauacagacaaggaaaccauugauuuaugguugccugugagaaguucugugacaagcauauaccuaauauggguaugugugugagagaaucuaggaaagcuuccuuaaguaaguaaugcuuugcuaaauuuuaagaaaggguaguauggccagguaaagucagugggggaggaagaugacagggaacacuguggccaaagcaugcagacccauggaauuacaggaagcaguuguguagagcuugaguguagggugguguagggccugaaucauggaggacaagguaugccaggaugaggaguuuaguuugaauucucuaggcaaugggcauccagugaaugcaaacagcauuugauacagguacucagggugcagaaaacugaaugauuaauaggagggcauuagaugagauuuuaugcugaugggaaggaaucccaggugagagagagagagagaaagagagagaaagaaagagaaaaagaccugggaaagagagagagagagaagagagagaaagaaagaaagagagagagagcgagaaagagaaaaagaccugggggggggcggggagagagagagaccuaggaaagagagggggguggggagagagagagagagagagagagaaagaaagaccugggaaagagaaggcauauuacaugggccauuauccaucugcuugcuuuaauuucuuggacaacuccagcaucuacuacccagauuuucuuguuguuguuuuuuuuuguuuuguuuuguuaguugucuuuguggcuuaccucuuuauuuguguagccgcccuuucuugucuuuuguuacaucuuugauuuggaagugaauuaauaaaugaaugucaaguguucccaaauucuguuuuaagaauaaucuagaucuuuuaaagcuucgguaaugugggcuuuaaaaaaucugugauugcccaacugguuuaugucagcauuuuggaaagaauaucagucuuuaaagcgguguuagagauauaaacccucuggggagugaagaaugccuggugcaugcuaauuuuguacuuauccagguggaagagagagaggaauagccaaagcuauagauagaacaaaggcaugucaauugcaaccuggucucaguuuaggcuuagcucuccucaccaauccccuaucaggauauuaguggcuuauuuauuuauuuuuaaccuguaucauauuaagcucuuugacaaaucgcauuuugauuuauagucugugcuucuggcaugugcuuuaauggcauuagccaacucuagacacauacugaauucauuauguaccuuauguauguaaguaguaauacuuccuuuuaaugaacauacggucacgucaaagugcugcgagguuguuuuacaaaagcaucuuuguguagugcuccucagaaguuuugagaugaguauuaaguugaagauuaauaugcuguauuuuaaguuguauuuuaguggaguaauguauuauaauuuugcccucuccuuaaggugaguagacuauuauagucugagucuuugauucuuaggcuuugguucuuaauuagaauucaacauuguugacauguaaauugugaccagaugaauucaaaacucaaaaaguaaaauugccuuugaauuuguauccucagcuacgauauugauugaaaaucgaugaguaacucuuauucuuguuuucuauaggcaguaagaaauucacagaaucuauuuacagcuauacgugacagcacuuaaccuugacuaugccugcuaaaagguuucuugacuuuaaaauguggauacucuucaagauuugagggcagggcuucuccuaagguagaggcagagaaguaaaccagcaacaaguagggcucaagaucuagccugucugaucaggcuuccagaccaaggaguggcagcaguccaaaccaccugucucugcugacuaggcaaucuuaauagccaucccacuccucaucaguacgugggaucugagcacaggucuaagcagauuaauaguuuucuuagugaagugauccauggagucaaaugcaugacaguaucuucaggauucugugggaagaggagggggucuauggaggacacuaggucauccccuugaaaagagagauagagaccauuacuugagggaagagcuaagcagaaugucagagcuuuggcuaagcaaacagauaugagcagaguucuaguucaacuaggagcacagagugagaaccagauauuggggcaggaacucuucuguuugacgucuacagugggagagacugcacaccugugagcacagggauuccuuuguguagggguuccuuaaagacagauaacaguuuaugggcagauaacaguuuccagagggauggggcucccuguauaaugccaggggcugccaggauugacuuaggauugacucagggacugcguggggcugacccugcagguugaaugcugucagugauuacaacagggcaagggcaccuugacugucucagaaacuaauagaaucuuucuuugacaauaaccacuggcgagcauuuccaggaagucuuugaaaauugcugggagucugggcaagaaacuccacucacugaaagcaugguauuugauucauuauaaaacagaaggaaaaacauuaguaauagacgugguaugucccagccuuguauaguugaaaguaaaacuaagucauacguuuucaauuuggugugacauugucuaauuucuaaauuuauuauuauuuugaaauuauaggaaaugauuagaaguaugagggugugcuucuucuguuguuuauuuuucacauuugagucuuacuacaugucaccauuguccagcauuucagagacaaagggaguauuuuugacauucauuaaaacuguuuuggugaaagagcuguauuacgguacuauuuaauuuuuauaauaguuuaucagaaaugagauuagagccuauuuauugaauuaucuuauuuugaaacucucacauauuuauugaguacagauuagaaucaaacuguuuagaauauuagaaaagucuuuuucaaguacaaagggcagagauuauaucuguagguaguucccccaaacccccgaggggaaguuuuguuuuaaauguuuacauguuuuauauugacacauuuguuggcuuaaaaaauauggcaauagcaucuagcauagugcuagauguaugugguugcaauuugacauuauuuuauugauaacuauauuguguauaaacuuucuuuucaugucuuuuuaugugagagacaucagauauucuacuagcuguuaggagguagugaaauuaaguugauucucacaguauuugcaucucagucuucugccucagcaugugaccuugccugugaagguucagaauagcuguuuuauuauuucgcuuagggugaucgggcucugguaaauugauuggcacuagcccaacucacagccuauugaaucaugaauuuauuacuuuaggcaacaaauaguuuaacaccuuccuacaugccauacauuguuguccuugcaggagguaaacucuuggagaagauggugggggauagaaccaaguuccugcccuuaauuuauucauuccuaugagaagugaaacauucauguaaaacagaugacucagauugcuguuaaaaaaaaaaaaaaauccaguagggcaaaccuauuugaauaaccaaauuaagaucaggauuggcuggguguggugguucacgccuguaaucccagcacuuugggaggccaagguggguggaucacgaggucaggagauugagaccauccuggcuaacacggugaaaccccgucucuacuaaaaauacaaaaaaauuagcugggcaugguggcgggcuccuguagucccagcuacucgggaggcugaggcaggagaauggugugaauccaggagggggagcuugcagugagccgagaucacgccacugcacugcagccugugcaacagagcaagacugcaucucaaaaaaaaaaaaaaaaaagaucaggauuuugccuaguaacuauagaguucaagcagaagcaaugaaauggucuaaacuauagcuuaaaaaacaauaucuguuaaagauaucuuugucaaguaagucugaauauuuugcuuuuauaguuaaaaagauaauuaaauucugacuuuuucauuucaucuuuuagagucucaagccccauauaaaguuuccaaauaaacauuaauucuggguugcugagagauguuauucugauaacugaggaauguuuaugauugagguauuaaauaaaagguuaucuuaacaaaaggagaaggaagguaaauguaguagaaggcaaucuguuaacaauauuagcuucauucuuauaaugcuuugcaguuuacaaaugcuuucacauaugcuggaaucugauuauuucagcgguucuaggggauugguagagaggcuguuguuagaccuacuuaauagaugaaacagacucugaugaggaaagggacguccccagaaccugaguuaguggcugguuggguccugaacucacacauucggagucuccagcaucagugcucucugaugggggccaagaguuagccugcuuuucauguaaaugcccuaguacacauuccuuucagacaaucaggacauuggguucaggucagacugauuugauaacaauuugauaagguguggaaucuuccugugauuaaagagagaaaucugauaagguacaagacuuaccaugaaacagauaaaggcucucucaaaaggcugccuccaguuagaauuccccagcugguccuuggcacaugguuccauguguuuauuauguagcucacacucgaaaucaccccuggggcagguugagccauuccagcauuuuguaaaaaguugugugcaugugcucacacacaaaugaggaaaagaggacugaaaaaaaugguucugugaaagugaaaggauucacuugcuuuucccaguccuauuaugaaagaugguuuaguuauaucaaagggcuucuuuugacuuguuguauaauucgauucuugaguuuucaguuggcuuauuugaaauuuuguaaauugcaauuuauaaaauuggagggcccugagagaucaaguuccacuuguggcucgaggaaugaggauacugagauuagggguuagggcuugcucagguuuuuguugcagacaggaaaaacaaaaaaucugguuaacuuaaacagaaaagaaauucucugauaggacauugagcagcaggcagaaauacugggaagacagagaccuagcuugaaaaauaagggacuaaauaugauuuguagcaaccacagccacaggcaaaauccugacccacaaccagugcaccgaagacuugauugcucaucacgucacgucuugcugugccaccacugcugacaucucuauugcugcugccccuagaaaugggaugguacugcuaucauugcaucuaccucuggauuagagguucuuugggucacuaccucuagaucgaagacuguugagagcgucggacuggcaaagccagguuaaaguucuguaucccaggggaccguucuuccucuccuaugggaugguagaaugccuuucugcaaagcuuacaagauaggaggagggguuuagacgcuaguaagcaaaaccaaaccauaccaaaacaugagacaguuaucugcuauggaaacauacccauuuacuggcuauuuaagagguuagaacuugaguuuucugaauuuucucaggaugccaaauuuauagcuaauauagauuuccuuuaugaaaagugacagaggcucugugguuuguaagagaaaaugaaguccucuguaguaagauuuaauaauucuaauauuuugaaacaauccauuuuccuaucaacacuguuuuccucuggauuaaaaaccauuccccaucuuccuauccuucaugacauacagaaaaaagaaucuuauuuuucagugguaaaaaguggagagagagaaaaggaguaaaagaagaacaaacaguauucaugcagugcagagauuagagguuaguuguuacacauuucaggguaaguuugccagauugaugagcaauaaaaccauuuagaacuggaaaaucuucagggcuuuuguuuuuaaaaguuauuuuaggcaauaaccacaucuugucguuauagucuuugcuuuccagcaauuccuuuuuaccuuuuaauaauaaaagcuaauauuuauugagaacuauuuugucauagcaucauuaucuaucucacuucuuccucacaauaacucuguguuaaucucauuacuauucuccuuccacagcugagagaucaaaccuuagaugaagcaacuagcaugagauuucauaguucauagaugugggacuugaacuuaagcauauacaccugugaaagaagcuuuguaaaucuuucuuuaacuuaagagagaaaauaagguauguguagaaugcuguuugguaauauuuuaagaaaacugcagaggaagaagaaaggaagugugcuagaaaaucaaaagacuuuugggagcaugugacuccuccacauuagguaaauuugcucuuguaucucuguuccaggacagcuaggccauucugaucucuuucaauuucuguuccccacaguaguacuuagcuuagugccuggugcauaguggguguucaauaaauauuuacaaaaauaauuaaucucaggcauccucaggacaguuuccugggcuuaagaugccaugcaauuuagagugcugcucucaguaaagaaauaacuuuacccucaaagccaggcauuucaagaagguuuaucaaugaauuuagugcauuucacaaacaaggaagcuuaccagggguuuuuaggccauauaacugcauagccugugaaagaucucuauagcaugucuugcuuccugacuuuccaacuucacuucaauuaauuuugucacauugcucccuuuuccuuuuucuuccuuaaacguauaaaaugcuguuuguuuuuuuuuuuuuuuuuuuuuuggcuguggucgagagagaauggauuguccugggaaaggcacaaggaaucuuuauuguaaacuaauguguggaacauuuuuguacagaaauagcuaaugaauacccaaagcaugcuguugcuugcuguuuaaaugugguuucauuuuuguucagcucuagcuucuaagugucuuaaaaggagaaaacuuacuuuucauuagauucauuuaaaacuuuuucaagagaggaaaguccugaggguauagaaacuuuauguacuuaaauauaucauguuaaggaacuucacaauguuucguuuauauggggccaaagaccacagauccaccccgauugcuaauuauugagauugcaaauagcuuauuucagaacuuagggugagacaaaggaaacaugaaggaacaaaaggcccaggauaaugaaaaggauauugugaagagaaaggccuguagaauuaugaugcaggucacauccugugccugcauuuaauuguaccuuuguauuuaauaauaaaaaugauuacaugcucacugcuaacaggugucccugcuucagaacuguaguauggauaggugacagcaaauuacuccaauucauaaacuuggaauauuaugcuuuuauuuugaguuucaccagucuauacuagaauacauuuucugccaaaauguacaucaacccaggaagauuuuuaaacuuagccccugauaaauauacauaaaacauaggugaauauuuuaaaguauaaaugaaagaaaaaaucaacuuugccaggcacuuaacacauugagguuguauuaauaccauagucacauuucuaguucuuuauauuuuauauaagcuuugaauguaauguaaauuagcagugauguaaguggucuuucuguuagaacuuaauugccuccuuuaugaauuuucucuaauucuugcuuaacuugaacacuuucuguaacugccuguccaaaauauagccccugcccuagggauuuguucuccucuguuuuucccuuuauugccauuauugcaauaacaauguucuuauuaaucuguuugauuuuaucugucuuccucauuagaaugaaguuccauaggacagagaccaagguaaucuuauucucccuaaaucagugguugccuaguaccuugaccaugccuggcucauaauguguacccccaaaaauauuuguuaaagacauucguuaaucugccacuuaccgucuuaaucauauaccaaaaacccugcuugcuaccuuaacuuuaucacuagccuccucccuuugcuuauguuuucaccaaagauuuugugguugaagacauucuauuuccauugucuguuggguagcuagguagagagauaauagucccccuugaucccaugaccauaguugaauggaaauugagggguuggggacuguucuuagacucuuuaagccuugagcacauuuccuuuauuugaucagccucugaacugugauucauucauauuugaauaucugcuagguagcaaaggcuuuggcagguacuggggaagcaaauuugaaaaagaugcacucuguucuuuuaggaacauaucauuagaauugaugucccauaagucuguaacugugucucuuuggcugugcauuauagacucaguuccuagcacaaucucugguacauuacaagugaucaauaaaugagugaauauuccaugcaaguauuuagaaaauagcuugugcuguaauaaauguauguacaaaguucucuggaaacacagaagagggaaggccauugugucuaaaaggagucagggaaaguuucacaaaggaaggauuaaaaguugaguuuaccaguuuggguaagauguaccacauaguaaggacaacaugagcaagaaaucagagguguggaagagcaauauuuuauuugaguuugggcacugcggucagucuggaaauuuaggacgaaugugaaggaguggugggcauugaggcuguuggaaucauuauuuauucccuuauucagguacccuaugcacuaaguagcuccuguggcacaaacaaaucaccuuuuauuuauaguauuucuauagaaaaaagaauugaguuccaaacauacaguuuugaagauagauccuguuuauaaauggggauuaacuuuaguagaaaauuggcuacauugccuauauguuaucuauugcuguaauucuucauacagauaaccacaaacgugaauggcauaaaaauaauuaggguuuauuguacaugcauuggaaugcucaucagguggcucuucugauauagucugggugggcugggugauuuucuguucuccauugaacuugcauuccucuguggagguguuggcugucugucagcugaaguaggauggcuuuagcucagggggcuacucaacauuugcugucaucuuccuccugguaccauuaggcuaaccugggcauguccuuuuaaugacauugguggaggacaagggcacaagcagaaacauacaaguguucuuuugagccucuguuucugucacauuuaccaacauuccguuggccaaaacaauuucacaugggugaguugagaguuagaguggggcacugugaggacucaaggcaaagggcauggcuacagggaggggugaaggauugggacaauuuuugcaauauauuauauagcccauacugcuaaucaaaucaaaguuuauagaucuaacggaagcguacgauuucugauuuccuugaugaaacacuuaucuuuucagcuuuacugaugcccagucucuuuuugauaggcugggggaaagucagagaaaccagaaaugggaaaagguugaagugagaucuugaaagggauagguaauuauuaacaauuagcuauugcaugcauuguauaauuucagauguacccggcucaucuccuuuuauaggacacugaagcccaaagcagcacaguguaucacccacauucccccagccauguuaaugacacaaccaaaaguugcaacucagucauucuaagcccagagccauucuccacaauaucuuuuaagauacauucucccuaaacugccucauaugccucccugaccccgucacuccucacacaaacaaucacuuuuguaaaugguuuauguuugaaaauugccuuguuaucacaauucaccaugaagaguggguucuuauuuugaguuuuccuuuuuaaguuuacacaucauaccuuaaagcaaaauaauccccuuaugugcaugcaugugaguacgugugcaugugcacacacaugagcauacacacgcaugccuacacacacucauucacacacacacaccacacacacaucccuguuuugcccugccuuuaccugaauauuuccaaucagaaagggacauuuugaauauagugguuauauuaaaucagcuugaguuugguaggugaggcuuugaauuaucuuugcuagaccucuaagggggagcugccagagaggucacugugacacucucagucugagacaaugaagccuggggaauaaauuuaguuagaaaugagauuaaagcuuuagggagguauuguuucuuaccagcaucauuuuuccccuuucuugaaguagucaaagugauugcucaagacucaggucaggacacagggacauggaaggaaauauucucaacauuucaacaguggcaguuuuuaauugaugaaauuauggacagaugcuauucuaauugagaaguacuuuuucuaacaaauagaguuucuauacuggcagguagauaucagaucaauaagucugugauaagcauaccauuuaaaaguaugcuauauugaaaggaagcuuauauguagacugacauaaauaagaguuuuagaccugaagaaacaagaaaaucccagguaguuuuauaccuguguuuuuuucauauuuacucauucuucauacucuauacaucagugauuauuuuucuuuuuuugagcuauuuugcauguuaacauaguugccaaacuuugacucugaggagagcaguauugcugucuccaaaauauuuauauuugaggccuaucuuuuagacaguuacauucuaaaauaugugugguccugcauuuuucacuuaaaauaucucuuauucugcucugugcaaggucauugaggauuaagacaaaguuuucucuaccaccaucaaccuucauucuuuuugguggguagauuuuauauuuuguuucucuaaacaagagaaaacaguuauaguuccaccucuugugugcuuccucuccuaugaguuguaggcucaguaugugcacauaugcaagauuucaagugcaaaagagaacagagucggaaacagauuuucacaguucccgucuggguccuuguguaagugccaauguaaagcuauucggugauuagugaaaaacaguauaauguugccuggcucuaaggaaacagcuuugaaaaucuaaacuuaauaagcagaucaauuagguggggguuugggauuauuguaucacauuccaauggcaugcaguguugucaaaaacuuuuuucuccagaauaaaaauuacaggaggcauagaguuaccuuucaaaaugucaggaaagaggguuggggaaauuaguuaggaauaaugaaaauauaucacguauaucucaggaagcauauacugugagcaucuggguaucucaggguaagggguaagggguaggggaggaggagguuuacccugcauccauggagguaaauggauuaagcugaaugucugggaagacgaggauugcuggguggaggugugaggcccagggcucggggauaccaucagauuacuugcuccucaaguuuugggagcuaauaauaccugugcuugcauuucccugcaaagcaagggauaccuucugggauaagucccgagggaaucacucauaacuauuucugcuucccucccacuuauuuaacauaaauauagggccuaguuugggguuaaauucagauuuuacacauuuaugucucugucacauuucuugccaccaacuuacugaagucugaaauuucuuuaacaagaggaaguauuccaucccauaguuagaaauguaagaauuucaauaccuguuuaacacagcgaaugagauuaggcuaaacuuaacaguaauuggaaacguauucuguaccugcuaauaacuagaaaaaaaacaaagacaaacaaguaagccuuucuguuuucucuugagacgugggaauuguacaguaauuacagugggauguaaguuucacgaagguagagaucacccugugucuuucucaguuauauuccgugcauuugucacagugccugauucauaacaaaggauuuucauuuuuguaaguagauggacacauggaugauucuaguaucauaaagacuauuuaaaaagguguauacaagauaaaauguugacccagaggaagcagugaauaauuuugcccuggaaggaugcagauaaagggagacuuucugcaucccuccaggagaugcagaacuagacauuugaacucgaucaugagagaugaagagagguuucucagaacuuccaggaugguauccagccagaagaauaaguguguguaaaggcaaggugggaaaugacaugaauguucagggagcuacaaauaauuucacaauucuagguaguaugaaccauggcagacgaggaucauaucaugaauggccuuuuuguguaagugacaucucagauuugagucaagacagcugcugcugggaacuggggaguggacauagaaaaacaaggaccauaggaacuuguuuccaccucacauuuuaaacugaaguuaagcuugcuuaccugcagucauauucagauuuagaugcuaauuagggaacauuuguuaguauggaagcuacagagcuugaagaacuauaaccuauacugcuccaaugagauuuuauauuuuaaacacauauuaaaagaaaauuuuaucuuuuuaaagucaccuuagagucagaugaauguauaacuguuuucuaaaggaacuaucauuucauaaauggaauuucugccugguuccuuuaaauaguggcuucauuuaggauuuaaaauauuucauuuacacauggcuuuccagaggcuucaaggcacaccuggaugggugagcguuucucuaagccuaugguaagagcaagcaugacuuggauuucuuguacuaccagauaugugccuuuguggggcaggguguuuccuuguuagauauauaaaucaaccagaaagauugggucggauggguacuguguuauuuucuuaauuuaaggagaagaucuauaauggaaauuuuauuuaguuucuuuggacuguuuucaugcauuuaguuuuauaaaauguauuccaauuuuaagcaaggaacccuacauuaauaaaaauugauuucuucagcuuaacuucaaauaugauuuuaagcaaccuuaggaucaugcugaguugaaacuauggaaccgcuacccuucccacuuauagcucaacuacugcuauugucauuguuuuuuucuucuacuuucauucuauuaauuguuagauaaaauaacuccuuauuuugcauguugagguuuaacauaaguucuccacuugauagagcauuuaauuuuggggggacgguucuuagccgauuauauuaguucagugguuuuagaauaagacguuuguggggaggggcagcagaaucuucagucauugauucucucuuuauaacuuugcccuuuuagcuggaacagauuacuucuguagugcugcuagcccugcacagacugaaucacaaggaagaaacuuugcauaaaccauuuauacuaaauguuugguaugcuggcaacauaaaucaacaacaauauccauuacaaauucaucccuuuaucaguauuaucuugauagaacugaucccaaugugugggaauuugaacccugcuucaauacaucuagcccuggauaauuaauuauucagggcacagagaaccuggccccugcaauguagaguaauucuuccuggucagcguuaacuccacuggcaauaauaaauagaaaaagucucuagugaugccaguauuuuaaagugcuuaaucaucuuuccccccuucuccucccccuuaguuuucuuuaacuaggauuuuucagcaauaaaucuuuaacaauacagguaggaauuguucuguaauuaaauuuugcccugcuuaauuucuuaccuuuuaugugugauuaaaaaaaaguuacauuuuaagaagcccugaucaaaauucaaaccaagaaaaauccuuuuacagaauacugagaaaugcucuauggaagauaaagcucuugauuuugaauauuagauagagcacauacacauaaaaauacucauaaaaauuguucaucaacaccaguuggggugucaaauauucuaaaguuuugaauugcuucacuuucaugcuuacgauuugucuguauuaggaaaagccugacauauacauauguuccaacacugagagaauaauuacuuauuucuuaacuuucagauaauugaugucagcucuguaggaaagggauauuuucacuauuuuuaugguacacgaaaugcacuugcugaagcggcagguagaugccuggcugagaaugaccguguauuuuaaauugugcccugucaagcugcccagccaucaugcauauccugggugacagggacagaugugacauaucuguugugacacacuuuuguaccaccagucuguggcucgaggugacuccucucccuccccugaugcuuuccccgcugcaggacaacauaacgaugcacggaugaaccuugccauugcucugacugcugccagguauggggcugccacagccaauuacauggagguagugagcuugcucaagaagacagacccccagacagggaaagugcgugugagcggcgcacggugcaaggauguccucacagguaugccagguaucugggagggagguauuucuuaguaucuugccuagcuuauauaaugacugaauuauaauuuuucugucacuucucuuucauuuaugccacgcuucagagucauauuaauuauauucguuauugucagcaaugacugguuuaacgugaaaauuucccuuguaggacuuggcaauuuuuccccuuuguauuauaguuguaauaaugauaaugauaauaauaaaaugcccaccaaauucccacagcuaugaauggauuccuuuuucuuuacaaaaacauguuauuaauaaaauuaaauaaaugugccaaguuucaaaguaucauuugggugacacaggcauuguuacacguuguuaaagugaaucuuuaacuuuauuuagauuuucauuauugcccuggcucuagcgccauauaaguaggcaguuuccaaauuauaucguuucuugaacaaaagcucuaugauauacauuuucucacagcagugcugcucacacauuugaguuuucaggagaaagcggcuuauuuacucauucuacuuuuucauguuuggugcuuugacgcugggcacuuauaagaucgacagaauccauaaugagaaaguggaaugcuuuucuuucuucaauuccgacuuguuuuugguaaauucacucagaugagagccuuuuguuuggcucuucaauaacuugagcugcucaggucacuuagugugguaugcaguauacuucaccauggguuaaguuaauagaugaauuaguaauacacagcauccguuaacagagaaacaaaugaggugugugauugaugccacuuucuuucacagggcaggaauuugacgugagagccaaauguguuaucaaugccacgggaccuuucacggacucugugcgcaaaauggaugauaaagacgcagcagcuaucugccagccaagugcugguguccauauugugaugccugguuauuacagguaauugucuuccaauguggcaguugucacccaaaaaagagggucagcagagauugucugguuuauuucuucuucuagcauagcaauagauggucuaacuugcuguucaaaaucaggagaaauaaguaaaggaacucuuccaaaacacaaaauacaaaccagacuugggaaguuuuagccacuuauggcaauacucguuucuaaggguuaaugcuuugggaucuauuuuucuuuguucaguguagucaccuucagagacuaagcauugguauuuuugaauuaaacuuuuacuuaagucauuagcaaaauuaauuuugcaaaauuuuuuauaaaggacguauuuuaguuaaaacaauaagacaugaauuuugcagaauacccaaauuugcuuaugaagaaucugaagaugugggcuacccaaguauucuuagguuuauaacuuuugaaauagauuaaaaaaaauauuguagcaagcaaaaaccagauauaucuaaucuaucaaauuaacaaagauaauugaggaugaagaaaugggcaggaguagagauaaaauaagaauagcuauuaaaugaaaaucauuuaagcugggugauggguacauggagcgucauuaaacucuuuuuauauauguuugaaauuuuuaauaaauuacaaaagaaacauuugugugguucuggcuaaaaaauaauuacccauaacguacauuuuaagguauuuauagaagaaauucguauggccaugcuaaggguguagagcauguguacuguuuuuauuuccauaugugguaaaccuaguaggcaaaguaguaauucuauaugaaauaaugacuuaugugcaacaguauucauuauggcauuguuuguaguugagaaauauuagaagcuacuucaguuccucaccuuaggguaauagauaaauaaauuauggcauaaccacacaagggcauauuauauagucauuaagaauuauaauuauaaauacuuuuaaugcccuaggaaaacacuaaugauauaaugucaauuuagaguauaggacuugauauuuuaugugcuguagguucuaacaauguauauagaaaaagacuggaaggaaauauguuaaaugugaauggugauuauuucuagguaauaugauuaugggugagaguuauuucuuuccauguuuuaauaauuuuccauaaagggaauauacagcuuuuaauauuugauaaaguggauguguagaaccuaugauauuuuguuuaauacuuccauucuccuagaaugcuauccugcuaugcuauagaucaugcugccuuuuuaguuguugguuguccgguaacuaaaucuuccugaagagucuaagaugcaccuaauugguaccagauacacuucugagaaaaucauuaaagagaauuucuuauccaccaacuuccaagguuuccuuugcguuuucaaaaugcguaugugagagaaauaauagucuuuaggauuuuuacuuuggacuggagacaucaaggugccucuuaaggcaccacugcauaagauaauagaaauguaugcagugguaccuaauugaguuuuuaaaacuguugaccagaagcuuaguucaaaugaaaaggagagaaauaaauauaugaaaaugucccauauguuucucguauauagagaaguuuucaacauuaguuccagaugcaauuguauacgcuuuuguguucgauuaaaaauaucuaaggccagcuaguuuaugaguuuuuguuuguuuguuuuuaaguaucucuaagaauggaguguagauguaaucaucauacaucuuauauuuguuuagcuuuuacuagauucaacauauucucauguguugugugccuuauguuuucuucacuaucaucccaugaugucagaagacagagauuauuccccacagaccuuauguuaauucugucauuaaauaauuaaauaauuugggacaagccauuuuauuuugugaaccuuaguuuuccguucauuaaaaugggcaaacauucugcuccuucagaguuuagagacaaagagauuguucgcagaauuaaagugauaccuugcuauaggacuucugggguuuguucaucacuuuuccuugggcuguguggccugggcaagcuacuucuuucagcuucugguuccuuauaucuuuuuuuuuuuuuuuuuuuuuuugagaugagguuuugcugugucaccuaggcuggagugcaguggugccaucuuggcccacugcaaccuccaccuccugaguucaagugauucuccugccucagccucccgaguagcucgcccgccaccacacccagcuaauuuucauauuuuuaguagagacaggguuucaccauguuggccaggcugguaucaaacuccuggccucaagugaucugcccgccucgccucccaaagugcugggauuacagacgugagccacugugcccggccccuuauguacugauaauaccuaacugguauaagguuugacaaugauccuuggauuauuuuuucucuguuuuauagagugcuguauccccagcuauugguacggugucuggcacguauuagugcccaguaaauauuuuuugaaugaauccuccuaaauuuuuuauguuaacuugcuuauauugagauuguuccuuuauuuauauuaaaacuuuaauguaacauuuaugagauuuuuuaauauagagaauucaaacuaugaaaauaaaacaugauucuucaacuuacugcccagcuaaccccuguagacaaaaauaaauaaauaauguaaguacauaacuagaaauuucaaucaucauagaaaaaaauagaaauaugaaaaugaaaauugaaagccugacucuuauucccccuaccuuuuguucccucccccaguucuucucugguaauuaauaaccucuucuuccaauuccuuccuuaaaaucauguuuuuacaagcacaaauguguauucuguuaaaaauuuugugugaaaguggucauguugcauauauuguucuauauuaugcuuuauacacuuaguaacagaguagauuuggugucuuuuaagaauaaagguauauauuacccagaaguaauauuuuaaaaauucugaauccuaaaaauucagcauuagcuuuaggucuccugaagcaugaagguguuaguuacagcuaggucugucucaggcuaagaugcaguaagugaccucauucuauguugggagaaauuaauauccccauuuuuggcacugugagcuauaaccacuacacauccuguuggaagcuuugaaggaauggucugcagccuaguucccauucaggcucucuugcagaugagccccuucucuuuggauugugaccuagauuaaggguucauucccucauucaggacugaccuugaggcaacuguacuucuggcaucccauaggggugguuuuccucuuccuaucaagucauucucuugggugauauuaggagaucccaaacugaaaugacucugugguaucaucagucaaucauacuuagcagcugucacucaacaguuuugacuaggucuucagggaugaaccaaagcuucuggggcugccccacaacuggcuaaugauaauuuaaaaccaggcauguuucaguuagaaccugauccauuuggaaaugcagugaguucagcaagcauugauuuauuguguguaggcugguaaaggaagaguaaggaaccauaugugcaguguaucuucuugggcuguuuucagaaguaucuuuacagcauuuguuaauuuuguuguaacuuuaacuaauguuccaguuguggaauuaucuuacaccaugauagcagcuuuuuaggggaagaggggaagaaggaaaaauuguuuuaauuucggaaaacacaacacagaaauuauuuuuaaagcugcucuuuauauuaagaacaaaucuggaauuuccaugagaguuauggguagaugcucuuccaaaagcaaugauaauacaccaaacgacugaaauacaugaaaauaaucaucucuguuuagccuacuggugcuuuuuacuacugacaagaggucaauuuuuuuccuauaauguguguacauacuguuagcucuaacacugauugcuaaguaguuaacaauaaauugauuucaguuuaacuaagggcacuucaggaaagugauggucugcaugagaaaaauauucauuacauuuaauccuagacacacacauaaauuagcagcaagcuuuuccuccugaugucaaaugaaucauauauauugaaaaaagaccuaugccuuguugcauugcguauacuaucgcuauaguugauauccauucucaaacuuuagugugaacuugcaaaauugauccuucaugagaaaacagacuuuucccgaagggaaaauaugaauuagguaauuuagaacugaugaaagauauuuccaaguggauucuuaaauuuuuauaccauucguuaauagcuuugucuucccucugugcuuguuaauuuuauguuugucacauaugucuucacuuaagcaguugauucucuacagguuccaguuacauguguguugguaaccaucauguucaccuuuuaaacuacuuuauugcauugcaaguuuuuaaaagauucaguaguugugcauuucuaaugguauuuccuuuuuagguugaugaauauuauaauuuuaugauuaaauuuaucauguuuauuauuuuagacacaucauaugaugucuaguccuugauauagucauauaaaacaugucagcauauaauucguuuaucaauuguuagaauauagaauuuuuuuguuucaauauacuucuguuuaucaaauagaaugaacucugaguguucuaaucucauuucuaaucucaaagugacugauguaaucuaaggacauaucaauccaggaucaaaaaauauacuuagaaaacaugugacuaguuucuucugagauuuuuagauaguuuuaugauaaauacaaagaaaaaauaaucauauuuagagaacaaaaauacuuguuauuuguaguuuucaauacauuagaguaaaaguaaaauuauuuucucuaaguaacccugagugaaggugggacucugagcugagguuuaaaugauugcagacuuccagggugcuuuuuggauuagcuaaguagaagaacuucuaccuacucucuccgaugugucucagauaggcugugaacagugacuucuuucugcuaaggcugaguagacauggcaagcguuucaugcggcugaggguuuuuugaagagaaagacucacuccuugugguuuaaauaaagaagauacauuaguuaagcugccuauauguuucuuuuuuuauauaaaauauuaucauuauuuuuuacacaguuguuacccucucauuuuuacacauugggauaaaucauuuuuuaaaacauguuaagggaaugaugauaaagauaaaaaucugacugugugucuuuuuaaauuuuuguguaagaggaguuucuugaaauuuguucaaaccaaauagaauuacguuuccauauuaaaaaauaacauuaauagaagcuaaaaacauauuuauagaaaauacuaguaacacuggcuugauacaagaauccagucaaauagaagcagcuaucugaagauuuguaguguucuacuugaauaggacacuuuaagauuccucucacucuuuuaacaacaucuccaaauuucuuugaauggcuaaggaaugaaauaaaacaucagcuuuuagugauuuaaaaacaaaaugauggguuuuguuaauguuuguuuacaguugucucuucuuucaaauauguuuuauuauuugauuuuagaauaguaaauaucaguaaauauuuuugacuaucguuuugggagauuuuauguagucuuucaguagaggcagcauuguaccuugauuuaacauaguacacuacuagugucuuuuauguaaaagauuuucauugcuaaaguguuccucuccuguuugaccuuauccuaggacauuacuauuuagggaguaguaaaacauggagcucuuuucuucuagauguacauuuugagauuuuuguaaccucgaaauaaaguaggaaaucucauauuuggugaaguggcacaaguucaucuaggcauaaaguaguaaagaacuuugugauuacauuuuaguuucuagaaagguagacccuucacuuucuuauguacuccugagaauuucuacugagcgaugaaaugucaaaugucucaggaaaauacuuuggcuauucuugaaaaaaggcugaagacauauccuuaauuuaccauuauaaaggaaaguauagacauuuauccugcugacauuaucugaugugaaugguccaaggaguaugaaacucaaacaguaggaaguugaagcccacuuucuuaauuagccuugcauuguugaaguggggagggaagggguagcucugcuguggaauauuguuaucaucacauuuguuucauucuguuuuguuaucuaaguuauuuuuuucuuuuaggaguuucuagauuaggguaggggaagugcaaguaauaguucauaucuuucuuguuugcauauuugagaauuaaugaauaaauaguuuuucgaaugcagauuaauguuaaacuucugggauuuucagaaauaaauaauccuucuuuguaucucagcccagagagcaugggacuucuugacccagcgaccagugaugggcgaguuauuuucuucuuacccuggcaaaagaugacgaucgcuggcacuacugauacuccaacugauguuacacaccauccaauuccuucagaagaagauaucaacuucauuuugaaugaagugcguaauuaccugaguugugauguugaagguaacuaagcauuccuuuaaguuugucucucuguguccauaucucccaagccauuccagcucucacuggauaaaugcuaugucuccagucugacucaucuucacacuuguccucuugugccucuuagaacauuuaugagggccaaauuuuaacauaauggggagaaauugccuuuucuccucuacuuucuauacccacaugaaacuuaugcaguccucuucugauaauuccuaauggcaagaucagaguagccccucuagcucugaacacucaugugcuuccagaaaacgaugaaauguguacaucacaguuuaauuucugcagcuuaggaaugucuaauuuacagaugcaggauaucaauaggaaauaauuaagcaaauaaacgagaggcuggaacuguauuuguaagaugcuuaauagucuguuacuacauggaaaguauaauguugaccagugggcuuagcaaagaaggauaaguuacuuauuuuaauggaaaaagccaaaguuuacuuccuuccuauucuuacuggggcauuucaacuugacugucagagcauuuuccuuggugauuuauauaguuuuuuguuuuuuucauucaggccagucucagaaguuccccaacauugugcuucuauauuuccucucucaguugagucucaccaugcaucuagucacucaaauuagaaauggugugcuuauuuuugguauccuuucucuuuccauauccagucuaaugccuaucuaugcuuauucugaauaccaggcagguccaucagccacuucauugcccugguucacaucugugccauuucucacuugaacaguugcauuggccccacaauggccucuuuaggucaggucucuaucccucuccagucuaauccuucuaccagaauuuucuuucuaaaacacaauucugaucaucacuuuucugcacaaauauacacuuuagauaucuucucauugacuuuaggaaaaaugcuaaauucucuugcaugaaacauaaagcuuuuuguuuuguuuuguuuuguuugagauggagucucacucugucacccaagcuggagugcaauggugugaucucagcucacugcaaucucugccucccagguucaagugauucuccugccucagccucccaaguagcugggauuacaggugcccaccaccacgcccagcuaacuuuuuuuuuuuuuuuuuuuuuuuuuuuuuuuaaguagagacaguguuucacuauguuggccagguuggucucaaacuccugaccucaugauccaccggccucggccucccaaagugcugggauuacaggagugagccaccgugccuggccgaaacauaaggcuuuuuacaacuugucuuugcauguuuauauucaacuacuccccaucccugcauucuguggucuaaucaugucuuauuagggugaauauuguuuuauuagguuucaugucuuauuauguugaaucuucgugucuaauuuagguugaagccuugcucugggacacccuuuuccccaacucuucaucuuggcaaaauuuuuauacuggagaaaccaccuauucuuuguauuccugugggauguuggucauaucguuuguauaucacaacauuauauuauagguaauaguccaagauguauucucacuugaagcuccuugaggguaaagauucuuuauuuguguuuagcuacaaaucuugauuaucuuauuuguaugcuacucaugauuguuuugaauuaaaauaaguuaguuauggauucaugguuuuugauaugguagccauuugaaaaucuauauuaaaguauacaaguuuacgauuaaaaauaaucuucauauauuuauaucagaaaucuuauaauguugaugucagugaaggacauggaaaagcacuauguuagucugaaugcaacucacuagcaucuguguauccuuuuuccccaaaggauuuuuuuuugguuaugugaucacauuuguaaacaaaaugcuucaaaacugcuucaaaaaugguucaggugacuccuaguuuaauugacuaauccauauuguauaguauuaauugcuuuuaaucuaaaguaauggauguaauuucauucuuaagagucucuuuggauaucuacaauaauaguauaaaagauacuaaauacauaucauugaaauccaugugugguuaagguuuauacucacacacauacacacucauacaugguauuugaaaaauaguuugacuuguuuaacauccauguuuaaauacugaaacugcauuacaauuuuagcuugguacuuuuuuuucauuuuguguucuaggaggagcuucaacauuggauuaugauuauauuuuaacauauucauuauuguuaaugaaucuuccuucauuuguaauuuaucuguauauaauauuuguugaaaguggguuuauaucugggccugaagaucaggaaguuuagauuguuggagcaagauauaaaauuaauucaagagcagagaacucaauguugacaguuuccaaaaucuuaaaguucaaaugcagcgaggaugagaaauguaacuccuuauccugcuaagaagcuggaugugcuggaagcagguguggguuccagaaggcugccgugcccauauuguggguggggaucucuacccgugaagugagcguggggcuuuaacggagacuggaucacuuauguucuaccuauaaauacauggaagacuuggcauaccugguugguccauaaaagucuuuucaauuaacauaccauuuuguagucagcgaauuggugaaacuaacaaauaguuauuguuaauucugauguuugauaagaguguuugaaauuaauaucuaaacauugcaaaccaggucuuccuccuggugaucuggggacaucuugagauuaagaguccuccaggguaaaaagcagaaaugacagcccuuuccuagacuuuauugauuucccugugugcggcaccugucacaacuuuucuacuuauaaacuuacucuucaaaaaauaguuaacagugauucuuuauagcuucuuuucauucuuauuucuaauugacugaaauauucauauuugaggaauuaugcuugaucuuaguaaagaguaucaguuagcugaaguuugucuauaucuuaaaaugaggccagucaaauccauauuuuuucucaaggaauuuuggugaaagccacuauucucuucuaggcugaugaaaugugaaagagaagcucagcuuuagccaccauucaguuauucaauuacaugcuacuguuaaacauauuuuaauauuuauaguuauaugccucauuuuuaaaaacuuccuauuauugagcacuucuuaugugagacacugcuaagcaagcauauuaccuguuagaucuuugauuccuccuuaacaaccuuaugagauuuauuuaauaagucccacuuucuaguugaagaaacugaggcccagugacauuaagcuuuuuuuuuuuuuuuuuuuuuuuuugagauggauucucacuuuguagcucaggcugguaugcaguggugugaucucggcucacugcaacuuccgccuccuggguugaagcaauucuccugccucagccuccugaguagcugggauuacaggcacacgccaccacacccggcuaauuuuuguauuuuuaguacagacuguguuucaccauguuggucaggcuggucucgaacuccugaccucgugauccacccgccuuggccucccaaagugcugggauuacaggugugagccaccgcgcccagccuaagcuuuuugccuauagcuaguuaguauuggagccauaauuugaguauaaguaagucugguucuaauacuugugcuucuaaauauugugcaguacucugauuguucguucuggguuuccugaugggauacuaugugcacuagggagugguaagcuuaucaauucauuucauggaagcugcuagauaccuuuagcaugacaaugaccuuugcucugcacugaccuuauuugaauuugaauguuaaacuagaggagguuuccugucucauaacuaaucccuugggccagucuucuuuacagauuuaaaaaauaaaauuucauuuagauccuagagcaauaguuuugaaguguuuuacauucaccaggguugaaauaaucauucuaaaaggauuuauuaaauggguaaguaaaauuccaacaacaguuucugagccuccccaaauggcuauauccuuaagaaaaaaaagugucaaaucuuaacacuccaugcuauucacagcagcugccacacuucugcaaaaugcgucggaacaauucugaaaagcauuuugccuguugggaauaagaccaugucuucuuuuacaauuuagaaagcuuuccauucacaggcugaauuuucuagauuacuuguuuguucuuuucugaaauggguaauugauaguucugcguuucauauugaguuaggaagaaaaaugaucuuuugaaaaauguaucauuaagucugcuguguagagguuaaucagaaggaugcagugacaaaacuaagcuaugacuuaacaggauugagagagacagaagauuugcugagugcuuuauccauguaguuuuuccuggaguacuucuuuaggcagcuucucuacuuguacacagguuuucacauaggcaauuaguaguguuuauagauugccuguuauucaauuaacaacugagcuggccauaucaacucacugcagaccugccuuuucauugccagagauuguaccaggguuaucaacuuacacaggcuuggaugucuuccagcuguuuaauuauagugucacacgcuuugcuuuuucuaguuucauuaguuuauaaauguaauaugguaucuuauuucugugauuaacacuucauuucagcagguuaaacaugcugguagagaaguauugauuucugacacuauuuccccuguguucauuuagauauuuucacaugccuuuuauugauuguuuuuugaaaguggcaaacaugaaaaaaaaacccccaaaacauaugccuaaauaacuaaugugaagcuaaaccgcacauuuaccucuuaauugucacuuccugugggcuuuauuuucuacuaauuuuuaaaacaaacacuuaucuugccaaguaugaguaaaaauaugaauuauaguuugaaauaaucacaucauacuuaauuuuuucaauuagccgugaaaauugucuguucaacuuuucuauuuauauuuuacccuuuacauauuacauuacuaaaaucugaaugaguuauuuuuugggaauguaauacaaaugauucuuaaacaugaugguaagaguauuuuacuuuaauauugccaaguacuuuuauaguugucacuuaaaaaauuaacugggugcccucuaggugagccagucuaguaaguggucuuuaaugauggauuuuucucaacuuuauuuaauaguaguuuuuuucuuucaucuuguuuuauuuaaagcauucauguaauuuggaagggaauauccaguuguucaauauauagucacuagaaaccuacaugaagccuagcauauuaucucagaggcccaagcguucuugcuuugguuuugguaauaccagcucuuauaguuugauauaaaaaguuuagagaaugcuuuaauauuccacuuaauauuuacugauaacuguauaugacccuuuacuagauacaguauuugggguauugaaaaauauuauaauugacacugcuggagacuuucagcauggugagaaagagaugaagcaauaaugaaauuuuguuaagcuauccuggcaguaugagaacuagaaaaaauuugagcuguaaagcauagaggccaugaguuauguuauuuucuucacauguuauaccauggacaguuaaagugggugauggucauuuauuaaucuugacuguaaccuguaugguaaaacugguuucugggugagaacuugaggguggaaguacuuaauugaaugaaaauauguuucauuuguuugaauuuaugaaauuagcaagagaggaggaaagcuugaaaugguacauauugacaugagugacaauaaaguguuuaggagcuauuacagcagauuuuauuuuauucucaugagcaaaggaagugcaguccaauuucagugaaaggaugcuccguuggagauguaggcaagguggccaguagaaauaacuagcuuaaucuaccagacaagucugagaucuacugcuuggaggcuuuuuacuguagagcugcucugugcuauaugauagccaucagccacuuguaguuauuuaaauuuaaauuaguuacaauuaacugaaauuugaaauucaguugcucagucaggugaaccacauuucaagcgcuuaauaaccacaugcuacuaauggcuagcgaauuggaucguggagcuauguacagaaugucuccaucucugcaguaaaguccaugggacagugcugaucuugagaaucuagagguguuuaaauauacacuuagagaaagacauacuaaauuuaauagaaucguugaauuuggguuuuuuuguuuguuaaguaaaauagagaaauucauuaucuuguaaaacaagaacuccagacacaacaagccucaagaggugauuaaugauuugucagggucuaagauauauuacucuuauuuaucuucacucugccauccuccaaggugguuucauccuaagguuguuuccccugugguuaccucauggcugcaacagcagcaugcagaauuuauagauaucccaaugauacuuuauucagacuagcaucuacuaccuugaaucuuucuugaaaaaacuuucguuaggguuuaacaauguacaaaauuuccacuguggguaaauacgugauauggagaggaaccuguuagcuucgucaguugcugucuuuuauucaagaaguuggaauuaaugucucacauguuuagcugugcugugccccuuagacauggauuauacccaagguccugaggagucauuacugaaugaguggugaggagguauaagcucuuaauacuucaguggcaaauagaguuuugaaucauccauaaaaaccauuacaucucaagguugggaggggaacuguuguagauaaccugauccaaccaccuucuggucuaauacuguacaaauccuguaggccauaaagacuaauucauauuuuaaauaaggaaauuugaucauccuuaaauguauuauuuuuaauaaauuuauucccaacauucaacugauauaauucucaggcuaaaaagcugaauccuaagaugucaagcaaaguaaauuaaaguucuuaacacauuaugaacccuuugugacucggaaucuuuucuuaacucuuuuuuauuuuugacuaucaacuccaggaguauuaaaaaugguaucaauauagauaauguuuuacauaguguuccuggaugaaugaaaaacuugaauguuucaguuucagacaauacaauuucauagaugugcuuuucugccuguuauaacagaaaagguaaggcauuugccacagauuauuugcauaugccucaaauuuacucgcaaagccuaauuuuccaucaaauaacuuuaaaauuagucagagagcuucaagaguuggaaccaaauuccugaucaguguggcuaccuaaggaauuucacagacacuagagggacuguggggugaccacaaugacguuguaagcggguuugcuaacuuuuauuuuuaucucagagggugaugugaacucuaauggaaaauagugguaauuuccuaguuagguuuuugguaacgauuaaaacacuuuuuacaacuuguuuugagguuuuauaugacugguaaaauuguguaaagcaggaauuaauccccauuccacagaagccauccagauuaaaucuauuuaagagaaugcacacaucagagggggcagagcuagagauggaaucccagcauugagauccuguauugucuccaguuaguaagacugagaaggcuuaggcuuuccucgccaguuaauuauguugguauuucaguuacaguguuuggauuauggguuugauuaaacauccuguagaggugauggguaucuacucuuucagauuauaguuaugucaagaguguagccuuuaagaaucuauaguaaaauaugccagauuaacuugaguugaauuuauuuuuagcagaaaccuauuauucauuuuagaucaagauggagaaauuaucugucauccaacauagcuuguuuugcuuauacuugguaaggcaugguuuuguuuuauuuuguuuugcuucaguaagaacuguuccaaucauuucaaggagucuuugugacuuuuuacacaaagagucugcuagauauauaccuaacuacuuuucaagugguguuguauauaaauauacaggauguuuacuguacaaaggcacaugaccaaggguugaguggaaacugaaauccagcccugcccucugcucacaaaacugugaucccugaaugggauuuauggauuugaacuaaaacauggacaugguaugggcuaauaaagguccugauacuuccauauucuauguaaaauauuuccuuaacccuuucguaauuugagacuugaauuauaucaguuuauccuuuuaucuugauuuuuagauuaugguuaaauaugcagaacauaaaauuuaccauuuuaaccauuuuuaaguguacaguucuguggcauuacguacauucacauugucaugcaaccaucaccaccuuccaucuccagaacauuuuugucuuccucaacugaaauucuguaaccauucaauaguaacucuuauucccccucucccaaccccuuggcaacuaccauucuacuuucugcuccuaugaguuugaguacgccaaguaccucauagaagugcaauuguacaauauuuguccucuugugacuggauuauuuauuuagcacaaugucuucaagguucauccauguugcaugugucagaauuuucuuccuuuuuaaggcuagauaauaguucguuguaaguguauguuacauuuuguuuauucaucuguugauggacacuugguuugcuucuaccuuuuggcuauuguuaguaaugcuaugaacaagguuguaaaacuuuucucugcuccauuucuuuggaguauauacccagaaguguaauugcuagaucuuaugguaauucuaaauguuuaauuuuugaggaaucgccauacauuuuugauaguagcugcaccauuuuaccuucuaaccagcaguguacaggggguucaguuucuccacaucuucaccaguauuuguuauuuucuguuucguuuuguuuuuguuugauaauauccauuuuaaugggugugaagugguaucucauugugguuuucauuugcauuucccgaaucauuagugauguuuacuaucuuuuaaugugcuuauugagcauuuguauaucuuuuuuggagaaauauuuauugaagucuuucauuuuuuaauucaaguuguuugcuuuuuguuguugcauuuuaggaauuucucauauguucugcauauaugauauauucuuaucaguauaugauuuaccgguauuuucucuauucuaugagguaccuuuucauucuguuaauagugucuuuuuaauguugaugaaguguguuuuaucuauuuuuuucuuuuguugccugugcuuuugaugucacauccaagaaacuauugacaaaucuagugucauaaagcucuucuuauauguuuucuucugaguuuuauaguuuuagcucuuauguuuaggccuuugaugcauuaugaguaaauuuuuguauacgauauaagauaaggguccaccuucauucuuucacauguggagauccaguuuucccauuaucuugaaguuuucaagacuauauacagucaauuuuuuaucaguauggguaauugcugggaguaugaugaagaaggagggcacacaugaccccaagucacaguugaagcaaaauuauacucauguuucuguuauccagcgauggauuagcugauuuaccacaauaaaugcagcaggaccagguaggcauuauuuucccaguagucuauaucaucaggcaacuuucagucuggugcccauagucagcucccauagcuaagccauuccugaagcuggucuacaugaagaagggcagauuccgaaaauucugcccuagggucuugcccuuguaccugauagaugagaaccauagcucaccuucucucuuaagucauuuuuagauuaguaaugagugcuguucaacagcugucuaauucuaaugaaaacuuaaucagccuggauauaguugggcauuguauuuugacagagauaguaaagauauuuucauggcaucuugaguauugaaagaacuuccauauaauauaauucaaguauaauguaccuacugggagaagccaguauaccuguuucugugucagugcuaaaaauaauggaaugagaaaagaaaaaaggcagaguauggaaguugucagaaguugagagacaguacaauuuaagagguaagaauauggaccuuaaacucagaaggaagaagguucugaugcuguuuuaccauauauaagauauuugccuuggccagguuuguugcccagcuugguuuguuaaauguuugcauucaucuguuuucugaucuguauggugagaauaauaauaaccaaugcuauagggcuuugugagauuaaaugagaugucuaugucaaguguuugcacagugguaggccugcuguaaacacucaggaagagggugguauugaugaggggagaaaauauaauauccuguuacagguuuguuuaauuuaauaaggaucuuugucuucccugagaagagauaggaagauguauucuagaaggaaauuuaacaauucaugcaucguuagcauugguuuugauuguuucugcuuuuuuuucuuucuuguuuuucuaacugcuccagguugcuucagcuggaagguugcuaacauuugccucuuuugcuuccucugugguaucaaugucagugauuuccaaaguucuuuacuuuuucauggaaauuaucuuuguaacagaauaauucuuuaugaguuuuucuuguaccuauccacaaacuuaguucucaucuuuaggcuuucucuccuuuuuaaagugcacacauguguauuccugucaccgaacucuuuuuauuaacuguuuaauauuuuuaucaaaauauuuuugagcaauguucauaacccuuggcauugauuccuaccagugagaagaggggauguccuggcagcauggaguggaauccguccucuuguuacagaccccaaaucugcagauacucagucuaucucccgaaaucauguuguugauaucagugagaguggccuuauuacuauagcagguaugagauacuaccuuguuauuuucuuuucuuuuuuuuuuuuuuuuguuauagggacagggucucaccauguugcccaggagggucuugaacuccuggacuaaggugauucucccaccucagccucccaaaguguugggauuacaggcaugagccacuacaccuggccuucugucuuguaauuuggaugugcuuuagauauaaguuugacuuaaauuguccugccagaaucucuuuuaacuuuauugaacaagcauuuuuuuuauucugaauuaaguuuuacacaaucccauguuuguuacaaacaacaggaaaauuuuguuauugguaaguugauaaaugguuaauuauaagaaaaauaagggguggcaaccugaugaauugucuaucaauuucuuuauagguggaaaguggacaacuuaucggucuauggcagaagauaccauaaaugcugcugucaaaacucauaauuuaaaagcaggaccaaguagaacaguugggcuuuuccuucaaggggguaaagauuggagccccacacucuacauuaggcuugugcaggauuauggacuugaaagcgaggugagugugcauugccacaucaucuuacucuuuaccuaaucucucacugcugccagugacagaacuggcagcaaucaggucucccugauugagauuuccuuuugcugaauacauuucugccagucuguuauggaaggaaaaaaagaugaucuugcuuugcuuuacuugcccaacaagcaauguacacuuuaugaaauguauuuuauuaaaaaguggaguuuauuugguuuguuucuaguguauagggcaucccaaauucugucucaggcaugaagaaggcuguucuucagaagugguaucaggagcaaaaugaagcugaagcuucaucagucauugaugcagugauacauguguaagagaguuagugcuggccuaagcauucgaagcccaagugguuuccuuccacaaaaucaaaauauaauacucuccgagagcuauuaguuacaggcuguaagaaaacugacaagauaagcaugugugcuuuuugcuuugugccuagaagcuauugauauucaaagugccugccuaacgcagcuuuauuucucuagguggcacagcaucuugccgccaccuauggugauaaggccuuugagguggccaaaauggcaagugugacuggcaaaagguggccuauuguuggaguacgucuugugucagaauuuccauauauugaagcagagguaugugaauggucacauaggaauuucaugucugccaugggauaccauuuaucuguucauuugucaucuuuaaaaauuauauguagcuaaguuuuaaugcacauaugucagcuaaaaccaggacuacuaugucuuuccaauauagauccuuuuauuuauaaaauuuuaaucuuaauucugaagugauauugauagugguaauaauaacaacauaaaauauagguuucuuuuuucuccaucaaacugucccuaaacguguuaauucacaguugucccuuuugugcauuugcagcucuuuaaguuuguaccacucauguccuaccuacauaucuugugacaguuucucaaagguuuaggucuuguuucccaucaagcucuccaguuuugugaaaucagagaccaggcuuuguauuuauuuguaauucacugugccuuaaaauaucgauguccagugaacauuuacuuguugauugaauucaggauuccuauauucugguuacucuaagacaaaaaacuauacagacuaaagaggugagaucauaacuuuuugacacucguccuuuuccuagucagcuauguaaauuaaaauccacauuauguauaagcauagagagguaagugaugacuguggaugguuaaugagaagugaugcaauuugcauguuuaugccagguucuauucaggaaaaaggcauuaacucuuguccaauuuuugccauuuuccaaaccuccuuuggcaggcagauggaaaacuugugugaugccacuauuugucucaugccugcuggaggaccagagaguauaaagaaaaauauuaccuuugugaagcacacauuuauuuuuuuuaagugaagcuuuauuucucauuuucuaaagaagagucucaacuaauaauuuuucuuuaauucaaacucaggugaaauaugggauuaaggaguaugccugcacugcuguggauaugauuucacgucguacucgccuggccuuucuaaauguccaggcagcagaggaagcccuacccaggauuguugaacugaugggcagggaacugaauugggaugauuauaagaagcagguauuauauagaagucuuuaaaaccacaauuccuauuguaaacgcggaauggcuuaauuuguuaguagaagcuagcguaguuuuugaugauaaccuuagauuucuuaccaguuuuucuuuguguguguuuaauauuguuaggccuuaggaaaauggaaagauauuccauuuaaauuuaguuguuuauggaaaaucucuuguagaaaaugcucauaaauuuguggucauaauuccugaaaaagaaagauaauaaugauuguaguauggaaccuuuucugguuuucauugaaaacacucuuggaacauaaucagugaaaugcaaacuccugcuagugugccuuugguaagaaaugugguuuuucugccugagcacuaaaugcuuaucauuugugucauuugagauuuuauauuuauauuccaaauuuuaaaagcuggugaugcucagaugcauacacacacacacgcacaacacauacauacauacauauacacgcacacaaacacacauacaggguuaggcuaaguagaucuuuauguuuuuuaauuaacccaaacucuugugauaugcagaggguaaugaagcauuuuuauauauucauaaaauacuuucuguauucauuggguucuguuccuuucucccaggaucucuugaacccauuucauuuaggcacuuuugccaccacuuugcugcauuagcucuggucaaucucaccaguaaccuccauguuacucaauaaauuuguuaacuugcaguccuuguuuuacuuggccaauuagcagcauuugacacaauugauucccccuuccuucuugaacaauauuuugcuuucuggaacaccaccucucuuggaucuccuuuuaccuucccaaaacuacuacuccuauagacuuuuccaugucauaaauagcuauccuucaguuacucaagccuaaacauuaguaucauacuuuaugcauucucuuauacccuaucuaaauccaucagcaaaucauaccauauuuauguuuaaauaacugaauucaacccuuucauuuaaaaaauuauuuuauuuuuaauuuuuuuuuaacaaacacuuguguugaagugaauucaaccguuucuuaacacauccaacuuccaucacccugauucaggucaccgguaucugucacauggauuaccgcaauagcuucccuccccuuaacuggugucccuucuuuaacaacuucagaguucaguuuauuaauacaaauccagaucauuggauaugucugugugaaauucaaagggaaggcuugggcuagagauauaaauuugaguugauauuuaagccaucagacuggaugagauuauauagggaguuaauguagucagaugaugaaaacaguccaaaggccaagcacuggagcacaccaaaguuuagaagcauaggauauaaggaagaauccaggaaaaagagaaaauaauagcuagugaggcuagaggagguguaagaagaugcaagagggaguuuugaccuagaagguaagacaguauaucuuaguucauuugggcugcuauaacagaaauaccauagacuggguggcuuaaacaacaaacauuuauuucucaugguucuggaggcugggaaguccaagaucaaggcaucaguagauuugggaucuggugggggccuguguccuaguuuauagacaaacauuguauugcuguguucucacauagcaugagugaaugaacauuauugggcaucuaugauacaugcugacagugcaaggaaagaauuagucacauggccuguuuuuaaaguauucucauucugguauagauuuccaaagaugauuacauaucagucaccugggaaaugugggaggaaaggguuugauuuuaggaguuccuuaauccugaucaugccucugacagggauaaaauuuacccccauguuauagcugagaaaacagguucacagaguaggacucuuuucagaguuuauaucaacagucaauuguaaagcagggauugaaaccagguauucugauccuagagcauaagcuuucuccauccugucuugcugugucugcauuagcuguacugguuuauagcuguugaagaagucuugagcuuuaguuugauuagcuaaagcuccguacagaggcagcacaggaaugaaacuuacuccugugcuucugucaguccuuuuuaccauauagaaggauuggggauaauguguccuuccaaaaauuauggucggaaugauuugaauaugcaggaacauauuuuaugcuaggaauucaggcuguaggagguaggaaggaggaagaaaauucuguaaacugguuguguuuggcccuacuaaggaagcuagauuuaacuucaguucauauuuuaugaacagauuuaugugcucagaaaugcucucccaucccccuuaacaaaguaacauaaauaaagaccuaaagcuauuacucaguaucugagauguaggaguauuaaugagagcuguggacagucuagagagaacaaaggaguggggagaaagaauuaaaagguuagaaaguuggacuucugagaaaagguuaaaagcauugggauuauuuaaccugcaaaagugaaagaggaacaaggugauaaauaacucuccguagaugaacugugcuuguuuuuaccagucaauacuuaaugagugacuuguauacugaacauugcaccaaauauuuuaggagaauacuaaauagcucauaguuuuaagaucuuaaaaucuaauuggguuguuauaacacauguauagcucuggcauuuaugcauaguuuccaaaauuuggagaaauauuucgagaaacugucacucaagaccaaaauccaaccaacuuggaagaacugauuagggaagaaggcaaugucuuagggaguuggggauuguuagaggaguuggcaggaacauuuagagaaaaaaaaaaacauugccaaauuguguucugcaggguacaaauuaauauacuugaaaggaugacuacauggucaaaagagaaauucugaguuaaacaaguaaaaccacuuccuuuagugcaauugcaauuagaaccuuuaaaaugguuauguauguuuucaguuuccaaaaaggaacuuauuggagacagacccaauucucacuuuuugggagaacuggguaggaagggagcuaguacuuagaacauauuuugggaaaugcugccccauaggauuugauaagguggauuuuaucauguucagacaaaagauccauuuuucauucagagacuauaaagagaaaacauguaaguagacugagagucucacaaaaauacauuuuuuuuuuucaaaauugauuccaaugaggaggaaaaaugggaggcaugugaagacuuugaguggcugauuaaagcaagcugauaaauaccaaauguaaaacagauagaagccaagugcucaacaaugaaaggagcgauaucaggaauaauguggauguguaugaguagugucagguauuguuuggguguuggggaaaaaauacuuagggcaccaaauguaauguuuaaaaguugaagaaaaaaacaaaagcaaauaagaccuaaucuagaucauugcuuaagguggcaggcaucauauucuugaaugcuggagaguaaggagaacuauucaauuuauaauuuacuaccaaugucuuuuuccuucucucucccuguuuuuaugugugaaaagagcaaaauauaaauguugguaagaaugaauagauauugaaauaggaggcuacucugaaugaguuuuaugccaguccagaaaaauuauaccuuagaguacucagagaauuugcaguuaagauucucuugcuugggaucagcuuacuguugaacuuuaaaauacuguagcaaauaggaaugggaccagaagacagaaugggcaaauguaauaccaaauuucaaaaacgagaggagagaaaaauauaguuugcaaccuagaaacuaauggucuuggcauugaucuugcgugguuuucuagauugugacauuuuaaguuuauuuuaucagcauuuaucaagaaauagugaucacggaagcuaguaaggaaucacuuaggcaaaaucauuucagauauaucauuuucuuuucuuuucuuuucuuuuuuuuuuuuuuuuuugagacaaggucuugcuauguugcccaggcuggagugcagugaugugaucauggcucacuacagccucaaauucccaggcuuaggugauucucccaccucagccucccaaguagcugggacuacaggcaugcaccaccaugcccagcuaguuuuuaaaauuuuuuuuguggagacaggguuuugccaugcuguccgggcuggucucaaacucccgggcucaugcgauccaccugccucagccucccaaagugcugggaucacaggcaugagccaccacacccgguccucauuuccuuuuuagauagagcaagcagauggcuagauuagggaauuuugauucuauaaagcauuuuagaaagucccguaugauaucuguaaaauugguagauuuauaaccaguuaaaugacaguguuggccucagaagaggucucugguaguaagucauaagcaccuuguccuagaucuugaccuagucuaccuugauucaaaugguuaaauuacaauguugauggcaugcaucuuugauguaccaauaacaagauaccagagggagagugaauguuugaugauggauugaaacaaugggugaaauuucauuagauauaauuuaauagagauaaauggcaaaccuuacauuagguagaaaaacaauuccauccauucaagauagauuugacaaggcuuaacaauagcacaugugaaaaagaaauaugguuuuaguuaacugugaaugcauagccguuaacaguggaccauggcugcccccaaauccaauugcaaucuuaagccgcauuaauagaaaucauauaucuagauugaugaugcugauaguuacucccuucuagguacuugccagaucucuguugcaguguuguauuuuguucugauaauuguauuguaugacaaaccgguuguggucuggaagaaauuauacaacaugguauagggauuugaaauaauguuuuauauaguaguucuagacuaaaagaaaacucuaaggaggaaagcacaugauacuaucuuuaaauacuuauuaagcugugauaaaaaaaaaaaaaacauuagguuuguucuacccuaggaaaggauuuguuaauccccccaaaacuggaagaauuucaaggagguagauuuaaucucacuguaaaaccuucuaauaauuggaaguaacuuucagcaguauuaaguuaccuccccagugcuagaguuguuuagacaaaggcuuuguucuuccauuuuuggaauguuauaaaggaaaugugggguaagggaaguacauugaguaccguuuaugaaaaaauaucuuccagcuuugaaauuccauaauuccuuguuugauggaguauagauaaauuacacaugcaaugaagggccauaagucgagaaagaaauuguuguugcagggaagcaucagagguggcauuuccaaggagauggauuuugaacaaguuguguagaaaauggcuagguaaaagugguggaacagcaaaauaauuuuauuuaugaccacugguggauuuucuugugaaaaaucugccagugaaaaauguccuuggagauggagacuucacagacaaguuuuguauaugagauacacaugcacacauacacacacacaaacacacacauuuuaaauuuacuuuuuuaagcucaaagaauuauucacguugauaauuuuuaauuuuguuauuuaagaacaugaaggaagaauguuucuaguaucuauuuccuaagaaaaggaaagcaggaaaggaaucaugucagaaaaaucaacugauggcugggcacagugcuucaugccuauaaucccagcacuuuggaaagcugaggugggagaaucaaucacuugagcccaguaguucaagaccagccuaggcaucacagggagaccccaucucuacaaauaauaauaauaaaaaauuagccaggcauaguggcauaugccuguaaucccagccacuugggaggcugaagugggaggauugagccugcaugguagaagcugcagugagccaugauugugcuacuacacuccagucugggugacugagcaagacacugucucagaaaaaaaaaaguuugucuucucaagaaaaaucaauaagggaucuuaucaucaacauaaccaaacacauauaaacacaguucaugcaaguguaugugucauugcuucauuuucuucauuucacuucacacuggcacuguucuucagaccagaauuugggaaccauugaguucacaagauccuuugaugggaauuuggggaauuuaagacuuguucuagguuauacucaauaacagucaauuucaaaaucucaguggcucaucgcagcaagcauuucuuuuucccucacauuacaugaaggcugcguguuagcugcuguggcucucuucuccacauucuagauuggcuucagaucucaucugagaugugcccuucuuauggcacaggaguaagagaugcuaagcaaaacuauaaaguuaccaugaaagcuuuuacucaaaaguagcauauaucauaccuauucauguuccacaguccaaaguaagucacauggccaacucacaucaauacaguugagaaguauaugugugcguguguguguguguagcauaauauauauaugaggaaagagauuugugaacaauauaugcuacaauaaagucauuucagaaguuuuuagaugggaaaaugacaugaugaaaacuaagaaaaacaauauuugcagcaacaguuaguauuaauugacacugaggacauugaaaacaggaagaguaacuugaggauagcuuauuucuucucaugacucuguaacuucaccuaaguaucagaaucccaguggcaaaaucucagcacagcuaaucucaugagauauaccuucacacuucaugucacauuauagugacaaguccaaguuguucaaauccaagauagcuucaccuuuaauuacuuuuuuuuuuuuugucaccaaacuacaagaauuugauccuguagauuuugucggucaguuucuguguaagaauacucagcaguacaaagaaacaaaauauugaaacaugcagcaacauaaaugaaucucagaauuauuauccuuugugaaagcagucaaacacaaaagacuacauacuauaugaaaccuuuuguaagaaauuccagaaaaggcaaacucuggugacaagaagccagucaguguuugccuguggcuagagaucaugggaagggaucagcugcaaauggacaugaggaaaguuuuagggugauggagaugcuguagaucuuaaucaugguaguagguacauuuuauucaauauaaauuauacuucaaugaaacuggaagaaauaaaaaaauugugcugguuagauaaguaaggaucaacuucauuuucugaagaucaacaguaaaaaaaggaggaaaaaaaucaauauuuccaugugucuuugaacuuuguguguaucucuguuuuaggaacaacuugaaacagccaggaaguuucuauauuaugaaaugggcuauaaaucucgaucagaacaguuaacagaucgcucugaaauuagccuacugccuucagacauugacagguacuuauaauaagugucuaucuaucucucuuuuuuuuuggccuauguaaguauauuuuuccauuauuuaaucuuguguuccagguauaagaagagauuucauaaguuugaugcagaccagaaaggcuuuauuaccauuguugauguucagcguguauuagagguaauuuucuuugguugaugucagccucugauacuagaagaauauaaaaauauuagauguuuuucucaucuaggguuuucuacaaguaauauuuuuguuauaauuuuuaaaagauuuaguaacauuagugaaagcauauuuauaauuuuuuuucuuuuuucuuucuuuuuuuuuuuuuuugagacagagucucacucuguugcccaggauggugugcaguguugcacgaucucggcucacuguaaccuccuccuccuggguucaagcgguucuccugccucagccuccagaguagcugggacuacaagugcgcaccaccaugcccggcuaauuuuuaaaauauuuuuugcagagaugggguuucuccauguuggccaggcuggucucgaacuccugaccucaacuaaucugccugccuuggccucccaaagugcugggauuacaggcaugagccuccuugcccagccaaagcauaugcauaauuuuuaaucaaacuguauuauucuaugcuuuucuuuuacuuagaguaucaauguccaaauggaugaaaauacacuccaugaaauucuaaaugaaguugauuugaauaaaaauggacagguugaacucaaugaauuuuugcaggugaguuguggugaaaggaaacaaggauauuugcuuuuaucuuuuguuugucaugaucauaaaugcauguucaagaauggauauuuaaguccacacaauugucagauuauucugaagaagaagaaagcucgaagccagcagagguugauaugucugcccucaaguguaaggcucuacuguggugcauauucuuuuccuuuuuuuguauaagaaacauuccauuauguugggcaauuuagauuaaauccaaguuauuuaucauaaaggguugaauaugaagcaugcuuuuuaaagacguaugccauggcauaucaaugcuggaccuuuuucuuuugcuuacuuuucuuuuucuuuuccuguacuucauaagaggcaacacaagauuucuaaucuuuuauguagaaaauuuuuaaaaaguaugguucuauucacuaaugaaucauauucauuugagaauuuagugauuagauucugucauuauaaagaacuagaaaaacauaaggaaggaaacuuguauuuuggggucaagaccacauaauuuaaguauuuccauuuccaauuguuaauuuauucaaggcucuguuguuuaaucuuuguaaucaugcaggaaauaaauuuuguuacuuuaacuucaaacuggaugcuacauaucguuucuuaaaagaaauuucaacaaacccauacauuauuucuaacuguccauaugacucugaucauaugaagaauguauuggguuuccaagcagcuagguuuuuuucuguagugcuucuugggcagguauuucaaaugaaugccaggucuugcuugcaccauggcaaugaugaaugcugaacaugaaauaaauuaaugcuggggauuuuggucaaugucagcccuuucuucacugugucaaguuaaacaaacaagaucaaggcaaaggaaaugguaauugucucucuggagaugagcugcagauaagagcauuguugaaucuaaaugcagaaaauuuucacagguuguguccagcauuacaaaaaagaauguuugguucuuuagcuuacuguuuaacuaaauacacauuuuaaauuaaauuuaaaauuuaugcuugggaauuaaaacaccauuuaaugcauuuuuuguguaguuuuucuggagaauauuuuauuguugcccucacaauguuagaaaacuuuucuucaaagaaauggccugugcuucauuucauguguuguaaauaaacagcagaauuuaggguugaaagacauggcacuuuagaaacaauaagaaucugauuuuaugaauaugcuaugugguuuagguuuuaaguaauuuucuugaaugcaguugaguuaaaagcaggagauaauugaaacuaucugcagguuuucuuguagaguuuuuuuuuuaaauaauugaguauuuuuuguccaauuccaaaugaaagggacuauucaugcuuuuacuaagaacaaauacacagugugauuuucaacuuuaaaaugcugaccauauuccucaugaaauauauucacacccaaauguuauuuuuuucuuguaauaugguuucuagauacauguaguguuuaaagaaaacuuuugaguuuuuagaaguuggcacaucauauacugucuauggcuuaaaaaaccucuagcuuugucaguuguguuagcucugauaaacuuugcaggucuuccuggaaucagagacaaagcaauaaacaauaaauuguuccgucuuuagaugucagcauugcuuauguuacaucauuccucagauguaaaguauauuugaaggguuuuuuuaguuuuuuuaaaauauuuugcucuucugcagacuaagagcccauguuuaucccauuaaauauauuuuuugaauauagauacgguuuuucauuaaucuucacagaaggaucacuauagauaucucaugguuauaugacuuuauuucuaagucuggguuuuaaugacacuuuugcauguaggaguccaucucuaauaagcaauagcuugugaaacagcuuuuaauaaggucaugaaauucugauccagccccuuggcagaugucucugacucuuauucagagcucuuuuuaagcaacgugucucuauaggcuaaaagcuauaacccuaaaaauauuuugagaauuuacauacauacauagauacaucauauauauauauaauguguguguguguauauauauaauguguauauauauaugaugugugugcauguguguauauauuuauaugaugaauagcuaaaucuuuucuuuuuaaaacaaauaaaaaagauuagggaagugagaucaagaagagcaaauaguugaaaccacaucaaacuugaaaaggaaaaaaaucccuaugcucauaauugcaaagugccuuccagauuaaaggccuuugcccgcugccugcauguaauuucaagacuaauucugauuuuauccauuggauaaaaaugaauuagcuaaaaucugggcuguagagugcuuuuaauucuuaagguagaucucuggguccauuuucaaggaauuaaauguaaauuacguuaaaaagucuuuaaggaauuuggauuuaggggacucgaaguugucaaguacaguaacauuaaaaaaaaggguagacaaauauaggucaugguuugucuuuguucaaucccugagauuccuuuuuaagauuuuaaauggaauuaaagauccaauauuugaaguugcuaaaaaaaaaaaaaaaagugccuugagcacauuaaaggacaaaaaaugaugcauuaagauuugcuuuuagaggcagggugauuuacuagauggauguaguuuuuguggcaguguugaaauaccugccucuuccccucuuuuggaaacguuuaaaaauuagacucuucuuaucugagcuguaguacuuguuaagguuuuugauggagcacuuaauuaccucugucugcugcaauucuaacgauuaugaugccaugaagaagagaguaaguuggccugcguucugaaucuguugcauauuuucucuuuaagcugaugagugcuauucaaaaaggaaggguaucuggaagccggcuugcuauacuaaugaaaacugcagaagagaaccucgacagaagaguuccaauuccaguggaccguaguuguggaggauugugagucugggcaguaaauccacagccaacaaacauagaaacgacaaaucaccauguaacaaccagagaugacugaaaccacucugaaauaaugaauguggauagcugccuuuuuuaacacuagaaaacauuccaaaacuuuaagguguugguguauuugccagcuuuauuugcuguacuuuauuuguauuugccauucagucuagcuuuuaaguauauuuuuuucuuuuucucauuuucaaugcacauuaguuuugcaucuguuuugugaccuguuagaugugacacauucucuuuuuguuuauucccuuauucuaaaugaguucuaaaaacauaauauuuuggcaaaaauugaaaaaagcuggagacauuuugugacaugcauacagauagcauguguuauuaaaaagaguugccuauugaaaugaucauguuucuggagaaauuaagcuuauagacagcauguguuauuaaaaagaguuaccuauugaaaugauaguguuucuggagauuucucagccccaucuuccuccagcuugucuaccuuccucaugcaaacaauauuccacauuuuuauaucuagagcaugacuggcuaacuggagagggaaggaaaaguuuagaucugguuacuggagcaagucucaaagagaaacucugaaagcuuccagaaucacagguauaagauaaggauagcauugacauuugcugggaguuacagugauaguuucaucucagcaguucauuuuuuucuucagucacugcugguuuucuuugacuauuauaguugccaggaagauccuugcucuucuuacuuuaaaaccagcauuuaaguggcaauuuggauguaauaggaugagaccaaauuuaucuaauuauuacaguaguaauacauuuaagaguuaaaaauguguuuuuauauauccacauaugauaacaaaagauucaauucccaagccuaaauuuugaagcaugugguauugucaaaucuagcuuaccaucuuuuuuggggguacuugcaaccauaguaaaggaagauggaauagacuuuaguuaacuuuaauuauaauuauauguuaaauaaggcacauaaccaguuuccaaggucaucaugguugcuuaaagucuuuccccuucuguacuccauggaaauauucucaguaaaccaaaaacaaaaauggaaaaauaaucaccaacccccaucccgacacacacacagaguccaaagcaaaagucaguguguauugaauuuaacaaguaaugcaguuugggaugcuuuugcuacauuuugguggcauuuuaacuaguuaucugaauauuuauuaaucguacuuccucuuguaaaguuaacuacuuacuuuuuuguuguuguuuuuuuaacaucagguucuguaucuaauaggagauguaacacuuuauuucauggcagguuuuuauugcagagacuugaagucuuaguuuuuuaaacuggcacauaaaacacuuuuugcuguuauuuuuauuuaugucaauacugcagaguaucuuuaugccuuauucaaguggauucugagccuguaugucacaauguaaacacuggagguucacucaccuacgcacucacccaccaccucugaaagaaacagaaacugcagagaaagacagcaucuuagcucauuuuguuuuuaaaugagguuuuagacgcuugccacuuccuaagggaaauccuaaaacagagcaagugaugcucccagguaucacugugaacuuuuuucuuucaaagugugaauuuuuacacuggcuuuuucauuuuuuuaaaguaauugaagcuuguggcuuuacaacuuaguguuuuuugcuauccagauaacaaguuucauuguuuagaacccagugacacuuaauagguagauaaauuguccuuuaaaauaucccagaugauauacacaauaugguacauuugugcucucucucucuguuuuucucucuuucucuuucuaguuagaucaagauaacgaugacuuguacccucccugauucuguuacaguagggcccgggcagaucuguguuuguuaaacaggccuuguuugugcaugcuuugcuaugaaugaaguuccuuuaaggacaaagaaaagcacacuuuucuucuuuugagcauaucugcuuuuacuuuaaaucugcuaauuucuaaaauguagaguccuucaccaaucccagagacucaauuuggaaaugaacugauuucaagccguuacugugaauaaagcaccccagcauuuuguauaagcucuuaauuaaaccuguacagcuucuuuaccugauuuaagaaagggagacaagcaauaggggggaauaagcuucuucaaaauucauuccaagcacaaaagaaauuuuuucccuuugcauauaaacuugacaucaguugauucuguuggggucgggguggguaugcagggauugccuuuuauuaucaagugauuuauuucaagagccuuugaggggauucaggugaaggaacccccaucugugcuggagaguuggauacuccuuuaaauagcccccaccacagucauaacaauaaugauaaugcuggauuauuuguuaagccaagguugucugccucauauccaucaugcuguuugcaauauucuugcuuucaaucaauuuauacugaguguaacuuuaggauuucugcuauuaaaugcaugcucucuauccugcuucaguuucuggcuuugcuuugucuguuucaaaauauguagcuuccucuuuuguacaacaaaaaacucauucucacuuuuacuaaauauacuguaggagucaucauugauguuauuuuucucuuauguaucuguaaagauuuuuggcauaugaauguaauauuaaagucaaugaugcuauaacuugcgauguuugcaucaugucaaccuuuuugaaggagugaaaaagcccuacuauguuuuuaaauagcaaguguaagcucagugcuagaguggauauacacaccgcauguuuucauauguggcacuuuuauguaucauguuggguuauuguucuagacuggacuguuaaauacuauguuugaggcuggguugucauuuuuauaacugucuugguguuuuauggccauuauuuauuacuuuugauacacagaaugagcugcaugcauuuauagagcaauaagaggauguauuuaaugugccuuguuuuuaacugaauaagaacuggaagcaugaaucaauaaaacugauuaaaauggucua

SEQ ID NO: 13202 - RNA, 3781 nt, Homo sapiens
ugcaagucagcaauguuuuauuggagaaaauuaucuacuauacaacaguuuccuauuuauuuuauucaagucaauaguugagauuagaugugugugugaagagugggagagugggaacuauagagcagaggugcacggucuugaaaaagaagauucagaguaaauuguaugcugaucaggugaagcuucuuuccuugucugugccaauugaccccacucucaugcacaccuuuuuccuucuguguccuuccugaaucccaccagaugccaacaucuuucugcuguccuuugguuguucugggccccaaauuuggcaagaggaaucacguccagugcuccugacuuuucucaggaaaaggugguuagugaaaccaccuuugcaaaauuaugaccuagacagugaaagagaucuaacuuaaccgacugcaacuuguuucuaaccuacaagcuguccuuguucauuccugggcguaggcugaacuaacuuugggaaaaacuuaguuuacaguuuauaguuuuaacaaaggugguaacagcccauucccaaagcagaccucccucuugccuggggacuagauugccuuuguaggacuaacagccacaaaagauuagaaacuaugguuaaggagucauucugacgcucccuaaacugcuucuaagaucagugcuugagauauuuugcagacccugcacuugacggaucagcugguaccaccuagaucaauaaacugacuccucugaccuuguggcccuccacccaggaacugacuuagugcaagaagacagcuccaacucccuaugauuucaucccugagcaaucagcacuccuggcucacuggcuucccccaacccaccaaguuguccuuaaaaaauccgcuccacgaaugcuccggagucugauuugaguaauaauaaaacucuggucucccgcacagcuggcuuugcgugaauuacucuugcaauucccuugucuugaucaaucgacucugucuaggcagcgggcaaggugaaccccuugggcgguuacacuagcuagcagugugacuaggacuaguggggaaaauaaucagcugacauaguauggauuggaccagaucgcucaccuaagcauucauuucaaaucaagaaacauuuaaacaucaguuauauucaggcacuaugcuaggcacuagaguacaaaagugaguaacugauggucccauuucccaagcacugaacugaucugggauaaucagugagaaggaaauccaggacuggcacccaacucaaccagauuauuccuuuucuggguaacauguugcauuucuagauaaaugaugaggguuugaaaaaaaugauaaaaauauugguuugauuugucaaacuaaagaaaaaagaacugaggcauacuuaauauaaccagucucaugauguugcccagucacaaguuuuuauuuauuuauuuuuugagauggagucucacucuguugcccaggguggaguucaguggugccaucucagcucacuguaaccucugccucccagguucaagugauucuccugccucagcuuccugaguagcugggauuacagguguuugccaccaugcccggcuaauuuuuguauuuuuaguagagauaggguuucaccauguugguuaggcuggucuugaacucuugaccucgugaucugcccaccucagccucccaaagugcugagauuacaggcgugacccacugcgccugcccggccacaaggaaguuuuuaaaggaaaagaagaggcaguuucuaaauuguuuaccaauaauuuacauaaaaaaacaaacuauuaauugucuauagauuguucuucguaucacaaauuccaggaacaugaagauaugguuggguagucagucaugaacaaaaugccuuuaaacaaucgccucugagcaugaguguggggggugcaacuuaugucccauauucaaggucucucugggccugauaaauuuugcauaccucacauugcucaaaugcucugaacuauuuuucuuuucucaacuacaauuuccuuuuucugguugcucaugauucaacugggggagcuuuuaaaccgugguucucaaacuuuaaugugcaucagaacuacccaaagggcuuguuaaaucuggguagcucagccccagccccagagucuaugaaucaggucacuggaguacaguuucugucaaguucucaggugaugcugaugcugcgggcuccagugacuacacuuuuagagccaguuuuaaaauacaaggacuugcagaucccacguccagacugacucauuggacuuggggauggaaaucuggcauuccaccccucccugcccccuccccccaauuuuaauguguccaagggugagaaucauugcuccucuguggacuauggaugguucccugaaguuacugaguuugggauuuaauaaauauaugcauuccucugggucaacuacaggaauucugcgguauuuaaggacauuaaaugagugacuuaauacuuuauuuaaaaaaauaccacugcuuuuugguucacacuaauuuucuuccuucuuuuggaaaggcauuuccguccaucuccuggauauuuuccaauaccacgauagaaagguuauuaguacagcacccagaggucuucggagcaaagcuguuaaagaagugggguccauuugagccccaacuuugccuuccuuagguccccuugggcuugucuagcccuaggaguuccaacaaguaagcugggcaugcucagugggcagggucguuuuuuuuuuuuggguggcgggggguugcaagugggaagccugcuguucagcugccggggcucuccgccuccccccaccuguaugaggcugggucuggggaaccugugcucagcauuccacccccuggagcuugggcuuggucuucccugcgggucccugcgcugacauucaggcggggagccaggaggccuggcgcgccuccagagcccgccgggggagccgggcgaggguucugggcucugacggcggggucgcagggucgcccgccuccuggacacgucuguaggccuagggaagccugccggccgggagguacagaguaggagaagccagaucccagggcggacaacgagaagucgucagguaagccagccccgccagcgugccggcggacgagugucuccucucccgcaggcagauggccagggcggcccgcaugggcgagggcacaggaaaucggacaccgccaccgucuuccccagccuggccuagcucaggcuuuccaguccgccagcccgcuggcaaggcggggcggaggucuggaguccggcaucgccgaggcacaaagcaggaacugcagccaggggcgagggcccuugcguguggcgcugcgcgaccccacccggcggcaggacccgcguccccgucuagucacguucauugggccacggagaccaccucgcucgccgcccgcuguuggcuuuucccucccacacccccgccaaccccggccccgguucccgcccccacuuccgcguuuccccgcugggccggaggagccugggcccgagguauccgggcaggagguggcggccucgccgcccuggucaggccuccgggagggagcaggcgcgggagcgggaggaggaagucgggaagagggaaggcgggggcgcggcccgcccggcgcucgaguuacacccgcccagcccgccucgagugacagccccgcgcgccucgcugggagcacccgggccgaggcucugauucuggggggaggccgacuccacccug

SEQ ID NO: 13203 - RNA, 4150 nt, Homo sapiens
gaagcgauaccaggagcagcuccuggacaggacggagaaccagaucagcagccuggaggccaugguaggcggccgggugcuucgcccuggagugcaggugcagcuggaggcagcuccgcccggcugcguggacaucagaaauuucucccgagagcugaaagcuccucucagaugccucgggcugaagcugaccugaagaggggcgggccuggaaucccggggagucugccaggaagcuaauggucuuaagaggcuggggggcagguuggcucucgcaggacugagguggggaagguugggccaccccugggugguguggguaggucaggggucugcauggggacugagugucccugguguuagggacccgagcggcgugguucugcucuuugguaaccagagcuacuaacaagcaaccagcgguccccugagugugucccuggcaccugcucaguccugcgcauccccaccuggcagugggagaggacagggaggagcaggugucaggagucacccucacgcccagcagcacccgcccagcaagggugucauccugaacccugccccagggccgggaggagggcaccccggauccucagcaccugcgucugcucugguuuccuuuucagguucagaguauugaguucacccagaucgaaaugaaagugauggaggggcugcaguuuggaaaugagugucugaacaagaugcaccaggugagucucugcagggccaggggcauggagguguggggagcccauugggcuggagcuggggauagggcggggggcuugucccacgguguucgugucagacacagggcaagaggcuggcaggggagauguguugggugcugccaggcaggcagggaugcagugaccgggugcagcacaggcugggaacugugggaacuggguccccaggcgccgaagugacauagaagggaagucugaggguggggagggggcuggcaaacuaaucacagaaggcuuccuggagguggcgggugugguggcucacaccuguaaucacuuuuggaggccaaggcaggcagaucaccugaggucaggaguucgagaccagccuggccaacauggugaaacccugucucuacuaauaauacaaaaaugagccaggcgugguggcaggcaccuguaaacccagcuacucaagaggcugaggcaggagaaucucuugaaccgggaggcagagguugcagugagaugagauugcgccacugcacuccagccuggaugauaagagcaaaacuccgucucaggaaaaaaaaaaaagaaggcuuccuggaggaggugaauaccggccucaucucaggccgggcauggaugugaagcccagcguggccauaccacguucccccaccaaccccaucacacuccugacaugggggccaguagguggggcuaguuggagagccagggacucaccuggcgggaggucuggcugugcuacuuuuccaaguguuuggugaguacugguggugugugccggucaagcacaaguggcccuuugaccuuuugccacucaaaagaaaucaagucaccugcccagaauguucuaccuguugcuuguuuuuacuggcggcugugagagcugacucagggugagagggggcaucgggcgccagggcagugcagucguggccucugaaaagacucaucaaacggccccuguggccucaggacaggcccaugccugggacacacauguccuggccucauuuaaacagggacaggagcugggugugguggcaugcaccuguagucccagcuacuuggacggaucgcuugagcccagccugggcaacacagccagaccuugucuuuaaaaauaaauaaaaauaaacagaggggugaggccauggcccugagagcccaggaggccucugucgggggucuaccauuggccucgcgacaggggucaacacccaucacccucguccacaggugauguccauugaagagguggagaggauccuggacgagacgcaggaggccguggaguaccagcggguagguggcacccugaccggccugcccccaacugugagaacccacaaggccacccucgagggccaaacugucccacauccuagagcggccgccuucucucaaggggacgagacccagccacaggccaucuccuuccucccugaggggccaccuccucgcugcucucaccaccgccuguccuuuugcagcaaauagacgagcuccuggcaggaagcuucacucaggaggaugaagacgccauccuggaggagcugagcgcaaucacucagguaacggcccccccgggacugagcacagucacucaggcagcgggacccccagagcucagacccccaggaggcccugcccauggugaucucguaugugguguccuuuaaguaaauagucugcgguuugugacugguuuuccuaccugaggugacucuguuuucaggguugcucacccaacggucuggugcaggcaggcuggccccgugcccuggacagagcgggggugcugggccuuccuggcgccucggccccuuucuguccccggcugucacggauguggugcuggcuuuccccagccguggcugcugacucacgucccacauaggcccucgcugcgggggccgcguccuggccccaggcucacauccaggcucugagucuguauucacuccccgacacagggguuguccucucugugggccccugccucaguccgccaaauucucauggugcccccagagccggccucugccccagcccugcugccagcugccccggcgcccuggugcugugcggcccauggugccugcacccacuugcuuguccaguuacuuucuccugaggguccgaguccuccggggccuccagggaaggccagcugagaggcagaagcacccgugcuggcuuaggcagccaagcucgcugggacagcguuguaccgcagcccaccccgcagugguggacaccagcgugaccugggugucugugucacccaccccucggucccugagagccagggucucuggggcacacccaggacgucgccuccuuacagccccucagcgccccagggucuguugggaggagccuccaugguagcggcugcgucaccaccuaggggauucugguggcaccagaagccggggcgguugcagacuugggucuucugagcagcacguuccuguccgcuuuaacuccggcugagagcggcugacggacaggauccguguccucucggggaggcccaggcagcccggggcagaccugucaccugcucauagccuuacccuuugcuucuugcaggaacaaauagagcugccagagguucccuccgagccccuuccugagaagaucccagguauuuccauguuugauucuuuugaaugguuggaauucgcaggagaaaaguggauucuagaagggaacaagacagaaugcucccaggccuuccugggccgugggcaagcccugcugccuggcuguuuggcuugggggcgugcgugccuggccuugggguugggcuuggguuucccagggguucgguaacugggcaaccucauaagagagccauaccccauucaaagagacacauucagaaaucagaacuggggaaaggcuucuuuagcagcaccagcucauucccaggguguagcccaggauuagcccucagccagggauggcucuccccguggcaccauucagcacaggcucuccaaccugcccacugggaagcugacuuuagaaccguccauccacguuuguucuguuccuuuacccaucuuuggggcucuucuccucucugagucccgcugggaggggcugugcuuuccuggcccacugucccgugucccuggcccugucugucagccccauuggcuuccuguuugucacuugccucccccagagcugggcgugcccuucccuagugcgaaguccccggaacuggcccuugccaccccuguggccucgucccucucuggaggucucugccugugggucuuuggcgugucauaaacaucucuguuuccuccacagaaaacgucccugucaaggccaggcccaggcaggcggagcugguggcagcuucguaacguggccucgucuugugggacucacggggaugccccagg

SEQ ID NO: 13204 - RNA, 1017 nt, Homo sapiens
agagauagaguuuaauuguagaaaagcugagguagcagaauucugaaacagcagcaaaagguuuagcccagcccauguauuuacaauauacaggagcugggguuuuccauacacuucuguacugcccucucucagcuucagauuuaucccuaucagcacacucauuucuuuccuggaucugccuuggccauaaaagacauaacucuucugggugcuaucccaucauauaaaucuaggcauuaccuccuagucccucugggucucuucccaguauuuuuuuuuucuuaaacauuuuuuuuuuugagggggucuugcucugucaccaggcuggagugcaguggcaugaucuuggcucacuauaacuuucaucucuaggggucaagccauccucccaccucagucucccaaguaccugggacuacaggcacaagccaccaugcuaauuuuuguaauuuuugguagagacaggguuuugccuuguuguccaggcuggucuugaacuccugggcucaagcaaucugcccaccucagacuggugcucuuauuacagguauaagccucugggcccagccucucuucccagucuaugacuccagagcacucuaggggccugucucuucagugaaggaggcuuccacugguguugugggaagcaucuugggcauugacucaggugcgggggccacucucuucuuagagauaauccugauagagcuggcaaaggugagacaguucuuucucugauggcuguuuccagcuguaccauagguaccaggguucaccugagacgaggguggggacuggcagagaaguacucauagcuccaugagaggcacuaaaaucaaggucccgggguucaacuugggagaugugguaacugaggagaccaugaucccuggcuuucuggauggcaugggucaacaucuugugcugcuucauacagacuccuguguauggagcguggaagauaauacccgugugggcacugacaaacuguuccaagagcuuaacauuccu

SEQ ID NO: 13205 - RNA, 1017 nt, Homo sapiens
aggaauguuaagcucuuggaacaguuugucagugcccacacggguauuaucuuccacgcuccauacacaggagucuguaugaagcagcacaagauguugacccaugccauccagaaagccagggaucauggucuccucaguuaccacaucucccaaguugaaccccgggaccuugauuuuagugccucucauggagcuaugaguacuucucugccaguccccacccucgucucaggugaacccugguaccuaugguacagcuggaaacagccaucagagaaagaacugucucaccuuugccagcucuaucaggauuaucucuaagaagagaguggcccccgcaccugagucaaugcccaagaugcuucccacaacaccaguggaagccuccuucacugaagagacaggccccuagagugcucuggagucauagacugggaagagaggcugggcccagaggcuuauaccuguaauaagagcaccagucugaggugggcagauugcuugagcccaggaguucaagaccagccuggacaacaaggcaaaacccugucucuaccaaaaauuacaaaaauuagcaugguggcuugugccuguagucccagguacuugggagacugaggugggaggauggcuugaccccuagagaugaaaguuauagugagccaagaucaugccacugcacuccagccuggugacagagcaagacccccucaaaaaaaaaaauguuuaagaaaaaaaaaauacugggaagagacccagagggacuaggagguaaugccuagauuuauaugaugggauagcacccagaagaguuaugucuuuuauggccaaggcagauccaggaaagaaaugagugugcugauagggauaaaucugaagcugagagagggcaguacagaaguguauggaaaaccccagcuccuguauauuguaaauacaugggcugggcuaaaccuuuugcugcuguuucagaauucugcuaccucagcuuuucuacaauuaaacucuaucucu

SEQ ID NO: 13206 - RNA, 264912 nt, Homo sapiens
gcugugguaaaaaagcagcgaggagggaaggccgggucgcuuuauugauuuugaagaggcuguaaaaaagacuauggcccaucucauuuuggucccagaggggccuaggcgcagccccgggggacccggugcccagagggaugguagggugcuucaggcccggaccuggcgccgagaggcgggacaaggggaccucgcgcccaagccccgcggaaaguucgcgcuccgcgcuccagccggucccuggauccgccgcagcccggggcggggaggggcgcgggaggcgcggccggggcgggcgcgcgagaggaaggugccuucgggaacacgcgcaagggcggggauucgcgcugccaaugaggccccggugugggccgagcaaggcggggggacgggccggagcggaggcuuugcuguggcagcugcuggagcggcggccgccucgggagccggaggagaggcagccgcggagcgccgagcuggccucgccccgaggcccggcccuggguguggggaaccgcgcugaggagcuggaaacuuucccggcagguaacucccgcagcccggacuccgccgcgggccugcgagcgccccgggcauggccagcugccagugugcggagaggucgagagggacccgggguggagagggugaugggagaagggaaaggcgugugggaaaguuucuggagcgcccccuccuccgccgggcacacccgggagcuuuccgggaauaggcacagacauguugggcgccccgggccuuggucucucggcggcuuuggggaguccgcaccuuccuugcgcgguucccccgcgccggaccgagccggccuccccuggaaccgguguggugggaaccgggaacgcuuggggcacgcucgaguucugggaccacccccgcccggcgcgcccgcucgcccccuuucccgccuucucuguagcccucgggcuuggcaagggccugggcuacgccugguaccuggcgcgggggaggcggggggaggcgcgccuggcaccgcgggguccugggcgccccccggaguguuggggugcgcgggucgcgaaguugccgagagaacuuaagccggaggcaugguauugccccagucugggcugaaagucuauugcuuugcuuccaagaacacugcgauuagcauauccacacuccuuuauugggggugggggugaguuaggauuagacguuggggguuuuucuuuagggguggggcgcugagaagagcgguaauugucaagauugugagcccccuuguucuuggaugcagaguggucauuuucgggggacgauaucagggcacuggcuuccuggaggacuuuggggugcgggcgcgcagcgcugugggugugcggggcucccggcuuuggcgcggcggcuuuccggaacgccuggcugggaaggaagcucuaggcauugugugguguguuugcagacagaaaggucccuggaccgguguucucaaaacuuacuggacuuauuguguaaagcuccgggaggaaauguggcguuggccagguagaaacgcggcgcugcggccaaggggcggaggacgccaggcucggcaacggccuucucccagcccccuccugccagcuccagauccgcgugccuccaguguugggaccguucucaguggcguuguucccugcuggaguuaacuugggaggugaggagggaacuuucaucuugaacuugaccccagaagcagcgucguccguacagguuacaagguaaauggaagcugagucuuaacguggguuggaccgcaaacucuggcuggcgcggaaaggaaguuccugguucagaaucuuugaggaaagggcucaagauugcugagaucgcucgcucuggaaaugccagacacaccagacugcagaaguuaaugcguguuuggaggggugggggugggagaggaaaggagaaaccugguuaguuggcacagagggcugguauuucucuguaguggaaaugaagggagucugcgucucugcuuucaccagauccgcuacccucuuuuuuccuuccuuggucaucuuuauuccugccaggcuggcacuccugaggcaggggaggggaaggagaggaaagcaguugugaagcuuccugggucagccuggagguauuucagaucugcuacuaggaagauuccaggauuuuaacagcugcuucuugauugcugggaaugaaggaguuuaugagcggcugagacuacuucauuauagaaguagucugaguguuuuacucaucuaagcuacuuaaagaccucacaagggaccuucccuagaguaugccaguuucugcaguuugugucagccagaaugcuuggugaguguuagucaaaaagcaucauaaauauauccuggugguucugaaaugaaaaguauguggcaguaaaggaaguaugguaucugauauccuucaggacuuccuccuaggguuguuccuguuaccugccaagugaacuugguucaggcuuccggacuguugugauuugacaauaagagaugggaaauagugucaucgauuuuaguggaagcaggaaaaguccacaaauaaauuuaaggugaguuuuuaugacccugucuugcacauguggugccccaaacuuaacuuuuuggcaccaagccuuuugguuugaaguguugcuggaacuuggaagcaaugguuuuccugcuuucuugguuuaaccaccagaaugcccaaauuauuauaauuuauauccauccuugaucuaagauauaacugauucauagucagccuuuuucugcuucccauaacagccuguagaaaaaagaacauuuugucucuuuaaccacacacgauuuauuuggugccauaguagguuuugacacugggugauugagggcauaauuuuagagacaauggaguugucuggauuaaaucguccauuuuuaggcaacguucucuucugaguugcugauuaauucuuuauuucucugggaacauuaaaaccagcaucccugagccaguggaacuauaauccauauuauaaugacuccugccagcauagcuggagguuaacuuuaugucguuguuuccauuagacauuucuaaccuaauuguaaagauuuugucucaguuggguugagaguaggguugagagucucauagaaaaagaaauggcuuuauuuuuaucuuuaugauaaaauaaaguuuguguuacaggaauacauuuacagaagcaaaauaaagaagaguguuuauauauuuguggggaggauuuguuuuaguguuuaaaauaguuugguuuucaacugucucuuaaaugcauauuucagugguggaaaaaccagaaccucucccugcccccuuucuccccacguuaugaaaguguucacuguacaaagaacucuuaagccuuucugggucuugguuuucucauuuuuuucaucccuaaaaugggauuaccuugcaucccuaaaguucugugacucuccaaaaguuugagaaauguaggaauucugaagccagugcuguaauguuagaacacugcuaugggguuuauaagggcuugauuuacacauuuuaucccuaacccuuuauuugaauaaaccaaggccuagaaaguuaaauuagaccuguaucaucuauaaauaguugaguugaacuugaaccagagucuucugauucucccuagucucuucuccucuguuuauucaaaccugccaaacagacuaaaguuaauauguggcaauuucucacaauacauuuuuaggguuauauaugaguuauuuugauuucagaaccccaggguuaacaucuaugcuuugaugucagggauuaaaaacaguucaccaauaaugguaauaaaacuuucuccucaagagaguuucagaaagucacaugcuucaaacuaaucauuuguuuauuuucaacuucuuuuuuauuaaguaggcuucaggguguaaugugauuuauaauccggacuaguaacccagacagcauucuuaaggaaaucacuucucaaaucuguaccucuuuuuaaaaauaaaaaaugaacauaucauuugccuuugaucuugguaucucucagccuaauugcaaagccugggugaguauuccuuuuuuuggugucaucauucuuggacuguuccuacugauggcuggauaagucugauuuugcagcacuuuccaugcuaaauacauccuucccuuaugcuguuggguugaugguaaagagguaguagguugcaggugacccauuuuugcugugucucuaaauguuugugcuuuguccugcuugccuaguuagcagcacucacugcagcuugacacucaucuggaggcugguauugauuuucuuuaacagguucuaaaaugcaauuauguguuaagcuguaggcucuuuuaugucugagcagcuuguccaucuucagcuuuuuaaacuuauucucagaggaaugucuuuucaaaauauuaagcaaugggguuuaaaccucaauaagaagauguaucagugcucauuggcugggaaggagguguaguauaucugaaauugccgccauuuccaugagugagagaagagaacauuaugaagugcuauuagcuagagaaguugggacacuuuguaccaggagggcacaagagcagcaaaggagaagaaugauucuugguuuuuaauaauauuaucaggagcauggauuuggaaugauagaggacuuugaagaaggcuuucagaggacauuaucuuguggagagugaaaggaguucuccugguuugguuuagcuguguugcugauggaacuugcccuucuagggucgguguugucuuuagguuccccugcaggugggugugaucaaggagaauguucuagaaagaagaguuccauagacagaaugucaaggacaaaaguguugcagagggaugacauaguuccuggauuuuagcacagauuuuuucgcuaacaugagggaauuuauuaggggaaaccuuccaguuguagagguagacagaugcgaacccaucauguucaguucacauagcccagagccacagugacucaaccucuucccugccccaccucagcacaccuaggguuacgugccagucaugaacaguggcuuauuaccucuuuggguaggagauggggguggagaguagggaagucucucagaagcacucagcugugaccuuuucaugcauguauacccaugcaaaaaugggauccucuguugcaugagcuuuugaagaaauaugaaaaagaucauacguauacggcugcugguauuauagcucucaagccucacauccagaauuggccuuuuugauguuaguuccaauuugggaaagcccuggagggaacccgaauuggcuugaugccagccaaaggagaguuacgguuagacccauaaaauggggcuguggggagacaaaguaucccacaaagaagaggguuauuguuaauggaagagggagggagcuggaucaacaaaagagcuagccagggcaguguacauuuccacaagugguacugcugaucauaacaacauaccaaaggauaugaagauucuuaauguuguugugauguacaccccuguagucuugagggcaguggacuuguccacauucugugggacucugaauugcuauguacacagacaugaggggguauugaauuacugcuaaaaacguaagaguuggucauuauucccauguaacccauuacacuccccucucucugccaugcuuuguucuaaauuacuugggauaaguaacauuaauuauuaauguuuauugagugccggcugacucugaacuacauguuugaauuuuaaaagucuguggaugaaacaguuugguucuuucuucuccuguuguccuacauacguagaauacuauggcagggauggucaccauacaacagcauucuguguucugguccuccuugcuucuuguggcuuaacaacaacuguuuauuugcuugggauucagaaaugggggccagguucccugugccuaggcucacuggugccguggugguuacaugauucauugagggccauugcugcaauaguuuacaacauuauaaccauccuugauaccuauggaagauugguuccaggauucccacggauacuaaaauccucaaaugcuuaagucccuuauuaaaaaucauguauuauuugcauauagcuuaugcauacccucauauauauauauuuuuuaauuuuauuauuucgagacagagucucacucuguuacccaggcuggagcacagugguacaaucucagcuacugcaaccuuugccucccggguucaagugauucuccugccucggccucccgaguagcugggauuacaggcaugugccaccacgccuggcuaauuuuuguguuuuuaguaaagaugggguuucaccauguuggccaggcuggucuugaacuccugaccucaggugauccaccugccucagccucccaaagugcugggauuacaggcgugagccaccuugccuggccuccuuuguauuuuauuuugagaaaggguuuccauuuguugcccaggcuggacugcacuggugugaucauggcucacugcauccucaaccuccuggacucaugcaauccuuccaccucagccuccuaaguagcugggaguacaggugcacaccaccacacccagcuaauuuuuguauuuuuuuuuuuuuuuuuuuuuuguagagacagggucuuacuaugagaccagaccaggcuggucucaacucuugguucaagugauccuccugccuuggccucucaaagugcugggauuacaggcaugagccaaccccccaguccuccuucauacuuuaaaucaucucuagauuauuuauaauaccuaauauaauguaaaugcuagauaaauaguuguuauucuguauuguuuuaaaauuuauauuuuuauuguauuuauuguauuuuauuguguuuauuguauuguuaucuuuuuuccaguggucaguuacuagaauauuuuuugaauauuuucuaaccuagguuuguugaaucuguggccauggaaccugagauauggaggguuggguguggaggggggugacugugcuuacuacuauaauccugcuuuugauuaguuuuccacuggccauguacuuaaggguaagguggaugcguccccugccccagggagugaauuuugauuaagccaucaauuuuaguaaugccauaccuuuugccagugacucauuaaugaauauguaugugacgccuguuagguccuggcauauuugaagcauaagguugucagcacaagagaacaaguagcaccgagugcagacuaaagguggccuaagaccacaauuacuuuuuuuuuuuuugucggugucagggguguaggaggcgggcggguagagacagggucucaccauguugcccaggcucgucucgaacuccuggccucaagcaauccuuccaccucaguuucccaaagugcuggauuacagagugaaccaccauccccagcccacaaugacuuauuuuagcugcugauuagccagcccuagaaccacugugacucagaacuucugugagaaaaaacauuuucguuauuguuucuuucuuaucuuuuuuuuuuuuuuuuuuaagcuagggucucacucuaucacccaggcuggacugcaguggcaugaucauggcucacuguagccucugccuccugggcucaagugauccucccaccucagccucccaaauagcugggacuacaggugugcaccaccacaccuggcuaauuuuuguauuuuuuguagagaugggguuuccccauguugcccaggcuggucccgaacuccugggcucaagggauccucccaccuuggccucccaaagugcugggauuacaggugugagccacugugcccagccucauuauuguuuaagaucagugguccccagaguggagugugcuagaucauccaauaugggagggaagaaaauauucaagaauguuagaaaaaauuaagcuuuuaaaauauuuaauguaugaguugacacugguugguauaucugguagucuuuuaucaacuuacauuauaugagguugccugagggaagacugggccuuuuacaaccugguggaauugacagugguacccucauucuuauucuugccuuuggugaacucuauccaucuaaauacauuuauggcuagauuaucugguuuuaacuaaacugacccccagaaaaugggcgagugguuuaaaaagauucuugcaaagaaaguguaaugauaaugauauaaguauaaaggaacaagaaaauguucuuaugaguuuagaacaugacuuuuaaaacaaauuugacaagaagguggcucaaaaauuauguaugggcugagcgcggugacucaugccuguaaucccagcacuuugggaggccaaggcgggcagaucaccugaggucaggaguuuaagaccagccuggccaacauggugaaaccccgucucuacuaaaaauacaaaaauuagccaggugugguaguguacaccuguaaucucagcuacucgagaggcugaggcaggagaaucacuugaaccugggagguggagguugccgugagccaagauugugccacugaacucuagccucggcggcagaaugagacuccgucuugaaaaacaacaacaacaacaacaaaauuauguuuggauuuguauuauuaauaaaaaugaacuuaaaaauacuguuugacucccauccuuuaaaaguuuuaaauguuguauaauguauauacuacauucauguguguguauacauaccauucauaacuaguuuuaauuacacauaaauuaauacaauuuauaauauguuaguauauauguuauaaauuuuuuccccugaaauuccugagcuucaauacguuuuuaaaauuuuuuacuuuuuauuuuuuuagagggagucuugcucuguugcccaagcuggaguacaguggugugaugauaguucacugcagccuccaacuccugggcucaagugauccuguccccucagacucccaaguaucugggacuacaggugugcaccaucacaccuggcuuaauuaaaaaaaaauuuuuuuuuugagauggaaacuuucucuguugcccagguuggagugcaguggugcugucucagcucaccauagccucugccuccuggguucgagugauuguccugccucagccuccugaauagcugggauuacaggugugcaccaccacaccuggcuaauuuuuguauuuuucauagacaugggguuucaccauguuggccaggcuggucucaaacuccugagcucaagugaucugcccgccucggccucccaaagugcugggauuacaggcaugagccaccgugccuggcuaauuuuuuuuuuuuuuuuuaacugauaguccugcgugaucaaaaaagcuuugauaccacaauuuaagucacuuagaguuagguauuuuuguuacuugcagcugaaagcaucauaccugauauaaggacagauaagaguaguagcugucccuguuuuauucuuagcuuucaagaaucucugugaucuggacccuaacuuguuugcaggcccagcuguccucuccuugucucugcuaauaccacugaacuccugcccgucccugauacuuuguuucaauuuugccucuucccucacccuaccaccaccacugaaauuuugacuuucaagggcuagcuuaaauaaauauugcuuucuuaugaacauuuuuucugauuuacucccgcuuccacauuucaguuuuucuuuccuuuuagucucccuaguacauuguacauucauuauaaugucuuucucuguuugcuuuuuauuauuaaguuguucgccuauuggcuuugcagauggguuguaggcuuuuugaugguaggggguccugucuuaccuuucucauuuaaaaagaaaacaaucuguuucuccuuugggagaaagggagacagagaauccacaguuguuaaacaucacucuggacuuguuacucuggggugggucucgccuccagccuucuggcagccuuaggaaggcagggagcuccauguacaugaaaggagauugagggcagggagcucacagaaccaagacagcaggacccaggauucagaccuggaaaauuuuuauuuccuggcugguuugugugcccucaugcauguuauuuacagugccauguucuuucacaugggaacacugacacaggugaaaugggagguuccauaggaugauagugcaaaaacauuaaagacaauccuagcagaugcagugaguucaagggagaguccuuguggaguaacacgaaaggccugguggaugagauguaugaagaucuaaaugccugcagauagugagcugucugcaacuaccacaaagcaaaaucaugggcgauaacuccccaggguaggaucuggccugagcauccccacugggagaugggaggugaugggcucuguagugcuuagcugaauagaguuaucuaugucaguauucccucuaugcaaagauaguugagaguucacaaguuguaggcuuucaaguugagcuauguuagauauaugcuccccugauggaagacagacaugucuccaggguuuugagggucaaaugacagaauguauauaaaguguuuugaacauuauaaauugccuccuuagaggcaagggaacaucaaauuugguuguuuucuugcaucagagacuucuagcucagauuucuuuguuggccauuuuuaagggcauuuccaaugaguuuuuaaguguaaugaguuuuuaaguguugggguucuuaaauggaauaugauauaauuuuuuucagaugaacugcagauauuacuuaaaaucuugcugugaaacuuucaccuguggaguaaguagaauucaugauuaaggugaaucucuuuugggauccaguucaguuuuuccaaaggaucuguuuauaagcauaggaccacuuagcugagugugguugcucaugccuauaauucuaguacuuugggaggcugagguaggaggaucucuugagccaaggaauuucagaccagccugggcaacauaggaagucucugucucuacaaaauuuuuuuuuaaaaauuagccaggcauggugguaccaugccuguggucucagcuacgugggagacugaggugggagggucgcuugagccugggagguugaggcugcaguuagcugugauuacagcacugcauucuagccuuggcgacagagcaaguccuuaucucaaaaaaaaaagaaaaaagaaaaaaaaaaacuuaccguuuucauaaagaugggaaucuguggggcuuuuauuucugguccuggaaacccuaaguaccaacugaaagacucaaaagagcuuugauuucaagguuuuuuguuguuguuguucuuggcuacuguaaauccaguaauuuauuuucaugagucuuuggaaaggguuagggaaagcuuugaaauaucuuaagguaguuuugaaaguaaaaaguagguaugguuugacaauuugaaauuuguuucauuguagauucccaaggcaauggguuugaauaaauuaaguuaauuccauuucaaagaacuuuugcagugggauuucauauuguagaaagagucugacuuauaaaucaaaacauguuaaagaguaaacauauuuauagaugcaaaagacaucaaaacagugaguggcuccuaaauugcaaauagaugcaauugugaaauucuuauucagggguuggugaaucauccauguaacuuaagagggccuuauuuuucuuaggauuuauuuaaguaaagcaagaauucccaaaaugcauucugggggaaacugagucuuaggaaguuaacagguguuacgcagggaaaaaaguccuguggucaaauaagugggaaaaucuggguuaaccaaaguaaaccagguauuuuuguuuuuaacuacaggacuuuugagcacccuuagaucuaguguucauuauaaauauccuggaagggaaauagaguagucaguguuuuccaaacacauugaauuguagaaacuuuuuuuuuuuuccagaacauuuuuuggccagagaacaauguuuguuggguuaucuaauuuguugaaauacuuaaaaaucaaaucgcagacaucauguaauuuugccugacuaacuuugcuaugcauuucuaacuuaggacuuaaaaaaaucaccaccccauuaucacuuuuaauacaauuaacaauaauuuaaaaauauuaucuaauuugggcugggcgcgguggcucacaccuguaaucccagcacuuugggaggccgaagugggcagaucacgaggucaggagauugagaccauccuggcuaacacggugaaaccccgucucuacuaaaaauacaaaaaauagccgggcaugguggcgggcaccuguagucccagcuacucaggaggcugaggcaggagaauggcgugaacccagaagacggagcuugcagugagccgagaucaugccacugcacuccagccugggcaacagagcaagacuccaucucaaaaaaaaaaaaaaaaauucucccuuaaauagcauuugucaccauuuuuguuuuuuggaaaccaagauucaaucaagguucacauugcacugugggcuguuguuguuguuugucucuuucgucuuuuuaaauguagaaaaauaauaucucauuacuucccucccucccauuccugacuuuucuggguugucccauauucugaauuuguuuccuguggcgguguuuaccuugucccauuguuuccuguauuuccuauaaacuggaggcuaggucuaaaagcaagauuagagucaaguaaaauauuuuuggcaaaaauagguccuagacuaagauuccccucugcacuuccgacccccucuaugauuugagaacagacauuuaaguuuagcaauucagagcagcauggugagucagacacaccuguaauccuggcacuuugggagguggaggcaggaggauugcuugaacucaggaguucgggacccugggcaacacggugagaccuuaucucuauugaaagugaaaaaaaaaucaucuggguauggugguucaagccuguauguaguccuugccacuagggagccugaggcgggaggauugcuugagccugggagaugauuaaagcugcugcaagcuaugauugaaccacugcacuccagccugggugacagagugagacccuaucuuuaaaaaguuuagcaauuaauauauagcuuuuauauauauauauauauauauauauauauauauauauauauauauauauauaaagaaguaacagcuuagaguuuaaaaauuagguuuauuaguauaucaaagggaugcaaguugaauugauuccagguguguuuggaaagguauucugaauaguuggcgugguuaaauggauauguuuucaguauaucuugagacuauaaaccaugugucucuuggguaaaguggccuggguguuaaacguuuuuggugguugaauuuuauuccgaaugacaaguaucugaguugugaugguaaaauaauacuccauagacacuuauuuuuaaaacacauuuaggaaugugcauucuuucuaccucugcuugauaaauuuuuaacagaauauuuucaugauaaaugcuuaugcuaaucuaaaauacagccauaaauucaaggacacccucggggugauaauuuucuauguacauugucuuagaaacccagacaagcaaauaaaaguuccuaucauagcuaacuuugcuaacuuaauuugcuauuuacauuuuuuuuucccuugauauccuuccaagugcuaguuguaugucugggaaaaguuaaaggauuuugugaaucuuaaugaagaauagcuuaguauauauaaagaagcuuugcaugaugaaugguagcugucauaagcagcucccagcgcauucuuauauuuaauccuuuaaccagcagggacacuguuuucugcauuaaaauuugccuguugugaauaauaaggugacuuggacagaguagguacuuuguaacuauauuuaguccauuaaaaauauacauauacacuccuuuuuucuccccucuuuaaaaaaacacaaacauauaggauaugguaaaaaggaugaucuuugaaaccagauagacuuugguuuuguguuuggcucuggcaauuuacuugaccuguuucuaugucuguagaauggggacaauaauuccuguuucauagagguuaugccaaggccaaaggcgaagcccuguaugaaaggcuuagcaccgugcauggaucagagcuaucaaaaccagaucaucuuccaccuucuccuccucuuaccauauuuuauuuuauucuguuuuacuucauuuguuuauuuaguuuuugagacaggguuuugcucuguugcccaggcugaagugcaguggcacagucuuggcucacugcagcuucaaccuccugggcucaaaugaugcuccugccuuagccuccccaagagcugggaccacaggugugcaccaucaugccugacuaauuuuuuuauuuuuuuauuuuuauuuuuuucuguagagauaggaucugcuaugucacccaggcuggucucgaaugccugggcucaagcagucuuccugccuugaccucccaaaguguggggauuauaggcugaaccaccacauccaguccuuaccauauuuuauucagcauucuggaucaguuguuaaauugaaguuuuuaauuguucugaguguuuuaaaaauugugaauuuuaagguacuuguuacagaagucgagauaaguucuugauuucaagauaaucuguaugggaguugguugcuuauauuaaaacaauuauaugccuauaugaaauguuuugagcuaacaaguaggacaguuuuagauggugauuuauagaggagaaggaguaagagucaaaagugguguuuuagccaggcacgguggcucacgccuguaaucccagcacuuugggaggccgagguggguuggaucacgaggucaggagaucgagaccaucuuggcuaacacagugaaaccccgucucuacuaaaaauacaaaaaauuagccgggcgugguggcgggugccuguagucccagcuacucgggaggcugaggcaggagaauagcgugaacccgggaggcggagcuugcaaugagccgagaucgcgccacugcacuccagccugggagacagagcaagacuccgucucccaaaaaaaaaaaaaaaaaaacaccaaacaaacaacaaaaaaguaguauuuuauuauuggcacaaaaauauugcuaacaaacucugguuuuuaugaaaaucaguauuuaaaaaaucaauuuuuuuacugagacugacaacaugugaagcuccucagacuuuuguaauguuuugcuugaguaugguuuagaacaauacacuuuauuuagguggaauaagucuauuguacugugcucaagucauacaugcauauucauuuaugaaauaaauauuaccgacaggagagcaggcuuuucuagagaagaggauggucagugcuucauucaagauccucacaguggagaaauggggauucuccuuauugccuuugugccuauuaaagaugcacgcgaagguggaauuaauauauccuaaguuuugaacagaaguggaggaacaguuuggagaaugccuggauaucuaugguccuugcauucuugccauuuauggguaaaccaaaaaguguugucuucugucaucagcuguuuccaagucuugggacuuuggcuuugaaucuggcuuggacaagaaaagaucucagccaggcaaggacugacacugcuccuucccagauagugccuguucucucagaaugaacuugauucccuacagacuucaagucaagugguacuugagcuuuuuacacuuuuccucuaccauuacaaaguuuuguuuaaucucuuccuuucugaaauguuuugcuucaacaaaaaggacccuuuuaacugucccaacucuacauaccaaaaguuaagccaggaggaaucaaaggguguuaguucccccuuccaucuggaaaaaagagaugccauuucuaggacagugauugagaccuaagccaguggaaaauguaaagagacuuuaccuucuucacaaggcuuuuuugcuuccuucauaagagugguguuagccaacucaacaaauagaauuuccuuaugaguuuuuuaaagauaaaaaguuaccaugaaggugguaacuauuugacaaauuagaaaccauuuucauuugucagcgggugguggaggucuuguauucauuuuuccaaaaaauguuucuugagagcuggucauugugcacuucaggguuugaggcccagugcugugucucaaucugaggagacaagugcacacacaguaccacugcaagguguuagggagugcaggaggaggaggaguagggggaggaggaggaguugacaguggcuggggaaagcuucagggaggagggggaggaggugaaggugacuuugccaggugggaaagagggugagaggcuuucuagagaaaaggagcguaagaagcagaggcugggaggcaugaaaacacaaguuguguuugggguguuguuacuagaacggacggugcuuggcauuuggguacaguggcagggagaagagagccagauugcaaaggccuugcaugccaggcuaagaaguguggacuugauccuguaagcaagugauagcugucaaagguuuuucagcagggagaugauguaaucagaucuguguguuggagaaaagcuuuggcagcggugguguggaggagagacuggcguggggacagaugggcugcagagcucucuguuaggaggcuuuugaaguaggucaggugagagaugauguuugaggccugaguuagugggaggaagagaacuaaugccaguugaauaccuuugagugugcacuuaaggugaaggugcauuagcucauguaaucuucacagaaaaacuuuucauagggugcuguugucauccucauuuugcagaaaaggaagcaagcucaaaguaaccuaguucagccaggauugaacuuggguuuacuguccugugccaccaugguuuuuagaacaagaugucaaagaacaaaauuucaacaaaugaagcuuuaaagaucuaauuguuguuuuuuagggguccaugaacuaggcagcacccagacuacaaaauaggcaggcgcucugcagggcauggcugaacagcggguuuuguaaggcagcuugagcaggagcacagagauugcauagugccaaagguggacugguuaaccucagauuauuacuucagguuacuuuccuuguguggguuaaagcagaggggauuuccuuauuuuugccagcucugguugacugggcccaccuuuuuuuucccuuuucuuccaagacagagucucgcuuuguugcccaggcuggagugcaguggcgugaucucgguucacuacagccuccaccucccggguucaagcaauucuccugccucagccucccaaguagcugggauuacaggcaugugccaccacgcccagcuaauuuuuguauuuuuaguagagacuggguuucaccacguggccaggcuggucugaaacuccugaccuugcgaucugccugccuuggccucucaaagugcugcgauuauaagcaugagcgaccgcacccagcugacugggcccccuuugauugguugucgugaaucuugugcuuuuugaaaacuggccuguuuggagauuugacuaucauuucucuccuguuugcuuggaggguccgaucuuacaaguaaacagcuuagguuuugguuuggugacguggaacuuuugcaugaaugacuccauuuggguuggucuguuggauccuagugcaagagcucaguccaaaucaguggcucccuaucaauuucacuuaacaagacggaaugagaacaugaagaaggagugcacaugguguaugauuuuuggacugggaugaaaaggaauacuuagcagcuuacugaagguagagaguuuccagguguggcaacaagguauggaugaugaacaauacuauaacagcacucucucaggaggggaggggcagaguuugggggccaucugggauacccaguuggaaaugcccagucggugguuggaaauuuggcauuccuguggaaacucuuuuaagcuaaugauauaccuccagguaggcauggacuuagaauuuguaggagggcaugguuaaugccuaagcaucaucuggggcacuuaauuuggaaugcagauuuccaggcccugcccccaggaggugcuucaguaggccugugguggguuuuggggaucugcacucaugucaagcuccuggguugagagugagacagguucucacauuugagaaauguuuggcuuucccaauggccuaggcugucuuguaauuucacuuccuucagggagcuuuugauaacuccucaaagaauaggauguugaucucugguaaaaagcaacaucugagaaaauugcuuguuuuuaggaaccuguguacauucauacuuaauucugccaaugaugcuuuuuaguuuuuuggauuaacacucaaaaguaacaaguccucaaaauuagguuuguucuguuguuuuaaguggaccuuuggcaagagauuucuagugaagcuugauucugaguacuuuucucauguauuaaaaagaggcuggaggagggaaccugggacguggagagugaggagugauagccugagguucuugguuugccaaccuggggaaacccugucucuacuuaaaaaaaaaaaaaaauacaaaaauuggucaggcgucauugugggugccugugauacuaguuacucaggaggcugaggcaggagaaucgcuugaacccaagagucggaggcugcagugagccgagauugcgccacugcacuccagccugggugacagagcaagacucaucuccaaaaaaaaaaaaaaaaaaagagucacugaaggcuggguaugguggcucaugccugugaucccagcaguuugggaggcugagguggguggaucacuugagcuuaggaguucaagaccagccugggcaacauggcaaaaccccaucucuacaaaaaauacaaaaauuagccggcugugguggugcacaccuguaguuccagcuacuuggguggcugggggguaggaggaucgcuugagcccagaaggucaaggcuacagugagcuaugaucacgccacugcacuccagccuguacaacagagcgagacccugucucaaaaaaaguacucaauuccuugaaaucuggguuguaaaccugaucacucauucauuagaccauuugcuuauaauuaguccuaaccagccuagguuccccuuccccucugucaugcaugucuuuuucucaggaguagaagcuuugaagccagacagacugggauaaggucccaguuuagucccuuugccccacuaugacccuggacagguuacacagccucccugagcuguuuucugugaauuuggaaugugggaagguaguuuugggaauggaguggauaaagucagaacaccuggacuugagcuaguaccacucugaaucuugggcgggaaggugaaggcugggcaccugccugguucauucagcacacauuaagugccuacuuauucagcuagagaguguauuuaggguugaccgugugcauugcuuuacauuaccuaccuuacucuaauuuuccuccacaguuggaggggauuuuugugugguugugguugaugguuaucaagaaaaaguggccgggcgugguggcucacaaguguaaucccagcacuuugggaggcuguggugggcagaucaccugaggucaggaguucaagaccagccuggccaacauggugaaacccccgucucuauuaaaaaguacaaaaauuagccggucgugguggugggcgccuguaaucccagcuacucaggaggcugaggccgagagacuugcuugaaccccgggagguggagguugcagugagcugagaucgggccacuguacuccagccugggugacaggcaagacccugucccaaaaaaaaaaaaaaaaaagaaaaaguguuuucguuuuguuuucagcuugugugucuuuuuuguugguaucuuguuacccuugggauaauuuuuacuuucucucccgggagcaagauuuggguucauuaacugcuugcugcugauuaguucauuuuuccgaugugugggagagaggagcaucuuccuuuauuuuccccuccaccuuugcuaaaugccguuacuacuuccuguugcaaugacagggcuucccagcucccagcuucuuuuccuuaguccccaucguguuggggaggacacaggagaaaguuggcuugcucacugguugguuuacucagucacuuaacaggagccaauugagcccccacucuaugccaggcucugugcuaagugcuagucuaauucagcccucuugaaggccuuaagagagagcaggcauucuuucuuccuaccucaugggguuuuugcaggugaggcucuguaccuaccuccaggucucauggcaggucgacuggaccccugccaccuccugcggugcugcccuccucacccacuccuugcccacucucacuaucggcuuccuaauaggcauuuccuggggcgacuguaucugacuaaaauuggucauuuuguagauccuuuagggguccugguccaaaggucaguuuuaaugagugauauggggacuguggaguugcaggguggggagagaaauguggaccauaacugacaguguucacagggagagcacacugggggaaauaagccucacuauugcagcugcugagacugcacgucuaguucauuuugaauggccccucaaagauacccccugaggaugcuaaaugcagauuuguggaugcuguuggcagaauuugcuuguuuauaauacuuuuuuggggggugcugggcaaggucgcucaugccuauaauuucaguacuuugggaucucaccuggcuccaccaugauuugggaacaggcauuuaaguuuagcaauucaggccaggcacaguggcucacgccugcagucccagcacugugggaggcugaggugggaggauugcuugagcucaggaguuugagagcagccuggcaacguagugagaccucaucucuacuaaaaguuaaaaaaaaaaaucagcugaacgugguggcucaugccuauagucccagccacuuggaaggcugaggugggagaaucacuugagccugcaagaucgaggcugcacugagcuaugauugugccacugcauuccagcuuaggcaacagagcaagacucagucucaaaaaaaaaaaaaaaaaaagaaucuuuuuuguuuucggccaguuugguucuacauuuuagauugcuuuugacugacuuuuugggagacugucgugcccuuagaguauccauaauaauuaugaagaugucaagucccuuaggacugcauguuugacuuagcuuucagcaucaaaacaugcaucagaauagcauaauggaaagaucagugauucuggaguaaaguagacuugguuucaaauuccagcccuccucuaaugcccuuggauaaauuucuucacggccuuaguuucuucaucuguaaaauggggauuuuuuuuuuuuuuggagacggauucucgcacugucacaggggcuggugugcagugauacaaucucgguucacugcaaccuccaccucccggguucaagcgauucuccugccucagccuccugaguagcugggguuacaggccccugccaccacgccuggcuaauuuuuuguauuuuuaguagagaugggguuucacuauguuggccaggcuggucuugcacuccugaccucgugaucugcccgccugaccucgugaucugcccgccucagccucccaaagugcugggauuacaggcgugagccacagcacccggccaaaauggggaucauuuuacaaggugagaaauaauguuuguacaguacuuuuagaguagcuccuagcacauaauagauguucagaaguucccuucuuguuugauucagcaggaacuaaauuguaucaaacuguaggcaguuugaugaauaagaugugguuucuauccuggaggaacuuaaaaucuaaugggcuaggcugacacaugaauucauccugaggagguuaagugccaagacccagguugaggcuggagcagagcacaggagcauuuccucugccuggaggguugggagagccuucugggaggagguuaugccuaagcccugucuugagggauugaguaagaauucacuuaagcaagcaaggugggauggguuguagccaaagcaacagcaugagcaauggauggaguauuuaggaggacuacaugcaguuggggguuggcuggauggaacagugugaaguaggaauuccuaggaaaugagccuagagagccuggugagugugaacuugcuggugggccuuguguaccuugcugaagaauucaggguuaugggcugagugcuguggcucacaccuguaaucccagcucuuugggaggccagggugggcggauugcuugagcucaggaguuugagaacagccugggcaacauggcaaacccucgucucuacaaaaaauacaaaaauuauaugggcaugguggcgggcggcuccagucccagcuagugaggaggcugaggugggaggauugcuugagccugggaggauugcuugagccagcgagguggagguuguggugagcugagauugcgccacugcacuccaaccugggugacagagccagauccugugucaaaaaaaaaaaaaaaaaaaaaaaaguagaaaaaacagcagggcuagagaucagagguaguuuagggauuaaaauacacuguuacugauuaauaauacuuacauguaaauuuccuguuuugauaggaagauguagaauuugcuaggaaagaaaauaaaaauacaaggaaaaauaauauauaaauaguguuaauaacauacucaugcauuuuuacagugcacggucugauuaaguaaauuuugguacauccauacgauagaguggaaugcagauguuaaaagaaugagguagguuuaugugugcucuuaaggaaaauuuuccaagaauauuauuuaacaaaaaauauauaugcauagaguaucuuuagaaguauauauaagaggcuggggaggguggcucacgucuguaaucccagcacuuugggaggccgagguggguggaucacgaggucaggagauugagaccauccuggcuaacaugaugaaaccccaucucuacuaaaaauacaaaaaaauuagccaggcgugguggcgggggccuguaguccugggaggcugaggcgggagaauggcgugaaccugggaggcggagcuugcagugagcugauaucgcaccacugcacuccagccugggcgacagagugagacucugucucaaaaaagaaagaaagaaagaaaauauuguaaagaaaugacuaacacuauacauuuucaggugagcuggaaaccaaguggcagaacauaaaaauaaccugugcuacuacagugucauaguauuaugcauaaugcuagauuauuucaugcucugacaauaacagcauucauucauggggguuuuuagaguuuucaccuuucacauacauuauuucagucaaaauuaaucacucuuccaucugugcucucacaucaauuaaaauauuuuaagaauuauaaauguuaagugauguuauguaaaguuuggaaagcgagagaaaagaguaauacacguuuaggcugggugugguggcucaugucuguaaucccagcacuuugggaggcugagacaggcagaucgcuugaacccaggaguuugagaccagccugggcaacacaggugagaccucaucucuagaaaaaauacaaaaauuagaugggcaugguggugugcaccugcaaucucaucuacuccggaggcugagguggguggaucgcuugagcccagggagguagaggcugcagugagcugugaucacaccacugcacuccauccugggcuacagacugauacccugucucaaaaaaaaaaaaaagaaaguguuuaagugcagcagccaugauuuuauucucuuccuuccuucccuucuguucuuugccuaugccuuaaaaauguauagcuguagcuaagguauacauguacuuauaggcuuuucuguguaauauauuucuuuuuuugagacggagucuugcccugucgcccaggcuggaguguaguggcgcgaucuuggcucacuacaaguucugccuccaggguucaugccauucuccugccucagccuccugaguagcugggacuacaggcgcccaccaccaugcccagcuaauuuuuuuuuuuuuuuuuuuuuuuuguauuuuuaguagagacaggguuucaccguguuagccaggauggucucgaucuccugaccucgugauccacccgccucggcuucccaaagugcugggauuacaggcaugagccaccgcucccggacuguguaauauauuucaugcauuuccccagguguugugugguucuccuccuuggcuuuuuaaauagcugcuguuuuguggaacauugugauuacuucacugugcuucacuugcaccuuuacucguguguucuccaucacagccgcguuaguuuacugccuucaugcucaucucuuccuagacucuuggggcugguaugaccucuuugucauuagaaucagggcagagagaaaauauuuagcaaguaugucugaaggaauagauguuccuucugggcuuuauaacagcguuuuaagguguagguaaauaugagcaguuuucagccaaggaaaggagucagauuaaacggucacacagcagcuauguggaagugggugaacucaaacuuugguucaguucuccuaaccccagcaaagcacuuggcaguguuuuguuuuguuuuuuguucuguuuuguuuguuuuggaggugggaucucguucugucaggcaggagugcaauggcacgaucagcuuacuugagccuccuaggcucaagcgauccuuccaccucagccuccugaguugcugagauuauagaugcaugccagcacaccuggcuaauuuuuguauuuuuuguagagacaggguuucaccauguugcccaggcugguuuugaacuugugugcucaagugaucuggcaugaaauaccgugcccgccuuuauuuuuuauuuuuuuuaaggcuagucaagugaagcagugggaaugggaaauccucuguucuuaagaaauaaaacaugggggucggcuuucucucccuugaacuuucaacucuuaaauuuuuuuguuaaauuuuuuaaaaguuaauuucuaaagccaucuucugguuugucucaagagaagacauuaccuuuuguccugaauucucuccccugaacuuucucuucuucgaacuuucaacccuuaaauuuucuuguuaaauuuuuaaaaaguuaauuucuaaagucaucuccugguuugucugaagagaagacauuaccuuuuguccugaauugccuuuauuccauaacaaauagcauuugaaugccuucuguaugaauguauguucugagguuuggccaauaucuacaguguucauuugacacuaucacucuggucauuuaaagaguacuuaaaaauuuaaaucauuuuaauaugaaaaaccuuucucauuguuuggaccaugcacuagugcccuaguaucucuagugcacuacacauaucugauuuucacuuuccagggggggauuucuaucucaggguaauggagauuauaacuaucaacggauccuaaucuuuuuuauuuccugguuucugaaucauagaauuguuuugcaauuaaccauagaagcaagaaucucuuuuuggggugagagguggugcguaggagcagagaagggauauauaggaauagagugaucuauuuuauuuuacuauuuuuucuuuauauuuuuuagagacaaggucuugcacuguugcccaggcuguagugcaguggugcauagcucacugcagccuccaacuccuggggucaagcaauuuuccagccucugccuccugaguagcuaggacuacaggcaagugcuaccaaacccugcuaaucuuuuauuuauuuuuuguagauaugggaugucuacuugccuaggcuggucuacagugcuuaggcucaagccauccuuccucccuuggcuuccccaagugcugggauuacagaugugagccaccgcaccugccuagggugauauauuuuaagaguacaaaguagauuaguugucauugagaaugaaaagaaucaaaucuagauguucgugucucaauuugagaucuucauguugcaaaagguuauuuuugauuuguaacuuuuuaaaacuuuguaaucaaguugauuuauuugugguuauuguaauacuauuuugccaagucauaaaugguuaacuuuacugcauucagauuugagaauaugcuuuagguuuuaaaguugcaaucuugacaucauguaugaauuaucucacaaaauaacuacuguuuggagaaagaacugaucugauuucuucuuuuuaaaccagugauacuaaagguguauuuaagccuguuuugaguuuguugaaacaucacuccaaaguggaaacauggaaggcuucgagcuggacagagcugaguauaaauuuaaauuuuugccauuuccagacuagccauuuauggggcugaucuuugccuuguuuguuuugaggguuaaaggagauaauggguguaagauaccuaugccuugucuaguuaaguguucagcaaauacuaauucucccccaccuguuacagugagcuggggauucccuguguuugcauaagguuguccuguagcucuuucuguauuuacauaugugaucuagucuugaagguggcuggcugggggggcgcucaguuuuguguauugaaaauugcuagaaacugagaguugguuauuauauugccauugaacuuccuguguaauggaugguuaccauguguuuguguuauucucugguaaaaggcacuuuuuauaccaguggaguguaaauuccaaugugaaaacguuaaucuuugaaaacccugagcuaggcuccuguuaacagccacuugagguuaucuggugcuagaggcuaaccagaucccauuaggcaauccuuucccucccuguagcacauuacccgagggcgggacucuuggaaacuucaaacugaggcuccccauggcugucauugcuuaagaucuccccuggguuuuuacagaaugggauaaugagaaaccuuccagacagaggggcagucuuauaccugucuccauucauuuugccucccuuccuccucccugccucuauuuaaaucuuuccuguucuuuaaacccuacauuucucaggaugcuuccccagacagcucucaauuccacccuucugucuguauuaaacauauuagcacugacacccacugccuuaccuacugccuuggccuuuuugaugcucaucucggauuacagccgacccgagggcauccaccagccagccugccgugcccugugcaucucuggccuggcucagccgugggugcacucugccugguccacagaaacugauucuguuucuucuuugucagauccaacacucugucuuggaagaauucucuguaagguuuuccacacagcagucuucugucuguuacuuuuagaaagaaaugaaaaaaguaauuuaaaaauaacuugauggcuggacauggugacccacaccuaaaaucccagcacuuugggaggccaaggugggaggacuguuugagcccaggaguucgagaccagccugggcaacauaguaagaccccccaagucugcaaaaaauacuaaaauuauuugauagcugggugugguggcaugugccuguagucccagccacucgugaggcugagguggaaggaucacuugagccuaggagguugaggcugcagugagccgagaucucaccacuguacuucagccugggugacagugacagccugucucaaaacaaaaacaaaacuugguauaugccuuccuuaacuguuuuucuuuucacagacauauguuaaauaaaugccauacuuuuugcuguauaacuugauauuuuuguacacacgcaguguguauuauaucaauaugcauucuucuagaaaugauuucuagugauugcauguaauucauuuuccagccuguagguguaacauaauuuuuucaacuauuuacuuauuacugaauuuuaaauaacacugcagugaacauuauucuaguuuuauugaaugacuuccagcaauuaacuguguugaauuacuaaacauaguaguuucuuucaauaaauuuguggaauauguucaucuuauuaguaucugaguaauuuacuucgugguccagaacugagcuaggugucagggauacacguagacauaaguauuguaguacuaaggauaaaacaaugcguauaccaauaggaagggaugucagcuacuuaaguaaauagacuuuaauuauuuagauaaaauagacaugaaagaacuuuaguguaugcaaauuuauaaaacaucaaccagcagcuguucauaccucuccaugugugggguguugggaguggggcacugagaugcagacuguggcaaaaaaaaaaaaaaaaucuaccugcuuuacagacugugggaaaagaaucuaccugcuuuacaguugcaugacauggucacuuaagagaguggggacagaaagacauggaccuggguagcuuuggaaaaugguguuuugacuauaaucuauaaaaacuacaaaaagaacugcauaaacgcuguacucuaguggguaaaguuucucaugggacacagguugacaguuccaacgcugcuuuauauauguacaaggguuaaacaaauagugaaggggugguggauggagagagccaaguuucccacagcuggagaggaaagucaaagguaugcaaggaaggaaagcuagaacgaaccuugugggacuguauuaaagucagaaaccucaaugugaacuuagguuuagcuugacauagauacagaaauaauuauauuuuaguguguauucauggauuaggacacacauguauuuccuagaucuguucacugaaagagcuuagaaacaauaacaccccaguaucuugguuccuaaauuccauucucuaaucacaguaaccaggacuccuugaagaaauggauaauuauaggucuggggcaucuugcauugucagaaaauaaggaagugcucacgaaacaaaggaugugggcaugucugaaggccauaccagccaaccucaaagagcuccuaauagccaaagcuggaauaauuugagcaacaaaauaaauaauaugauguacugcauuauaguccaagauauaaaauaaauauaccugcacauaacuguauacugggagaagagacaucuuccuuauagaagaauuucgaguaauguuugcagauaccuccccguucacuagcuaggccuuagcccucccuacaccuugaguguggacugaauuuagugacucacuucuaagagacagaguauggaaagguggggaaaaaguaaauuuacaguggagaaaccugccagcacuaccuugaccaaguaaucaaaguuuaacacaaccagcaguaaaccauguucaaacaugaagaaaaguuucacuuugggagaauugcuugaggccaggaguuugagaccaaccugugcaacguagcaagaccccaugucuacgaaaaauaaaauuuaaaacuuagcugggugugguggugugcgccuguaguuccagcuacuugggaggcugaggugggcacaucgagguuccagugagucaugauugugccacugcacuccagccugggggacagagugagacccugucucaaaaaaaaaaagaaaaaaguuaaaagaaauguacagugaauacugacauaccccccaccuagauucuauaauuaagaucaugcaaucugggcuuuauuacauaucuacccaucacaccaucuuauuucaaaaaguauuucaaaguaaauugcaaacaucaguacaugcgauccccagccccuacccccaacaaaaauuuguuuaaaauguaauuucuacauucucugccaagguuguugugcagcaccuaccagccacagcacaguugacgcuaugugauugugcccuguugagccucgaggcgugugggaaauuggagaggauguaggugauguaggcaugcuccgaggugagcacagaugugugugauugggugacccacuggacugacguggaucuguacuugugggugcuggggcaucaugggaucugugaagauccagaaaauagcagcuguuuccuggcacaagggcggcuuuaaggauggcgagaagggauggugagucagcucugggacagaacugagcuacuaaaguuguaauaauguagagugccugagcauuuauuuggggagagccaaaggccugccucaccaugccauuccccccuccccucugaucucuugggaaaauaaauagagcgggaagagaggguuuagcucaggaagggguaggaacacugaucagcucaucaaucaggagagugcaauuaugcagaaaggacagaaaucacucccugaaggccacagacuuggggauuugcccagaagaagaccuuacagcugcuaacaguagcccuauucaguuggggugcauaaugauuuuaaaacuaaucaggaaccaaagccugaggcuggggacaagcacaaauaucuuguugacagagcaaacaucuagauuuugucagauaggaaguuucugaggaggucagagugauguaauggugugcacaaagcuuucauccuuaaacagaugggcccccgagguaccaucugcagcucccuggggcccuucaaaaugacuuccuauaaauuaaauaguccuaaauugguaucgagaaauuagugugguagccauauaccagaagcaaaacuagacaaaggaaggaaauuuccauggaguuacccauuuccuuuucuucccuugcuuuauaaauagcaagggagguuuauuauuuugaucaacuuucuugguuaacaugugaauauuauugccucccucaaauagccauccaagguaaacuucccuuucuccucuuaagcugggacaacugcauugaucccuaccuaagccagugucagcuggauauuuuucauaaacugccuugcuauuuugggcguucuguuuuuguugaggaggaaguagugguuuuguuucugguuuuuuucuuucaucaaagggauauuuguucuggaagggcaagggaaggggaugcuucacagucuagaucgagggagaaaauguccgacaucauauguaaguggcugaugaugagucaauuggugaaacauuucagaacagaaaguagguccacuguacucauccuuuuauuuauucaacacuuacuggcacuuugauucgcaauggacaauauagccucuguucucagggagacagacaaucaaaaauuagcgaaguaaaguuuacauagguaugaguggaguauuagagaagcuggggcaggggguucaaggaggagguaauuuuccuuucuugagauggaaucucacuguguugcccaggcuggucucuaacuccugggcucaagcgauccucccucagccucugaaaucacuaggauuacaggcaagggccuccaugcccagcaggaggugauucuugagcugcguuucaagggaguagccaggugaggugggaguuggguugggguaggggggaccacccuagccaaggaugaaaggugaaccgggugguguguguggguaaguggauggagcgugggguguggaagggagcugugaagaagguuggcuuggaacaggagugaagaggaaaagccgaggcaggugcauguggguaaguggguaggcgaggcaccagggcgggaagcugggguguuagcacgucaagccugcuggcuucuguuaccugaguaaaaugggaagaaagggcauuugcuagaguaggagggaggagaaugacaaaaguuugaaacagugguugcggggagugggaggagggccuuuuagaauauucagggucuuuuggaucagagaauucaagugcaguggcgucuuucugcacagugaugugauuucuguggucuuucgggcccaggguauaggugaggacaagcugaguuguguuauuaguucccuuggguuuggcuaaagaggaggguugcagaaaauugagggugcggcaagggggugauuggugguggaguccacacugugggaaugaagaaggggacauacucaagggacauccgagagcaaggaccucaggagggagggggugugcgagccggaaggauaggaggcuguggucaugaagcaagaguauggaaauacggcuucugacugaggugugacccuggaaauggcuggccagagucaagagccagggaucagagcuuaagugcaggcguaaugagaacaucugccaucacugacccugcgcuggacacugcccuaagugcuuuggacuauucauucaacccagccccacaaauagguacucuuauuuauugccauuuacaggugaggcagcugaggcccagagaggugaaguaauugcucagggucauggaguuaauaaaugguggagcggagcuucuaacccagguugucuccucugcucuuguuccuuuaggagcugacugcugggcaggaacgucucucaggagaaagaguggaagagaaaauugugaacuaaggcccccugcccccuuuuccuggugcaugugaaguuaucaaaaacagguaggugauggcugaggauugggguagagugugguaugacugugaguagugacucaaagagggaugaaucuuuacaugagguuagaagagagauggccuguagaacguccagucuuuccaccugcccagagccacuggugagccagcgccuccaggggagagaagcccugucaaaagcagagauaggggaguuaguguuuaaugaguacagaguuucaguuggggaagacaaaaaacuuguauagguggauggugcugaugguugcagaaggacgugcuuagugcuacugaacuauauacuuaaaaaugguuaaaacgguaaauuuuaugucuauuuuaucacaaugaaaaauaaaaacgugguggagggagggaguaauaaucacuaccauuuaugaaacccuuuccugguucauugucacuuauuaaauauuugaaugugugcuggggauuuuguuaagugcuuuauguguauuuucauuuaauccucacuuucagagaugagguaaacucugcuguacagaugaggaaucucagguuuaaccagauuaggcaacuugcccaaggucauacauccagaaaugguaggggcugggcucaaccagauccucacacuccaaagcccuugcuuguaauuguuagggaauugaacaguggacagaagguuccagaggcugugggggaagggagaggggguuguugauggagggaggaccugggauagggaaaugcugggugaaaagaggaggguuggggauagaggagcagcuagaccaaaggaaugagaagucggauggacaggaccauccuccaguguccagacugggcaugugcugucauggaacuggcaaaaaguccaagugacaccaacuuguucucagaaaggggcuggagguuauggagaagugggagagcccagcguggggugugccagugugauccaaagaaagucuugucagcagaggauucuucccagacugggaccugcggccggaggggcuggcgguauggacaguguggacaugaguucagccugggugccucuucucaucuuccuccugaaugcccuuucuuccugcuggccugcccgaggggacccaggcugcccauugagccugaagucagcaagcugaucgugaauuuaggugcaugaacguagggaggggguggcagugaggaggacugaauaucuuucuaaugcugacagaccaaaugccaagggugaggguaaaucaugaccaauuaccuggcuuuguagaugaucagcaaacugcaaauauuuugccacagauuuucuuuguuuuuagcagaaugguaugaaaugcauacaugaggaaauaaauuuuaucugacuccuucacagagauuuugagguuguaaccuguaacuucuaaggcguggccagugguauuugugauccucugggugcagauguggguuugucucagauauuuggguuuagugaggcguuugugagcugcugaggagggaaaugcccucucgagaguuucuguuaccuucauguguuuacuuuagauucagcaggauucuuuuacugucuugcuggugguucuacaaucugugcuaaaagcaggcugccugagcagugcuuucuguguaauagaggugaccauggagagcgugguucugugauuauauaauaauuuugaauaaauaaaaagaugucucauggcagguccuauaagggcagccuggaagugacaucaugagggauuaaguugcacugcagcugaaucuugcagcuaucagacaugcagcaguaugucagcuguaaccuccagguguaaauagaccuucaucagcaucgcuggaaagugcuaggaggauccagagugcugcgggaugcuauccaucaaaagucguuugcagaacuuuguuccuggcugugauagguuuuuaaccccuguagcugacuggaucuguggagcuuuucauaguuuauuucaaggaaagguagcggguauaugugcucacuggugccaaauucagauugauuguuuuacuguccccuuuucugccccuuuucaccagcuaagaaacaggagcuagguagaauuugccuuaaaaucaaaacaggacuaagguaauguuaagagagguagcgaaguagcccuuuguuuugggaaauaguaauggcuaaccuuaugacuaguuaccuucugugcuuucuuggaauuaccuaacaggaugcuuaggaacaggauugugucuuuuauucacugccauaucccucagccagaaacagugccuggcuuuuacuaggcacucuaauaaaggaacuucaugcagauuaggauucuaaagcacagagagguuaaauugccugcccgaggcuacacaguuaauggguuggauuccuuaacaacugguagaggcauaaaguggaagucacagaaaauaauguuuucccuucagaagcucuucauuaacaauauuuggguuggaguucagaugugcgcucccgggauaggcugccucggagagggagaggcggggucagcuguaucacguuggaucugcuccagcugccgcugccgcagucgucgucuuucucugucucggcugaggcagccaucuugcucuugccgcgugcugguguuggaggacccucccugcuucagauuuaccaacagcaugaaucaagaaaaguuagccaaacuucaggcucagguccagauagggggcaaggauacagcucgcagaaagaagaaggugguacauagaacagccacagcugaugacaaaaagcuucagaguucucuaaaaaaaacuggcugugaauaauauagcugguauugaagaggugaacaugauuaaagaugaugggacaguuauucauuucaacaaucccaaaguccaagcuucccuuucugcuaauaccuuugcaauuacuggucaugcagaagccaaaccaaucacagaaaugcuuccuggaauauuaagucagcuuggugcugacaguuuaacaagccuuaggaaguuagcugaacaguucccacggcaagucuuggacaguaaagcaccaaaaccagaagacauugaugaggaagaugaugauguuccagaucuuguagaaaauuuugaugaggcaucaaagaaugaagcuaacuaaaaguuugguuuuuggaagcuggcauggacuagauugaacaaaucagcuaugugguuccaaaguuuuacagacacagagaacaucaccuguuacuaguucaguaauauaaauauuuucuauauuaauaaugcuguuuguucagcauuuuucagucauuugauuuugcauuuugcacuuccucccaggauuuuuuuuuggucaaaauaugaaguauuggugcaguuugaggguguuuugguuuuuaauuccugguuuuuuuguuuuuuguuugggguauuuuugguguauguauguuuauguauguguguggguauguguguauauaguggagagcaaauuggaaaacaguucuauuuauccuccucccuccccaguagaaauaaaaaaaacuuuacaaaacaaacaaacaaacaaaaaaaaccaauauuugccgagaccagcucaguuguggagacccuaacccaggggugcuagaggaauuaaagacagacagacagacacacacacaaauauaggguguggagugggaaaucaggggucucacagccuucagagcugagagcccugaacagugauuuacccacauauuuauugacagcaagccagucauaagcauuguuucuauagauuauagauuaacuaaaugcauuucuuacgagaaauaaagcgaugggccgaaacaaagggaugggucuggcuaguuaucugcagcaggaacauguccuuaaggcgcagaucacucaugcuauuguuugugguucaggaacagcuuuaagugguuuucugcccugggugggccaguuguuccuugcccucauuccgauaaacccacaaccuucagcaugggugucauggccaucacacacguuacagugcugcagagauuuuguuuauggucaguuuuggggccaguuuauggucagauuugggggccuguucccaacaauauugaccaugguuuuagaggaggcuugaauaaaacuaaaggccaggugugguggcuuaugccuauaauccgcgcacuuugggaggcugaggcagguggauugcuugaccucuggaguuugagaccagccugggcaacauggcgaaaccccaucucuacaaaaaauacaaaaauuagcuggacaugguggcuugcgccuauagugcaagcuacugaggcugaggugggaggaucaccugagcccaggaggcggagauugcagugagcugagaucacaccacugcacuccaaccugggugaaagaguaagaccuugucucaaaaaaaaguaaaauuucuguaucuauuaaugcuaguuuuuauaauucauuuuauuaaaaauaaauauaauuuuaugauauaauuuuauaauuuuguuaugaggauuaaaugagaaagaacuuagaacaguguacagcacuuagaaccauguaagugcuauacauguuugaaaauuugccuggucuauucugagaccacuacaaaaacaaaauugaaaaagaaaaaaaaagaaaauuguccuugaaugucauuuauuuuuuaggauauuugauggcuuacuugguuuuaauuuuuaaguaaaggccaaaaaauuuuuuuuuaaacuauggagaugucuuuaagacuagaccugaauaagaaaauguaauucaagauacaacaggaaggccaaaugaggucugauuuuuaguaauuagaauguuauggccgggcgcagugacuuacaccuguaaucccaacaccuugggaggccgaggcccauggauugcuugaguccaggaguucgagacuggcccuggcuaacaugguaaaacccccgucucuacugaaaauacaaaaauuagccaggagugguggugcacaccuguagucccagcuacuccggaggcugaggcagaagaucgcuugaaacugggaggcggagguugcagugagccaagauggugcugcugcacuccagccugggugacagagugagacuuagucucaaaaaaaaaaaaaaaaaaaagaaugucacauuacaaucugaacacuacauuaauacaaaauauuuuauaaaccaaacaacuagaauacaaacuuuuaguaggaauuauccacacaggaccaagaaaaguauauuaggagaaaguguuauuguuugguacaguagucuuuaaacauuuuucacuuuacaauccuuuaaguaaaauacuuuuugcucauaccugcaacauuuguaaauuuauaauuacacauuguuuacuaaagcuauuuccauuauaaaauauagaaaaacaaauaaugagacaaguaaacacgacuacaaauuucaguauuuucuuucuauaccccuagagaucaucuuuuacucucuuuuaagacaucugguuuagaaaggguaaucuagaagaggagacccacagcauuuuuugaaggagaguuuauuauuucuuuggaguuauauguagaugagauauugacagaaaguuauauuguuagacagauugaauauaggauguuuggagaguaaaccgaaaagcuaucccuggccaucugucuaaaaauauuggugagguaucacaaacuccuaaggauuaaagugucccauuagaauuucuaaaucauuuccucauaacugacaauaauaaugcugugcacucuggaauaggggaaaaauauaguucuuacacagguaugcaaaauugcuuuuaaauuugaaagguauuucaacaacagucaugcaccauauaagguuuaggugaaugacagaccacauauacaaugguggucccauaaguuuauauuggagcugcccuauacagguguacuguuuuuuaucuuuaauacuguuuuuuuuuuuuuuuuuuuuuuuuugagacagaguuuugcucuuguugcccaggcuacauugcaauggugcgaucuuggcucaccgcaaccaccgccucccugguucaagcgauucuucugccucagccucccuaguagcugggauuacaggcuugcgccaccacaaccaacuaauuuuguaucuuuaauagagacaggguuuuuccauguuggucaggcuggucuugaacuccugaccucaggugauccgcccuccuuggccucccaaagugcugggauugcaggcaugagccaccgcaccuggccauaugcuguguuuuuacuguccccuuucuauguuuagauguauaaguacuuacuauuguuuuacaguugccuacaguauucacuacaguagcaugcuguaugguuuuguauccuaggagcaauagucucuaccacagagccuagguauauaguaggcugucccaucuagauuuguguaaguacacucugugauguucauacggcaaaaucuccugacacauuucucagaacguauccucguugauaagugaugcguaacuguauuccugaacggaaugguaaggaggccagguuaaucuuucagaagugaagaaguggagaggagaugaaaucccuggacuuaauauggacaagagcugugggauagauagcugaguagugaggaggugacuuggcucaagggcccccaaacagaccaggguggagguggccgaaaacugugacagggcaggugcagagccuaaaguggggcgcucacccuuauuguggaauauuugcugguacauuaaucuuaguuucuucacaaauuaacauuuucuaagauugucaauccuuuacguguuucuggaccuaaaauaucacuugaagagagauuaucaaguuaaacuggaucaauugaaaaauuugccccuguggaucaaaaucaaauuuuuugagugguuuuauuuuugagaaaauuuuuauuucaagagaaaguagcaacuauuguuacuggaauuucagcuuaugcugugauuaauaucuguuauacaauugcuguugcaaacuaugcaagcauuacuuugaacugcaucugauacagcuugguaguccaggucauuacuugcaaauugaugaguccuguagccauaaaaucaaguaucacagcugugcccuauugagggaaauaugggcuuuugguguaagccaucaacaagcuguugauuauuuggaaauuguuggugacaguucugcccaaacuuugcugccuacuuugcaggcauagguuugcugcuauucaugggcugcauaaaauaacauucagccuuuccuugguuuccagcaugcucagguuaaccauaaugauucaacguucacuucguguuggcuuuugguuugcauacccaaaacgucgaaucuuacuggaaaaacaaauguaaagcaaagugcgagaccaugagaggauuuuuucuugauaugcuagacucauaguugucugaauguaugugguaugauugauuuggaaauaaugcuuucaauucucuuuuacugcauauaucaaauaauuucauguuuaauaugauguucuggcuuuugguuuuaguaugucuuaguacaaaauucagcgauaaauucuuuaauugaauacaucuuagagacaaaguauucgguugaucuauuaaacuacccucugcucaacuggggagaguccuguaguaggacucccagggcagaauucauuggccuugcaacaucaguaaccaccuagaccaacaaaugguaauaaauaugaauuuaaauuuauuugggaugaugguugggguaagcugaucauucuuaguuuccuauugaucuuggggacugggcuuaacuacugaagaaggcagcaauuucagacauuuagaauuaaaacuauccuuucuugaauaacuaagagcagguuggaaaauaaauuauagauugcccaaagcuuuauuuucacuugagaguguuuaaaacuauguacguuaauuagaugugagcccauaaaaaaauaaaaauaauugaaaacaggugaaggugccucaaaaaagcuaaaaacacagcuaccauauggucuaccaaccccacuacugaguauauaucccaaggagaggaaaucaguauguugaagacauaucugcauucccauguuuauugcagcccuguucgcaguagucaagauauggaaucaacuuaaguguccaucagcagaugaauagaauguaauauacaauggaauacuauuuagccauaaaaaagacauucuaucauuugagguaacauggaugagguuggaggacacuaugucaagugaaauaagccaggcacagaaagauaaauaccgcauggucucacucauaugugaaaacuaaaaauguugaucucauggaaguagagaguagaauagugguuacuagaggcugggaaguuuuggaggagggauggagcuagcuagagguugguuaacagauacaaaaucacagcuagauagggggaauaaguccuaguguccuauagcaaucucaggugaugauaauuaacuggaauucauuguauauuuucagauagcuagaagaguggauuuugaauguccccaacacaaagaaaugauaaauguuugagguguuacauguuaauuauccugauuugaucacuauacauuguauacauguaucaacauaucccacuguacccucucaaaaaguuagcaauaauuuacaaauuaaaaaaaaaaaaucuguguaccuaguacuggaaagaagguagaaauugacaacauuucagcaaugauggcauucugugaauuaacaauuaaaauauuuaaguguuauuggaguauuuccagcagaaagauuucacaacaagagagaaaagaucuggaaauaggugggcagauauuaaagaaccagaggaaauagcaaauauggaccacuggugcgugccuuucauuccucaguaacuuccuugaaagaugagcuauguagggagcuagucuggcaguauucagcccuggaguuuucuuaaaugauaguuaugcuaucauucagagaacauuaguaguaagauucuuauccuuaauuuuacauaaaaaagacuuagucacuuucauaacuaauuaguugcauuuguggcuuagaugggggaaaacugagaaaaugauaguuggcaaauacuuagaagugacaggaauaaaauaagaaacugauaaaauaagaaucugggguugcuaggaguccuugagaaaaguagccucacuaaaagagugaaucagggaaaaguugugcugauucuagaugcauuacucauuaggagaaugcaaacuugcccuccucacucuugaaguggaggccgugggugcgucgggggagggccuggcuguggcaggcaugcuggcaaacccuggggucugccucacauuguuuguacaguaaagaaagauuuaauacugacacguggcucuaguuuacagauucuaaucugccaaauccuauuucaaggauguggacggacaggagacuacauucagaacuaugugcuuauagaaaugaaugaaaggcuuuuuuuuuuuuuuuuaaugaaagccuuuaaaauuuuuucucugaaugaccuuagacagaucacucauucacacuggaucuuaauuucuuaucuaaaaaugaaggaaagguuuauuggaauaaucuccuaaagaccauucugcuuuugaaucuguccauuuugguuuuuuucuuucuuuugguuuuuguuuugagacagggucuugcuuugucgcccaagcugggguugaaugaguccguugugaagagcugaggauggaaggugauguuauuuaauacuauccccaugaguguucuggggcuuuacauacaauaguugcuuuaauccugcauuauucauucacucuauaaaucacaccuaugaguuuaggauaucaccauccccauuuuacagaugagagugaguaacagggacaaguucauuuaaguacuacuaguuagugcuugagguggaauacauugaccaauggcuguaauaaugauaucagugagucauuguaagguuuacaugaaaugaaaaaagucauuguuuuggguauuagaauuguucugguuuuucucuuucuuucuguuuucucacagauuacuuggaaguaaaacaacaacaacaacaaaaaaaaaccuuuuuuaaagauaguaagaucucaaaucuacuccucaaagaggaaacacucaguguuuggauucuuuggaucugaugggggcaggcaauaaaugguaggucaguuuucccugucugaauucugaaccaguucugagagacaaggagaaagaaaacauguggaauucaaauuacaccuuaaauuuuuuuuuuuuuuuuuuuuuuugccaagacaaggucucacucuguugcccaagcuggaguacaguagcaggaucauagcucacugcauccucaagguccuggccucaagccaucuucccuccuuagccuccugaguaauugggaccacaggugcacaccaccaugccuggucaaauugcaccuuuuuaagaugauagaacuaauaucagagacuuugacuuacauuuuuaaaaaaaugauuuuuauaugugccaaaaguguacaucccacucccgaauuccacaguagagacagccugcccuccugcuuccuggcaguguugggccaucaaggcuucccauguggggccagaaggcugaccagacuuaaaccugugcuuccagagagcagcucaguccccaagaagaaggaggagggaagggcugggacccauccccagucucuauuccuaaacuuccuggguuaggaaagucacuagagcuucuaggaagggggcuagugacaggccagaagaggagcccagaugguaagcuagaggggugcuguccucauagaaggaaacaggaaccaggcagacccaucccaccccuggaccccaaucauaaaugcucuguguuuccuaaagccagcaucauucagaauaaauuauuuucuuuuacuugagauaccagcuuuucuaaaagugaaauuggauuaaaaacaaacaacaacaaaaaacccuaaccuuguugcugaggccagugcugcugcuguuucuauuuuaguagaagucaaaguaaaauauucuggcauguauuauucacuccgugcucuaagaaagucccuguacaugauugugccgauagcaaugucuuucagaacccaaauucaaacacgugccucuggaaccuuaaaauaccuuggcacucuauuuuuuuuuuuuugagaugguggauagauggaagacuucauguaaacagaaacugccccucucuauuguggcgguugaagucucugccacacaagagacccaguuuuaaaguugugcuuucccucacacaguuuuuuccuaauaggaauggaagauacugagacugaaaauuucugugggcaacugacuugucaauuucugaaguaacauuuuuauuuaacaaggaguaaaacaaauuugcccaacuaaauuauucagaggaauuacaaaacuugucacuuagaguggauguugggauauucaggucauuuaggaggcugugguuaaaaauaaaaugaccuaaauauaaagcucuacuuuuuuuaaaaaagggaauuuugagcuuuuaauuuuuguuugacauuguuccuaauucuguuucuguggggggauguaggaggcuacucuuucgguguuccaaauaaagaaaaauucuucucuucuuguugguaguuuugcaugguauuuauguagcucuauuuuuuagccaggguauauaaauucuguauucuuuuugauauauuagggggauguaugugugugauggagaaauuggagaaggucauaaacaaaugacucucuuccaagaaaaauugaagacaauucauuaauuguucuggucauucuuuuuguacuuuuaagcaaggagcauuugaaauaugaacuugccccaaucugcuuuugggcaauaauuggagcauaaaauguugaaaaucaauuauguauuuagggaggaugaaacaggcugacauauugaaggcauauuguauuauguuuggugcacuaaccaggacaguuacgucauauuccugcagucaaauugugucucgagagggugagacacagaggaucacacauccugauguacucaaacuucacagaacaugagaguauuuauaauaggccugccaucuguccugggaacgaguccuaucuuaaaaauuggcuaugcauuuguuguuauuguugacugauaagcacagaguuugauauuuuuguauuauacaugcuuauaccugauuuauagcagugugauaauuucacaaugcauuaugaguuccccaugcuggcuaggggguaagaucuuugcaggagaggguagacagaguuuuagauuucucccguaaccccaaugugccugacacaguaccgacggucuauauccccaguuguagauuugcaggagauuugcagaauauugucuuguguccuccugauaggagaggcacccgaggacuggguuguguugucugaggucacauaauugguaagcagcuguauuaguugcuaggguggcuauaaccagguaccagaaaguagauggcuugaauaacagaaauguauugucucagaguuauacagaggcuggaagucccagaucaagcuguuggcagagcugguucuuuccuaggcuccgggagggaucuguccugggccucgcuccuugacuuguagagggccaucuucucccuguaucucuucaugccaucuucugucugugccuauguccaaauuucuccuuuuuaaaaagacaccaguuaaauuggauuagggcccacccuaaugacuucauuuuaacuugauuaccucuguauaaagaaucuaucucuaaauaaggucacauucugagguauuggguguuaaaacuuuguauuaguccauuuucacacugcugauaaagacauaccugagacugggcaauuuacaaaagaaagagguuuaauugggcuuacaguuccacauggcuggggaagccucacaaucauggcagaaggcaaggagaagcaagucacgucuuaugugaauggcagagaaugaggaagacacaaaaguggaaaccccuaauaaaaugauaagauucugugagacuuacucaguaccaugagaacaguaugggggaaacugcccccaugauucaguuaucucccacugggucccucccacaacaugugggaauuaugggaguacaauucaagaugagauuuggguggggacacagagccaaaccauaucauuccaccaccagccccuccaaagcucauguccucacauuucaaaccaaucauugccuucccaauagucccccacagucuuaacucauuucagcauuaacucagaaguccauaguccaaagucuuaucugagacaaggcaagucccuuccaccuaugagccuauaaaaucaaaagcaagcuaguuauuucuuagauacaaaggggguacugacauuggguaaauacaaccauuccaaaugggagaaauuggccaaaaccaagaggcuacagggcccaugcaagacugaaauccaaaucuuaaagcuccaaacugaucuccuuugucuccaugucucacauccaggucauacugaugcaagaguuggguuucuguggucuugggcagcuccaccccuauggcuuugcaggguacagccuccuuccuggcugcauucacaggcuggcaugagugucuguggauuuuccacgcgcacagugcaagcuguuaguggaucuacaauucuggggucuggaggaugauggcccucuucucacagcucuacuagguggugcccccuuagggacuuugugugggggcucugaccccacauuuccuuuccacacugcuguagcagagguucuccgugaggggucuaccccuacagcaaacuucugccagggcauccaggcauucccgugcaucuucugaaaucuaggcagagauucucaaaccucaguucuugacuucugugcacuggcaggcuuaacaccauguggaagcugccaaggcuuggggcuuauacccucugaggccacaguccaagcucuacguuggccccuuucauucauggcuggaguggcuuggacacagggcaacaacucccuaggcugcccacagcaugaaaacccuuggcucaaccuacaaaaccacuuuuuccuccuaggccucugggccugugaugggaggggcugccaugaagaccucugauaugcacuggagacauuuuccccauugucuuggggauuaacauuggcucuucauuacuuacgcaaauuucuacagcuggcuuggauuucuccucagaaaauagaauuuucuuuucuauugcauugucagguugcaaauuuucugaacuuagaugcucugcuucccuuauaaaacuggaugccuuuaauagcacccagguaaccuuuugaaugcuuugcugcuuagaaauuuuuucugucagauacccuaaaucaucucuuucaaguucagaguuccacagaucucuagggcaggggcaaaaugcugccagucucuuugcuaaaacauaacaggagucaccuuugcuccaguuccugaugaguucuucaucuccuucugaguccaugccagccuggauuucauuguccauaucauuaucaguguauuuuggucaaagccauucaacaagucucuagggaguuccaaacuuucccacauucuucugucuucuucugagcccuucaaacuguuccagccucuguauguuacccaguuccaaagccgcuuccacauuuuuggguaccuuuucaguagcaccccacuccugguaccaauuuacugaauuaguccauuuucacacugcugauaaagacauacccaagacugagcaguuuacaaaagaaagagauuuaauuggacuuuuccaugugacugaggaacucucacaaucauggcggaagguaagaaggaacaagucccaucuuauauggauugcagcaggcaaagagaaaaugaggaagaugcaaaagcagaaaccccuaauaaaacaaucagaucucaugagacuuauucacuaccacaagaacaguaugggggaacgacccccaugauucaauuaucucccacugagucucucccacaacacgugggaauuaugggaguacaauucaaggugagauuuggguggggacacagagccaaaccauauuagacuuugacaugaauuuuggggacacacaauucaacccuaacagcaaagaucuggggucacagucucuuucugucuccuaauucaguaccuuccucugcccuguuuaauaaguauuuuuuuuuaguuuauaugcagcuuggucaaaauuuuuuguuuuuuuuuuugagauggagucucgcucugucacccaggguggagugcaguggugugaucuuggcucacugcaugcucugccucccggguucaugccauuuuccugccucagccucccaaguagcugggacuacaggugccccccaccacgccuggcuaauuuuuuguauuuuuaguagagacaggguuucacuguguuagccaggauggucucgaucuccugaccuugugaucugcccgccuuggccucccaaagugcugggauuacaggugugagccacugcacccagccuagcuaggccaaauuuucuagucaaagaaauaucuacuccucuucuuauauuuccuuccauugcugguuuauggauugaaauauuuuucuuagauggugacaguuuugcuugaggcuguuuuucagugauuuuaaaaaaauuuaucuccgcccuguuugauccuaggaguauaaaaguaauugcuauuugauguacacauuguuuuuaaagaggcauaaacugcauaccuugccuaugaucuuuucccuuuuagucuuuuuggaacacuucuuuggcgcccuaacaggggaaaaugaucaguguuugaggguuuauuauaugggacauacagccaccuggggaguugggaccuuaacuguuaggcaacgguggaaaucaagcugccagguaguucuugaguuuggguugguacucagaauguaauauuuauaagauaaaagauauuauauucucucacuuugaauuaccaauaguauuuuaaggaaccuuuuaugccaaacagcauuugugccaaaaagacaucaguuuauuuaagaaauucccaaaugcaguggaguuucuccuuagagcuaggugucuucugccugacucaagauuguaaacucacaggggauggcccuguaaauguuaggaaauaaguauuugcagugguccugaguuuggaagacugugaaugcagacuggauauaccuguuuugugugugugucucagguuaauugcaguuuucaaaguaacuuuaaauuugcuuauauuucacauauuuuuuuaaugaaagagagaugccuugcagaugagcagucuggguaacaacaacaacaaaauauauauauauauauaugaaagaaaggggaaggagagcauuaggacaaauaccuaaugcacgcgggacuucaaaccuagaugacggguuaauaggugcagcaaaccaccauggcccauguauaccuauguaacaaaccugcauauucugcacauguaucccagaacuuaaaguaaaauaaauaaaaaagaaagaaagaugccuuagaaaguggcagcauguagaaauguaaaaauaguacccugauugggauguucuccuauguguguugauuuauagccugguggaacucuuaguguaugugugcguuuugaauacuguuauagaacaggcgugaaucaaaccucgucaguguugugcagcaucccgcaguucaaaggcagccaguuacauagugcuuggcaggaaggcuuccauuuuuaauacugguugagagaaaagagagaaugaggagucuguuuggagcauuuuauuaugaaggaagcacagcccaacugcucgagacagguauuaaaagccuaucccucuggccucauacuguauuugcuacagaugcauucccacaaggcuuccagaucgaaaaggaagcccacuguucugcugcacagcuguuaaaauaguuaauacugcgcuucccaaccauuaugggaugugccauauguggccuuugagaacaugaacuuauagugcauugggggucuuugggauuauuaacaguauaauucuagcaaacaguagcagacaaaauuaugcaggcuacaguaauucuuuuuuuaaaaaacuguaguaaaauauauguaacauagaauuuacauuuuaguccaaaauguaaguguacgguucaguggcauuaaguacauucacauuguuguguagccauuaccaccauccaucuccagaacuuuuuuaucaccccaaagagaaauucuguacccauuaaacaauaacuuuccauuucuccuucccucagccccucuaaccucuauucuacuuugucuuuaugaauuuguguauccuagguauugcguacaguagaaucucauauucgucccuuugugucugauggcucuaguaauucuuaaguuguaucuguauagcuucuacuaugugccauuuuguuuuugaucauaaaguaauuuaguagaugacuucagaauauuaaaacuugaggacaaaaaauaaaagaaagaauaaaacucaaggacagaaauuugaaacucuuauuaugccuucucgggcaugaagguaguaacaucuaauauuuauagagcauuuauuuccuauauguguaucaggcacagcucugagcacuuugcagauaauaacacauugacacucaugcuagcucugugagguagauaccauuaauaauacccuaguuuugcagaugggaaacugaggcccagagagaugaauuccuugcuuaagauacaggcauggcuggugugcagcagagccgggauugcaggucagcagucugcuccagagcccaagcuccuucgagcaccuuaggugcaaggugcacugggcugggggagggaaacugaagcccagcagccacgcagugagcugaaggaagcagccagcgaucuucagcccguguuaggagugaugggaauagagauucugcaccgguaguugcugagugggaauacaggcaugauacugcuggcacuugcaaauuuucaagagaaacuagaaauccuuauuuauguguaaccuccugcuuucuaaguguuggcaaccuaauucaguuaaagacaaaaacaaagcauaugggccacacaauaucuguggcccacuaccuucagaccuuugcucuggagguuucaggacaaucuuuuucuuauccagaccccucagcaguugguacuucugggcaguuguccacuuguuuggaccuggaggcagggucuugaugaucuuugcuucccuaacugcagcuugcuuucuuucuguuuuuuuuuuuuuuuuuuuuuuuuuuuuuuuuugaggcagagucuugcucugucacccagucuggagugcaguggcaugaucucugcucacaaaguagcugggacuacaggugcgugccaccaugucuggcugaguuuuguauuuuuugauagagacgggguuucgacauguuggccaggcuggucccaaacuccuggcuucagccucccgaaguguugggauuucaggggugcagcugcagcuuucauauagcaauggucaguaaaugcaugcugagcaaaagucuugaaagcacucaugacuucuuuccaagcgcugccaagaguucacagaaaaucuaauuuaacacaaaauaaaacuagucgauuuugagaggauuguaucuuuucauguagaacuucguaauuuauuguuucauuacggacuccuuugaauuaacaauucugacuagaauaggacuuuauuuuuuauuuuuauuuuugagauggagucucguucuaucggcuaggcuggagugcaguggcacgaucucagcucacugcaaccucugccucccggguucaagucuccugccucagccuccugaguaggugggauuacaggcacaugccaccacacccagccaauuuuuguauuuuucguagagacaggguuucgccuuguuggccaggcuggucuugaacuccuggccucaaguaauccaccugccuuggccucccgaagugcugggauuacagguaugauuauaggugugagccacugcaccuggccuuagaauaggacuuuaaagugauuuuuuuuuuccuucagaaaaagucccaccaaagaaauuuaaauauaugcuguguguaacacauacaaaccuaaacuucuuuuuuuucaauaacagccgcagcauuuaugacauacuuacugcaugguagccacugugugaagaguuuuacaugccuuauuuuuuuagugugaagucaacuaagaauuugugaauuugaacugaauuuagauucagaaaggcuugaacauaucuaauacaauguacuggcuuugccuaugaagcugcucaggggcaaugaauuuaagagacuuuaagaaaauuuaagaguccaaggucauacauccguugugugguacagccagaacccucuggacacacacaucuguugaguuauauagacaaucuucuuggacacaccugugguguggggcagucagucucuuuuuuuuuuuuuccuggccucggguccaguugugucuuuuuagauaccguggugcuucuacuuuuaucuuuccaucaucuguggaaagguaggguuaaaguguaauauaaugugucacucauauacaucuucugagcuaccagucauuaccaggguauucgaagugguuugcuaguacugguguggauuuggauugucuuuuugccucugugagaugccuggaguuaacaguuaccuguggccaagaaaagaccguacuucauuagaacagaacccuaaaccaaaugaucugaucaucuuauagauaauacaguaaaugagaauguaaggagaauuuuaaacuuuuuuuuuaauggguaguuuacacauaaugauauaguaaucaucacauucaucuccuugacuuuuguccucuuaauuugguagguagacaucagugguuuuaagaucaguuucuagugaggagggcaggguuuguauccuucucucauucaacugaaaaucauuuaggcuuuucuuuuaaaaagauaaccaaaguaaucuaagcuucugguagaacuuauuaaaaauagggaaguagcugggcaagguggcaugcaccuguaguccuagcuacucaggaggcugaggcaggaguagcaguagagcuugagcccagggauuugaggugguagugaguuaggaucaugucugugaauagccauugcacuccagccugggcaauguaacgagacccuaucucuuuaaaaaagaaagaaagaaagaaagaaagaaaaaguaauuuugcauucagaaauuugcuguagacauuuaaaaauaaaauaguaacaauuuaaauuuaacagaauacaacugaaauuaaaauuaaaugaauugcugaacuuugguuaaauuuuuuucucaaacuuucagucuuuucugcuuuacuauacuguccacaugcaagagaaguauaaauaguauagacuggcauguaauuaaggacuagagucugcuauauaggucguaaggccaaguuugaggaagaauggagaaaucucagggacauguaaagucccauuuaaaaaauuaaaaaccuuaaagccugucuuaaauuaagacagcugaaaaauuuucaagauaaauuaauggagagaucaaugucuuuuucaguguuucagaacuguggaaaaaaagagcucugcuacuuagaaguugcuuugaaauccugguauacguaacuuuacucguucccaacaaccuuuggugguauucauguuuuuaucauugcacgcuguugaaggcugauggaguaaugucacucuggaggugacacuacuuaucagaggaguggccagaaugccacucuuucucaacuaucacucuuguuaucccauucacaguugcaacuugggaguuaagcaaggaagcccucugagcaguucagaauauguaauacauguaugggguacacaccagcguguaugcaccuuuuuccuaagugugugcccaggaccucuuguuuuugaucuggagaccacuugaauucaggauguuuguuccgggguucuauucauaagaaaugacaagcuggaaauuagaaguggagguggggcaaggcacggugguucacgccuguaaucccagcacuuugggaagcugaggugggcgauugcuucaggucaggaguuugagaccagccuggcuaacauggugaaaccccaucucuacuaaaaauacaaaaauuagcugggcaugguggcgcaugccuguuguccucgggaggcugaggcaggagaaucgcuugaacccaggaggugaagguugcagugagcugagaucacaccacugcacuccagccugggcaauagagcaagacccuguuuuugaaaaauaacauaaaaaauagaaguggagguggccuggagaagcuggcauuccugacuggguaaggucaucagcuugggaagcacacaggcuuuguagcucgacagaccuuccuaagaucucuuggcaggacaacaacuggguuuuugaugacuuugggcuaggucuuguucaugacccaaauauucaucaggagcauacuauaccaggugcugggugugugaugauaaacaaauuaggucccuuccuuguucacagccuaagagggcacaugguuucauauauaaauauaagauaguauacuaaggauuacauaaugggaugaguggcauauagugggagcauagggaaaauugagacuucugcuuccaagugaaaggaagucacaaauaucaacacuuugucagucuuauuucaguaacccuacauugcuuuuuuuguguguggucuuggggagugacuaggaguuguccagguggaauaaaaggacauucuagguagaauucucucucauucuagaaagagagagaucuguguauguaaaguggacagaaucugacaaauuuuuagagaaaaguuuauaccaaauggguaacccauggccuuuuuuuuucuuuuuuuuugaggcagagucucgcucugucacccaggcuggagugcagugguacgaucuuggcucacugcaaccuccacccucccagcucaagugaucuucccaucagcuuccugaguagcugggaccacaggcacauacaaccacgccuggguacuuuuuuguauuuuuggaagagacaggaucucgccauucugcccaggcuguucucaaacuccugagcucaagcaauccucccaccuuggcuucccaaagugcuggaauuacaggcaugugccauggccccuggccacccauggcuuuuaaaagucauuauagaaauugucaaaaauaaggccaagugcaguggcucacgccuguaaucccagcacuuugugaggccgagguggguggaucaccugaggucaggaguuugagaccagccugaccaacauggugaaacuccaucucuacuaaaaauacaaaaaauuaacuggguauuauggcacaugccuguagucccagcuacucgagaggcugaggcaggagaaucacuugaacccaggagguggaaguugcaaugagccaagaucgugccacugcacuccagccugggugacagaguaagacuccaucucaaaaaaaaaaaaaaaauugucaaaaauauacaaguaaugaggcauauaacaaaccaucauguaucuaccaaccagcuucacaaauauuaacacuuugucagucguguuucaguaacccuacauugcuuuuuugugguuggagcaguuuauuuauuuuuuauuguauauauuuaaggucuacaacaugauguuuuuguauauagucaugugccacaacauggcauguguaugcaauggcagucccguaagauuauaauaggaacuggaaaaucccuauugccuagugacaugguagccauuauaauguuauagugcaguuaccuuauuuuuaaaauaaauuuaguguagccuaaguguacaguguucauaaagucuacaguauuguacgguaaugucccaggccuuuacagucacucacugacccacccagagcaacuugcaguccugcaaacuccauuugugguagguacucuaugccgcacuguuuaaaaaauccuauaggcaugggcgcaguggcucaugccuauaaucccagcacuuugggaggcugaggcaggcggaucacuugagaucaggaguucaacaccagccuggccaauauggugaaaccccgucucuacuaaaaauauaaaaauuagcugggcaugguggcaugugucuguaaccccagcuacucaggaggcugaggcaggagaaucgcuugaauccgggaggcagaggcuguagugauccaagauugcaccacugcacuccagccugggugacagaacaagacuucaucucaaaaaaaaaaaaaaaucuuuuagaucauauuuagauuauauuuuuacugugccuuuucuauguuuagauauguuuagauaacacaaauacuucccauugugcuacauuugccuacaauauucaggacaguaacaugcuguucugguuuguagccuaggagcaauaggcucuagcauauagcccaggcuuguggauuuguguaaguacacucuguuacauucgcacagcaaugcugaugcugaaucccccaccuuccauccucuauccccaucauuaagccaccuaugacuguacuuauugauacacauaugcauagugaagugauaacuauggucaagaaaauuaacauucccauuaucucauauaguuaacuuccuuucuugcuuucuuuuucuuucuuucucuuucucuuuuucuuucuuucuuucuuuuucuuucuuuucuuucuuucuuucuuucuuucuuucuuucuuucuuucuuucuuucuuuucuccuuccuucuccuuccuuccuuuuuuccuuuucuuuucuuuucuuucuuuucuugugguaaguguaccuaaaaccuacucucuuaacaaaguaccacuaagcaauacaauguuguuaacuauagccuucauaccauacauuagaucucuagacuuacucauucugcguaacugcaaccuuggaaccuuugaccuauauuuuauccccagcaauuuaaagcaaaucccagacacuauguaauucccuuuguaaauaguauguaucuguuacucaguaaagauccccgaugacauuaacacaaaacaaaaugaggauaauucccuaauacuugucaauaccuaguccauacauagauuuuuccuguuaacacagguuucaguaucuaagggauuccuuuuuuuuagcacaguaaguuuuucagggauguuggauacauggggcuuuacuauaauaccauauuuuuauuuauuucuuugaaaugguauacaauuuaucuggucuuauuucugaucauuuaacuaaucagguuggccccaauggauggcugugccuuaaaacuuucuugauugcuuguuugucauauaggaaggccuuuucagggauucagugaacauucaaauucugagagcuagauuauaaauggcuuagggaacuccgaccaauuccuuugauuuugcuucaguguuuuuugcuauuuuuauuuuuuguagagacagggucucacucuaucgcccaggcuggagugcaguggcaugaucauagcucacugaagccuccaguccugggcucaagcgaucaucuugccucagcuucccaauggcuaggacuacagggguacccacaauuccuggcuaauuuuuaaauuuuuuguagagauaggguguugcuguuguugcccagcauggucuugaacaccuggccucaagcaguccuccugucuuggcuucccaaagugcugggauuacagaugugagccacugugucuggccuugcuucaguuuuuagcuucuaguguuuaguucauguccuccucagccuuuaaaagcuguugccuagcaugccuucuuggcguggaccagcucaguguccuuacucagaugcuuguagcagucccugcagccucagcugauccuucaggguugggccuauguugcccuuuuuuuugaggcuuuccucgaugaccucagcuucuuuggcuuccuguuccucucaauuucuccuacccugcacucuagccuuuaauuaugugcuguuuuccauugcuauaacugaauaccugagacucagcaauuuauaaagaaaauuuauuucuuacaguuuuggagacuaugaaguccagugucuugaggcugcaucugggagggccuucuugcugguagggacucucuauagaguccuaagguggcucagaguauccugagccugguacaugcugcuaguccuugcugcuuguaccuucuggagugcuggguugagcugcacuuggggucgcuugagccacagcugggguggcugaggagugcugcacugggaugcagaaagcagagacccaagggggcccugggcagcaaccccaugaagggugccuggguccuucugaaaccauuccgcccuucuagagcucugggccagggaugggagggacagccucaaagaucucugaaauggcaggggucuuuuuccuauucucuugauaauuucaucuaucaauaguaaucuccuuaacaaaugaucaccuacccacagccuugguuuccucuccugaacacacuuuuucacucauuuuuuuuuuuuaaacauggaaugcuucaugaauuugcguguuauccuugugcagggaccaugcuaaucuucucuguaucaguccaguuuuaguauaugugcugcugagggaagcgucuuuuucacucuuuauguggccaggcugcagaguuuugaagucuucccauucuguuuuccuuuuaauuauacauuuugucuuuaagucauuucuuugcucucauauaucacugaauguggucaaaaguaaccaugcaauauccugaaugcuuugcugcuuaaauauuucuucugccagauauuuuaguuuauugcccucaagcucugcauuucacaaagaccuaggacauggacacaauuuagccaagcuuguugcuacuuugugacaaggauggccuuuacucuaguuuccaguacuuuguuccucauuuccgucugagaccuugucggaauggccuuuacuguucaaauuucuaccaacauuuuggccaccaccacuuaagcaaaucuugaagaagauucagacuuuucccuagcucucgucuucugaacccucaucagaaucuccccuaaugcuccacuuauagcaauuacaggcuuuuucuagcuugcucccucaaacccuuccagccucuacucauugcccaguuucaaagccacuuccacauuuucagcuaucuguuauagcaaugaccccauucuugguaccaauuuucagucuuaguccgucucuugcuauaacugaaugccaccuucugcauaauuuauaaaaaagggaaaauuauuucucacaguucuggaggcugugaaguccaggagcauggugcuggcaucugcuuagcuucaaaugagggucuucuuccugcuucauaacgugguagaagguaucacgcagcgagagggcaagagcgugcaugucaguucaagucucuccucuuuuuucaagccgccaguacuaucaugggagccccaucccgaugaccucaucucauccuuauuuccucccaaaggccucaccuccacuccacauaugaauuuggggauuacguugccaacacaugaaaguugggggacacauucaaaccauaguauaugcuaauugcuuuuuuuuucuugauacggagucucacucuuguugccuaggcuggagugcaauggugcaaucucaccucacugcaaccucuaucuccuagauuccagggauucuccugccuuagcaucccaaguagcugggauuauaggcacacaccaccacacuuggcuaauuuuuguguuuuuaguagagacgggguuucaccauguuggccaagcuggucucgaacuucugaccucaagugauuugcccgccuuggccucccaaagugcugggauuacaggugugagccaucaugucgggccuauucuuuacuguuuauacuucucuuguguguagacaaaaugaaacaguagaaaggacaagaacuuugaagcuaauguaaucugaauccuugaguuuguauccucauauuuuaaaaaauugugguuacaaaacaaaacacaugagaucuaacuccuaacaaaauuuuaaguguacaguguuguuaacuuauaaacacaauguuauacagcugauuucuagaaguauuucauccucugugacugaaacuuuauauucuuucaacaauucuccauuuuccucucuccccaagcuccuggcauucaccauucugcucugcuucuaugaguuugauuauuaauuaauuaauuaugauuauuauuguugagauagggucucucacucuguugcccagucuagaugcaguggcuugaguguagcucacuguaaguucaaacuccugugcucaagugauccucucaagcagcugagacuauaggcaugugcugcuauacacagcuaauuuguagauuuuuuuauagagaugaggaucuugcuauguugcccaggcuggucuugaacucauggccucaagugguccucccaagucagacucccaaaguguugggauuacaggugugagccacagugccuagcagaguuugacuacuuuauauaccucauaagaguggaaucgugugcuguuuauccuucugugacuguuuuauuucucuugugugaugucuucaaguuucauucaugugguagcauguaucaggauuuccuuuuuuuauggcggaaugauccauuauguguauauaucacauuuuguuuauccauuuaucuguuagugaauauuuaggaugcuucuacacuuugguuauugugaauaaugcugcaaugaacaugggagugaaaauagcucuuugggauccugacuucaguucuuuuggauaaauacccagaaaugagauuguuggaucguaugccucacuuuuuaaguaaagguuuguaauauggaacaugugcauuguuccauguaaugcauggcauacagaguggguucuuuccugucuaggcacccucuuuugaaaccaaguguccauauaguuugaguauuuucacugugguuuaucauaaguacuuaguauuucuugcuuaacuaaugccuuauaauuauuuuuuagagacagucuugcucugucaaccaggcuggagugcaguggcacaaucauaguucacuauaaucuuggacuccugggcucaagcaguccucccacgucagucuccugaguagcuaagacuauaggugcuugccaccacacccaguuaauuuuaaaaauuuuguguagaggugaggucuguguugcccaggcuaguuuugaacuccuagucucaagugauccuccugccucagcuucccaaguagcuaggucuacacguaugugccaccaugccuguauuuuuaacauagcgauauggggucuugccaucuuguccaggcuggucuugaacuccuguucucaagcaguccuccugcuuugaccucccaaagugcugggauuauaggugugagccacuguacccagccucuacuauuuuugaucaugucuucaauaacacugagaauuauuuuggagagaagucaacauuuccccacaaaaacccuuuuauucacuggucacucacagcagcugugucauugagaaguguugacacugcuuuugguuuuuaagugacuguguguuauuccuucccggggugaaaaaaaaaauugcaagguuggaauuuucuggauuguuaacaagaucaaaaagcaaagauauaaagccaaggggggaaugucuuucuacggaauggugguagaaagcaaaaaaugcuagaauuuuguagaaauuacuagguauuacaaaaauaaucuuugaccagaaaaugaagguugcuguuuuuuauguuauucuaaaguguaguacacuuuaaccagcuaggguuuuugucuggaucuuuaaaguauauugauaaaaaugcacauacacauuuauuuuucuuuuagaagaugacuugauuuccuaggacagaaguuauuucauaguuguaauuucaauaaucauggauguuagcuuugaagugguugauaagaagcucucugauucuccucuauucagagaagacacaguuguagccauuucucugauuuuccucaguuuucgccuuagaacuaguaaaagaggauucaguggcuucagcauacucaaagccaacauagggguguugaauucuccaggaaaagagagauccuguuuucucaguuuguuguugggguuuuguuuuugacauuuuuugacagcuaagaucaagaucucaugacuuguguucuggccagaggacccucagcuuuuugugaugagucauuuccuaaugcauccggaggcacugggcuuggaacccccaucucagaguugggggcagcagauccagccacugcagcugggagggaguccaggugucaggaggaaggggcugaggucuucagggcugguggcucaggguauaugaguagccugacacaggcacccauguccccagaccuucucuggccauauggagucagagugaccuccaguccccuggaagauugccaagagcaaggcagcuccucagccccugaggaguuagcagcagauuauccagagagggucucaggcuccuuaucagaacugagcuagagggugauuuaggccuguggaaugcaggagcaagaaagccaaguuacuggauacaaggucagggccugccuguuaagcagcaagagcaacuuagccagagcuauuuaaaucucuaucuuagaaauucccgcuggguugagccagcaaggggagugugggggcaaggguuaagaggcuucagcuguggggaaggaagggccauggacacugaaaacaacaggccaggccuggauguccugacagccuagaccuaaauagagagguuuuuaguguccugguaggucauuucagccugcuugcaagugaaugggucuuaggguguaagguacauauucaaucaugagcuugaaaacugagaauuacuuaugugaaucuggaaguggauguaguuuuaaauucaauuuagacaaaacaaauuccucaauuuuucccaaguguaaauuauaacccuauauuacagaacugucaguuaaauucaugaaaguacucuuuaccaagccugaagcaaauuggugcuuuugagugcuauuacuuaucgagaaauaaauauauaaaucagaaagcugagcuuuggaaaaaagaaauaaauaugaagucacccaauaauccauucugaguagaugaaugauuaaagauaugugaggugagguugcuuuagagcaagggaaaacucacccuagccucugugguucacaugggcaugcauaacaguacagaauuuauuccuuggcucuguaugucauacagauuagauuccaaagucaacugaagcuugccuuauugaucacagaauccuaacauuuaaaccaauuuuaucaucuuuaagaaaguugaaaacuuaauaccuuuagagacuacagaaacgcuuaggcuguuuaaaaacacucucauucaaauaccuucuucccuaaggucauauggcccugggguaucuggggcagauugaacuggcaaagauucagaaggcuucauuggugacuuaggaggagauagggggcgugucauuaauacaaaggcauaguccaucugcucaaagaaguuuauaaucuggugaggagcuuuacucacagauaccguaagaaaagauggaugagaauaaugaaugggagaguacucagauggaauauuccagaucagaauggcagugcuuuugagaaagccuguccugguuuccguugguguuagagaccacacagagacagcacauugcaguuggauacaguccccauuccuauuuuugaggacauuuggaucuuguggacugagguuagccauguggauaucucuccuggauauaguggcagagacacacugugagcaaaguaaccuuuucuuggugcccagggucaccuuucagagccaagaauugugcugcuuuaaaaugcuuuuuuuuuggcguccuugcaugcauuuggggauugaaaggcuguuaaaauauaacagccuguaaucuacuguuucgaauuuuacagauucucuccugucagucgcagcuucucagggcugucauugugcccagaucuaacacugucccuccauucucuuaacuuacaacagucugggaaaccacauauucucuccuguuagaauugaaucugaaagacagugggagggcucugagggagagccugugaagagguguuggggguugguguggggguuaggaguucccuucugcauugugcaugaacugagccccagauuuuggcagcuuugaagacuuauuugcaucuugguucuugguguuuucuggauaaguugagguugcagcauaugacuucugucuuugauaggccucccccuuuuuuccuccuacucuugccugaaucaauuuuguuauggaaagagugaaaguuuucucagggaaaaugagaagaagcucaacggaggaagacccagggcugagcaagccuuggccgguccgucagccacuguuuguacagccuaaauauacugagcccugcaaaagguucagugggaugucauggagccugccaucaagaagccuagucugugguugggagagagaacaaacagaccugaaacucccgauuaaaagcagugguuuugcaucuugugugaguucagagaagagugauuuaagucaggggcuuggugucgggagggugggauccaagugggauucaaguaaguggccauggaugaauuugugaaucaccaguuaggaaguggcagagguuagggacagauguagcagcacaacugaggaacucauuucaaaggaagaaucguaaauguaugaccgguucacagacuguugaguuguguggcugaugaaaaugcagucucuugggcuccaggugugauugcccaugggcugcgggagaggggaagugcccaggagcagcccagguugcucuaguacagaugggauacacuuugggaaacauugguaaaggauggguaaggcaaagcagaugaauuuccuucccaugagagacagaaauuggggaagccauccagacucaacagccuggugguugucccucuauuacagaagagcagguagcaagcagguauuccuaagaaugacgggacaugggagugacaauaggguuagcaccucagauggagccgguguucccgcaggcuucaccccagguucuuucuuauccagccucugucacaucugaaaacaucaugaugcucaugaaaucaaggucacauucaaccugcaugugcgccagcugguuuuauaccaaggaaagcucuguucuucaggcacuguggcucuuaguaguuauccuugaaugcguugugcuuugucaaacuuggugagcaagaaaauauggauccucaguaaaaaacaaaaacaaaaacaaaaacccuaucaggacuauuagaagaacaggugaaaucauaguggcaaauacaguggugcaguaaauuccucacaucugaaaaccaucauaucacuucucauauaguuaacacuuaauggaaauauucuuuacagaugagcuuugaauugcugccucuuggcccugccucuaccugccaaagcagccggacucaaugcagaugccaugcagggcucacuuagugaauggccuaaucugucccuccuccugccuucucccuugggccacaccuugcacccacuccagcgaucaucaccuacaaaucguuauucacuccaacuuucuucagcucucuucccugguccauuugcuuuucccucucuccccuguuuuugaggcauaaauauuucccaccugaccccaucaggaggacaaaagaaacagcugggaguuggucagguguagugacucucaauccuggcuacacauuaaaaucaacuggucggguuugaaaagcgccagugggcccuauucccagagaucccguuucacuuuuucuaggccucagaauuuuuaaagcuaccuaggagauucucaugggccaugggauggaaaaccaccucagggcgguugauaguguaacaguacuagcaggacaccugucucauggaaauggaagcugaaagauuugggauggaaauugguauguuuuaaugccuuuugcuacucaagccccaaauguaggacagauccccaugaaguucuccuccucccaucuuccucuguuauguaagcuugcuuucuauuaaauagcagcauucaacaugaaagaagagcuuucuuuuauuugcuuuaggauuucugugguauuguuuccacugugcugugguugagugugacuugaacguccucacgaacucaccgacgcuggcuuugccugaguggucuuugucacguuguuuagccucucugggccucacauuguagucaaagcaguguucaaugcugcagaacccuuuacagcuggaggauuuggaccgucacauggaaucgauggagacaugcuuugguccaugaacacauacaguagccuuugucuuguggucugaggaggcccagugcuaggcuuuagaaggguacuugggagaaaaaaaauuuuuuugaugaauacuucuauuggauaaacaaauuugaagugugucuguucauccuugcaagaaagugaugaccacgagguaaacuguaauaauucucuaugaaguuuuuuuuugaaggagucagugggaaauuagaucugaaaagaaaaagcuauugaugggcauuugaaauucucauucagcuagucucuaaccuccuguguuuuagguuucagaaaaauucccacaauaaguauauuuugucaucuuuuacaugagaauauuuugugguguaaugcucauuuuuucaaaacuaucaugggcccaaaugcuggguugugcauugaaaaaggccuuugaacacaggaaugccaaaacaguaaaaguucauaauuuuuuugcuaaucuaaaauuuauucugaagaacaacaacaaaaaucucaaggcauaguuucuuuucugcgucugauaggugaucucgcuguaguuauaaguaaccucucaaacaccacucaguuucucuggucucauugaccuuccuuuuuccuuucuguaauuacuaaagaaggcccuuaaaacccauguaggaccaaauacagaaucuaaacucugugaucucaucaccacaaaaacaggcuggagggacagucuuccuccucucaggaagcugccuuccuugagaucucugcgacucuguaauuuauaguggugccuuuguagcuuuaaacucagaaaggacuuuuccccugcugcccuuacagaaguuuuauaaauggguugcuguagguggggaagaggccaaagagaaagugcaugucuauguguacaugaccuguuagauuuaauuuuaagggugcacacgcaucuguggguccuccggacagagggucugagagcgggcaugcugugagagugggcgugcugugggcugugauggguauucuuuuauacuugucugucgguugugguuaggacagaugaggagucucccuuuucugcugaggugugcuuuaugaaaggagacuuggcugaaggacaugcagcagcugggagacgauucccuuccuggcugccagggcccucucccuuuuaugagccuguccugggaaaccucagguauuugagcuacgacuguucaccagguggugcuguccugcagugaaugcuuagauacuaugccagugaggucaucaaccuuauguaggaaaaaccuagggugcuuagaagcucuugcagcauuugcaagcugucgcugaacgugaguugaggcuuuuuguaaaaaauuauuauuauuauacuuuaaguucuaggguacgugugcacaaugugcagguuucuuacauauguauacaugugccauguugguuugcugcacccauuaagucaucauuuacauuagguaucucuccuaaugccaucccucccccauccucccaccccaugacaggcccucgugugugauguuucccgcccuguguccaaauguuuucauuguucaauucccgccuaugagugagaacaugcaguguuugguuuucuguccuugugauaguuugcugagaaugauaguuuccagcuucauccauguuccuacaaaggacaugaacucauccuuuuuuauggcugcauaguauuccaugguguauauguggcacauuuucuuaauccagucuaucauugauggacauuuggguugguuccaagucuuuacuauugugaauaguuccacaauaaacauacaugugcaugugucuuuauaguauaaugauuuauaguccuuugaguauauacccaguaaugggauggcugggucaaaugguauuucuaguucuagauccuugaggaaucaccacacugucuuccacaaugguugaacuaguuuacaaucccaccaacaguguaaaaguguuccuguuucuccacauccucuccagcaccuguuguuuccugacuuuuuaaugaucgccguucuaacuggugugagaugguaucucauugugguuuugauuugcauuucucugaugaccaguggaugaugagcauuuuuucaugugucuguuggcugcauaaaugucuucuuuugagaagugucuguucauuuccuuugcccacuuuuugaugggguuguuugauuuuuucuugaaaauuugcuuaaguucuuuguagauucuggguauuagcucuuugucagauggguagauugcaaaaauuuucucccauucuguagguugccaguucacucugaugguaguuucuuuugcugugcagaagcucuuuaguuuaauuagaucccauuugucaauuuuggcuuuuguugccaaaauuguuuuagucaugaagucuuugcccgugccuauguccggaaugguauugccuagguuuucuucuagggcuuucaugguuuuaggucuaacauuuaagucuuuaauccaucuugaauuaauuuuuguauagguauaaggaagggauccaguuucagcuuucuacauauggcuagccaguuuucccagcacgauuuaucaaauagggaauccuuuccguguuccuuguuuuugucagguuugucaaagaucagaugguuguagaugugugaugucauuucugaggccucuguucuguuccauuggucuaucucucuguuuugguaccaguaccaugcuguuuugguuacuguagccuuguaguauaguuugaagucggguagcaugauuccuccagcuuuguucuuuuugcuuaggauugccuuggcaauggaggcucuuuuuuaguuccauauggacuuuaagggaguuuuuuccaauucugugaagaaagucauugguagcuugauggagauggcauugaaucuauaaauuaccuugggcaguauggccauuuucacaauauugauucuuccuauccaugagcauggaauguucuuccauuuguuuguguccucuuuuauuucguugaacagugguuuguaguucuccuugaagaaguccuucacaucccuuguaaguuguauuccuagguauuuuauucucuuuguagcaauugugaaugggaguucacucaugauuuggcucucugugucuguuauuggcguauaggaaugcuugugauuuuugcccauugauuuuguauccugaaacuuugcugaaguugcuuaucagcuuaaggagauuuugggcugagacgaugggguuuucuaaauauacacucaugucaucugcaaacagggacaaucugacuuccucuuuuccuaaucaaauacccuuuauuucuuuaucuugucugauugcccuggccagaacuuccaacacucuugaauaggaguggugagagagggcaucccugucuugugggaguuuucaaagggaaugcuuccaguuuuugcccauucaguaugauauuggcugugaguuugucauaaauagcucuuauuauuuugagauacaucccaucaauaccuaauuuauugagaguuuuuagcaugaagggcuguugaauuuuguugaagaccuuucugcaucuauugagauaaucaugugguuuuugucuuugguucuguuuaugugauggauuacauuuauugauuuguguauguugaaccagccuugcaucccagggaugaagcccacuugaucuugguggauaagcuuuuugaugugcugcuggauucaguuugccaguauuucauugaggauuuuugcaucgauguucaucagggauauuggucuaaaauucucuuuuuguugugucucugcccagcuuugguaucaggaugaugcuggccucauaaaaugaguuagggaagauucccucuuuuucuauugauuggaauuaguuucagaaggaaugguaccagcuccucuuuguaccucugguagaauuugacugugaauccgucugguccuggacuuuuuuugauugguaggcuauuaauuauugccucaauuucauagucuguuauuggucuauucagggacucaacuucuuccugguuuagucuugggagagugugugcguccaggaacuuacccauuucuucuagauuuucuaguuuauuugcauagagguguuuauaguauucucugauuguaguuuguauuucugugugaucauuggugauauccccuuuaucauuuuuuauugcaucuguuugauucuucucuucuuuauuagucuugcuagcggucuaucaauuucauugaucuuuucaaaaaacagcuccuggauucauuauuauuauuuuauuuuugaaggguuuuuuaugucucuaucuccuucaguucugcucugaucuuaguuauuucuugccuucugcuagcuuuugaauguguuugcucuugcuacucuaguucuuuuaauugugauguuagggugucaauuuuagaucuuuccugcuuucuccugugggcauuuagugcuauaaauuucccucuacacacugcucuaaaugugucccagagacucugguacguugugucuuuguucucauugguuucaaaaaacgucuuuauuucugccuucauucguuauuuacccgguacucauucaggagcagguuguucaguuuccauguaguugugcaguuuugagugaguuucuuaguccugaguucuaauuugauugcacuauggucugagagacgguuuguugugauuucuguucuuuuacauuugcugaggagugcuuuauuuccggcuauguggucaauuuuggaauaagugugauguggugcugagaagaauguauauucuguugauuugggguggagaguucuguagaugucuauuagguccacuuggugcagagcugaguucaaguccuggcuauccuuguuaaccuucugucucauuguucugucuaauauugacagugggguguuaaagucucccauuauuauugugugggagucuaagucucuuuguaggucucuaaggacuugcuuuaugaaucugggugcuccugcauugggugcauauauauuuaggauaguuagcucuucuuguuguauugaucccuuuaccauuauguaauggccuucguugucucuuuugaucucuguugguuuaaagucuguuuuaucagagacuaggauugcaaccccugcuuuuuuuugcuuuccauuugcuugguagaucuuccuccaucccuuuauuuuugagccuggggguugcucuucucaaggaguaucuuugugguguucucuguauuuccugaauuugaauguuggcgugccuugcuagguuggggaaguucuccuggauaauauccugaagaguguuuuucagcuugguuacauuguccccaucacuuucagguauaccaaucaaauguagauuuggucuuuucacauagucccauauuucuuggaggcuuuguucguuucuuuuuacucuucuuucucuaaacuucucuucucgcuucauuucauucauuugaucuucaaucacugauucccuuucuuccacuugaucaaauuggcuacugaagcuugugcaugcaucauguaguucucgugccaugauuuucagcuccaucaggucauuuaaggucuucucuauacugguuauucuaguuagccauucgucuaaucuuuuuugaagguuuuuagcuuccuugcaauggguuugaacauccuccuuuagcuuggagaaguuuguuauuacugacuuucugaagccuacuucugucaacuagucaaagucauucuccguccagcuuuuuuccauuucugguaaggagcugcauuccuuuggaggagaagaggcauucugguuuuuagaauuuucagcuuuucugcucugguuucuuaccaucuuugugguuuaucuaccuucagucuuugaugauggugaccuacagaugggguuuugguguggauguccuuuuuguugauguugaugcuauuccuuucuguuuuuuaguuuuccuucuaagagucaggucccucagcugcaggucuguuggaguuugcuggagguucacuacagacccuguuugccuggguaucaccagcagaggcugcagaacagcaaauauugcagaacagcaaauauugcugccugauccuucuucuggaagcuucaucucggaggagcacccagcuguaugaggugucaguuggccccuacugggaggugucugccaguaaggcuacaugggggucagggacccacuugaggaggcaaucuguccauucucagagcucaaacacuguacugggagaaccacugcucucuucagagcugucagacagggacguuuaagucugcagaaguuucugcugccuuuuuuucagcugugcccuucccccagaggaggagucuacagaggcaggcaggccuccuugagcugcgguggacuccacacaguucgagcuucccggcugcuuuguuuaccuacucaagccucagcaaugguggaugccccucccccagcuaggcugccaccuugcagcucgaucucggacugcugugcuagcagugagcaaggcucugugggagcgggacccgcugagccaggugcaggauauaaucuccuggugugccguuugcuaagacaguuggaaaagugcaguguuagggugguagugucccgauuuuccagguacagucugccacggcuucccuuggcuaggaaagggaauuccccuaccccuuguacuuccugggugaggugaugaccugcccugcuuuggcuugcccucugugggcugcauccacuguccacccagucccagcugagaugaaccaggcaccucaguuggaaaugcagaaaucaccugucuucugugucagucacgcugcgggcugaagacuggagcuguuccuauucagccaucuuggaacccuaccccauguucgaguugagacuuuuuuugaggaaacauuaggcauuugacaugggggugaccaccugguucauguaggguucuccucugugcuuggcucaaaugagaucucagcugacccugaagucagggaaaggcugaacccauccccuguauuacucccugguuuccuuccagagaaaccuccuauucuccguucucaucuuugaaguccugguggggaaggcagcaggucuucuggagcuccucauuaaacagacuuaggaggaggagaggccuccacccagccucggcacgcacaaaccuguuagcacccuggugcccugccaaggugguuuuuuuggcccaaacgugacugcacaugaucccguucuuucuggcagugaagcccggcaggauugacuugggcaggagccuaguuggugguguguuugaacauggagagcacccuugaaaacgaauguucuccaggacguguagcagugaaaaggacacuucccagggagauaggcucugggucagucacaggagcuccuuguuggaaucuuucaaugagcaagcgugcauggagcaucugcuucugcuugugaugagagugagagcgggagggugguggaugacaccagggaagaccagcccuggagagacugguaggaggggagcucaggcagaacgaagccagugcugcaacucagaggccaaccagguguucugagcacagagaaagggcuggcaagauuccgugggggguggugugggcaugcaggugauauuugagcuguaccuggaggaugacuaauuuccagagagagaggggguuucagguugagggaagagaaagagcaaaggugugaaguugagugguguguuugggaauggugaauuucguagaaaccugggacuccugaggggugaggcaggagauaggggaaggaggugcuuaggaggacuucagcaugcuaaggguuugagagagguucuuggcauguuaucuuaaaccuuuaaaacauuucguuguggacugggcuguaaaccuauuagcaucacauaaacagaaaaccugagauaguggugguaaaccggaugcaucuaguaccuugcuuaagagcaggugcuucucaguugauguccugacucagcuuggauagugagcaucugaggaaggaauggauucucuugguuuugccaauccccggucacucugcuuuuacugggcuugacaguauguccaugugaugucuuuuucuccauuacugcugcuuugggauuuuuggggaggucagagcugguguugauaaacucugugccucucgucucauagggaagagugcugacggguuuucuuuuuuccaguucuuuugccagcuuucuauggucaucuucuugggaggaacuuacgggcaucccugagugagggagacaaccacucucuguugcaagcaaguggcauguggggugaggagaguugagaccagggacgugcucauagggaauccaugcuuugacaggccagguauucaagguaugcuauucuugguaaauuuugagggcucugaaaguaaaucagauuucuucaaagaaacuuaaaguaaaucauuaucuuacuguguuaaagcacucuuacuaauaacaugcgugcuuuagugcacucuuuugaagcuuuccuaauuuuauugacuugugcccauuuuagaauuuuggaucccuuuuuuauggugucuagcacaguacuuuuccauugaaaacauuuaauauauguugauugaauggcuuaguaucuuuguuuacaguuuaaguacaguugucagaaguauaacugauaaaauuuucacauuuuuaauaaggucagacuggcugucucauccguaucauuuucauucuucuacuccuuauuccccgugaaaaacuucuuaaaguuuaaugacaaggcuccuuaucgcuccuggaagacaaauaaggaaacauuuacagguugccuuaccucaaaugcucuucauagauuggcuuuuuggggucaugucaguuaaagcugacauagguucugccucuugcccguucuacagacuguccuguuaacuuacucugaguugucaucccucuucuuccccuggguuucaaggaggauuuucuaguuguguggcuuuaggaacuuggggaaacuugcuaaccgugugcugagaucucccuguauuguagucuuauauguaaguuaugaaacagaaauaccuauuuuaaugccaggaacaauggcucucgccuguaaucccagcacuuugggagguugaggugggaggaucacuugagaccagccugggcaacgcagcgagaccucaucucuaccaaaccaaacagaacaaaacaaaaauggcuggguuaugguggcaugcaccuguagucccaagcuacucgggaggcugaggugggaggaucgcuugagcccaggagauugaggcugcagugagcucugauggcgccacuguacuccagccugggugacagcaugaaacccugucuuaaaacuauuucaagagguuuggcgaggcuggaggcuccuaauguauaugaucuauguucuagucaucuuuuuauuugcauucugucuccaaugccuagcaucuaguaggacucagauacucccucuuuuaagaaagagaccuggcugagaauggugccuccaaucccaucuuaagugagcacagcuuggaagacuggcuauuuaugccuagcugugcacaguggaggcagcaagcaggaguccccaagacauccaggaccaaauggcugacugggggcauuggagacaccggcucgcuucuccauggguguuggaaauacugccccaaggggaugggggucaagauaaaaggagcuuccaaauugcugugaguucuugaaaugucuaugagaugugcccauguacucugccaucuguuuugugugacuugccagcaggauuucauuuucugcauucaguucuccugccacacccugcuauccaugaggaaugcaguggccuuguugcuccccagaacuuugcgggauccugccaaaaggcggagcuucuccacaggggcagggcagcagaguacauaucacaauuccugugaagcuuuaaaaauuaggauacugggacucacuugaggagugcugaacuagaauuagggggaggaggagucccugcuguguuguuguuguuguuuuaaaguuccacaagaggugauaguguauaucaugaaguaagauagccacauaugggccgggcgcaguggcucacuccuguaauccuagcacuuugagaggcugaggugagcagauugccugagcucaggagugccugucuguacuaaaaauacaaaaaaauuacccgggcaugguggcacaugccuguagucccagcuacucgggaggcugaggcaugagaauugcuugaacucgggaggcggagguugcagugagccgagauugcaccacugcacaacagccugggugacagagcaagacugucucauaaauaaauaaaauuaagauagccagauaugauaaagaguuuaaaggauacauaaaauuaguuaccagaagauccgaagaaauugucugcuuaaauucagugaugcauacaaagagugaguaguauuuuuggaggaauauauuucagaagccucagaucuucaaauuuuuuugcuuuauauuaaugacaauucuauaauagucauuaauauuugagauauguaacuuuugaaaaauauuuguauggggaguaaacuuauaaaccucuuucuuagccugagccgacguuuaggggaacuuuuuugaauuccacugaccuguuuaaccaguugacacugccaacccaaacauucccuugugccauaauucauaucguaaaacuauuuuauaauuuucacuuaaaauugcaugcgauagcauuuucuaugaugcuaacaugacaaagaacaagaaaaaugacauggaagaggaauuuacuaaauucaaccagaguuuaggcuuacugagaaauccagguggaaaucugcuuaaauggcauuuuacaauagauuugcguauugaaaccaagccuuucuuccugugguaacacguuucucaaaguaacauugaaauagcaauuuaaguguauugcccauagagauuuaucagaaaggaaauuuauuuagaaaguuguggguuuuuuuuuucccccuucaguuuucguuuggcagagaauucacuaauuuuucuccuucccugggaccaacuuuagaaaauagauaggaacuuaauagcaaaaaucauguuaaaugguuuugugguuuuagacugcgucucucuuuugcaaauuccuuuucugugaaagaaaaccuugcaacacauugcuauuugacauuuuauuaauuugguggguuugagggagaagggugaguuucaguuuugaaguuaaagaauuuuacaauuuaggagggacugacccuacagauggccugucuccugguuuccuucgccucaauagaaacugcccuugucgacgucccaaauggccucugaucauugaagccuguugucacuuguuaguccuugacaugacuuuuccuguaguauuugauucugcugaucauuccucaucaaagcugucucuucuggguuccuaugcaccauucuuuucuuuucuuuacuuuuuuuuuuuuuuuuuuuuuuuuuuuugaggcagggucuagcuuugucacccaggcuagagugcagcggcacaaucucggcucauugcaaccucugccuccuugggcucaagcgauccucccaccucagacccucaaauagcuaggaguacaggcgcgaggcaccaggccuggcuaauuuuuuuuguauuuuuuguggagacggguuuucaccauguuacccaggcuggucucaaacuucugaguucuagcgauccacuugccucggccuccccaaaaugcugggauuacaggcaugaaccauggugccccgccccuuugcaccauacucgacugcuuuguuuuugcuucuuuaauuuccucuuagguccugcuguaucugcccuuauguuccugguucauccuuggugguuuucuuuuagucugcucagccuuuuugggggagaccucaauaauucuguggcuucagccaccauccacacuucauggaccccccaggucucucugaauucauccuccucuuagacaaucuuuuggacauuucugcuuggaugacucauagguacuuuuaaaucaggauauccaaacugaacucauuucccccccccaguuauugccugcuuccugcuccccacuccaaaccacucaccccacgcuugucugcuuuucccauuuuggucauuggcacuacuuucuacccugucacucaagccagaaauuugugauucauccuucagcccucccucagccccauuuuaaaauugcugauuacauuuuaucuuaauuuccuaaauaaagaaggaaaacgcaaacuuaagucauuccaccgugaaagaaaaauaucuugggcccccaaaucgcuaaagcuaaaagaaaauucaagcugggaacuacuuagggcaaagcugccucugauucuauucaaagccaucccucugcucacugagauaaaugcauaucucauugccuccuuuggaaaggcuaaucagaaacucaaaagaaugcaacaguuggucucccaccugugaccuggaagcccccuccccauuuccaguuguccugccuuuccagacagaaccaauguucauuuuacauauauugauugaugucucauguuucccuaaaauguauaaaaccaagcugugcucugaccacuuugggcacaugucaucaggaccuccugaggcugucugaagggcaugcauccucaaccuuggcagaauaaacuuucuaaauugagaccugucucaaauuuugggacuucacaccacuaacauuuaauuauaaauguuuaaaacucaucacugggccuauauaaacaaguguaauaauacaacacauuagugaccauuucuauaauauauguuucaugcuagguauaguccuacaaacuugucauguuuuauuucugauuuuuuuucacagcuauucugagggaugucaugcucuguuacaagugaggaaucuagggucagagagcuuguguccaggcccaggggcacagggcaaggaaagcacaguauaguugggguuuagaccacaugggcugguguugguugaccugaccccaacaccuuugccuuugguaucaugccaccuuguuuugaguuguuucuauaaugccacagcacuguuguagauaucuggcaaguagauuggcuuuggggggcaguaacuggucuuguucguauuugaaucuguuaacguauauuuuuucuuacaauuagugguaaagacaugacucuugaugguccauguugucuguggcuucgucuggauaccagcccuggcucuuccgugaacugucuauuagcuggguggccugagacaaggacaguaggaucaugcugcucgcccucagaggguuuuuaugaggaggaaauggaaugccguacaggaaagugcuuucaaauucagggcauuuuugaaaaguuguguucaauugugggaauugaucauuugcuggcuuacaugagcccucuuuuuuuauaaacgacaaugugaacauagaaauuuuccuggauuucugauguuaaugcugaucauucuugcacaggcagaaaaggcaagaaacgaccuuguuuauagcacauauagaccuaaauuuuguuaguccuuaguaaaacuaguuuagaacagguaaggauaugaucuacaaaaaucauacagaaccuuuuuggguauaggcgggugaacaaaagcagagucuacugaaguuuuuuguagagaugggcucuugcuauguugcccaggcuggucuugaacucuuggccucaagccauucucccaccuuggccucccaaagugcugggauuacaggcaugagccaccacaauuggcccucuuuauucuguuaaauugcucuugggagcauggauggacuuuugugcuguaccacaaugaacuguaaauugagaccuggcuguuuuauauuuuguuuccucauaggucccuccuuuugcccuguucugaaaaggaaaugcuccuuuuucuucauaggucucccucuuccaucauauuugguuuuuagagugugucuaaggagagggcccuuuuaauacauagauaaacucaaucuauuauuguggaauuuagaaauuguuuaauuuucaaagucuugguuucuuauaaaauuguccuguaaauuuaggggcagugcuguguauuuugcaguuguuuugacugaacuugacagacugugacucacaguagguccuuggcaguugguagccauuaccauccaaacuuaguucagauuuuacaaggguuacauugguuuauguuaggauucaagaagaauuuauguaaguguuguagaaagggagggaggagaguguauaauaacagugguuccugggaguguggaccaugagggacugcuucaucaucagcaggguagcuguaccccagaccuaaagaaccguccagggugggguccagcagccugccucuuaacaagucccccagguaacucugaugcacuuaacuggccuaacguuacagguuucagccugaaguccacccaagagauagugaggaccuccccagagugguggaagcgaauggaggggagucaggacuggugagacggagaccuguuuggcuguuuaccagacauggaagggaggccaugagaaagaggaggggcuuugagucucgugaacuaaaaaggauggugcuuuaucagcaggaaccuggacccagacuagugaguggguuuuggaaguggggagaggaagauggguuuaguuuuggacauguugagguaugugagccagggcugaugacggcaaguuggaaauaaaguaguguaacuguagcacagauaaagaauggagaaacagauuugugacuugccugcauacaggcagcaguugaaguggguauucuggucauuuuuccaaggaugauagcacagagaaagagacccaagaauagacugauaugggauugggugcuugggagugcagcauuuguuucucuuucagaagaguaagucaaaaugcuuaggaauacauagugacauaauuuuuuuuguuuaagagccucacucuguuaucuaggcucaagugcaauggcaugauuagagcucauugcagccucgaacaccugggcucaaaugagcccaccucagccccgcaaaguacugugacuacaggcaugugccaccacucccagcuaauuaaaaaaaaauuuuuuuuguagaaacaaagacucacacuccuggacucaagugauucuccuaccuuggccucccaaaguguugauuacaggugugagccaccacacccagccugugauauaguuuuaaauuaaaccagguuaucagaacagcguugcaguuuugccauuuagcuuuaggccccaugcuguguaacagagacuuguucuugaaugucauuuuaucuggaaauccaaggcuuagggugccaaggcaugguuuuagugcauguuuuucuugcaaaggaagaaguggaaugagguguuaagagcuaaggugugaccuagagcaggcugcugagauucucuaagucucaguuuccuuaucugucaaaagaggauaauuauaguucccaccuggugguugugaggacuaaacaggagguugucugugaaauaaguuucucuaccucugccauugcuuuugugguugguugcuggauuugugaaguaaaggucuuccauuuguaucgauaaaucuugcauuuguauugauuuaugauaugaggauuauaaaaagugaugucaauuggagaugaaugcaguuuuauaguuuuuagugaauuaucaguacauugaaauaugggcuuuguuagguuugugagaaggcaaaagagaguuggcuugagaaguuuuacugcauaaaaacaagaaucagauauuuuaaaaauuauuuuauauccagcuuuguugcagacugacauauuuugcuguaccaggaagauguuuugcugagaccaugaaaacuuaguacaucugugcaacaucuucauuauaucuacaacaauuuuacauccaccgucucuaauucaaagccauucaagaaacaugugucuuguuuuccacuggguucuaauugggcuguuuuuccuuagugggagacauuuggaccacacacuuacauuuaggaaauaacuugguaacugggcuacauguacaagaguguauaaagaauguucucauuguggaaaaaguagcuucugcaacucccuauuccuccccaagaaaagaaagcuguguguauguaugugugcauguguuuucugugcugcgucacaauagugacuuuuguucuuuaggucugagauguuucauacuaagagaaaugaugacagaaucagugaucaaagguuucacugcagaguuacuaagagcuuuaauugaaucuuucacuggguuuuagaggaaaaacaucugauguucauacauggcgcguaacauaccuucaaguauaaggcuuaaacuucauagguuugauuaguuuuaugggaccccuacaaauaacaugucauauccacccauaggaauuagcucuaauucaaaauuuaguugaagugguguuuguguguguguguguguguguguguguguguguguguguuugcuguuggguuggguuuggaugccuucaguuuaguucagaacuaccaccccagcucuuccagaacugcacgaggcuugcaccauucugggaaauuuggcugcugccacagcugaaauacugagccagacuuagguuauuuuauuagucuagaaagaguauugcgcucuugcagcuguuccuaaccaugaaaacaaaaaccaucucgguuacccaggauccaugagaaauuggcaauggcucaguuuaaguccguguauuuuggacucugaauuauauuuaucuuccuaugggcauccccugauuuagggcauacagcuggggaauggccugugacuguaugaggcagugggggcgggagaggccaagccuuggguaccacauucauuaggaagccugauccaguuaacugaaacacggcaguuuccagagcacaaauacuuucaaaaagagugaggagagcaccaagaaaacaauacaaccaacagcguguauuaaaaacaccugucucaaauaugaaauguggcauuuuguuuuuguacauugucugucacaguaaauaucuagagucugucuccugucaugccaggccugguuuuuguagauaguaauuugguggugauggacauucuugauaaauagggcuuuuacagacuauucugaaaaugaaucaugggacuugccuuuaauugcuagcaguggcguguaugugacauacucgcuccugcuaaugugugccaaucaguaaguuacuguuuaauuuucugaauuuuaugggaugaugcgguaagaaggcacuccccagaagugggccccucgaucuuggacuucccagcuuccagaacugugagccaaauagaaguuuauaaacaaacuucuauuguuuauaaauuaccaucuccaugauauucugugacaaaaguacaaaauggacuaagacaagggaucugugaacuugaauggguggagaaaaacucaacuguauuuucacuaaccucuagccaaaauauagccauugcuucaaucaugaaagugggcaaccaaccauguaagaucaacaggacauguaacuuugucacauggaaauuaacugauuuuuguaucauauuguggaaauaguuuaaaauacauuuaugcccaucgcugcuuuaaaaacugcaguaguuauaaaaccugcugcugugucuuauuuaugcguuaagcauacuuuaguguaucagguuugcuuuuugaacauuuugcuaucuguguuucaauauaauuaguuuucuuuguaauaagacugucuacuuaaaaaucauucaaaaacacucugaggguacagauugcugaagccauccauggaacuuaaaagguuacagauucaugccuuggauauggcacccuugugucuuucucauccucauuugagacuagauuuguuaacauuaaaccugaauuuuuuuuuuuuaagucuuaacauauuuggccuuuguuuucuagcaugccuugucugugacuuuuaucaucuggagcucugguauuccccuuuuggggcuguuggaguuaauuaaaaaauuaagccuucaaguccaacagagcuuaagggaaaaaaaaaaaagagaaaaaaauaaagcuauuguccuugcccauaugcccuuucucacaggcuucugugagacugcuuacugcaaccaaauguuuauggccaagaaugauuuccuuuacaaauuccagaggagagcgcagugaugcauaugcugaugucauugcuuuagcuaugggaagagaugaugcuguguggcuuguaugaauuugauucagcucuccacugcaguaucacugcaggcauaucuugguuuaauuuagaacuugauauccaagguuaaaaccucacuaaauuuauuagacuguauaaaauugcccagagaaagacauugagaucaucaggccauuucucacugcauccugucaccguguaacaagcuuuauacaauuuauucacaagaaaugaggcaguuuucuggguuuuucaugaauaccauaguugcuaacuucuggguaaguguuaggaauaggggcagcauuguuuguaugacacaaaggugucugucuccccaaauccuccauauuggcauuguagcccaccucccaggguucucccccugugggcuaaugaacucaagagcuugcucauuuuggcauguguucuguugcauggugccuccaggucacacauggacagcacuguaguuugaaauaacugauaacucgagggacuguacuguagaugucucucaguggaggcagguguuuuuguuuuuuucaggauagauuugcagcaugggaugcugcucuaggagugaagugugugugagccguguguauguuuggccaaagccgauuuaucuuuuccaccuguugagcagcuuugccuuugacucucaccacucccugggggcuggucucucuucuuuucaacugaaaggaggccugguagacugacugcauggucaggcuggggaucaagacugccuggaugcacacugaguugugugacccugggcaagucacuagcuugucugugccuuuguggaauggagauuaacaguaccuuccucagacggugguugugaggauuuaaucaguauaugcaugguaagugcuuagaacagggccaggcauauggauagugguaaauaaggggugcuggcugcacauuagaaucaccuggugggugauucuaaucacccugcguggguauugagaacuccaauccuaaugaaauuagggccuggggagguuauaaccuuguucagcaaguggaggagcguuuuugaugucuuauauucugggcauuaagugaaagauccaucugucagcuacauaagcaagagaucauucugugaugaauagcugccuuucacaggcaucuuugaggcugucugacccuucacuuugaggccagauccagugcaauuuaaaaauuuuaauuuccuuagguuuauaauaccaaauuucauucagcuggcauugauugagugccuuuuaacacuuuuugaaaauguccucaaggucucuuuucauaguaaaagcuuaucacgcauacaguggccuccucugagggguuccuuuuucaucugugaugaugguuuauuguguacugugcuuacaguggucuuaggaacaagaaaguuucccccuuaaaaauuauaaugccuacagguggaagagaccugaaauuauccaguccagcaggaaagggaacaguauucuuggugaaauaacaacuuguccagaaucacuuuguauacauaaugccucuaccuguauucugggaguugcgauugcacaucaggaaggugggcaguguaaguuggggauuguagcucuguuguaugacacaagugggaaacaacaggaaggagaaaggaaaagagaauguaauucugagugugguuguuguggagcuaacugucauaaggaggauugggacuuggguuuccgguugcccuaaaccuuacacaaagaaagacucuauggcccuagccacgccuucuacugaguuaugugagaggaggagaccacgaucagacugugguucauacucaaacccuaggugguucuccaggagcuuuuuagcugcauggcuacugggucccugaggugaugcugguauccauaacugcuacacuuucauccucaugcaaagccucccuuucuuugaggcguguauucugugcuguccugaucaccucccuauucccccuacccucaguucauugaggacuuuggaggcagcuauucagugccugagcuuucaagucaggccuggguucacaucacagauuugccuuuacuaauccugugggcuuuaucauugucuggaauuguuccacauccaaauuuuaaaaauucuuuaaaaagaaccagacucuuucaacuuccucauucauuuauuccgacuguguuuguucuuugaucucuuugagacaccauacuuuuucucucuggcuauccuaccucucagggcuucauucccuuccugaccagccuugauuucacagcacaccacucugagcacuccuguacuggccccugcacugugaacuccugaucauugaucagauccugcauucucuggaccaucccuggaugguucuuggggcugagagucagagaagggaauugcacagcauagcuuauuuauuuauuuauuuauuuauuuuagcccaagugcuguuuauuuaaaagaacaaaaaagaguggaggcccccuagggacggaugaaacaaaacuagcagugcaagucugccucuagcucagcauaaaagcuuguugccccacugggccaucuuguuguugauaggcaucuucaagaagcagucagacugcauguaggcagcaauuuucuccaaagccucaacggcacaugaaagccuuaagaugugggaacucauccaggcacuugggcucaaacaugcacuuuugauccaggacgucauagaugggaaaauccacaaaggugagcuuuccccugcaaaccaugagaauuucucccaggaacauggagaauuguuucaguuguucagguagcuguuccaaguacugagguuucaggguugguuuuuauuuauuuuauuuauuuauuuuuuuuuuugagauggagucuugcucugucgcccaggcuggagugcaauggugcgaucucggcucacugcaaccuccgccucccggguucaagcuauucuccugccucagccuccugaguagcugagacuacaggcgcccgccaccacgcccagcuaacuuuuuguauuuucaguagagacgggguuucgccguauuagccaggauggucuugauccccugaacuugugauccacgagaaaagagaagccucccaaagugcugggauuagaggcgugagccacugcgccuggccagguuucaguuuuucauggucagaguuguaacagcacuguaucaguugugugcagaaacugguugcuugguucucuaaaauguccacuugaaucuuuucagucuuaccacacaugugcuugccagcaguguagcacaagauggcauugcucugggugaccuuguucuucccguccaugaaguugggcagauuaggaaaguccaggucuagcuugaauaucacauccagccauuggcuucaaucauaggaguuuccuggcauguguaccauuucuccucauaggacauauccgugaacuacaggagcaggcaaauggugugugccagcccgcaaauauuccacuaacccagaaccauagaugaguugcacgauaugaugaugcuacuugugagccuuugaggauaggagcaguuucauaaucggguguuauggccuggucugcagccuaguuuggaugaucagagcuguucagcuguccguuuuauuguuuuugguuuuucugagaaucuccuucuguugcccaggcuggucucaaaggccugggcucaaacgauccucccaaagugcugggauuacaggcgugagccaccaugcccagccagcuguccuuuuaaucucuuacuugccuuccucucaucuacagggcuauccugaaccuucacugcaccucuuaccuuguuuuuaccuuguagacaaaauggaggcaugaauguuuuuagcuuccugcucauguuuguccacauguugucuuccuccucugucaguuguacuugccuuugugucccuuguuguuuggcacaggguagcaacguacagauguaugucgaaugaaaaccugcaauugcuaacccaacacucauuccuuaauuggaaaauuagguuguaacccaauuucugccacuugcugguccaggagagccagggcaaguuucuccauugcucauagccuguagaaggauauuaauuuuacuuaaaguuauuaaaggauaacagucuguuuuuagguacaauaauucccuuugaaaauuauagauuaaaauuauguuucuccacaaccauucauugauguugaaauuggaaaacaaauacuuugcugggguggggagcaaggcagggucugaccauucagaggcccaaagccuggugaaggaagcagguguauaaacaauuaaaauaagaugaagaaggcuucgaagaugaggugauucugugguguguuuugaagugggugggcuuaugaaauucuuuugcuuucucuaauauaucuaaacaucuauguaaauaccuggaugauauacaguacuagugacaauauuggaguuuugucuucuaguuagccguguuuugcugcugugguagggagguaagucucagcuagggagcacucaggugacagggaaaugaagacagggaacuccugccuguaagugagcaggagcucucugcaagacugagcucugccuugcacaguagccauuggccugggagacaucaugauuauugcuggaaaugcugcccuuucugaacccuuccuuuuuuugaaggagaguguauugauuucagauuuuuggcuacugucuuugcacuuaucccuucugugugccuauuugaaauacccaaauaaaaccuaccugcagccagugcuucugaaagccuguuauuugaacagaucuuacuguguuaaaugugcacuucuucauguauacaccaaauuauuuugaccauaaaguugggaauuaguacuugguaccagaauucuuaaauuauuaguccaaacuccuuguuggaagagaauugccguugauuuugauuucccuuccauaauaacccugccacucauuuaaagacuuuuuuuuuaguguuuguuguguguaagguacauugcuagaugccaugggggauuuguggaguucaacauuuuucaccauaauuuugaucuaucaucauauuagaacaaggcaggauguagaauuagagaaaacauaucuuuugaccauuguggccugagaaggcuuuauggaagaaaugguguuagaauuuggauugaacaaaucccuuuacagguauaugaagauggcucuuguacuuagaaggaagcaacuucuuuaucgucuccuccaaaagugaaauuuucuuucugccaaguacuuaucaaaauacuaauuuucuaguaacuugaaauacuggcuaagguaagguguuuuguuuguuuguuuguuuguuuguuuugguagaaacucuuccugaaacaaccuguaugaauguacagaauauuuuaaauauagguggaaggugauuucaccacaauaguuuccacuuaauuuuggugcaucagaacuuaagcauuugauuuccaauuucaugcccagaacucuuuuaaauucauauuacuugugacuguaaauuuacuaugcuuuuuaauaacuuauacuuaaaucugaaguguuuuugcuuaggacaaaacuauaaagaauagaauaguagaauagaguucagcuuguagaauggguuguugaauaaagaaugaaugacuggaucuaugugucuuagagaauaaauuauaguuuaaugucauauuuuccagcuaugcaaauuaagaaaaaccagacuaggugcuguacuucaugccuauaaucccugugcuuugggaggccgaaguaagagaauuacuugagcccaggaguuuagagaccagccugggcaaccuaaugagaccuccaucucuaugaaaaaauaagcagcugggcuuggugguacaugccuguagucccagcuacucuggaggcugagaugggaagauagccugagccugagaagacaagacugcagugaacugucacugucauggugccauugcauuccagccugggcaacagaguaagacucucuuaaaaaaaaccaaauauauaaaaaaaaaagaagaaccaaaggccaauucuuuacuuaucacaauuauuuacggguuguucuagccaucccccgcacccugacacacuuuucuggaugaagcaucuggauccuggagaaguuccguuaguuguuuccagucauauuggcaaggucucugucaauuccuaggauuucucuacuaaagugagggaaagugugagagaaaucuuggaaugucaaaaacucaucaagggcugguuuuucccagccuccuaggaucuccuaggagugaugagacauggcucuugcuuucaggaaauuucuguguacaggguuuuccaugaguuucuagauaacagccaguguaccaucuagcagaccucuuugugugugugugugugugugugugugugugugugugugugugguuuuuuguuguuguuguuuuuuuuuuuuggucucuuacgcuuuguuuuuucuuauuugcuuuagucuguauuauuuauuuuguaggcugcuucagacucccugcuaccaccaccacuuucuuguugcuaauaugaagaacaguucuaaagguguuauacagaaggcaugacuguuaguuacgugagucagacuaacuacguuuuaagaacuuuucaagcuucuaacacagaggauguuuuugaugcuucuuugaagcaaagaagaaaaaugucuuaauuaaguguaccuuaguuuacaguguuucacuuguaaauguugcuacucuggcuuuauuauuuuugacaaaagcagcaucuucagagaauuuugcuuugaggccagguggauaguuugaugggagaagccccuucauuagagcgugcacagaguauguguguuuagguauuugggguaacuggacugagguuuuaagguuaauucagauguggauaugaagagauauugcuaaaugcagcauuuuccucccuaauaucucauugucugaugucacauggauuuaacugaauuuucuugcauuccuugcaagugugaauauauaggaauauucuuugucaauuauaaacugcuauaaauguuuguuaauugcuugauuuggaggaaaucuuacaucuguauucauugcagccugucaacaaauacugagaacagggugggugcgaagccuguguucuggcuucuguuuguaucuguuaaagaauaaacauagucccugcccucagcucucagauucgacuugaaauuguguaaauaggcaguauggcacuccagaagagaaacguuuuacugcuaguacucuucuaugaucucagacaagguggucaugguucugauauugccauugugauuacagacugaaauagauuuugucuuguuuuggaaucaucuuacuauuuugucuaggguguuuuuuguuauauuuuauaugccaacacaacaugcugugcagaauucaaauacauaauguagagagguugugccuguccccaaagacuuggugugcugaaggagaaauaccagaaguaaaaguaagcuuuugauagucuauuuaacuucuggggggcuuaaaagaagaauaugugacauuuggaaaacuuacauguugaaugauaguagaaauuuaggugacuucaggccauuggcccucucagaguaauguuaccuauucaccuuuucuccucaaugaacguuacaggaaauuuacuucuauuauucaguuuuaguuguaguaacuuuuaguuguaguaacaaagaggcuggucuuuccuuuuguuggggcucaggacaggauaccccccaauauggcaccuuggcauauaagagaaacugcagaagaaaggaggucccucugaccuccccuugccuuucuccccugaagcauggucaucaaggaauucucugaccuaucucaccugacagugaguuauaagacucucauuccagagagguccugcccuguacccagaggacaagaagaaucuggacaagcaggccuugcuaagggcccccaccccaauuauuaggccucauucccuuuuuguucaaucaugcuucuacguggcuguccauucuucauuguacuuaagcguaaaaauucaaguuuccuaagucucuggauccucauuucugaaggcucuugugucaugcaaaacuuugguugaauaaauuuguuaugccuuucucuuguuaaucuuuuuguuauaggggugucagccaugaacuuugccaugggugaggaaaagauaccuuuucuccccuacacucucuuccucaaaaauauauaauggaaagaaaugacaucugacguucuucacauuuucaaagacuuauucuuaaguauuugaguucaacaguaccuuuguucuacuugcugucauagaggcuaagguuuuauggggcagaacuugagggauuguuuggucaguauuugaguuauaccugugccuuuggucuauaauauaaaguaggccgggcgugguaguucacaccuguaaucccagcacuuugggaggccaaggcaggcagaucaccugaggucaggaguuugagaccagccuggccaacauggugaaaccccgucucuacuaaaaauacaaaaauuagcugggugugguggugggugccuguaaucacagcuacucaggaggcugaggcaagaaaauugcuugaacccaggagguggagguugcagugagcugagauugugccacugcauuccagccugggcaauaaagugagacuccuucucaaaacaaacaaacaaaaaacaaaacaaaaaccacacacauacacauauaguaaaaaagaacauuauuucuuauguuuuauccuaugauacuuauccauaaguacuuccuuaccauacaguauguugggcuugucauuuaaucugcugagucugaauuacugugucagaaaggcugguuugcaucauuucuauuugguucaagugcaugacagcucaguguucacccuuuuaggggaaaaaugacaguaguugaaguugcuacuggaagggaagugugaugaugcagaagaggagagccugcuggcugccuacacaggugggcuucaaggugccauuuccauugaggaauuuaccacugccuucucuuugguccucagaaacucaauauucuccaugucuuaaauggaugagacugggcaaagugacucccuuuaagaaagcaaagcucggccgggcgcgguggcucacgccuguaaucccagcacuuugggaggccgaggcggguggaucaugaggucaggagaucgagaccauccuggcuaacaaggugaaaccccgucucuacuaaaaauacaaaaaauuagccgggcgcgguggugggugccuguagucccagcuacucaggaggcugaggcaggagaauggcgugaacccgggaagcggagcuugcagugagccgagauugcaccacugcaguccgcaguccggccugggcgacagagcgagacuccgucucaaaaaaaaaaaaaaaaaaaaaagaaagcaaagcucaugagagcuuuuguuuaaagcuggaguaccgauuuguuaauuuauucucagaauugucugucagcaagccagacaguugugugaacuggaccagcacacucucucccuacuauuugcagacuaagaaaggagccaaauuacgaggugucucucagugugaacagaaccagaacaagaaguaguuguaucaugccaaugugugacagcaccuagcuccaacagcccaauguguccauuuccagaauuggauauagggguauguguuuauaagugugcagauaccagauagucuucucuggaguguacugucauuauuggccccuagggucuauuccuauaaaugcuauuugugaccaucccccuuucagugggcauagccuguauguccauuggugacuguuaaguuccaguuauggguuuaaggccagagacgauugaaacuuccaggugacuuuguauagcuccacucugaucuguguuaguuucagaauuuaacuugcugggaagacuuacuuuuuuccuuuccagucugggggaggggaggaugguuccuuauuuuugcacucagguauaaucaguuaaaguugcuccaggucgcaguuugaauagcuuuuuuaagaauauaaaauuuaagcuauuuaccucgaguugcuauuuauggaggaaaacaggaacuggaagaaauacuauagcagauauuugauagccucuuucacuuaagaccacugauguggaagguaugucuauccugaaaauagcugagugccccaaaauaggaaaacagggugucugggaugagauaccagagucagugucaccuaguccuugccccgugugaugccuauucugaguggccugguagguguacugccaacuggugaugaccugggugauuaaucgggagcagcucauggaugugguggggccugagcuuggucaaugauccagguaaacacacggcucuggaagaguucaccaaggcuuggugcaagggaccuugcaugagcuucgguggcauggcucugucaguauuuuucucuuauuuuuuagguaguuuuugcuaaauuauaaaccccaaaguugguugguugaagaauaugucuguguuuaccuaucuauuuauuauuaacuuuuacuaccauuuuuuuauacuacaguguuuuucauuguuucucugaagugugcuuguuaagagaaguuuguguuuuccaucgguuccauauggaaacuauugcugccuuccaacuuuaguguuugcccuuuaggugaaaccuaaauuuuuucaccaggguuuauucaagcagcauuuucaaaaacagaauuaggcucuaagccaugccccuucaguauguaaaacuuguguguaagaugauuuuacuccgauaaccuucaguauggcuuuuuccaaauucugccuaagauacuaucuuucuaguaucacucaguuuuguuugauuguuguugcccaaagcuuucauugaucugugaggagagaccggccugguggaggggaggaaggugguccugcugggcugcugcagauuuggauucuggcccugcuguuaauuagcuucgugaccccuggcaagccagccucccugggucucuguuucuucaucaguaaaacaaaaggcuugggaaaacaaauacaggcuuggaccaaaugauaagaaaggucacccugccuuuuuauguugugugauucuaugaauggcaacacauugggauuccuuacccuucucaacgggugccacaaaacuucugcuuacucugggggcugagagguggugugugguguguuacacugaggccauuugaggcauuugugcuaacuaggcagaugugggagcccuccuacauaggaguuucucccuccuugccucccuuccucugcucccuuccccguccucauuccuccccuccccaccccuuuucuugccuguucaauagagaccugcuugccuucuacuucccuuagugcauuaauaaaggugugaugguaacacaacccacuaagauugguuaccaucugggguuguucagccaucucaucugaguuagcaguggggagagagagcuuaaaggagacuggcuucaugaugaaauaaugguccuuuugucugucucuugcuguagagaugguuucauguuucaucuuagaccugggccauuguguuuuuacaagcucaguacaacccugcuuaaagauacagccuuuucuuuaaaggaucuggccguagugccacaggccuguucuacuuacuucccuuccccaccccaaaguuauaacuuccuauauauuguaaaaacccacuguggugugugcuguuuaauuggguucucugaucaggguuaaaauguguucccacuguauuuauuuugcaaauguuuauaagauaugccucauuucauaaccuuccaaaauguuuuccuugugauuauauaauuaguaacaccuguaaaacauugccuuuaaccauguagcuucuuucauuaucuuuuugauuucauguucuagugccgccuuuugaugaacugggauugggaaacugugccaaauaucuugcaguacuguacccagguuuagccucauaaccuuaauuagauguggaaugcugagaaugcacuauuguuuuuuuuuuuuuuuagcuuuucuaacaacagugaacuucugagcacuucauuaaaaguuauagaacauuccuugugucuucagcauuuaguuucccaccauaguuuauucaaagaaaauuaauguaaggcuuaggguaccuuaauauuaagcggucuguuuguuugaacacaaguuaccucuuuugucaagacacaaguuauauuccaacuuucaauguuuaauuccucuucucucuguuucuuuucuccuuagaaacaaguguugaaaauguuaaaggcugugcugaagaagagccgagagggaggaaagggaggcaagaaggaagcagguaugugugcaagaaugagaagcucagccauggacagcgggcagcaagcugcuccucaccccaggccggauggauuuguugcuuugggagugggucagagaggguuaccuggguuagaacaaacagugugcuggaggcuaugagaaaugaaauaggccagacauggugacccacaccuguaaucccagcauuuugagaggccaaggcaggaggauugcuugaggcuaggaguuccaggaccagccugggcaacauaaagagacacuuuccucuacaaaaaaauuuuaaaaaauuauccggguaugguggcacauacuuguaaauccuagcuacuugggaggcucuggcaggaggaucucuugagcccaggaguucaaggcugcagugagcuaugauaaagccacuguacuccagccugggcaacagagccagacccugucucuuaaaaaagaaaaaggacaggaaacauaauuuugaacuuuauuauaagaagugacuuugagaauugaguuuggguuauaaccaaauccuuucccagaaacuuuaaagguucauaauuuuaauaggucauucagaucuggagggagucaaaguuaaagacauugagggauagcagguguguucaggaauuuaguuucuagaaaucccauucccuuucccacaugauuacauuuuauguguuugaccaacugcuggcugacugguccucaucuuuuggaguaucaaauuuuacuccuaacagguggagccccacuuaaugccagacugcuuguuuucauuauaaugagaacuacuuaauuuggcuugaauuucauucuuguuuguagaguucuggugcauauugucacugugacuuuaauagcauuacauuccuugugcuaaccuauucuaggauuauuuuggugaauacucacugguacaccauuuuucucucgcuagaaaaacuauauauugucuaccuguauugcacaauaaaaauauguuagcaugaauugacuugccugaaauguuacauuucacucuguaaacccauguuaauccagucuccuuggagaaugacugguuuucugaguuacuaugucaaauaauguuucaguuuuaauuucuguuuuaagaaguauguuuauuacuaaagcaucauaaaauuaugguuaacucuuuaauucaaaagaucuugcaaugccuugugauaauauuaaugucuguuguuuccauacuuauauaagagaauaaguggauuucuaacguuuuugguuauauagaaccuagacaaaauuuauuuuuauugcuaauuaucccuuaaaccaagucugcaaaaugacaaacucaccuuaaaaguagagccuuuauugcaaggcugcuguuaaagcuucucaucaaugccugggugagcagacaccaaagaaaaggagaaaccaguuuuuaaugaccuaaacaggagaccauaguuaaccuuagaaaaucaaccccuggcuuugaauaauugauuagaauuguuacucuggagaaauuucguucacagaauuuccauccagggggacauucacccucugcugggucaagaccaaaaugucuuucuuguuaguuuucugaaagcuguuuaaaaauaauaacaacaaaaaacuuuuucaguuuuggcucaucugucaccaaucaugggaacuuuauuugcuucuuuagaagccuuuguaauuuccagcauaaaguuaccuccuaagcugucuguugggguggaacugccaaccaguggguuauuuuucucaggaccaggguccccaagccuaaacucaccagucgguaacaguucuucaaaacaggccuaccauccucuuugaccagugccauacuuagaagaaauagcaauauauuaauaaucuucagcacccaugucuuucagacacaccagacaggaacauaauuugcauuugaaacuuuuccaguuucagagcaugugauuuuggguuuauuucucccuuuggucuuuaaaagcaacuauugcuuuuucugaaucauuucuucauaauaauuuccacacuggcuuuuucacuaauacaaaccaacuugaaagaccaaugggaacguuucccauaaaauaucugcaugguaugugccuuuuugcucuuaacuauaaccugguuguauuaggcuagcaacaaagcagauggaauuuuaaauccugaugaaguuauaucacaggauuguugggggaaauacuuggaauuugaccacucauauguugaguccaugccaguccucauuauauaaguaaaucauagcuaagauuuucuauaaauuaaagcuggcuagucuaccaagacugcucugaaacuuagguaauaucuccugcaauauggaaaaauuuugcuguacuguuuccaauuaaaaccaaucuuuguugcaaagacauaagaaaauucauucccauguacuugaacucauaaucauagaaauuuaggagacaugucuaaaaacuugaguucagcuuuucauguccuuuauagguuguuuuugcaggcaaucuuuuacuacacuuuuauguuaaaccuauuuugagaauuuggaaaaaugcaguaacugagauaaacuuaguauccuucaauggaaaccaaauauuuuucagaagcguugaacaguuguuauucccucauuuaucccuaaaaaaaaguuaucaccuauaucuauagguaaaacuuuagcagguauugaauucaaacuauauguauauaaggauauuugcaauauuauguuuguugguucuuauucuuuugagacagccugugucuuuugagacagacagacucuguuacccaggcuggagugcaguugugcaccaucuccacucacugcaaccuccgccuccuggguucaagcaauucuccugccucagccucccgaguaguugggauuauaggcccgugccaccacgccuggcuaauuuuuguauuuuugguagacauggggguuucuccauguuggccaggcuggucuugaacuccugaccucaagugauccacucgccucggccucgcaaagugcuaggauuacaaauaugagccacugcgcccagcggauauuugcaauauuauguacagugaaacuuaaacuauugaaaaucaucgaguaaacucaaaauagcagaauuccucucuuuuuugugauuaugcauuuuuaccuaggaaaugcuuauagcugggcaaaaaguguuuucagaaggcaauagaggcacgguggagaauguaauuuuuaaaacuuuaccauguuuuuuuagagagcauauucaccuuguuccugcuguuccaucagugcaaaugagcacuauauuuuucuugaccuugaguuuggccuaagggagcaaaaaucaguauuaaaccauaauacagggagaaggccagaugagggcaucuuauuuuuuuuccucucccugcuuuauguuaggaccuugaucuaaaauaagcaaacgaggcacuguguuuauuuuugaagcucuccagagaggccuacaaccuuuaccacguuucuuaauuuuaagugaccuuuacuaucagaaaacauucauauuacuacuauuaaacaguuacuuaguuuuaaaaauuaaauaauuacuagacucuuaagauuaagaguauugugauauuaaaucuggaccuaguaggaguuuacaguagauauaagagccacacuggaaguuaguaucuuuuuguacagcaacacuguuuggaaaaugaauaggaaaaaaagucccauuuuacaauagaacaaaaacuuuaucaaccuaagaagaaauaugugcaagcuuuuuuuuuuuuuuuuuuuuugagacaggguuuugcugagucacccaggcuggagugcaguggcgugaucucggcucacugcauccuugaccucucaggcucaaguaauucucccaccucagccuccugaguagccaccacgcuaccaugccuggcuaauuuuugugggguuuuguugcuguuguuguuuuuuuuaauagagaugggguuuccgccauguugcccaggcugguuucaaacuccugggccuacacaaugcacccacuuuggccucccaaagugcugggauuacaagcgugaaccacugugacuggcuaugcagccucacauuaaagaaaauaaaacuuuauugaaggacuuaaaggaagaccugaauaaguagaaggaaauacuguuuuucugaauaaccugauucauuauuuuaaaccaucuagcuccuccauaauuauguagacauuccauuuaaucccuaaugaaauccccaauuuuuaaagaagacuuuuuuuuuuuugagugguuuuagguucacagccaaaauugggaggaagguucagagauuuucccccacacacgcauagcuuccaccauuaucaacauuuuccaccagaguugugcauuuguuacaacugaugaaccuacauugacacauuauuaucacccaaaguccauagguuacaucagguucacucuugauauuguguauucuguggguuugaacaaacguguaaugacauaucuaccauuguuguaucacagaguaguuucauggcucuaaaaauccuguguguuuuuuuaaaacacuacaaaauugauucaaaaauccaucuggaagagaaagugcuuaaaggaaaaucaaggacaauuugaaaaugugaggcaggugcauauaaauggccgaaccugguucacgugccucggaucuagcugcaugagagagcccggaagaguguguuuggacuucuuggcuaagauuuguacaagauggacuuuacuauccaccaccauaugcauuguggaggauucuucagucauagacauugggcagguucccuccccuucaaaaacuaaggaagcacagauaucuaauugcagcucauuaugguagcuguuacuaccacauagcgaguaaauggcucagcuaauauuuuuuuuucuacuggucuccaagaaaugaaacauaauuugaucuaacaucuaugauguaauuaaagcucacaguugguaguguuucuguucuuucuuuaaacccuggagauuuuguccuuacucuggaagcauuagguggucaaggccucuugcucucuagagaaggcuggucccugucuacuucugucccuucugccuuccaccagucuucaaucuguaguguuuugcccgcuguaauucuccuaguuguucaguauuggugaggaaguagguucaagcugaggcagaacagcaaaguucagugaacuuuuaauugcaguacugccucaauuaaaauacagaaaaaauauagacugauuaaggaauaguuccuuaaugugccaaaauaaaaacuguuuauguuaagucuuuuauuuguaguuaaauuauuugugcuuuauuuuuccccaguagggggacuuaguuugaagcaacuuguuaaaaaaaaauuuuuuuuugaccuuuaccuuucucucauuaaaacccaggugguuggcuaaauacacuuguaaugauguuaauuaaggcauuggauagucucuaagccuguguguguacugaauuaaucuauuagcuuugcaucuaauucuucacuuugaauuucaaguagaaggaagcuguuugccucuaaaguuuaaaagccauugaugugauuguuaaacuugguauuuuaagccauuccaggcugcagccuggcuuucagugguaccuucuaaacaugccucaauacaaaugaugcuuuguuuuauguagaaaauacgaagcugcuuuugauuauucugugcugccacugcccguuuucugugguuguggacuauuuaggaauuuagugcagugacucucuugcugagcuauggauauuugguaucuucuuguuaacauucuccaaaaguguuucccaagcaacaaaacaagcagaaauaauucaguauaaagguauuguauuuuucuuuacuggggcauuuaaacaaauucugcaaaauguuagaacaugauuuaaacauagaaugggacuucuguguuuuuuuguuuuguuuuuuguuuuuugagaugaagucucggcucuguugccugggcuggagugcagugggugccaucuuggaucauugcaaccucagccuccuagguucaagcgauuuuccugcccaagccucccaaguaccugggauuacaggcaugugccaccacacccagcuaauuuucguauuuuuaguagaggugggguuuugccauguuggccgggcuggucucaaaauccuaaccucaggugaucugcccaccucagccucacagagugcugggauuacaggcgugagccacugugcccagccugauuuuuaauaggagcaggaaugcugguuguucccucugguuugauagguuccuucaucagauuuucuuuguugucccucauguaugucacaaagucaagaaaaagcauggacuuugaaauuagaggacacagacucacaucccugcucgaucaccuccuauuuaacuugaauuuggacauauuuucuuaaccuugauuaaacuaccuuauaguuguauugucaggguugaauacgaauaccuuucugcaaaaguguuuuagcuugacauuuggccucugcuagauauccaguacaucuuuucuuucuugagaaaacugugugauaccuuaaagaacuaacaaaacccuuaaaaauauauaaauaaaagauauaccuaauguuaaaggacgaguuaaugggugcagcacaccaacauggcacauggauacauauguaacuaaccugcacguugugcacauguacccuaaaacuuaaaguauaauaauuaaaaaaaaaaaagcuucuuguuccuuuucuguuauggagaagacaggacugaucucagaugaagagugauguucuagaagcuucuuuccaugacuuccuauucccaaauauucuggcaucuccucuggauacuaaaggcucuucucccagcuucagccuuuccccuauaacaaaacuggggaagcucugagucauuugucugcccuguggugguuuaugcuuucaaaauaauguauuuuaccuuuuaaccucuaugaaguacuugcauuuuaugguuuucucuuuaugaaguuaaacugaaaggcuuuucuccuugcuuaaagggauuucgggaguuggcaagcaguuucgagaauagauuucuaaguacaguuuauaaaauguuaucucaacacauccuuugugaaugaaggucuuuauauauggagggcccuugucccccgaccucuucauagcuuuuccauguguuuuagggaaauauaaaggaugaaagaguuaggggaaguagggaacagauaucuaccguuuaucauuaggcaccuacauguaaggcccaagcugguuucaugcugaacugccuguuuuccugguggggggcauacuuggagaaagcucuggaccccagaggaaagggaagucagucacccuggacuaauaagaccuuuuuguggcauaagaucuccagcaaggcaccaccuaucugaaucaucauaaagcaugugauaaaacucucaaacaaugcuucuuuacuugagcugcuuuuuguauguguauguauaaaugccauaggaagcuagaucaguaguaggcaaaugagcaauuccgaguucauuuuuaaauuaucaaaucuaauuuuauuucacaaauuuuuauuaaaacuccucuguaaaacacaaaggucuuauuuuguacagacuuaguuuucagaaaguuccauguauauguaacuuaauucccauaaaaaguuucaucuuugcuuuuccauguuuucuauuugcacuuccuagaaggggaauucuaagguuuuauuucuauccuacaggaauguaaaaaacuugauuucauauaaucuacuggcaaguguaguuccugaguggggagacgggcuacaaaggauucugaaguagauuggcuuuuauuucguggcuggugauccaaacugaguauuccucauaagagucuuaaggggaugguguguuuaccaaccaguugucuugcaguuaaugaggguggccaucaggugaccagcuggguagcccuagcucuggaucagcaucaaauugagaaaccuuauucacauccagaaucagaguuagaacgcagcaucugugugucuucucucucccacuccccucuguccuuuuaggggcaggcuaguuauaccucaucagccaugaaaauaccauuguucuuguccuauguucuggugaccacagugcaguggguaaagguaaaacgagcaacugagcagcugguuuuaauucuucacacucuuaaaguuugucagggaguugcccauuuuuaagggaguuuggagccuucaacugcuagauuugguacauggugaugaucuuuaugcccugggaugucaucaggaaugaugucucugaugugagacaugcauggagguggcuguagugguuugagaucuugucuggguuuuuguagaucacgaaacuggcugauagcagaggcuaagagccuggagguagacuccagguuaaggauggaagagagccaccugcacacagggucuuccugaugauuguguuuuuauuucacuugccaaaauuaaggaauuuauguuaaugcauuguuucuuugugagggcuugcucuucacgccccacuaagcaaauuuucuauaugacuuaucuagaaagcuucuuuccaaguacgagauguuaaaaauauuuugauuuuugauaguacaucuucguguugucuuagucugcuugagcugccguaacaaagcaccauugacuggguggcuuuaacaauagaaacuuauuuccccucgccaugcugcacgcuugaaagucugagaugagggugccagcaugguugggugcuuguagggguugcccucucccuguguucucacaugguagagacagggauagcaaguuuucugguaucucuucuuauaagagcgcuaaucucaucaugugcucauguaacccaaucaucuaaucugaccucauccaaccuaauugucucccaaaggccccaucucccaaauacugucacauugggaguuagagcuucaacauaggaauuuugggaacacaauucaucuauagcacuuuaauguuguuauuauaaacacgauacccuggagaauuggucaugaaacaccauuauuuuauguacuaaggaagaaaaaaagucaaucaauuagaauguuuauuacacuuaagauuuucuuuaaacuacuagagaaguaaaaaugagaauaucaguauuugaauccaugccuaauauuuauauacucaauguacaaaauucgaaaaauacgcugggcccagugguucaugccuguaaucccaacacuuugggaggcugaggcgggaggauugcuugagccuaggcguucaagaccagccugagcaacauagugagaccuugucuauuaaaaaaaaaaaacaaaaaaaaaacuggccagguguuguggaacaugccuauagucucagcuacuuaggaggcugaugugggaggauugcuugagccuggaaagucgagguugcagugagcugugaucacaccaucacacuccagcccaagugacagaguaguaagaccuugucuccacaaaaaaaagaaaauagaaaacacucauaauacuuacaagcaaauaacccaagauauucuguauuuuuugcuuuaucuuuuuuaaauacaaugucauuuuuuuguauaaaaaaaagccuaagauuuuauuguaccaauguaccaugguuuuauuugggcccauuuuguuuccauauuuuuuucauuuaaaaaaccgucuggaaaauacauaccuuuguaugaauuuuauuuuagaauauguuuucaagcauggaguuaauagggaaaggaaaugaacuuuuuauaagcuguuagugccucuugccaaauuguuuucuagaaagcucauguugguugccaccuguguaagcaguaugugaaugugccugcuugcacaauuccuauuacuaggggguauuuguggguuuuaguaaucuuugucacuuuuauagguuaaaacuugcacuucauuguuuuuaauuagcauuucuuugagauugguagaccucuuccaguauuuauugcucuguuacauuucuucuucaaugauugucuuuuucaugcccuuguacuuguuuuuuucuguugggauugugaggggcuuguuagucuuguucuucccuuuuccuaaucuggcuguuguguauaguaaugcaaauuuucuauaugacuuauccagaaagcuucuuggggaauuuuuacugaagucgcugauggugaaacugccuauguucuauagguaaaaguuucucugcguuguuaacauuucauguuugugcugaggcuagagauccacuagucugauuggcuuauauucaagaauuuauaaagaaaccaaaauaaaagcauaaaagcaaccccauugagucaucaagccauccacaguacuugauaacauucugucuuugugcacagccaaagaugucaaaguuccuccucuacccagaugugcuggaagccugacuccugguaaguucccaacaguagauggggauaguuccagcaacauuuccuuaauaaauugcuauaaucauaagugcaaacuucuauccauggcugcaugcucuuagauuauuauguguagagauucuuuuuuaaacuaugauaaaguaaugacauuuugaaguuuuagaucuaggaggaucuuagaaauugaguucaauuucuugcuugaggaagaccuggaaaaagaggcauugagcaacuacccaaagucguauagcuaguuaaagcaaagauggacucagaguguaguguuuguacguuagugguuuauacuaugucuccggcugucuuccuuuauuaucucacaccgaguaaacauaaaggaaaacauaucucuauguuauaucucuauaucucuaucccugagauagaagauagaaaauuuucuuuauaauuucuuccuucagggacguucauuuuguuuuuuuuuuuccuuuagauuuuuuuuucuuuuccuagaaggauuauuugugagauucuuacauggucuugaucuagacugaaucacugaguagacagggucuugcuuugucacccaggcuaaagugcaguggugcgaucauagcucacuguagccucuaacuucuggauuacgcaguccucccaccucaggcucccuaguugcugcgcuacaggcgugcagcucuacaccuggcuaacuuuuaaauuuuuuguagagguggggucucaguauuuuaaagcaaaguuuugcuugguauccuugagacuguccuaauuccauccuauucuaaaaucacuuguuuuuguaaagccauucaaacuccauaaauguaauaguguacacaauuauaaaaacaaaaccuauaugaugguauuaaaacagacacuauuccuauuucuucucugcuucucuuuucgcuccccaaaggcaauuaauguuaacaauuucuuagaugaucauucaagauauuuucugugcuucugugcauauauguaugugcauauggacacacaucaauacauauaucgauccuuaagaaaccccacauggacuuuauaauacaucuuauucuguaaacuacuaugaugauugcauuuuauacauuuuuuucauauuggcacauaucgauauauagccuucuaaaaaguagcucaguguugcauuggguaguuauaauuuaucucauucuucuguugauggacacuuaaguuauauauauuuuuuuuauuacaagucaguucuagagugaaucuccuuguacauaacugccugugcuuucauaagaauaguuguaagaaauucuguuggguaacagguuuguucauuuaaaacuuuucuagguuuugucaaauugucccuuugaaaggugguaaguuuacaauuccaccaguaauauaagagaauacuuguuuuuucauauccuuagguuaugaucaaacuauuucaucuuugccagcaugagaggcaaaaauugugucuguuuuuaauuaugcaguucuuuagaaugaacucaaacacauuuuuauauguuuaugggcuauuugaaaccauacuuccuggguuuguauccuggcuccacaguuuaucagcuaugugaacuugggcaaauuacuuaaccuuucugugcccugugauucacuugugaggauuaaaugaauuacuauuuauaaagggcucaagcccaugcuuggcauauaguauauguuaugucaguauuugucaaaaauuaaaauuuaaauuucuuacucucuccuaccuguuuguuuaccuauuuuugucuuggguucaauagcuauuuuaauauuuugguaagugguuaaucaucugauagcuuacuagcuaaaguucuaagcaaggcaaaugugugucuuguuuaauuuugaauuauaaagccugaaaagauauauguaagucauccuuuauuuuuuauaggaucaagugaaggauuuuguaucaguucuguaaauucacuguugaaaacuaagagguuacaaagcaauauuucauggaggucagcucucuuuauuucccugcuuugucugugaguuuugauucuacuaaucugauuaaaccucuuagagcuacauccuuagcuccaagauucugaagauuagagauucuggaggauuuuuucccccuccauccauuaaauuguuaccaugguuauuggacuccuccaacaguaccucuaauccuucugauuucuggaagcagcaucuuaagggugaauaacucugcugguuugguuucaaaaaacuuaaguaacguaagagucuguuugaauaugccuacaguuuucuuugaauaauuuuuucugaaccuguuuucuugccuacaaaaugaaguuaguauugcucuguaucauuaaguaauuaugaggguuaaauauuuuuuuaaaaaacuucaggcaugauaguguugaagauauaggguuguuuuguuuuuguauuuuuuuuaaaccuaugguauaccugcuuuugggaaaugcccauuaagcaaggaacaauaaaauauauuuguagagauauuuagauuuauauuggggguuuuugguacuuaaauguuugggggagggaugagauaaugcucaagauauuagaaaccagaaggugaaucucaguucagcaaaaagugaaucuuuuggagaaaauaugauagcacuaugagaaguuguuguuguuuuuuaaagagauggggucucacuauauuguccaggcugaucuugaauucccgaacucaagcgauccuccugccuuagcaucccuaguaacugggauuacaggugugagcaaccucacuuggcugaaaagugugugugucuuuuuuuuuuuuuuuuuuuuugaguguuugcuguguuucagacagugugcugcauguuuauaaacaguuacaucaucaauagcuuauuaauagaggucaaaguacuagcuuaagacuacauaguuacugagugucagagccaugguuugaaccuaguuugucuccaaagccuauguuuugggcaguauagcagccaggcugcuuggguucaccugcaucuauacaauggggauaauaacaguaucuauguccucuccauugugaagauuaaauaaauuacagugcuuuguugacaagggcugucccaaaucaauagaaagggaaagggugggcggaguuaguggaagguugagggaacccaucacggacucagacagugccacuuaggguaaagccagugcccgcaauaacaguuuaucaugcucauuaauuugggauuucaaaacacaaaugagaacucacaccuacccacccccaagugcaugucuucaucauguaaaaaguaaguuuccuuugaaaauauccuuuugccccuauuuuuguuuguuuagacaaauaucuaauuuauaagaagugcaugggagggguuuuagaaguuuaacgaauuuuuaaaugagaaaggguaguuugguagucuacuugaaaauguuucugggaaauucccuaaaaacauaggauuuuggugaccuuagcuucuguguuccuacugccacccagaaaaggggcagggcucugcaacccccgggacaaaugggcaccccaugccuauaccucccuccccgagcuaagucccagggcaucugggccuugccuggagacugggcuagcucuguaggcucggagagccuggggaggguguuaccccaccucuuguauuuugggagacagggaaagugaacagacuuccccuucccauaccccucagggugguuucccuaccagucaggcuuacugcuucuagaagagagcagagagugucagggagugagacugcauuucugggcuuagaaguaaaggaugugagacuuguucaguauuugccaucagcacagggaaaaccaggagaaagccuggcuccaggaccuggaggcuucugccccguacgaucagaagguggauagaucuucccacucuagcauggcuagaacucuuaagagucuguggugcuccaucucuauugaugaccccagcucaguaacuauaccugguauauuuccuauguaaaaucuguaccuugaaggcagagcauucugaauaaaguuggaaaaagaauagcuuugcaaagauugaugauagacugguuccccaaaggccuaggcuacgcaucaccccuuuuuccagagcgagggccuggaaugaagacaguuccuccucugccccuggagccugagauuugcuuuggcuccuugagguggaagaggcuaagagugcagcugcccagagcagcucuguguacagcccggcuccucuuggguuucugaugccuuccguggcacugugcccuaucccucagccagccagacggccucccaacuccugaccagcagguagguuuuggagugguugguugguaugguauugugauuagagcagcuuauggugccaagguggcaagcuaauuuucacaggcucacuccaccucgggcucccugugggaaugguaggccaggcccagcaagccaugucccaccacauccuccucucaggaggaagggccagcugucgagccagcagcuaguccauagcauggccuuauaacuguauaaagccaggcauugcccgugagcagagcuggaaccagagcuucagucaguaagagggaggauuaucuucaggagaagacaaggaagaaaauuggcuaucuuuauaguugcacugucauaaccaaguguccacauucaaaauguauaguguccaucccucauguaauggugguuucuggcccaaagugagacuguccuuucaauuagagaaggguacagagauagucuaggugggaaggccagaagugcuggcugcuuagccacugggaccaccuguucuugccccacugccaucuaguagggccaaaguaaaggcuggcugugggugucuguggauugagaauguggcagggacuggugcuccuaccucccucuggccgaagauggggucuacccucugugugcaugucaccaccagcagucauagcuucccaaauggagauguggcaggaaaaaguuuaaaaaagaaaacgggcaacuguauuguguuggggagaaauugaugggagaugagaaaacaguuuggauuuuguguaugggaguauaguugucuguaacuuugcuuauaugcuuuuuuuuccuuuuguauuuuaaaguaagugaaaggcuuuggcuuggaaaacccuagagagauuggaggggcggggcagaaaccugaggcugcugccccuuuaucugccuucacgguacuguccccuucccccagcuccucccuggccccaugggccaggccucagaccuuccagcuaaccgcuucccaagagccacuucucugauguuagccuauaaccaaaggagcugggggauccagguccagugaccagcccuucucagcccacucgaucagggugcuccccaccugcaggcaggaggcaacacccuauaugcuaccaucagacccuuccagagcccaccugcugcccagcccugcccugcccagccaagccauacccugcucugccccaucugggggugcccugcucagagaugggccagcagggcuauacucagccucccuaguaaacagagacuaaagaaaccucugggguccuguuuucuggucgugugaucccaggggugcacacaggccccuugggugucugaacagaagggcaugggagagagggccacaccccugcagucuugcucugcugguguagcgggcagcugcccacugccacccaacccuguaccgagggcuccugagucagcagauuaaguauuuuguaaauuguauuuaaaauacauguuuuaaacuuguuaaaaaaaaaaaaaagacggugcuuagaacagugccugaaccacaguaagcaucuuacaaauguuugcuuuuauuauaauuuagguaauuucuauaccauuuuggcuugcuuuucugcuccuuuacacucuccuuuugaccuugguaagugguggcaucuaggauauuuuuguuuccuagcucacuugucuguguggcaaacaugacccucgccuuuccaucuggagcagaugggggaaaaagccaugguaauaggcauguccuuagcagagugcuguagggaccguugcuguaaacaggcuugggguauauguguucacuaggagacagaagggggcagggauaugaggccugaaugcagggaccuaaaaccagaaaccugugugucuucaaagaugcaugcacauucaaagagucaguguucaccuuuggcuuuacaagaaugggcucuacuguaauuguguagugcagugauuccuaaaccuggcugguucaccuaggcccuugugacucaaauucccuuaagaccuaccgaauuuaguguugggguccaagcaucuauuuuuauuuauauuuuuauucuuuauuuauuuaagacagagucuugcuuugucucccaggcuggaguacauuggcacaaucucagcucacugcaaccuccaccaccuggguucaagugauucuccugcuucaucuuccugaguagcugggacuacaggcacccaccauauguccagcuaauuuuuguauuuuuaguagggaugggguuucaccauguugguucaagaccgccaggcuggucuugaacuccuggccucaagugaucugccggccuuggccucccaaagugcugggauuacaggcaugagccaccauaccuggccuauuuuuuuuuuuuuaaauaacaauuuuugaaugguuagccauguuugggagucacugguaugcuguuuguuccugugucuccacagggccugcccccaccagccauguuguaugugacuuuaaaaacucuuagaagaucccucauuaucuaguaaacucuguuuuuggcaguuacuguaaagauaaacuuggaauacaaauauacaagcagaugagugaaaggguuccauuagagaaauaacaaaggaagaguauuugaucaaaguaauuugucaguguauuuuguuugguucuuauacuuauguugauuuccuugucaacauuugcuuauuuucauacugauacuugcaaguuagauacacaaaaaguaauagcuauugaacguaauuuugaugcuuaauuuacaugccaauuuauagaauuguuagagggcucuuuucccagaguaacacucaaaaaaugaaugaaguaaguaauucacauuccauuuuauauuugagaauucaugauuagaauggaauguuaauaugguuagcuguagucagacaauauugacauuguugcuaagauauuuuacgagacaugucauugagacugcuguuuggaaaacugagcagugaauuuuuuuuuuuuuggugcugaugguggaauagggauaaaguaaacaaaauauacaagaugcauacaaauaagauauagaaaaaugcagucaucagcugggcaugguggcuuacgccuguaauccaaaugcuuugggaggccgaggcgggcggaucaugaggucaggaguucgagaccauccuggccaacauggcgaaacccccucuccacuaaaaauacaaaaauuagccgggggugguggugaaugccuguaaucccagcuacucagaaggcugaggcaggggaauggcuugaaccugggagguggagggugcagugagccgagaucgugccacugcacuccagccugggugacagagcaagacuccaucucaaaaaaaaaaaaaaauucggucauuucauuuucuucgucacuccuagcuccccccccaauacaggccugggaaagaccuuguuauauagccacauguacacggcagauuuagucugcuuuuuucuagaaugugagcuaaguugguaguauuuuugaacauguuuuuguggggaagaaacuuuaaauacugccuagaaacauugaggcauuuuuucccccaaaaugaucccguuuuccuuguaaggaguugaaguaagauaaaugguagcagcucccuuuuauucucucccuucucuuguaaggaggccuuuuggcagacagcuuugcugacgggacugccagaguuuggauuugaguaguuagugagggggugguguacugcuuagaguauuguucuaaaagucuuuuucccuuccacuuauuuuuccacccccaaaaugucagcauguccaacaugacagaauguuccugacaauuaucacucagggaaacaugacuugcuaaauuaucuggggcuaagucagacuuucuuuagcaccaagcaaugcuccaugcucaguauacaccuugguuagggaauaugcuaucugggacaguccagugugguacugugguuaagaguucugacuccggagucaaacuggcuggguucaauuccggaucugccacuuucaggguaggggauccuaggcaacuuagcccuccuccaagccuugauuuccucaucugcagcaagggggcaaugacagugucauuuuaaauggaauggggugaauaauuaguguauucaaguuaauguauugcugugguuuguucucaccaaaaccucaugaauggcuuggugcuguucuccugcaacaagucagaguucuugcucugggaagacugggugaguccucaugggaauggauuaguuccagagagaguggguuguaacaaagccaggauacuucucagcuuuuccccuuugcuuguguccacuucccguuugacugucucugccguguugugaugcauggggaagccauggccuugcccuugaacuucucagccugcagaacgaugagcuaaagaacucucuuuucuuuauuaauugccuagucucagguauucuuuuauagcaacucaaaauggacuugauauauagauguaaagugcuuagcaagaugucuggcacacaaaggaagggcuuaagaacugccagcuugaucaucauuauuagggccgauauacacaaugggcauuguguuaguccauuuugcauugcuauaaaggaauaccugaggcuggguaauuuauaaagaaagggggguuauuuugucucacaguucugcaggcuguagugccagcaucugcuuuggugaggccucaggaagccuuuauuccugguagaaagccaaggggagcaggcaugucacauggcaagggaggaggugccaggcucuuuuuaauaaucagaucucuagugaacuaauagagugagaacucacucauuacugcugggagggcaccgagccauucaugaaggauccacccccgugacccaacaccucucacuaggccccaccuagugcggauuacauuuccacaugaaauuucaaaggggcagauguucaaacucuaucaggcauacacacauaggugaaacaguacucaauguaaauccugucauguuacucaggaaugaaacaguaugugaaguucgaggauaaguggccucuggcaguaaucucagggcuuggugaguaauugggauggagaauggcuuuagcagugggguauccugugguuaguuguugucccuggguuggccucauugcacagcuccgggggcacuauuaacauagacgugacaggugcagcauggugguccacuacuguugucauuucucaugucaccuucaagaaagugcugugaaaaaaauguggaguucucuguuauuauaaauuaagaggguguauuuggauuuuuuuuuuuugagaaaguuuaauguuaaagcauuaacugguugagauugcagauagcuggggcagugaggcuccuuuuaagugcuuugaagcaccuagggugaggcacuagaucuuggacccugcagugucuguagggugaagcugauccagaacuucauugugagaacaaucaauaggaaagaccaucugacauuagagagaucugggauauggucaguuggagcuacauggacaagggcaaguguguggcaggcagacugagcaacaacagugggcauagcucgaggugccugaauaggggaaaagugagaccuuccuggaagaggacucaugacagcaggagccucaagaacuuggcagguguccaauguggcagcuugcaggggaaccucuggaaauaaagggagauggauacaaauuugaguuucaaauaaauguucacuggaaaauaaaguauauuuuauuuuauaaaacaugucagaauauaugucaaacugaaaauguaaaaggaaggggaaaaaaccguucauacuuccacucccuucaaaauaaccaccaucaucuuacugacugccuucgaacuuuugggucauguaucuuacuuauuuuuccauuauaaaagauuguguauacuagcuuaaauguuuuuucuacauguuuuugaaaauguucauaugguaaacugauuuuuuuuuuuuaauuugaguuccuuggcaaugaaaacagucauugugguguuccgugcuacucugcuuguuuagagggguggguggggguaaagagagcuuuccuugcccagcaucccaaucgugaaaaauguaagcuauuguuagcgaguucuggcaggcagcaucaguuauugcuuuaagggucuccagauaaaguaagagauucuuucugcacuguggggugaaggaugugguucaaaaagcccguuccugaaagagaaggcuguggaagaggggcaguugagugaagugcuggaaggccaggauugguuuauacaguuucuuauauuuuuuaaaaaccauaauguccccacuguugaguaguggauucuguuuuuucucugaaggaacuuguuucuuucagaaggauaaauggguuguacauuuucugagcuuuugaguaucugagaauguuuucugguugauaucauguauaauagccuggugcaguuuuagaagauuuggccgugcuuuuuuucucccucaaguuuuguagauguugcuuuuuuuguuuuuccguuuuuuuuuuuuuuugucguuguuuguuguuuguuuguuuuguuuuuguuuuuuuuuugacacagggucuccuuuuguugcccaggcugcuguacaguggcacaaucacaguucacuucagccucaaccuccugggcucaagugguccuccuaccuuugccucccacaggguugggauuacaggugugagccaccacaccuggccaauguugcuuuuuugauuucaggcuuucgguguuggacgggaggggacaaggguugugggugaaauuguguucaccaaaaagguacauugaagucucaacccuugauaccuguuaaagugauccuguuuggaaauuugcucguugcagaugucaggaaguucagaugaagucacgcuagguuaggguggguccuaaucuaguaugacuguuguccuuaggagacacagacacagagggagaaugugaugugaugacguaggcagagauuugaggcaugaaucuauaauccaaggaauaucaaggauugcugaccacaccagaaaggaagagaaaggcaugaacuagauucuccccgagagccuucagagagaucauggccuugccugauaccuugauguuggacuuggagccuccagaaaugugagaaaguaaacuucuguuguuuaggccacccuauuuauggaacuuuguuacagcagccccaggaaacuaacacaaggguucugagugcagucgggcucuggugccuuucagaggcuccgagguuuuguuuguauccuaguaaaacaccuuuuuaaugcuuaccuggaaaccugugauaauuuuucuuagguuuuuagaaaaauuacuuuaucuuguccuuauuucuucucagaaagguuuuuguuucccauaucuauaauauuuucucacauuguuaaaauuuuagcuccuucccucugcuucuuggggaaaccuucccgagcuuauucucuuuaucauggacuaaguuuucuauaguaucaguuuuccuugacuaccugaaauguggaucaugcuuuuuaaauuuccugcuuuucuuuccuuaucuuuaauagucuauaguauagauauauaguauagaaugccuuagucuguaguauagcucaagcuuguccaacccacggccugugggucacaugaggcccaggacggcuuugaaugcggcccaacaaaaauuuguaaacuuucuuaaaacauuaugagacuuuuuuugugacuuuuuuaaaaaacucaucggcuaucauuaguguauuuuacguguggcccaagacaauucuucuuccaauguggcccaaggaagccaaaagauuagacacccccgguauggauugucaucaggaaagaaacacucuaugaagggucuggaggccaggccaucuuauauucuauugaugguaccaagcgguucacagaauuuuguucucagucgucuuugaguguucaagcagauguucucuuuccuuucacuaauaagcuauguuuucucaguccugucauugauuauuuuggguggugguugggggaggcuuaucaaaagagaaaagaugcaaucagccagguuuuacugaucuggagcuguuguuccugcuggugggcacaggguggagauacagaggccgacuccagggucagggguuugcuauccucccccuuccacagugggcugggcucugauguuuuauagacuggagugugguuaggccaccaauuguuuauugcaacaacaaaggauccccuuuugucaucuuuaaaauuacuggaaauucuuuccuuuucuggcagucucuuccuuuuaguaugguuuuuuugcacuugugaguuuucuuacuuuguaguuagauauuuuacuaggguauugggagaggccuugccaggacugcuagccagaugcaguuuuaaaaagaaacaggaauucaugcauuuaucgccugcaccccaccuccaccccucccugcuccuugagcggcuguucccccucuucucuuuacuucucaauuccuugguccuguccugccucauuuccuuccuuuuuagcaucuguuuucuucccuguccucccauuacacuccaacccucaugucucucuuucccucuuuccucccuggcagacuggauguuuuccuagugcuuuggauuauccaugucccaugugagcaggcaucugcaagugugcccacacccaaccaccaacagcagagaugaccaggaccuggaagagaaacagaagggugggaagagaagaaaugccagcugacccagagcccaucaaugacaggacuguggcaggcucagcacugcuggcauccaaccuucagagcagggcacuggcacucuucuuccuguuaugcccguguccacuguagucagcugcaaacaagcuugccuccgagcagugccuacacacaugucacuucgagcacaugcuuuguggaauagagcuucauuucacccacuugccaaguuaggccuuaguagguggcccauuuauccuaaagaucuuaaaauugacacauggcucaauccuugggaauguacauuuaaauauuuacaggaaaugugcacauaggaaaaaauauaaaccaucuaaacguguguaucuuaacacccaugcuucaguugaucaguucccauucccagaggcagccacugcuacugguucgauguguauccuucucgagacccuccaugcauguacaaguguccauguuuguauagauguaaacauaaugugugugccuacauacauauguagauacacauauauauacacauauacccucaaggaauguacauuuggaauggaaacuuuuauuuuaaucaucugcauuacuuaguacaguaggccuuguaguuccuuuucucccgaccucuuugucuugggaaguggcauaagcauuccagaucuuuuugaccaccuucuugcuucuguggcucucgguccuggcugcacaguaaaaucacuuggugagcuuuaaggaccaucaccugugccauuuucccaaccaguuaaaacagccucgcucggcagggaucgggggucccucuguguggaggguguuggaaacugaaucagguguagcaucaguaggccuggcagagccacggaauucaagcugcaguguguuccacaggacugguagaccuggacaagucugugcuggcaaggaaauguagaaucccaaauuccaugcagauugacggugaauccugccagguugccuuccaccacagcuagcucgugacuucacccuucauugggccaggcagaaugaccggagccagcgccacugugcugcagaagcagcaggcccaaaugcugcaagaguuaauaaauguccaguacccacggagaggagaggaaacuagggugcuugaugacuaaacaccuauccuggauccacuucgcuuguauggugacagcaugaggugugacugagagaagauuaaugaucacugggccuggguaccucccaaaaggagugcugcaggagugcuguggagcuaauuaaccagccggcaugaaaagugaaaauagacgagggaacaggguguuuuuuuguuuuuuuuuucuuccccucugugguggcccaguacugugcguagaccuacauauacuauuuuugguuuuccuucuuaaguaugcaaaaugacauaauguugaaagccuuucucaguagccuucuccaaggggagcaauacugagacaguggacucuggaucccgcugccuggguucagacucagcucugauauaugccagaguggccuugggcaagauacuugauccuuucugugccucaguuucuucaucugaaaagggggcuaauagcaaugccuaauuuguggcguggcugugaagauuaaguuuaaauaauauauguauaaugcacccagaacccuguccuggcaccuaauacaucuaaaaaauaaaaagagcauuuauuuuaaauugcaccccucugggaguuugggggugggaguuuuucugaggucauuuauuuuuaaagcacagaaacucuugcaugcugauaugucuuaaaaggaaaacuuugacaauuagagaggaaaugccagucuguuuacucaucuguuucaggauaaggcacauuuguacguuugguucuauaaccauugaguauuaagaauaaaaccaugcggacaguauuuacugaucucuguuuagaucccacuggguggauuuuugaagacaaggauaugcuguccuguuggcuagguuucuuguacccuagggguuagcugcuuucuugccucuuagugguauuguuugagaauuaaucaugauugucugaauaaaguuuuugaaaauuguuuucuuggaugcauuuauuuucaaaauguucugccugaauguuaggagauucuauaagacauaaaauggcuucaagugcuuuuaguuguagucuucugaaggguccaaaaaugauacuggaucuuguggaagaaaucuuucaguuuucuguaaauauagggggggguguguguguguauguauguagaguuaugugguuauacaaccuuuaagaaacauuagugcacuguaaggcggggacugcacaaaaggugcccuaacacauuuaaugcccuaguuaaaugcauugcacaaguuccguuuucuggagcuggauaaacagaacaucuuucuuuuucuauucuaagcuucuaucgccccaccccaccucagccacuucaguggcacaauaaauggaaaucuuauuuccugccucugcagaccuauuuaccugagugucuaagugcacccuugccuuucucaggccuucccuuccugaaauaugcuuuuacuuucaucuccuugccuucguugcccucauuuuuuaaagcugucucuaaugcugcacucuauguacuuuaaucugugauguuggauguugccauucugcauagcugccuuuaaacauucaucucccagauugacauuuucuuccauuaugaauugaaaucccuuuucacagccuguaaugguaaaaacauuuuaaaauaaagaacuguuaucaaaagccauuucugccaauuuaaaacgccuuauuggauggcuuuauucccuuugauaauuuuguuaucuuugcaaacuaugacuuugacuuacuuguaugcguauauauuuuuauuuauuacgaacagagagguucuuauagaugucuguguguccccuugcccuuucuggacuuuuauuuuuggacuuaagggaauugaugauuuuaaaagaagcaaaggaguguguguguaugagugacagaggcuauauguaaccugcaaagucugaaauauuuacugucauacccuuuguagcaaagugugcugacgccuuauguauuuaaaauacucacuaaaaaugugucguuuuggggaucucuaucuuuuuccccaaauuaaagcucuuaaacgugugaaguggugagaauguuagagccugagcugaccgguuguggggagguucuagcugugaucccuguuccucaggguuaccuuccaggccccagucucccaucugagacagugugauugcauuugaugcugugcgauggaaagcauuuugggguaggugggacugucugugguguguaaauguuccaauggaaacaccugccagugaagcuggaggagguaaauuacuagucauugauaacauaguuuucauacccuggagagguugcaucguccuaccuggcauuucugccugcaguaacaggaagggugauugaaaugugcuucccaucacuuaaucaagguggggaauaaaauaggucauaguuaaaagaaaacaguaucuauucaaggguuaagaaauaugccagcugugcugguuguugcagugaaacaucuuuaauuccucuuaaaugucuuuaagcuucugcugaggaauguuacaucuacuggagaaucucuggugucuuguugcccagaaccaauauuguauuguucacguggaugccccuaagagauuuucacuuucugcccguggcaucaucgugaugcuuucuuuguuugaccguauuccccuugcccuugugcaguuaaagcuccuggcuccagagugcuagauccacccagcuuugugcuuccuguucauacauaaaacuucucucccuacuuugugccuuucuaaugaaaggauacuggaaguuagagaucuuuuauugccucugaaaaacaaaccaaacagaacaacauguuugagagugauuauagugagaugguaaaguaaacuugaaauggaaaccccccucccccucccucuucucuuaagccucguuuuauugcagccugcauaaaaucauagugcuggagcccagcugcuccaaaggcugaagguccucaugcuuacagcaugcuuuggaaacucaucugcaccacauuugcaauuaaugaaaauauuugcuuugcuuguuauaaacaaaguuuaugggcagaauuuauaauuaggaaacuuuuuaauucuuuuucccuucaaugccuaauuucucuugugucauguuggagaauuauaaguauuuaagaaaauaaaccuuuucucaaugcuguuuauuucugguggugguacauguauuucucccuucuuuuguguccucaugcaaauuaaaggacuugaaaucuggguuuuuauuuguuuuuguauaggucaguaauacucaugugugaguaggggagacagugccuuuguggccugucaggccaucccacagccauuugacuagcugggucugugauuuagccuaugugagaacagccacagggcaauguagcucucuucaaaccacauggaaaaccagugucaccucuucaaggucccccacacgucuuuuguauguaauguucuggggcuguggccucagugcuuuccaaguucugaucugucucuuggugauucuugccuguacacccaugaauuaggugacgugaugugguucuuguaggcacagcaccugcuugcauucucagugugagagugagguggugaugagaaaacaaccaucccucagcuuuuacaaguuugucgggucagagggcauccggcuccacugcgcgcuggcaucauggugcagccuagcucugccuuaagaucuguuuccucgccagacaguugaagggaaagcagcugggaaaacucgugaccuggccgaaagccucgaggugguuucucaaagauuccagacucaugcacagugcuauaagacuggccccugugguucuggggauuggugacaaugguaucuuacagugcuagcuagcaaaagaggguggaugaagcuuguguguguguggggggggggugggggccagccugggggccacugcuguccacacagccucuaggaggaaaggccucuaacuccugucugcuucucucccuugaggacagaacuuuguccugggcauuugcaugaauguccuuauuuuuguaacgccagugagagguguuuuuuuauuguuuguuuuuuguuuuuuuuuugagauggagucucgcacuguugcccgagcuagagugcaguggugugaucucggcucacugcaaccucugcuuccuggguucaagugauacuccugccucagccucccaaguagcugggauuaccggugcccaccaccaugcccagcuauuuuuuuuguauuuuuaguagagacaggguuucaccguguuggccaggcuggucucgaacuccugaccucgugauucgcuugcuucggccucccaaaauguugggauuaugggcaugagccacugcacccagcccuagugaguuuucugaucugucuuguuucuucaaaugccagucauuugggcagugagugauaaaucuuuaguuucccagguuuauaaaaaccguccaugcauagguaacccaggagagacuaaaauuaucugacuuugcugacaugcccauuguggggcuuuucuguucacugcucugcugugaguucccuuuaaaaguaaggcaugugcuggccaggcgcuguggcucaugccuguaaucccagcacuuugggggccaaggcagguagaucacgaggucagaaguucaagaccagccugaccaacauggugaaacccugucucuacuaaaaauacaaagauuagccgggugugguggcgggcgccuguaaucccagcuacucaggaggcugaagcaggagaaucgcuugaacccaggagguggacguugcagugagucgagaucgugccacugcacuccagccugggcaacacagcaagacugucucaaaaaaaaaaaaaaaaaaaaaaaguaaggcauguaccuguccuauaugucucauauaaggcauauguccuauauggagggggugacucuacuuccucuugacuccuaacacaaaaaacaagcacagugauaccacuugaaacuugauggucugguuuguauccccuuugagccuuguacacaaaaaucugcagaauuuaguuccugccuagcuaggcagcuuucauuguuucuuuuuuuaaaaucuggucuuugauuguguguguguaugugugguuuuuuugguuuguuuuuggagccaggaaggcguggcaaggacugguuggauagcuuuugucauagagacuggugugcuugugggaaaguuuauacaucuuucaaauucugcucucugugacuuagaguuugaagaugcuuuuuaagaagcagguaaugauuuacauucuuucccugcacauccucaguuccaucuuaguacauacuaacgagcggggaaggugauuggugggaagaagcagucagaggaaaauguguuaucugaauacaugaggacuggcuguauuuuuuuuuuuuuuuuuugggagacuaguuccagccaagauacucuuucuuguauauauuuuuuaacauugugauuacauccuuucugcuucuuaagguucugucuacccuagaauguuguuagaaaugcuuguucccuggugccacaaagaaauagcacucaaacauaaauuuaauuaucucagcaaggcaguuuuuacuuucugcagaaagggugcucaucacagauggaacaauggcgagagcacaccuggacaggggaggggcaggaguucuuauuccugacgcagguagccccugcugcuguguuguuccccuauuggcuaggguuggaccacacagucuaagcuaguucugacugacuguuuuaaagagggcaggggcaugagccagaauggcgggguuuggugggaaggacggugaggaacagguaacuaaaggugacuuaggucagagcaggugaccgggaugagucaggacagagcagguaaccagggaacagacgugaacuacuaauuaggauuggcgggaaaguuguugacugaaacuagaagcgagaagccaaagagaaccaggaaguuaaacuuuaaaauggagaaucaaagaauaagagcugaacauacugacauacugguuuuuuugaggagaaacuugggguuuaccauauuuaacaauguuuaauuuccuaauaguaagcuuguuuguucccaagcuuguuuagggguggagugucaagcggaagcugccuaauaagugagcaauguuuccagucccaugacugguuuggggcuguuugaguuuuaggaggguggcccugugucauggggaguguugaguagaugggaugggagccaagggauggugcuggggaggaauguggauguagacuacacucucacuuagucuuuucuuauuagagaggagcaguggaggccugggaguucuggaaggguugguaucugaaucuguuuuacugauacucauguaaggcuaguaagcccucuccuuuuccuuuucugagaucaaagcuucuuguggaucauucauacuugaccuugaucuaaucccagaucaguggcuuccuggauccuuuguuagggauugaaaccagaucaguuaggguagugcagaaaggcacauggagcagaguucacugaugcuugaguuuucccucacaggguaaaaaguuucaagaguagugggggaaaagucauuuaaaaaaauucaauacacacaucugauaugugggaauuauauucugagaauauaguuuauaggaguuaaauuugcaucaacuuauaaugaauggaugguuuaaccuaaguauucucucucuacucuaggaagugacuuugguccagagacuucuccaguccugcaccuugaccacagugcugacucuccugugagcagucuucccacagcagaggacaccuauagggugagcuuggccaaaggugucucgaugucucugccuuccucaccuuugcugccucgacagucucacuuggugcaaucaagagugaacaaaaaauccccagguaaacaggcaaugaaggagcugccuugguuauauauguaguaccugcauugaaaauaagcaaaacuagugcccaugagaaaucuucugggacaauguuuuuucuuugucgcaguaucuucuagaagaaauaaaucuuuuuuuuuuuuuaauuuaaggaaaaaguaugguuuuaauagauucauccuguuuggacuaccaggcuagauuuuuauaaagauuaaagauuuuguuaucaguacugauguuaaccagcaauuuuguuguuuucuugcugaugaauuaaggagcacuauacaguuauggcaccgacuaaugauguuucuuuugaucaaugacaaacugcauguaugaugguggucccaugagguuauaauacuguguuuuuacuguaccuuuucuauguuuagauaugcagauacuugccacuacauuaauaguugccuacugcauucaguauaguaacgugcuguacagguuuguagccuaggagcaauaggcuaugccauauagccuagguauauaguaggcuaugccaccuugauuugugaaguacacuugaggauguucgcacaaugacaaaaucaccuaaugacgccugucucagaauguauccucaucauuaagugacacaugacuguaauccaaacucauacgugguguguuuaaagguuauggauguaggcaaaugucaucugacaauagucuauuuauuacuaccuaguauauacugauguauuucauuugauuacaucaucuagcauuugaacagcuauaaaguuuguuugugaaaacucagacuuguaaaggggggugggggaaacagacuuuggauuauuccuauuauacuuuggaaguauuuuggcuucccucuaucaauguguuuuacacuuaacauuacccaaaaaaaacaaaacagaacuuugagagguuaugauucacaugugaggaaagccuuucuaaaaugcugauaccuugaguuuuaaaaauucuuggauuuuuuuuuuuuaagguuuguggaguguuuacaaaaggcggauaauuuggggcccaguugaucauaugccaguguaaggauucuucucaauuacauguaaacauauucagaaucuaucaaaaaugugccuagggcugugaaaugguaucuguuucucugauuuccugguaauauuuguauuacuugagaucaccuaugcugacucauuuaguagaucuuugagguuuaugugcggguaaaauuaggagggcacccuuaaaggcucugaauguuagaaacggugcuaugaauuugugaguguccaaaaucuuuuauuguugcagaauuuucugguuuaggacaacauuguuuacaauccauuaauuagcuggaacucaggaaccuuuuugguaugaaguaauuuccugugccaaggaauuugaccuguuuaucaguauuuggggaaguuccuggaauguccguccuuccuucuuugcccucccucacugcuguaucucuuugucacauuucuucucuuccuucaaaucauaguucccacacugccugucauacuggguuauccugauuggaauuacucuucccaaaaaguaugcacaguguuuuacuuuuucuuuauuaucagguacgucauuuguccuuuuccccugaauuaguggguauauugaccaaaaaaaaaaacaaaacaaaacaaaacaaaaaaacuuugcuuggcuacacuguagucaugcuccugaacuuucuccuaggucugugugugugugugcgcacacauuuucuuguaaaauccagguuuagcuaagaagcaugcuacuaaguuuagcaagaacgccuccccacccccacccaaaucugauuagauuccucauccuccaccaucuuccaggugacaucuggucacccugaccugucuuuaacaagaauugccuuccuaccccugauguugccucuuaguaauuuuucaugcaccgauaccuacccuguuccuuggcuauaaauucccacuuccccaugcgguauuuggaguugagcucaaucaacucuuucccuaacugcaaaauccuacugcauuggucccuauauguguuaagaugguccugaauaaagucugcccuacuaugcuuuuaaaaguaucacugaguaguuuuuucuucuuaaaaacauuaugugcuuccucugucugaugcuugaggacaaacaagaugucuuauaccucaucucuauauaauagauaauagagauaauucagaaacuaucgauauuuuuaagggaucucuguugaagguaaugccaagugcagagauuugaccuuuuguacaauuugccuaccuauagucugugcuacugcaaaugaauuaauguugcuugggccuuaggacuggggaaaaccugagagacuucagggaagacugcaugucagauauaauuuuauucacaaauucaguguuuuagugggacuuuaggugggauugaauggcauggcaagccuggagaguguggcuacccagaaagguuucauggagguuacaggcauggaggcagaagaaucccugaugaagccaugucuccuuauauguguguggaccacauuaguuuuugucuuuuuucaagaaaauauccucaaguuuuucuccauaggaaugaaauuuauuuuugcuaaauucuuugcaaggccuuagaauagaagguuaauaguucugaaacauacaagcuucugguggauuugggauguucucucuauuagauguuuuugguccaaaugauaauuaaauaaacuaagcagauacaucucuaacggagcagugcuuguucacugcccaaauuuguacagcaaauuagugucucacagugguaauuuggcuucauuaucuugguaauuuuaauuggaaaaguuuagggcagagaugcuguuuaaaaauggcagugacucaauacaucaaaugaugaacaguauuuuuuuucagugucuaacacagauuucugcuuaaaccauuuuguugguaaaaguauccagagcucuaauguucuaccugccugguuuuaauaauuuaaaaaaaaaacugacauaugguugugaauguguacuggauuuaaaaagacucaucuauuuuaaaagcuagcacuguugcugcuaaugauagagucaauacagugugucugcagcacccagagguauggagccacuccccuccucuccuuccacgcuggccccacagugggucaugcuccagggucgugccaucauucagacaugugcuccgaaacuaccuugaugacuuuuguucugauuuguaagaugccccccaccccugccaauuccucucuuguucaagguuaaaaaacaaaaacaaaaaaaccaaacuuguuucaguuguuuguauagaaacucuucacuaauugaugcuaauccagaaacuguuagggacuggaacaauuauucuugcaaggaucaaauacuacaaaccccuguaagaagacacucugaacaacacagccuguaauaauaaaaauauguauguuaauacaauugaugauuacuuccuggaucuugggaacugugggccagagauaauuuaauuaaccuugcaauaaugugacccugcauguuacaugauugaguuucuuacuuuccacucauauugagguuauuauuuuuauuuacucuucugccaccuuccuccauuuauuugguuuuuuuuuucauuguuagaagauuguuuucugaguauuguuucaaaacuuuuguuuuuaaugguaaauauauuuucuguuaaugaaaacaaggaccagcauccauuaaaguaguucuguggcaguugcaagucuuuuuggauuaagaauucaucaauauuuguaaugugugcugcuguuuuccagagaagagaaaagcucauuuccugugauuuauuaguaauaucauuagauacuuuauaaaguaucugcauuuauuuucccagaucacucugggcccauuaucaaacaaucaaaacaucaugaaugaaugagaagcaacccuuugaaaugcugugauggaguaagacagcagauggugacaagugggcgauacugcccuacuccuuguauggagacacuggagagugccggccacuuccgcuucugccgauuccaguuccaguucugucucacaguggacauagcugauguagcaguuuugaaaacuucucugccuguuuuguuaagggaaaaaccacuaaauugacaggcuguggaguagaagccauauugucucuuugauucuuggaccaugaguuaaugucugcgaaggcacucccucccccaacccgcaaguauuucuuguagaaaaucuggaaaucccaucgaaaaagaacuacugugaacaucuuuucuucuagucuuuugaaaaaaaucugcuccaccuaaaccugagaccacauuauguaacccucuugugugcugcuugugucacuuaaguuuuuuuuauuuguuuugagacaaggucuugcugugucacccaggcuggagugcaguggugcuaucaaggcucacuguagccucaaccuccugggcucaagcgauccuuccaccucagccucaaguagcugggaccacaggcaugcaccaccaugcccagcuaauuuaauucuuugcuuuuuucuuuuuuuuccuagagaugagguuuuugccauguugccuaguuuggucuugaacuccuggccucaagugauucucccaacuuggccucccaaagugcugggauuacaggcaugagccacugcacccagcucuugcuuaauauuuuaucacgagcaauuuccaguuuacuugaagaguuugauauuuguuguccauuguuucauuauuuuauaauugauuuuuaaacauuucugauuguuggauauuugcuuuuuuuuuuuuuuuuuuuuuuuugagauggagucucgcucuauugcccaggcuggagugcaguggugugaucugggcucacugcaagcuccgccucccagguucacgccauucuccugcuucagccuuccgaguagcugggacuacaggcacccaccaccacgccuggcuaauuuuuuguauuuuuaguagagacaggguuucaccguguuagccaggauggucucgaucuccugaucccacgauccgcccaccuuggccucccagagugcugggauuacaggcaugagccaccccucccagccagauacuuacuuuuuaaaaaaauuuuuagcauguuauaauguuuucgcuauuccuggugugaauauuuuuuaauuauggugaaauacauauaacaaaauugaccaucuuaaccauuuaaguguacaguucagugguaauuacacucacguuguuguacaacccaucuuuagaacuuccaacaggaauacuuuuguccagugauauuuacaaacaucucugauaucuccuugggguagcagguucccagcaguggaauuauugaacuaaauggccugcauuuauaaagagucuugauacauagugcccacuuccuuuccagaaaggcuguauugauuucauauuccccccagcauucuuugaguggcugcuuuuugaaauucacaucuucugggaacagcuuaaauggauggugcuuugugcggccuaacuguggacuacugacaauuuuaagaggcugagacgucauucuguagcugccuucuuuagaacuucccuucugucugcacuucucaggcaauuuucauuuucuuucuuugcaugagacugugucgggaauuaugacagcugagucagaucaaguucauggucagaaaaacauucaguuggcucccaguuucagccgccuggugcggauccuagagaucauggagguucacaggcauguuggaguuggagaggccuccagagcacauccuguccaggccucuuugcagaugugcaagcaaagaccccuuggucauuagggaacuuguccaaaauucauacaaguuauugguagacccugauccuccaugcuguccccagcgucuucucuuaugucagccagccugugccgauguucugccuguacguuguuggcuugugagcuguaaauaaugugaguguguucugauuucauagaaggugugggcaggaggagggcaugggcuuaaagccucacauggauccaugaggcugcuucuuggagggugaagaauaacacaggacaugcacagccccauuucuccuuguagagccagcugguucuaguccuugcuuccacugcugagugguugggaccacaguugacaucuaaccuucagaaaggauaguuccuccugcugaggugaauaggagagcauucuuuguuuccuccuggaaacuuguuauaugauggccuccuuacugcgugcccagcugugaacgugacgcacagauuuucuguuguacuugaacauguguucauacauagaaccagugugcaugcauuugcuccacuucaaguccauuuauuccccugccaaugaguccugguucaccuguauacaauuuggcuauacucuggagucagaccaggaauuuuaaaggguacugaugaugcccagcuccuacguucagagacucagauuaaaugcauaugaaguauggucuggacauugggauuuuuaaaaaggcuuccucggugauucuaauauguaacaaaguuugagaauuacugauaaagaauaugugauuaucucauauaauugcuuuuucaugaggacaaauauauguguauauauuuguuuugagacaaggucuugcugugucacccaggcuggagugcaguggugcuaucaaggcucacuguagccucaaccuccugggcucaagcgauccuuccaccucagccucaaguagcugggaccacaggcaugcaccaccaugcccagcuaauuuaauucuuugcuuuuuucuuuuuuuuccuagagaugagguuuuugccauguugccuaguuuggucuugaacuccuggccucaagugauucucccaacuuggccucccaaagugcugggauuacaggcaugagccacugcacccagcucuugcuuaauauuuuaucacgagcaauuuccaguuuacuugaagaguuugauauuuguuguccauuguuucaguaucuuauaauugauuuuuaaacauuucugauuguuggauauuugcuuuuuuuuuuuuuuuuuuuuuuuuuuuuuuugagauggagucucgcucuauugcccaggcuggagugcaguggugugaucugggcucacugcaagcuccgccucccagguucacgccauucuccugcuucagccuuccgaguagcugggacuacaggcgcccaccaccacgccuggcuaauuuuuuguauuuuuaguagagacgggguuucaccguguuagccaggauggucucgaucuccugaucccaugauccgcccaccucggccucccagagugcugggauuacaggcaugagccaccccgcccggccagauacuuacuuuuuaaaaaaauuagcauguuauaauuuguuuucgcuauuccuggugugaauauuuuuaauuauggugaaauacauauaacaaaauugaccaucuuaaccauuuaaguguacaguucagugguaauuacacucacguuguuguacaacccaucuuuagaacuuccaacaggaauacuuuuguccagugauauuuacaaacaucucugauaucuccuugggguagcagguucccagcaguggaauuacaaaaagaaguacaaaauaaugaaaguauugagucccucuauaccccgcaaaagacaaccacuuuugauggucgcuccugcuuuguuucuauaguacguaaccaacaguaacacauuugcccauucccccagcauuggacagguaagagguccccuguuuucugcuaaaaaauaacauucuuguauauuaagauuuaaaggcaucucugauauuuuuaucagacuaugaaagugaguuuacugggccaaaacuuacuuguuuaacauuguagaugaauuauuauauucuuaauggccauugguaacuuuuucuuuuggaaauucuuugugauaguuguccuuuauucuacuaggacaauauguguuucuuauugauuuagcacagcuucauuguuuuaaggguaucagucauguauguuuaaaaaaaaaaaacuguuucugguucguuuuccaucuaauuagguuacaguguuuuaugacgcacagaaguuuuucauuuucuccagucaaauuuauguauuuuuccauugugauuuauuccauugcauuuuuuuaaaaaacagcuuuauugagauauaauuuacauaccacauaauucacccauuuaaaguuuacaguucgauguucuuuuuguagcauuuucacaggguugugcaaccauccccacagucuuaauuuuagaacauuguuaucuccuccucaaagaaaccaaagcaaaaaaaccccauacccguuacuagucauuucacauuccgcccugcccuuacucuucacucccuacuuccuagccccugguaaccacgagucuacuuuaugucucuugauuugcuuauucuggucauuccauuaaaauggaaucauaauaugugguauuuugugacuggcuucuuuuauggagcaucguguugucuagguucauccaaguuguggcauguaucaguacugcauucaguaaaauauuguuugguaauaaaauagaaugaaguacuccuacaugccacucguuuuguuuauccagucuuccauugguggguauuuuguuguuuccacauuggcuauuuauuauauauaaagcugcaaucagcuuuugugucugcauuuuuauauggacauauauuuuucccuuggguauauaccuagugaaauuguugaaucauaugguaguuccguaaaaccuucuuaaguugccgccaaauuauuuuuuaaguggcuguacuauuuuauaucacuaccagcugaguaugagguuuccaauugcuucauauccuugccaaugcuuguauugucuuuuuuauuauagccauucuagagaaugugaacugauaucucauuguagguuuauuaaguugugaaaauuguuuuuauauucugaauacagauuccuuaugagauaaaugauuuacaaguauuuucuuccauucugaggauugucuuuuuuacuuugauuuuauugguggcuuuuuuguuuuuuguuuguuuguuuguuuguuuuugagacggagucucgcucugucucgcccaggcuggugugcaauggugcuaucucggcucauugcagcuuccaccuccuggguucaagcgauucuccugucucagccuccugaguagcugggacuaaaugcaugugccaccaugcccagcuaauuuuguauuuuuaguagagagggcauuucaccauguuugccaggcuggucucgaacuccagacaucaggugauucaccugccucagcuuuccaaagugcugggauuacaggcgugagccaccaugcccagccgcuuacaguguuucaaguacagcaguucuaaauuuugacaagguuuuaaauuuauuauuagucugucuuuuugaugucauguccuaguaaccguugccuaauccaaggucauaaagauacauaucccuguuuuccccuaacaguuuugacucuuacauuuaguccugugauccauuuugaguucauuuucuugugugaugugaaguagggaccaacuucauucucuuucacguggauaccaguuguccuggcaccauuuacugaaaagacuguucuuuccccacugaauugucuucucuugaccaaaucauuguugugccuucacccagcccuauuguuccucuucccccauugcucauccucuggaaauuccuaugccuaggucagaaccuucuccuuaggaguugaccguggguauggcuugcaucucuugcuugguccagccuuucucugugccucuccuuuucucuaggugagaaguaauauccuuuugcuccgagcaucuguagcacugugucuccuuuuugcucugcauaacccuuuauuucgcgucucugcccugacauucugugacauucucuguaaggacugcugucuugucuuuguugacaucuugucauucccccuugggagcacugaaaacaggauccaauuguaucuucagaauccaaucacuuucuuuauccuggugauggagcauagguaaguaacuguuaaaaccaauaggauuuuaguauuuccaugcccaucaguuccaugugauugguugaaaauacuaauggacgcauaggcaauuuuaaauguaacaguccuuuacauuuagaaagcugggaauguaccuuuccccauauccagagaaaagugacgcuuuagguccagccucccucuuagggcuuuucuguccaggcgcugagcaaaagggagugugucuucaacuggguuugucaguagccacucagccuugcuuuccuccacuccugucucucucccauuuucacgcuuuggcauuuuuugcugcccguuucccgccgccugcaguuaaugaugacuggguuuuauccagucacacuuuacagcagugucagcugcacccugugguggugucagauggcggcuggaacaaacccaguaccaugcucagaaaugaauguuuucaccucagagaaaauagaugagggcaggggccuuggugguggagaucuuuuucaucauuucugauuuacagagaaacagaagucacaggagcccaugcaggugauuauaucuagugcuaaugagcacuaguguaaagcagaaauaaacaggaaagaaaaccugauauuccagcucgacucaucagguuugcugugacaggacugcgcgugcgucugcgucuguuggcagggguggcuggcugccuccaggcagaggggcagccaggguugugccaaguggaggugggaaacuaagaugaacacagaguggugauuucuagaagggagagcccagugggaaccagagugccuuacaaaagggaaacugguaccuuugggaaaaacuucauuauuagggucuggagcacugaaaccagaaagccuugccugggguggggccuaucgagauaguuaacugugccaugcagggagccccuuuucuggacaagggcucugagaaguauaauuuaggaaacacucuucaaaggagaugugauuuucuuguuacuuccaccaccaacaaaguccucuuuauuggucacagguccugaguacagcuaaugagcugaccuuucgaagaggcuaggagaguaaguucaccacccuaaauccagaacuggugagacugcaguucagcuaaugagaugugaaggguccugacagaugcaggcugucucugucugccccagucaugagugugucugucugccccagucaugggcagguggacgcagcuggauucaugucccggcucuguaggcuugagcaggccauagguguuucuuccucugaaacaugggguaauaauggggcuucuaagauguuauggacugcauguuuauguccccccaaaauugauguugaaacuguaaccucuaauuaggaugcuaugaagagauggggccuuugggaggugauuaaguuuugaaaucaggaggguggaaccuccaugaugggauuaaugcccuuauauaagaagaggaagguacuagagcucuuucuguuagccaugugagaauacgguaguucuuccuuaucugugguuucaguuaccugcagucaacugugguucaaaaauauuacaugagaaauucuugaaauaauugauaagucauaaauugcaugccauucugaguagcaugcugaaauccagcucuuuccagcccaggacaggaaucuucccuuggcccaguguccaugugcugcacacgcuacccuccuguuaaucacucaguagcccucucaguugucaggcugacugucacaguaucacaccacauguauucaagucaaccuuauuuuacuuaacuguggccccaaagcacaagaguggugacgcuggcaauuuggaaaugccaaggagaagcuguaaagugcuuccuuuaaguggaaaggcaaaaguucuugacuuaauaaagaaaaaacauuguaugcugagguugcuaagaucuauaguaagaaugaaucuuccaugaaauuaugacaaaggaaaaagaaauucaugguaguuuugcugucauaccucaaacugcauaaguuacugccacugugugugauaaauucuuaguuaagaugaaaaaggcauuccauuuauggguugaagacaagaacagaaaaugaguuccauuuguuggcaacauguugccaagagaaagcguugagacuauggagaaaauucugcaagagagguccccugaaaugagugacacaaagccauuuagugcaagcgaaggauauauguauaggaaaaagcauaguguguauacaggguucaguacuauccucaguuuccacuggaggccuugguauauauccucugcagauaaggaggcacugcuguacagugaguaggcacuguccucagacacugguucugcugguuccuugaucugggacuucccagccuccaaacugagaaauaaauuguuguuuaagccacccaaucuauguuugguuuuguuucuuuaaauuuuuugaaaaagaugggguuucaccauguugcacaggcuggucuugaacuccugggcuaaagcaauccuucugccucagccucccaaagugcugggauuacaggugugugccauggcacccagccuucugugguaugugaaaaguagcagccugaacuaagacauaggacaagugaaauuuaaacaagauguagacuguaaaguguagggucguggugguugcaauuuccaugucaccaucuucccuggagcccaucuucagcuucccucgugugacuuggucgccaugaauggauucccauaguaucuguccccuugauuguuuauccucagucaaaugcccuccagugggauuccacccucuggucuguguuuucuggcaagcaugugucgucuugacaugcagcacagcccuccuucggggcuuuguucccugggaauaggacaugaaaguggaacacaguggguuccacuucuagcccugcugccagcuucuuggauuauucaucuuuuccugguuugcacaugauuugugugaagugauuaaaauguuauguauguagaauuacccuauacaggaagccagcucuuagaacuggugaugugaguauaaaggucuaagaaagcaaugguucuuggcagaaaagagaaacacagguaaagcaaaaaggcaggaugccugguggugcccugccuggguaauuugugaagcugccaugugcacacuauggaaaugagagccugugauucaugaagcugauggagaguauaaaugcugcaaggugguccagguuugcucuccaagcaaugagaacaaaacuccgguugaaacugagcacauagcuacauacuguucaaagcugugcaacacagcagagaaacacaggugcuccuuacacagguaagugauaaagucagcacuugaggcagaagccuuugugucagguuacccuugaacaucccucagauggcuuaaaugccaucugcagacaugcugucucuugauggcacagccguuguucugccauuuaaacagauuguuguuuauuuggacgagcaccagaugaaguagauagcuuguacucaggauuacacuguaccagaaacacauaccugguacaccagaaucccguauaggaggggcacguggggcugagacgggcugagggaccagcagaugagucugcaccacaguuggcagugcugccuccuccucuuagagugcacacaauggaaugcaagugaggucauugugcccuggucacaacugcaccaugaugccagauggaggcguccucugagaacacagcgaguauuauggaggcuucuaucuugggcuguuugaaguuuguuugauguuucaccaggacuuuggauguaacacuuggauauugaaggucuuugguaaucacagaaaaauauaugcccauuguacgccuuguagagucuaguguuaacauuugauacagaaauuguaugucuugaagugagacguacaaacuagaaucuccuguugugucagucagaaagagauuguggacuacagcucuucagugaaaauucaguagggauuucuuuucuugaaaguauuuuuacaaaauaauucacuuuuuucaguuauacaguugcuauuagagcagauaugugcacucagaguugaaugaauguguaugcacucauauguacauuaaaauuugaauguaggcaugcaaaauauucucaguaaguuuuuuggguuuuuuuguugguuuguuuuuuguuuuuguuuuguuuuugagacagagucucacucugcugcccaggcuggagugccguggugugaucucaucuugcucggcucacugcaaccucccccucacaggugcaagugauucuccugcuucacccucccaaguagcugggacuaugggcagauuccaccacaugcagcuaauuuucguauuuuuaggagagacaggauuucaccauguugcccaggcuggugucaaacuccugaccucaggugaucugcacgccucggccucacaaagugcugagauuacaggcgugagccacugcacccagccuuuuuuuuuuuuuuuuuucucguuuuccuaagagacagguucuugcuuugucgcucagcuggagugcaauggcacaaucacagcucacugcauccuugaacuccugggcuccuggguguaagcaguccucccaccugggucuccugaguagcuaggacuacaggcacaugccaccauggccggguaauuuuuuuaucuugcauuuuuauagagauaggguucugcuguguugccaggcugcucucaaacuccuagccucaagcuaucccccagccuuggccucccaaagggcugggauuacagguguaagccaccacacccagccaguauuuuuuuuuuuuaagguugugaaguuuaagcagauuuuuuucuuuuuaaacuuauggcauuuuuuaaaaaaauuuuuuugagacagggucuugcugugucacccaggcuggggaaucucggcucauugcaaccucuuccuccugggcuuaaucgauccucccaccucagccucccaaguagcugggacuacaagcaugugucacuacgcguggcuaauuuuuguauuuuuaguagagaaggguuuucucugccucacccuguugccuucagccauauugcccaggcuggucuugaacuccuggacuugagcaaucuucccuccuuggccucccaaagugcugggauuaugggcaugagaaguuuaagcaaaucuuagcugcauuagaugauuuuaguauauugucccuuuuacugccuccuaaacagaaaaauucuacccaggauauuguauuguaggaggacagacagaccuggggucaaucccaaguccuuguucuuaguggcucuguuuccuuagaagaguacuaaauuaaugucucuaauaguugguuuccucauugagaaaggagaauaaccuaccuaccauaugggucuuugagaggauuggaaggaauguaaagugccuggcuccuagaauauguuggaagaaugcugcccuugccauguuccaucaaacugguccugacaucugagauugggguaaaucgccccuucugccuuuuauuguccucucuccuguaucauccucuuuugccuuuagucuguuucucucaccuggagaauagagaaggcaccacuccuucaguggaggacucuugaaaucuaauugcuugccaggcacagcagugcacuuguaaucccgauuacuggggaagcagaggcuggaguauaacuugagccaaggaguuugugauaagccugggcagcauagugagacuccagucucuuaaaaauuuuuugaacaaaaaaaucuaauugcugacauuuggacuuggguuagcaaauauuguugaaaccaugaaaaccaaauuauucaucauugggaucugaguuuuugaauugugggcacggcucuguggaugagcugacccaucuacagcuucugugggaagggucuugccagauacuuaauugguuuucauuuccugaaguguguguugcuuccagccaaaugcuuuaugcuuauuuauucuuaguccuauuguagcuuuuauuaaaagugauaaagaucagugagagcacaaggaaccaaguuuuagaggagugugaaaagcaguucacaagacaacgagcugauaccaaagauuauggggacugaagguagggagccaaccaagcacccaacuguccuccugaggggaggacagauguggccuggcuguaaagagaugccuugcaggggccaccugagucccauaagauugucaggaagaaaugauaucaguggccaggucaaggagcuauccauuaguuucugaggauguaauauuuacuaauauuuacuugguuuuagguuuuacuguacaguuaauuuuuucuuauaguuugugguauuuuaacaggcaagcaggugcuuuuaagguggggggaaacaucuuaacuguagccugaaaucuugacuuacugacaguguugcuaguagaguagugugugauacccagaaaggaaaaaauaaaccuguugaguucaacauguuuccccgaaaugagcaagaaacauauaucagacugcuuaagagaaucccauuuuuauuugcauuuugacacucuuuuauuauuuuuaugguauacuuuuccuguuucuuccuuucaaccuggaaauuauuaguuugugugcccuuugggcuuuaaaauaaaguucauuuuauucuguggucaucucaagagcucuuacucccccaguucuccuggacuuguuuuggugagagccuguuccaggaucccuuucauuguaagaggacauuguauggguggauaugaugacuuuugguggugaucuuuauuuuugcaaauggccucagaggcacucugaguuauucagucuuucacgcagugauuucaugagcuuccauaaacauuuguuuuauaccaguuuauugagcaccagccauguguugggcucuggacuagagaugugguggauauaaagguaaauaaauacuuggcucuaagcucuggggaccucccaguuuggcaagagaugacaacagugaagacauugaggugucuacaaaguguugugaccucacggagaagagcgagacucuccuuucggaagcugguaaggguguguguguguguguguguguguguauguguguccgugugugugugugucauuggaggagccagguguuuuauuuuggcagugauguccuaugacagaguuaagcagaagagggaugaaauaaauagauuugguuucuaggacgguaacuguuucacacaggccuccuugggguugagacugggacuccuugagucaaaugcaguauaguggcuuaacucugcaggggaaugugcagugugguggagguugauuugaaaaaguuuuaggaaaaagaaucuuuagguuguggugaccuguuuguacaugagaauuagggaaggaagaaagugcagaaggaaaguacucaaggcaggggcuuccuaguccuuuuaaucucauggcacauauaggagauuuuuguacagcaaauggaaucaaugaacugucccucgggcacugccccagacucugcccaacgguccggagagcugagagaauccauauccuggcauacccuuaacucauuuuuugcaugccauugggaagcuugccgagcucuagcuugguuuucuugauaggucaagauucaaaauauucuguugugccucaugacuuuguuuuucuccccaguuuaauuuucauaguauuuccaaggugggcauuauuccuguguuuuggguaggaauucuaagguucugaaagguagaauuucagcccucguugguccugggauuccaaguaaugcuguuucugcccuaccacagguguaggugcugguguaauuaacuacaguguggagugguuugacuuugccuaucuugaacuuugagugcuccacgaagccaugcuugugaagagcaccaaggaguugagugcagagucugagcuaagguugcuggccucaagagagaaaagaggauuuugaaacagggcaucugacgcagaggcugugaaggucaaguaugauaaggaaugaaaaguaccuguuaguggcugggcgcgguggcucacacuuguaaucccagcacuuugggaggccgaggcagacagaucaucaggucaggaguuugagaacagccugaccaacauggugaaaccccgucucuacuaaaaauacaaaaaaauuagcugggugugguggcagaugccuguaaucccagcuacucaggaggcugaagcaggagaaucgcuugaacccaggaggcagauguugcaguuagccgagauuguaccacuguauuacagccugggugacagagcaagacucagucucaaaaaacaacaacaacaacaacaacaacaaaaaaaaaaaaacaaaggaccuguuagcuuuuggaaauauggcaauugaugaccuuugagcagaauaggcaaacuuuuucugucaagggccagauaguaaauaucucaggcuuugagggccacacagucccuguugcgacuauguaacucugccaucguaguacagagcagccuuagacaauacguaaaugaguggucauggcuguguuccagugauauuuuauguauaaaaacacucagugguccaauuuggccccugggcuguaguuggccaauguuaacuuuugucucaggaaaggaaaggagaaauggaaacuuagcauuuauucaaccaugugcuagacacugcaugaacauuuucaagccugcagcuuagguaugaaccccacuuacagugaguugauggagcgccccaagagcuuaguuauaacuuugcugaagguuagacugcucguugauaaccaguugggauuugaacuucagucuaauuccaaagccugggucauuuucacuuuacuucauugccacccggaauaguggccuucgaucacucucgaaaggugcagauggcacaggagcccucacacucugccuuuccaccauauccuucacaugaccuucagugaagcaguguuugcugcuuuacccuccucuaugcugagggugaaaggacugucaggaacacaaccuaaauacaacauagaaaguaaaaggacucuccuguaugugacgagaccucuuaguuaccauuaaagcuugggugaacuucuauuuuuaauaaaauuuaaauucagaauagcguuagauuuauagagaaguugcaaagaaugcagaguucccgugcacuccauaccaagucuccucuuauuaacauaggacauuaguaugacacacuugucagaguuaaugaacugauauugauaccuacuaaagucuguacuuuauuccuuuuuuuuuugagauggggucuugcucuguugcccaggcuggagugcaguggugcaaucucggcucacugcaagcuccgccuccuggguucacgccauucuccugccucagccucccgaguagcugugacuacaggugcccgccaccacgcccggcuaauuuuuuguauuuuuuaauagagacgggguuucaccguguuggccaggauggucucaaucuccugaccucgugacccgccugccucggccucccaaagugcugggauuacaggcgugagccaccgugcccggccuauuccuuuuuuuuuuuuuuuuuuuuuuuuuuuuuuaaagcuuauucccaauguccuuuuucuauuccaguauccgagaggacaccauauugcauuuaguugucaggucuuagacucuucuuggcuguggugguugcucagacuuuccuuguuuugaugaccuuggcaguuuuggggagugcugggcugguguuuugcagguugccccucuacuggaguuuuucuguacuggaguuuuucuguacuggaguuuuucucuacuggaguuuuucucuacuggaauuuuucuguacuggaguuuuucucuacugguguuuuucucuacugguguuuuucucaugauuagacuggaguuacagguuuuggggcagaaaccacagaagugaagugccuucugcucccaucuuuugauguacacaguagcuaccuggcuuaucacugucuugacuucgaucaccuggccaacguagugggugccagguugcuccaaggugaaguuauucguuuccuucccucccccuuccauauauuaacaugaacgcauuuguaugcaugcauagaugcuguauguggagugugcuguacucuccagaaggcaggaagucgcugugugcagcccacacuuagggguauggugguguacaccaccaccaugagaguggaggaucuauguaaauuguuuggaauuuuucugcauaggagauuugucuuguuucccauuuauuuucaucaguauggauucccgggaagaugaacucccaguguuguacuugggugugauucaggaguaugcaagccuuucugccccacuuuguugccuuguuaacuaagggaggcugagauaaguccucucaggugcagucagagucuguccuaagauggggguagggaguugcugugccucagugguuuacuuucucaauauagacuguuagccauauguguguuaccugaaaccuuaaggagaaagcauuuuuggccggccuggaaaggacacaagcaaauguagccuugaugguggagaaacgucucuagcagggcugugcaucugaaucagcauugaagcagcgccaccuugugguugaugcugaaugagcuguguauucggccagguucugugauucuuacccugucugcaugcuguucgaguagcuaaaguacuuuagaaaagaagaaacacuuuaaacucuuaaagaaaaagagaagcuaccuccuaacuuugccuuuguacaugacuggguacacaaacagcagacaucuuaaaguaaaaaaucucuguaguuacuuuguuugacauacuguuaaucauguauuuucugguaagccuuuuugucucugauuguucaaaauuguucaauagcugaggcguaaaaguagaauagguuauaaccccaagccucugucauauuuuucuuugguauaggcagauugggcaguuauuuuaauauucauucuucuuugcccccaaaugucuucagauguuuuuguacacaugcguaagagguuugagccuauguaggaaguagccagggagucuacugaaguccacuguaaugugugggaauguggagccaguuaugauuaacagcugucugcauccuggauuguuuaacccauuguuuacacccacucuucagaaccaguggaggugggggaguugggaagaugguuucauaugaccugugguugaccugauugacuguuagcaggugcuaagauggagaucaguuucaguugguuuuaaaaaaaaucaagaagcagccacucuguuguaauaaaucauuguauauucaggaauucuaacuguaauguaaaaucuugaucaccuguuuuagaguaagguaagcaaugacuguaguugcuuuaaccaauaaaaauucgacaucaaccugagcuguagcauguuuaauguggaaacccuguucucuguuuuguccugaaugcugaacacugauaggaagucagaugcgguagcugagaggucacgauggccuggguugcugcaggggacggcagcaggcacucuuaggaggugagcugcggucguggcuuaucuggccccucucacugaugucacagguuaccuaugcaaucugugagugcaauuuguccuuuuuagacucuaaacagauaauggcugagcccccaaauauggcuuugcugcugcgcuugauguuugcaagagggaagagguguuucagauaauggaaagcaugugcuugccagugugagcucaucaacaaugaggucagaggaggacagugccucuugcucgcaagcccagccuucauacugccuuuucuuucagucucaggugcagccuguugugggauuguuagaggccccuugcauguggucugacaugccagccuucugaccaugugcaacaggacugugggcuacuccugacuucagagauagcaucuuuguacagaugccagagaugccagagacacccaggaguugagucugcugggggacauggacaaggacguaggugacaauaguguaugugcuguggggaaaggaugacugugauagcauguggaagguucuagaauucagaggguaacagaaaugagauggcaguccuuaccagcagggugggcacugugggauagggaguagacaaugguggacuuggacuugagggaguaguuuguuuauuuuuuuuuaauuuuuuuuuagaaucuugaacuuccauugaguauucugaaagggagagauugacuuuacaugguggagggacuauuuugagccuuuugauguugagagaagcauuuuauguacaaaugauaugaauuuugcauugcuauucagugcauuaugguuaaaaauuuuaaauauggcuucucacaagacuuaaaauucaaugugucaaucuuguguuuaaaaaaauuuuaauuauuuuuagaaugaauuucacuuaaagcuaaaaauuauguauuucaggauagggugugguggcacaauggaucaucacucacugcagccucaaccucccaagcucaagugauccucccaccucagccucccaaguagcugggacuacaggcacacaccacaacuaauuuuuguauuuuuuuguagagaugggguuucacuguguugccuaagcuggucuugaacuccugaacuuaagcgauccuccugccucugccucccaaagugcugagauuacaggcaugagccaccgugucuggccucuccuuucucuuuuacuuacggcaguugaggcccaccuagauaagccccucaucucaggauccuuaacuuagucacaucuacacagaugauuuuuccaaaucaaguagcaaauaccauagguuccagggaguaugucuuugggaaccauuaucaguuuaccacaccuuccuaacacaagguaaccugauggucuaauaacauguuugcuggaguacuagcuagcauguccacauguccugccagaagaaggaaagagaagagcaaaaugggguuucucccagcuggcucaucuuuguaaacagucuuccuugaaauccuaccugaugcuggcucaccucucauuggcucuguggaccuagcugccaaggaggcugggaaaugcaauuauuuaugcacuuaauugcacuagggugcuaaagcauaauuuucuccgcuauuguuguuguuugagacggacucccacccuuaucgcccaggcuggagugcaauggugcaaucuucgcuuacugcaaccucugccuccuggguucaagugauucuucugccucaaccuccugaguagcugggguuacaggugcccaccacgaugccuggcuaauuuuuguauuuuuaguggagacgggguuucgccauguuggccaugucucaaacuccugaccucuggugauccaccugccuuggccucccaaagugcuaggauugugagccacuacgcccagcaguuacgagaaaggcaauagcauaauucauuaauuagggaauccaaaaagauguuaaugguuuaggaauuuggguuauagagauuuauauugucugccagagaauugguauggacaaacauugcuagggacaggaaucauuugcacugccaaguuuucugcaauuuacagaccuguaaacuagucaauagaaagucaagaguguacacagcuauggaaagauacugucggagggucugcuuuacauaagcaacauccaggcccacugaagguacacccuguuaucucuuuugucccuuuccaaguguuugaaacuuuuuauuuauuuauuuuugagagaugcucucguucuguugcccaggcuggagugcaguggcaggaucacggcucacugcagccuuaaccucccagguugaaguaauccucccaccucagccucccaaguacaugggacuacaggcacacgccaccacacccaccuaauuuuuguauuuucuguagagacaggguuucaccauauuacccaggcuggucuggaacuccugggcucaagccaucugcccgccuuggucuuccaaaaugcuggaauuacaggugugagccacuguuccuggccuauuuuuuaaaauagugaaaaauuagggcuuucuuacagagguggaaggagaugauagaugcuggggcuggccuuuagcuguugcucucuauacaugggucagagauguuuacccaggauuugagacuuggggacuuccuauaacuggguaucacuauuaucauugaaguggccagacccucuuuucuaacuaaaaaaaaaauuuaauguguuuuuuuaaaauuaacauagagcaaaaaugaacuuuuuuuucucauuguacagaucugugacugucaaaugcacaguuguguaacuaccacaaagauaccaguucuuucaccccaaaauauucccucaugcugcuccuuuguagucaacacccaacuccugacaaccccugaacuguccuccaaaccuauaguuuugccuuuucagaugucguguuuagaauuguguauaaccuuuugagucuggcuucuuucgcuuagccuaaugcaguugauucauucauguuguaguggguaucaauucuuuuucuuuuuucuucuuuuuuuuuuuuugcagaguaauacuguuuuccaaagugguucuaccauuuugcauuuucaccaacaguaugaggguuucaguuacuuugcaucuucaccagcaguuuuuauauuuuguuuuuuaaguuuuagccauccuaaaaggugugcagugguagcucauuguccaagcuggcccuuuuaauggucucagugcaaccuagucagguugaaacuaugauccauagcuaaucuuuggaccuaaucugauuaaacucauaaauccuauuaagagcaacagugcuuacagguauuucucuagagacaauugcguucugcaucucuguucccuguucuugcccuugaucucugcacccugaucuuggcccaugagugcagguagaggauucgcuguguguggauguaugcagaugcaugccagagcagguaggugugaggauggggcugaagaauuuccuucaggugcucccuuccgauggugauuuuuuucuguauagggcgaaggguggaguguguaugugcguguauuagauuuguuggagaaggcugggauagucuugaccuggucacuguggaggauggaaagagagagugcuauugagugagacauaggacugcucugccuucacccucuccuggcugguuagggaggggucguggagcaccuucuaaucaguggaagcuuucaagggacugggcugggacccacgcuccccucaccccaccucaaccccuccaacaccuccccauaucucccuucucacauuccuccccuuacuucugaaucuccugcccugacagaaaugaaauggaauucugugguagccacuguacugaguaaauauuggagaagacauucccaaauuacaggauuucuuagaaguuacuaauuuauagcaaaugaguauaauuuacuuaaaaagcagaaauaaacuuuuucuuauugaaauauauauuugugccccaccugaguacauagcucugugcuaaacacuguaaagaagcuaaacagagacaaaguucucuuccuccaacugcuuuuacuucguuuaggaaauggaaagaguaaaacccccugccucccaccucuguggucccauucagugacgccagucuccccucgugcccccagccucagguacagcucaaucgcugccuuccucccucccgcugcuguuuuucccaagucauuuaacaucauacuguuuugucuucauacuugaauuuugagcuuucuugggcugugggcaaggucuugcauagcuacuccagacaggccgugccaguggguuucaaacuugagugggaggccaggugagguggcucacaccuauaaucccagcacuuugggaagcugaggcgggcggaucauuugaggucugguguucgagaccagccuggccaacauagugaaacccugucucuacuaaaaauacaaaaauuagccgggugugguggugccugucuguaggaggcugaggcauaagaaucacuugaaccugggaggcagagguugcagugagcugagaucgcaccacugcacuccauccugggcgacggaacgagauuuugucucaaaaacaaaaaacaagccugaguggggcaucggaaucacucuguggucuggggaggggcugagaauuugcaugucuaauaaguucgcaggugaugcuguugcuguugguccaggggcuggucugaacccacagggaaagaaaauucucaaggauccugccuuccuuuuggagucaguuacuucaggcaguggagggcucacuuccuccuugugcaaacaacagaagagcccuguggcuuaaggccuacuuccugaguuccuuagacaaacucugaaauuagccauucuaggaagaucgaucuuuccuccagggauaucuuuaaaucaaaguuugugguuguucaauuguuuguagcuauuuucuuaaccauuccuacaaagcuaaggaaaucagcugcauuuuuuuuuuuuccagagacagggccucauuuuaucacccagacuggaguacaguagcaugagcaugacucacugcagccucgacuugugugauccucccgccucagcucuccccaccccccgcccuccucaccaaguacaggcacgcaccaccaugcccagcuaauuuuuguauuuuuuuguagagauggaguuucaccauguuucccaggcugguccugaacuccugggcucaagugauccucccaccucagccucacaaagugcugggauuucaggcgugagccaccaugcccagcugguauuagauucuuuauggcacauuguaauuacuaccaaaagucagaggaaguaagagcuagagauuuccuccuugugagcucacaaccaggcaugaaugaaaauaaggcuuagguggaguucugcccauacagauuuauuaguaggcugucacagcacagccacacaaccugcuuuauacgccuggugaggcuccagcuuuguccuuuucaggagucugcucugacagcagcuugcauuugguguuuaccuguagcacaugagacaguguuucauagacauuaugucaguguuuuauugcugcccugagaaauuacuacaagcuuaucuuaaaucuauuaucucacaauucuuuaggacagaaguccaggcacaucuggcucucuucucuagguuuccuuaggccaaaaucaagacgguagcagggugguguucuguuaaggcucaggggaugaaccacuuccaggcucauucaggagggcagaauucaguuccaugugacuguaggacugagguccccauuccuuccuuccucccucccucccuuccuuccuuccuuccuuuuuugacagagucuuacucuguugcccaggcuggagugcagugucgugaucucggcucacugcaaccuccgacucccggguucaagcaauucuccugccucagccuccugaguagcugggaauacaggugccuaccacgcccagcuaauuuuuuguauuuuuaguagagaugggguuucaccauguuggucaggcuggucucgaacuccugaccucaggugauccacccgccucggucucccaaagugcugggauuacaggcgugagcuguugagcccggccuagguccccauuucuuuacuggcugucagcugaggauucuucucaacuuuagaggcugccugcauuccuguuugugguucccuuccuucaucuucaaugccagaaagguggcuuccuucucacacuuuagugucugacccuuccuccugccuuuucucacuucugcuuucgagggucugugugauuauagcaagcuuacccagauaauccaggauaaucuauuugaaggucaucuaauuaguauucuuaauuccaucugcagagucccuacauggucguacccagauuguguuugauucaguaaugaggggaugggaucuuggaaugauaucuuuagaauuuggcccaccaaaggcagaauucagguuuuccugccauuuuacaucagggacuuaacaauuccugggaaucagcagcuggaccuggggccauuuacuuaucaaaccuagggcaccauucuuaaccuugagccuuacauuucugaggcuuauuacaaucuggccugcuagauuuuuauauuugggucacacacaggcagaguguuucugacauuuccagucaacucccuuaccucaaauaucaucaauuucaccacugaaaauguuccaacagcuguaauacuaauuaacaaagucaguaauuuaaccaauaugaaagcccauuucugacccaaaguauacuaguuaacauaaccugcucuugguuggugauaaggauagcuagcagacuggcuugcaguagugucucuugaguguggcuuuuugauuaaaagcugguuaacuacucuuggagccugucuuccagauuaagacaauucauugcuuuuaggcaguuggcuuacagccacuggacauaucccagcuuauguugaaguguuuugaaauaaaauucaaaugauauaguagacucuugccaucuuaaccgagagcaucgagaguucagucaugucugugguucucacccuugugccugguaugcaguggaugugucacagauauuuguugaguaaauaaaaugaauuaaugcauuuccaugcuuucauauauaacaauuuuaguacagugugagaacagcaugacagauugcacuggaagaaagcagaaauguuacucaaguuacuuuguuguacuaggagcuuauuguacucaugaugcuauaaacauguagacuacaaacuggaacuugaaaguguuaacauuuauuuuaaugauaccuuauugaaaggagcauggcuacaaaaaaaucccaucaaaaagugggcgaaggacaugaacagacaauuuugaaaagaagacauuuacauggccaacaaacauaagaaaaaaagcucaacaucacugaucauuugagaaaugcaaaucagaaccacaaugagauaccaucucaugucagucggaauggcgguuauuaaaaagccaagaaacagaugcucgugaggcuguggaggaacaggaccucuuuuacacuguuccugggaauguaaauuaguugaacuaucauggaagacaguguggcgauuccucaaggaucuagaaccagaaauaccauuugaccuagcaaucccauuacgagguauauacccaaaagaacacaaaucuuucuguaaagacgugcacacguauguuuauuguggcacuauucacaauaguaaagauguggaaucaacccaaaugcccaucaaugauaaacuaaaggaaguguaguacauauacaccauagaauacuaugcagccacaaaaaggaacaagaucauguccuuugcagggacauggaugaaguaaugagaacacauggagaagaacaacacauaccggggcccgucagggcacggggggagggagagcaucaggauaaguagcuaauguauguggggcuuaauaccuaggugauggguugauaggugcagcaaaccaccauugccauguuuaccuauguaacagaccugcacauuuugcacauguauccuggaacuuaagauacaauuuggaaaaaaggagcauggcuccaguuugauauacuguuuuccuaccagauugugaacauuuacauccucacaaugucuuaggcguugcaccaaugaauaaaggcugucugcccuuucccaguggaucuucgcaaacaagguauuugaaauaaauaaaaggaggcuuauuaagagugguguuaggugacuuuuguguuuucuucacuaucagcaggugacacacuuuuuugucuucuguuuuuuucuucccuagaauugcagucugaauuucccuagaucucacuugucuuuggauuaggaugaggucccaguaguagugacucaaaucacacugaucuuuugccacuaccuuuucauacaagccccaggcccuuguaaaaguguuccugaaugcuucuggaaguacccagagggugucugcugggacagcuggugcacuucuguuuccaggugccuuguccuucauccauacccuguaucccaggaguuguggggggccuggugcugcguuuugucauucccuggaggagagcugucagcaguuuaguuacuuaauccccuucugccucucaugggagauauccaagggauggaugccaggcuguguuugaaauugcccuccucuuuggccaagguuuuccagcuuggucaguucauuuucugucuccuucccccaaggugaaucuucccaagaggcucuuacccuguaagauggugucuuuggacggugccuucugucccccgagccgugccucaacucaggcaagagacaaaagcacagggagccagcccauguuccuguuauaaagacucccuuuaucccacaggcuuggguaggccaagucaucaucuuuuuucagucccuaauugcaugucaccucauucuccucccugaccaagcacucuuuuguugggggggcaggggaagaggggucaaacuuuagaagcucugucuggaugucuugcuccuuaaaauccaagacuuaucugguaguuuaccacgguuugccauuaggaauuggcuauuuaaugcaauuugccuuagugauaaagguucccccugcccccaaaauauuaucuuacucaucucuuuauuuuccucaucuugugaaauuucccacuguggaaugaaaaccuagaucagauaaaauuggcaggaaccuuuacugugaaaguucaggaugcaaaaaaaucccuaaaaugauugauaacauacagugucacuuuucacagccuccagauaucaugaaaaauguaagauccacuuuaaaugcaauaaguagccucagguguucugugucccaaauauugcuuucauauaaauauauaauuaucuuuaaccgaaacacucagaaaugaaagguaaucccugcccuucucccuuucacugccucgagauaaagcuggguuugguuuauuucuaccaucucuuuuaaaaaauacuccuuauguggcaguuucuaagcagcaaaauagucagcugugugauuaaaaugucaaaaagcaggaaaacuggccgcugggaaagucuauuuggagauuuauguaaaggcagaauucugaauggggagagugcuguaccuucugggcugcagaguggaguaauuaagggaggguucuggccacauccuuccagacugacacaggcccugcuacacaguuaaagaagcugacaggugcuuggguuuuguuuuguuguuuuuuuuuucuuuugcaagcugcauacuugauaucuuuggguuuauggcuguguaacuuacuuuuggcacuuuguuguuuuuaauuuuaaggguccuuuauaacuuugagauccaccuucuccuguaucacauaguggagauugugaggggaggggcaguggccuggggaaauuggaaugaggagaaggaucuagaguucagaugaaguagcuuuaauuuaugauggaggguaaugcccauuuaucuuaaaucuuguaaacugaacacguuggugcuccacucacagccacugcacuucacuugaaccugacuggagugggugguaaacagcggucuucccuagagaccccguucgugcuaccaaagugucaucuguggucccagcccacaccuugaacaucagaaucuacauuugaagccugugcacguuacagcuggaaaagcggcggcagcaggauaccaguaccgggggcggcgggggacugggagcccagcccuggagacaugccagcuccuagaggagcugguugucagcuaauaccagacggucuuuccuuguucucguuguuguuguuguuguuuauuucauguuuuuauccacagacaagucuuguuuuguuuuuaagagccuccugcguuaaaacauacccaguagcuggaauaucaugcuuucuggguaauuauuauguaguauuacauucugguuaauuuggggggauuaaucucauaacacuugguuuaaguaaaagggggaaguuaaaaguagcuuaugcuugaauauuucguuuuaaacaaaaaguugugaggggaaggugcugggcaguaguuuucccugagugagggcuuggggagauggauuuuucagucuggaucucuguugauaaggacuguggcugcuuuaugugggggaguguuccguauagauggcacagcgauuagugucauugugguuuaauagguggucaugugugauuggcgcuuggugacugugauggcuccugacuguguggccugcaguuguucuguagccgcagccugcuuagcugcccacaucaugggcuccagaugucccuugugccaguauccuuuuguguaauagaaacaguauugcuuuucuuucuauagggcguuucuucuuuucucucauuccuuaguuuauuuuuuuaaagagacaggguuggcacaaucauagcucauugcagccucgaacuccugggcuuaggcaguccucccaaguagcugggacuacaggcgugcaccaccgugcccaacucagaguuccuuucuuaaucugugucaguugcugucuuucaggguaggucuuuccucaccugccuggugguccuuggcuccuuauuuguauauaaggugcuaaaagcugauugaaagggguacguugagggcaagcugugcugcagcaugauggucagggaucuaccuuucuuggggugggggguccccaacuaugauuaucuuuaggccuucuucucuugaugagcuuccccagagaggaauccucccaucucuuccugccguggccuauaagcuuggcugucagaucucauagcugggggcugggggugggagauacgucucuggcccaucagucugcauguagaauauuucuuaaucuacuuuuuccuuagcaguuacaaguuuaaaaaaaacaugaaaagaaaacggcacucaugaguuuagcucuugaaucucucuccauggucuuagaauugagccuuuccagagaauaaacuuggccuccaggaugagggaggggaagggauguuccaggcuuaagaaauuucugggauuggggggucucacuuuuccuucaguaguuuucaaccagccacacuacuggaugucacccgcgccccugccuuccgaugggccugcugucaccgaggcucuggcccgggcugagcccucaucacucccccuccccccgccccuuccccugcccccacccaacacuaaccuuucugcuccaccugcuccacugcuccuuggcaaucuguuuccuaccuucagaggcuugguuucuggccaguggcucuuucuccuuuccccacuggucuuucuuuaaucuuuuugcuacaacuuuaaugguguuuugagagggaguggaggcaaacacguaucaucugcucugcuuaaugcaaaguaugcacaaauucucuaaugagugauugugggggacaauaaaaccuaugguuauaaauuuaucuuguuuuacagcacuuuauguucagcuguuugugaaaagcaauuuaaauacaaggaucaugcaggagaacaguuguuuauauucacuuaauauuuccucuaguaaaagggaagaucagagacaaguaggaugcauaaacgauuugcugccucugcagccagcguccauggauguugaugacugggugguggaaguucccagugccugggcuuuuucuagaauugcauauuuaauccagauuugauaguuguauaagugcucaauggugauucagugccugggcuucaaaacugcauagaccagggugugaauuccuuccugcuuugucaugugugggccgaguucagauaagaacaacuuauuugaaccucaguuuccugaccuaaaaaugagggaaauuguacuuuucucccagaguuauuaggaaugagugaauuaauguaugugcgugcuuugccuugugugaccacugaauauauauuuuacuuacuuuguuauauucuaggucuccuuucguaugugacauuacugugauuuagugugccugggaaccaggugggccuggucuuugugcguggauuuuccccuuguagcaagagguucauuugcucaccuuuagggucugggacauauuaaggcccgaguuaggggacaugaggagggagggguacaguuuuguuuuguuuuguuuuguuuuucuuuuguuuuguuugagacagucucacucuguugcccaggcuggagugcaguggugugaucucagcucacugcacccuccaucuccuggguucaagugauucucguacuucagccuccaaaguagcugggacuacaggcacaugccaccacacccagcuaauuuuuuuuuuuuuuuuuuuuuuaaguagagaugggguuucacuauguuacccaggcuggucuggaacucaugaggcaauccacccaccucggccucccaaagugcugggauuacaggcaugaaccaccgugccaggccuggguacaguauuugaaccuaggucugcccaacucaugagucccugcguugaguauccuggcuccucaggguugagucuaugaguuagggguuggaucugaauagaaccguucuaagacaguuaaacaggcaggcacguggaugcuuucugaaggcucugggugauacuggguuccaggauccagacauuuacaauaaccaucauacauuaaugaaauagcccacauuuuaagaaagugcuuacuauuagagaauaguuuugaagacucucuuggguagguagauuggagcuuggaaauagaucucuuuagauuugcuguuacuguacccugaagaguuaaggggagcagaaauacaggcacuucuugagcaguggccaugccugcucauugggcaaauuaucaggcaauaauaacaaagagcuuuaccuccccagguccuucaaauggaugagggcagaugaagggaaaauaugucagcaguucauuuuaccuuagagaguagguggcaaaccaaaaguguauauggguucuugucuuuguucugguuccuuuuuuuuuuuuuucucuuuuuuugucugagacagggucuugcucugucaccuuggcuggagcacaguggugcaaucacggcuuacuguagccuccaacuccugggcuuacaagacccuccuaccucagccuccugaguagcugggacuacaggcaaacgccaccacacccagcuaauugauuccauuuguaucuguccuauucaggcccuucuuucuaguuuaugucucuuacacagcaaauaguuuagcuccacccccaaacccccacaagucuuuuucccuacgcauauuuauguguggauauauauauauguuguagauaaagucuggauacuguugaauagccuacaucccgcacuuagauugcaauuguguguccccuguaaccauucuauuuuaaucuuuguaaaaguucccuuuaugacaggguuaaauuaugaagaccgccaagugauuaaauacuacaugaaucauuuaaaaacgaugguuccugaaguuugaaauaccguccuuauuuguaaaguauuauuagcuuauuugauaacagucuaguuuaagauguaguacacccauguagcuggcuaggaauuggauuauuuuuauaguaguauaaaugcuuuuguaguaugccuuuagauggcagcaucucucgccauaaaccaucuuuugaacagaauuucuuagaugcagaagacguuugagacagaaggauggucuaucugcaucaccccaucaugacacagugguggaacugggccccugggacugucagggcuauggcccagggcuaagaagaggggauaguuguagauuccugccugcaugucuucuacuaccccuucucuuacugauguaaaauguuuccuaucuuuguggucuugcuaaaagccacuuuaaggcaaccaaggaacacuagaaucaaggaagugauuuuggaccaaaauguaacagaauaggcaguauuuucuuuauuuuugagacaggguuucacccugucgcccaggcuagaaugcaguggugugaucuuggcucacugcaaccuuuaccuccugggcucaagugauccucccaccucagccuccugaguagcuuggacuucaggcgcacaucacugcacccagcuaacuuuguuuauuuuuauuuauuuauuuuuugagauggagucuugcucugucgcccaggcuagagugcaguggcgugaucucagcucacugcagacuccaccuccuggguucaagcgauucuccugccucagccuccugaguagcugggauuacaggcgcccacuaccgcgccuggcuaauuuuuguauuuuuuuuaguugagacgggguuucaccaucuuggccaggcuggucucgaacuccugaccucaugauccacccgccucggccuccaaugugcugggauuacaggcaugagccaccgcgccuggccucuuuguuauuauuuuuguauagagaccaggucuucacuguguugcccaggcuugucucaaacuccugggcucaagugauccuucuguguuggccuaagugcaagaauuacaggugugagccaccgugccuagccuuuuaauuuuuuuuaagcaguuuuguuuagguauaauacacauccauacaguucacccauuuaaagcauacaauagacuaauuuuaaauauauucauagaguuguacaaccaucccuacaaccuaauuuuagaacauuuggucacucuagaaagaagucacauaucccuuaccauuaccccacaggccugcauagccugcauaacccccagccccuggcaaccauuuauacuuucugaaagauuuggcuauucugggcaugacauaugaauggaaucauguagauccuuugugacuggcuucuuucacuuagcagaauguuuucaagcuucauccauguuguagcaugaaucgauacuucauuccuuucuacugcccaauaauccauugugugggcaaagaacauuuuguuguugucauuugacguaccuuuagcuaguacaaauggcguuacugugagcauucguguacaaguuuuugugugaacauacauucccauaggaguagaacugcagggccauguaguaacucugcacuuaaccuuuugaacgacugccaaacuguuuuccaaaacggcugcaucauuguaugugaggguuccauccagucuuacgaagaauuccggauuuucugauaauaagcaggggcugugggaacaggagguaggagauaagccuguuggucucuccuaugucugacccgcuugcuggcugcugugccccgcacaguuacugugcgucaccagccagauaagaugccuguguucuuguggcuggugcgcagacuguguugcuguuacaggccggcuguuuguaauccuugccuccugacuuuagagauaccaagcuaccaaauugucuuugucccauccuuguccuaguuagaggaaaaucaaacccuucaucacaaagcaguccagguuugaacaugucaaaaucacccacuugaccagugaagacagcuguagcgacuucacagcaagagagcagcuuuuguuuuuguuaggguuuacauucucaaaucugagcuuacucuuuucuucuuuggcaggccagacuggacguucccucgucuguacugaaauuuugugugugugugugugugugugugugugugugugugugugugugugugcgcgcgcgcgcguuuaagggaggggaaggcacuggcucuuccucuaggcauauuuggguccugguaaggacacacacuguacauuccaaggcuuuguuugcaucuggaaaaaauuagccacacucagaucuuucccacuacaggucccgucaggaagcccaaguauguggaaagccccagagugccuggagaugcaguuauaaugccauucagagaaguagccaagccaacagagccugaugagcaugguaagaauuucagugauuuccuucccccucuaccaaagauuuuauacaaugacacuucauuucugaaugaaacuugaguguccuugcaguacugcuuugcugagaauguauuugggagguauuuuccccuccagcaguuacagagaucuguuuggcuaacgcaaauucuuggaaauuguauaccuggcguauaaauaguuaaguggguacauaugcauuauuuaaggauugaguccuauuuccucugaauuuugaccuaccaggucuuggaggauaggaagcgucacccaguagauugcuuccaagauuuuguuuuguuuuuaauauucuacugcuugagaaaauucaacaacaggcuuuggcugaaaagcugaaaccuuaacuggacaaagcauguaauugcuagcuuuaaaaaaagcauuuggugucuuuugaaggcugcuuuuuuuaacaucugaaguuuuucuuuaggggauguugaaguaggagcaaaaaaaaaaaaaaaaaaaccaaauugauggaaauauuuuuaaagacauuuuauauguauauguauuuuauaccuggaaauaugugugacauuacaaauuugcagcauuuaacagauauauucauaguuguuuauuuuaaaaaaucaauucaagaauuuuccuguuuguuccuuucuggggaguccccaacucacaucucucuugccuuuaauuuggguguuuugaauuuccacccuguuuuucugcagaaacaugggacuaggaaucuugcuguauguaaaggggcuugcuuuauccucaguguggacaaaaguuuauguagcaaugcugaaagagaacucaaccauauuuuuacuuuggcauaucuggcaccuuccucugccuaauuguggguggugggagauacagacccuuuauguccuaaccugugugugccuuuuguguugcuggugcuguauggcagggaguggguaauaaguaggacaugggaagacaauauacuggaguggugguaaaaauauagcuaaaaaugagcugugaggaaggaucagcaaaagcugaaaacugggaagggaaggggaguuugggacauggggaaaagauggggccaggcacugggcacucugggcaggcaagaggugcuauugcaggugucuuggcaugagaaaugccacccuuuuccuuucuguccaggcacucauugugugguugagggaagaggauuugagcugaggauuugugcacaccgaauguugcuggugaagguggagauuccacuguggugucugguuaggauagccaacugcugguacaugaggccucucuugauugugcguucacgugggcaggcagucuguucucucucuccucgguguccugaaaggaaaguaaaaucucucucucuguagugaauaucagucaucaaaugucuaagcugucugccuggcucagauuaagccugcuaccuaccucuucccuucuuccccacccaccaaagccuuuguagcccuggucaauuaugccccuggcauuuuggcuggccuaggcuccauuauguaaccucuuccucccuggcugggaguaucguuaagguucuguacagggauugggaccuccuccuccuggugugggaguggggguagaaaauuuggauuuuuauuaggcaauaaaagguuauaaauaguuccuauuguuaacuuuucucccuugcucaaagcagaauuggccaccuuucuugacgaauggaaguguucuuaugcuuggcugugggcugagcuaaauuucaaaugcagcaauuggucuugcuggaguggccugaaguuugcaugugugcucacuccugagaccugagcuuucugauucggcaucuuuagucuucauggggaccaaaguuaugagaucuaugggcuacaaauacaggaccagacauuucgguuucgccugaaauuaagaagcaggguauguuuucauuuuuguuaagugucucgggagcagguguaguucacgucugugggugcauggucuugccugaagauagccaugauguugguggaugccgcagcagggugagcuuucucuugguugaugaggagagguggcugccuaacaaagucgaacaggacaauuaguauagaaugguauguuuuguaauccccauggagucccuuaaauuucaaugggguuaauuaagucugccaugucaaaguguaaauuuuauccagaucacugaacccaaaggaaaugauagagccgacuaaaacuaauugaguuugaguguuaacccagguguguacagauacaugaugggcaaacccucauuuuuaggguuuaauaucagcaucaucacuuaaguuuuacuuuaaaauguggucuucuguuaucuauauuucccuuggacauucuuguuuaaguuucuaagacgcuuuucugggugcugucaauaauagcaugccaguauucaccagacuaacagacuccacugaaaacagcucuuugugaagugcuuuugaaauuucccauggacucgugaaauagcagguuauuccuaaaugcuugaaauacuuuccugccucacuuuugcuuuggucauguagcuccaucaacucuugauucuuagcucucuguuuggauuuuaaaucaaaggaaaacaaaccaaagaacauuuugaauuugcuuauuuauaaguaauugcauuuaugugugaugcacguuuuagccuucugggaaguguggguucgaugauguaagaagaugaauuuuuuuuuguaagcaaauaacuuguuucuuaaagcuugcaagcuggggacuguagcucacaccuguaauuccagugauucagggggccgaggugggaggauugcuugagacugggaguuugagaacagccugagcagcauagugagaccuugucucuuuaaaaaagaaaggaaggaaaggaaggaguuugcacucaccuggaaacaucuuuaggaaaaaacauucuaucuuaguauguuuaaauauauuugaaacacagcauuuucuacucuaggaaaaacggaugacuuaauaaaaucaucaaacaaaauacaaagcccauuuucaugucaaaugguccuaauaagcugugugucagguagaauaaguucuuaaugaguaagcuuccuauugcuaaaucaacauaucguuuaggggaaagcucauuuacccacaaacaauaucugcguuaagggaaaaaaaaccuucagauaaauuagagaugauuguuauaacaggauccacgcuuuauuucuuugauuuagggguaaccauaauuuauuuagguuugcauuaauauauuucuagcuacuagggcaaguuuugaggaggggcuagaaaguuuuuagucucauaagucauugcucugugaagaucaaucucaaaauaugaugaaacuuuuuuuaaaugauaucuucaugucagucagugacgaaacuuuuuuccuggcagucugacuaagcaaauaaagcuaacacauaugaaagagcagaauaauucaaugugaaacuaucuucugggaggagagggucuuuaguuauaugcuuaaguaaauauuuugauaccuuauguuuuuuauuaccauuuuagauggucagacagguauagaggauuaaagagguauaaagcauaaaggggcugggugugguggcucgcccuuauaaucccagcacuuugggaggccaaggcaggagaauugcuugagccuaggaguuugauaccagccuggacaauguagcaaggccucauaucaacaaaaagucaaaaaauuagccagauauagcagugcaccucucuggucccagcuacucaggaugcugaggugggaggauucuuuagccagggagguggaagcugcagugagccaugaucacaccauuacacugcagccugggagacagagugagacccugucucaaaaaaaaaaaagugaaaaaaagaauaugauugaaaaaaaugcauagucauguuuuauuucuuaaaacccuuucuuucccaagagguaaccuugauccugcuuuaauuuucagcuucuuagaauggcagugcaacauucaaccaaugguugaaugagguuuuauuugauggaaguauagaaaaggggcauaccugguaugugugcacagaagagagacucuuggaaguagaguauccauucauucugcauuuccuugaauaaguauucaguuucuaugcugugaaaaaacacuaugcuaaaugcuauuugagauggguuaucaagcauggguccugucuuuauggagccuuagagucuggcaggggauuagagaccuguauauggcgugacuguaauaaaggaggaaguaaugacuaauccaagcugugugaugaacuaggaguucagcagauggagauucucuauuuuuuuuuuuuuuuuuuuuugagauggagcuucauucuuguugcccagacuggagugcaguggcacagucucggcucacugcaaccucugccuccuggguucaagcgauucuuuugccucagccucccgaguagcugggauuacaggcacccaccgccacacccggcuaauuuuuguauuuuuaguagagacagaguuuugccauguuagccaagcuggucucaaacuccugaccucaggugacccacccgccuuggccucccaaagugccaggauuacaagugcgaaccacuaugcuuggccagcagauggagauucugagcauggaaagacuuaauuguagcuaugccuuaagauuuaccuguugucuuaguucaggcugcuauaacaaaaauaccauaaacugagugguugauaaacaacaguaauuuauuucuuagauuugugcaggauggaaaguccaagaucaagguagucugcagauuuggggucuggcaaaggccuacuugcugguucauagacagccaucuuuuugcuguaaccucauguaguggaagggacaaacaagcucccucauuuauaaggucacuaaucccauucugagacacagacauucagacuauaguacguggcaacagaguaggauggagugggacuggaaagagacuacgguuaagaaugauuaaaaaauuguuuuaguaauuaagugagaggauaaagucucaaauuaguucagguucagugaagaagagguggugaauggaagauucuugaggaauugcaaggaccugggaacugaaaaagacagagacaacaacuucacgccuuugagaccacauuaagggacacuggaggagcagggacuguguuuugguuugaguucaguuucaggcauggagacuucaaagugcugguggaacaucuucgcaaguguccagccaccaguuggaaaaucaaacuggguaucaagaaagagcucaggauauaaacuggucagccauuugcuuggaaguaaugcugugagacuaggcaaguuacaguagggaaacaggucguugacaaaagagggcugagaaacugguauuucauuuaugagcugggacuaaggugcaaggagcaccagcaagagggacaggaaaagaccacacaagaccacaguauucugguaaucauggauuuuucccucugugugucucuuacaacaauugccacuuuauaccuugcaggacagagugcuugcaaggccguagaucuacaggaaaaucaaaagagaagguguacuacaaaaaaggaaaaagaaaaauuaaugugcuuaacagggcuguuucaggagacuugugaaggucugugacuugaaguuauagguaugugauaaggaaauggaauuggugagaauagagagcccucuuuuacccccaaauuaaacagauaaagaugggagaucaguuacuaggaugagagaugugugcagcugugguuuuuauuuaacacaguuguagacuuaauucagagguucugacaguguaggcuguggacuucuaguccccaagacacuuucagggguuugugaugucaaaacucuuuauaauaguacaaaacccuuuuguaauaauacggagaagguauuuacauuucccuuuguugacauuugcacugaugcugcaaaagcaauuguugguaaaacuucugauaccuuaguauaugucaaggcacuggcuacacugguaguccugguguucuucacugccaagugcuggcuucacaaauaauucacugaagaauguccuugaugaagcacuaaaaguaauguuauuaaaucuugacccuuggagacccaucuuuuuaauauucugugugaugaagugggaagucugaguaaagcccuucugcaugcucggaagucugaugguuuucuugaggcagagcacuuguaugauugaauugcaagcugaacucgcuacuuuuaaaauggaauauuguuuuuauuugaaagaaugacugacaacccaugguuauucugaaguagguauuuggcacauuuuuucuucaacaggaaugaaauuagccuggcacuucaauagaaaaaaaaaaaaaggccaggcacgauggcugacaccuguaauccuagcaauuugggaggccaaggcgggcggauugccugaggucaggaguuugagaccagccuggccaacauggugaaaccuugucucuacuaaaaauacaaaacuaacugggcaugguggugggcaccuguaaucccagcuacucgggaggcugaggcaggagaauugcuugaacccaggaguuggugguugcugugagccaagauugcaccacugcacuccagccugggccacagagcgagacucugucucaaaaaaaaaaaaaaaacaacaaaacaaaacaaaaaaaaacaaaaaaccaacucugacaggauuaguugcccauaauaaaacuugacauuucaaaugaaaauuagguuuuuugggaaauuuuacaccugucacauugagcuugaugguuucccaagacuuuucaauugagaucucucguaaugugauguuuugauauuaugugauaacauuugucaacauuugcaaaaucuguaaaaccauuauuuuccaaaugacccaaugcauaauguuacacagucuugcauggguaaaagauccauuuacaguauaaaacagaccauuggaucuuacuguaacaguacaaaaaauucaucgaugcagauugagucaacaguggaacuuaccuuuaagaaauugcuguuuccagcacuuggggaggcugaggcaggaggacugcuugagccccaggaguucauaaccagccugaguaacauagcaagaccccaucucaaaaaaaaaaaaaaaaaaaaaaaaaaaaaaaaauggaaauugcugauugucaaguuuuggcuggguaucagagaagaauuucuauaauuaacuaaaaagacuccugucuuucccaauuauguaucugucugaggcugcaguucuucacaugcuucaaccaaaagaacugauccccacagauugaaugcagaagaaguuauacaaauccagcuguccucuauuuaauugcacauuaaaguuuguaaaauuguaaaaacaaugccauucuucuuaacuaaucuuuaaaaucaaaaguacagcuuuuuaccuauguacccauaaguuaaaauuuaguuuuuuaauuaaaauauuaauuguuaacaugaaguuuuauaacauuaaaaugaacuaacauacaguuuaaaaauucuuaguuuuaauaucuaguaugauaaaugucaauagacauaacccuccuaagccugcaguccucaguuuuuaagagugaauucugagaccaaaaagcuuaagaaccuacuggcucuagaggaaggaaaagagggagaaaauaaaaauagagaugagaaaauugauccaaacucugauaguccucuagacuuaagaggaugaagacuuuaaguugagugauggaugacugaagaagaaaaggcuaauucaggaggcauuuugaauggagaaauaguaaguuuggugauaauuucaauaugggguggaugacaugaaaauuuugaagguaaccugcaugauaacuauguuuugguauugcagaccagaaacaacaaauuauugacagaaacagagcagguccauggauggauguuccuuuuuauuuuuauuuuucugagacggagucucgcucugucucucaggcuggaguacaguggcacaaucuuggcucacugugaccuccgccuccuggguucaggugauucuccugccucaaccucuggaguagcugggauuacaggcacgugcuaccaugcccaguuaguuuuuuuguauuuuuaguagagacaggguuucaccauguuggccaggcugcucucgaacuccugauccacucgaacaucugaucacucaggugauccaucugccucggccuccgaaagugcugggauuacagguguaagccaccgcauccggccaauguuccuuuuuaaauacuguuuuuggaacucuaaggagggagggaaugguaauggcugagaaggagcagacagaaacagggaaaauacuuguaaguaggagucauggaaggcaagaggauaagugagaagcaggucauggauagauagaggcagaggauuaaugucaaaccaagggccugucucauuuagcagacuagauucacaagugcuaucuuggacacuugguauuaagucaacuucgaggucacauggugauaggucacaugauagugaacugacgaaugucgucagcaauacucaguguucuuuagagucugaggaggacgagaauggaggaaagacuucucuauggagugauaauacuuggugaucacuagggaccugcgcuccuccccuggcuuuaaacaagagagaaugauuggaauggaaaaugaaagcaguaaggugcaggccaaauugggaugguuugguaagcagaaaaaggaaggggguuuguugucauggaauagugaguuuacaaaaaccuauuugaggcagaaaaauuaugaacagaaaguuauguaagacauacaagcacacuugaaaauagauaugaacuugugaaaccagaaaauaaucgcaaggaagugcgggcucuugguguuaaaguugguagagagaaugaccaauucuauagcaucuugugguuuauaagcuguuucucacacacauugguuuugagccucacaaccuguaggagguggguauggccacuucccucacuaagaaagugcaguugagagagguucaguacccaaaaggaucuggauggugguuagcacugagaacacccuggauucccagacaguggcggaagaugagaagaugguuguagagggcacugaugguuuaaaguuaugauggcagucgggagcuggucaguuuguggacugcuccuuagcauuugugcccccauaugugguccacaagggggugagaagcugaauagaggcagucagaagugauucaagaacuucccuuuaccuuucuccaugcagucagccuuucacgcuauguaauacugaggguuccaugaaugugcugcuggggggaguauuguucuccacuugccuaauggauucccagggcauucucucaucuccaaauaaagccaucauacagccgucagauauuuaaaucugugaaaugaaaagugaagucuucucuccagcccucaucccacugguauuggguaauguacacccauuauugaucagcgauuuaauauuaacuacaugaaugaaaauagacuugcuauuuagaguggucuguuugaauuugacuuggaggugcuuuuguaguaacuagccuaaaaccaucuggcuguucagaucucaguauuuagugaacagcuaugcaaguagacauguauuuccauuucacagcguguccaugugaguuccuaagcaacucaucacucccaagauggcucagugacacuucucccaggcgguccuucugccagagugagaaguucagugagagagggcucugugcauuagggaagggagagauucagacagcuucauuggauuaaggaauucagacugaaggggaccuuuuaaggggaugaucacugggaugacauuuuagaagacagaauaauaugaaaagacaggugggaagccuuuggaagaauacaguugcagugccuuaauggauauaaacaugaaguaaauaaaauaacgucuguccauucaucccaaccccggguaaggguuuagaacuuggguagcagcaaaguccagguugugcaguuaagagaacaguugaucaugaauuugggugucccuuuuccuuuuuuuuuuuuuuuuuuuuuggagacagaauguugcucuguugccaaggcuggagugcaguggcacaaucucggcucacugcaaccucugccucccggauucaagugauuccccugccucagccucccgaguagcugggauuacaggcaucugccacuacgcccagcuaauuuuuguauuuuuaauagagaugggguuucaccauguuggccaggcugcucucaaacuucugaccucagaugauccacccgccucggccucccaaagugcugggauuacaggcgugagccaccgcacccggcuuaggugucccuuuucaacucaaccauuaaagcuggaaucgccacugcuccccaacuuaucugaaauggguuggaugguaaguuguuuuuggauuaaaaaaaaaaaaugaaacacuugagauccuggaguaucuguuugcagacacaguguggaggcagcagccacugugcugggguguugcggucccccugcugcacauaggaccuacauaggaucaggguccuccugccagucccaagugagccacaggcauggcccuguuuguuguggaggugaauucuguggagccaagcuccugcagcugcucucucugccuccacggcagcugccaaaugggagucauuucuggcucucuacacagaguguuucagguugaaccagaagcuagacauucuggggcauaaucacaaucgggagcaguguggagauuguuucgaaagggaagggggguguggaguggagaaacugcggagaucugcccccucacccacuucuucccuuuccaucugcguccuguucccucccuccagcccagcugccaccugagauaaaguagcugcccugccugggcccggggcagaggcggagggagggcggugccauccuguucugagggccucaccccuugggugugccucugucugcugaucugguuugguucccgcccuccuuucccaaacgcccagcuaccuugagaaucaaaaugugcuuugagguaggaagggaccuccuguagagcggcuuuggcaugaggucgacccgcccugggguggcuccuuuucccuguguuggcuuggggccacugccccuucauguuuggcucacaugguccagaagcaucagggcucuuuuaacccagaauagucaagccuugguuuccuuaccccugcaguuuuccagagcagcuaaaaaacauccaagcuggcaaaccauucuuccuacuccaaacauuaggagcuuuuaccaguaagcaaggggugggaagcuuuuccuuucuugaagaugcugccagcguaguuucccuuguagcugccauccugggugcaugacuugcaaaacugauaugugagugacaauaagccagauggccuuugcaaaagcucugcuuauuuugauuuuugugguuccuuacaaaaggcgaagugagcauugaucuuuguuggugcuguuguagcucaacggcaacaucacuguguuguuuccucauuuuauuuuuccuaaaaccuuuacccauuaucugcagauuuucacaucuaagcaaaauagguucauaugaguccaguuaccuagacaauuaauaaaaaagagcaaaauguugagugacuaugucauagguuacuuauuguuaaguuacagcuuuguaagcagcuugcuuuguaaauuuuucauccccugauggaugcugauuuuagaaggugagagacguguuagaaggaugugaauaucguuuuauuuauuggccauaauuaagugccuuugggcuuuuuggguacaggguuaaacuacagcucaacauuuaaaucaaauccaaccauaaaauucucuuaaguacaaaaaaaccagaugaccaaccucagggagaacccaagaaaaggugggcuuucccagcauugcugugcagcauucugagaauacagcuugauuuuucuacaucuuugcaugggcaacagugguacuggguccugucucuugggacaaguuucacugugauuuuaaauuuuuguuucaacuuggauucuucacgauugaccgucaaguugaaauccugguuuugacuuucacuacugugggaugugcacaggaaguuuuccaccaaauuuuccacgucguuccccuggcuuguuuaaugagagcuuggauuucaguuuuacuccaacaccuaaauagccugggucucuaccagcaugccacuaggguuuuacuucauuucagccuccugugggcauuggacacccggcacucugugaggguaacaugaaagauaggcccuuuucuuacccaagcugaugucugaaguacccguuuucacaugacucggaauuaggaauugccgucagauaacacugggcucuucucacucacccuuugcacuuggaguuuuuguuuuacuguuuccuuaaccugucacagucccuuaauuagaauguauugcuagaggacagggugcguuguccaacuuugugcgcauuuuauagaaacacacaaaaucaccagacaaagcagcuguagugugaacucauccagaugcgauacugaaauuccccagaggggcaucuucauuguuuucuuucuuuguuccagaagcaaaggccgauaaugaaccgagcuguucgccggcagcucaagaacuguugacaaggcugggauuuuuacugggagaagggaucccaagugccacacacauaaccauugaagacaaaaaugaaaccaugguaaugcccgaggaagacacuacauugcauaccucuucagaggaugaacgaagcaauaaccaucuucucccuuuccuugagcagggaagccauuguucaguuaaaugaguucugggcuguuguguauugaaauuuauuucaacaguuugguucuggguuuuugcaguggggagguagggaaaagcagaaagaagcagaacguaagaaaauguccacauuaaccuucuagucaccacccagagaauaauggccacaugaauuaaagaggcuaaaagaaugccuucauaaugcuaccaguacuuuuaccuuuauagcaccguucuucucaucugguugcuuugguauacgcuuuccugugccuuuuuagcuguugagauuuuggagggucaguggggugaggaaaagauuuauaggagaugaggcagagacaaaauaagaugagaucaaaugguccaucuaucaggaaagcacuuccccuccaagggagcagcagcaugcacccugccaccucccagaugugaugugugcaucugaauagcaaugcaggauggagcuucuacccuggugaaggucucugcacugcaagggagggugucaugcauugauugagacugaguggucaccagucuccuuccccugauugcagagcccauaaaucuugaggaauugaaucagguugcaguguucgugaaacaucacaaaaacagagcucccaggucuuccguacagaggucaaauaacccauuugucuucugcagacuucaaaugaaaggaagucugccuguuugccauuucuguuguacaaaugugcauccucacuaaauuauugcuaagacugaccuuuuaauaaaaaggaaaaucacaaaggaggggaaccgaacaaagauacugcuuucucaaaauuuggaagaccacauauacauuuauauagauaaagcuccaugaauccauaucuauacacacauaucucuuuagauuuuuuuuuuaaaacuuccguuuuccuguucuuaguuuuauuguuuuagcacaaaaacaaaagcaugugucgaagcauccuguguaagccgugcuaacuccuccuuccauucaucuugcagugcacagcucugagucaaggcaucaguccuugcuccacacuaacaagcagcaccgcaucuccuagcaccgauagccccugcucaaccuugaauagcugugucagcaagacggcagccaacaaaagucccugugagaccauuagcagcccuaguuccacccuggaaagcaaggacaguggaauuauagguaagaagcacacugcucgguaacauaauggcucgaaucucaucaaccagagcauucaccaggcacuuccucagaggguuuuagcauggucugugaaggucagucugccagcgccugcucuguucuuugcaggcagcacugacuccauguguagcugagagaguggagcauuggcuuuuacauuccuugauguuuacuuuauaacagucagcucauuuguuaaaaaaaaaaaaaaaaggaauuccagaucagaucuggccugugaaacaaaaaucauugcucuucuauauucaguuccauuuguugggcaucaggucccacuggggcacacagcagagcaaugaaauuccugcauauuaagacgucgucuuaucccaaucucaaggucacuuauuuuccugaugauagcucaggcguauguuuucuaggguuucuuaucaugggaucugacugcguuuugaggccagaauuuucuaaggaugaccucccugagccccuacacccacguaauaagugugguuguccugaagccuaggagucaggagacuuggguuccaguccggacucuuacgccgauuugcccggugacuugagcaacauugaauuuaccuuuuugcacacuuucuuucucuagaucauuaaggauuuugauuaauccaguaguuuucagucccagguuuguauuagaaucauccauggaauuuaagagucuuuauuuuuauaugccaucccagacagacugcauuuauguuucugcagcugggcuccagugucugugugacucaggucuccagcuuggugccuuucagguaacagaugggugggaccccuggaggggauuguucagaccuuccucuguuccaagauuauauugcaguuucacgcagagcucuucugaaagauuuaacuccccuuuugcugaguuaugcacgugucuuugagggauaguuuaugcuuuauuguggacugagugccacuuccacauuaauauguaaucaaauggaaugaacgaccuuugagcuccuuauuuucuuuagucaccugcaguuuauuucaaguguaauuuggaaaaccaggcagcagguucauccaguuuucacuuuggagauugccccagaaggucugugagauuccugggauuggguugugggcucuuugguguagaccucacuauagcuucuagaggggccccucagcuuaaggaaggcggcuucuugccauaauuuucaauugaaucagaaucuuuaauggauuuuuguuuuauuuuaccuucauucuuuauuaagaugaaauucacauaccauaguauucacucauuugaaccauuugacgguuuuuaguauauuuuaaaaguugugcaacugucaccacuaucugauuuuagaacauuuucauuauccccaaaagaaaccuugugaccauuagaaggcacacucuauuuccuacuccaagcuccccaguccuagucaaccaguaaucuauuaaucuuucugucucuguagcuuauucugaacauuucauauaaauggugggcugaguuuuguguagcaaauuuauauucuuuucacucagcuugaaggccuuccagugagcuuguucugcuaauuccccauucucaucuuacccugcuuccccagcugcuguuuagucuaguucagcuaauuuuucccagcguuacuucuguucuuaugcccuaucucuucugagcuguccaccauagauggaucuuugguauuuauucugagauaagcagaugacuuucuucacaguauucucgguucuucugaaauuuugucuccugcagauaguuuaucuucaaggauguggccagugcagcacuguuuugacaggcuuuuucuuuugaacauccuggccauuggcauuacaugccuuugauuauaaccaaauuuuuuuuuuuuuuuuuuuuugcuuugacaguuacaaacuuuucuugagacaggguuuugcucuguugcccaggcuggagugcaguggugcaauuguagcucacugcagccaaacuucugggcuaaugcaauccucccaccucagguucccggguaguugggacuacaggcaugugccaccacacuuagcucauuaaaaaauuuuuuaacauauuucacuguguuacccaggcuggucucaaauuuguggccucaagaauuccucccaccuuggccucccaaaguacugugauuacaggcaugagccgcugugcccggcccaaacuuuuaauaacugagagccacccauucguuuauuucucuuucucucucauugagauacagugccacaauuuuuaagguauucuaagcagaggaaagaaauggugcugguuugguuuuuuguguugucaaugaaauauuaaacugcaggagguucuuaauacuuaaucucauacagcccuacccaguagcugacugauuagaccccucuuacauguuccccauagugucucaauauuccccuucaguguauuuguucuuguuuuguuauuuaauuuucucuccagauguaaacaggggucucauuaauccagcuaucuacuagguuccuagcauggugcuggaaaugagaaauuaaggaaagagaaguguugccagugucgaguugcaucgggagagggaacguucaguuuauaaagaagcuaugcaggauccccauuccacaugggcuuugucaaaccuuucaaugucuguguuguaaccucugccaugaugacagaguuagcacauuucaugacauugaagcuguguuuuuccucugcucaagccaacauuuucccauaacucggcugagcaugaaaaguggcaacuguaggugaaagcagaaggaauuaggaaguggcugguaagucccucucauccagaagaccucagcucuggagaccaugccucccacuguguuuuccugcagguugcaagggcuguagagggaugagagggaggcacugcuguugacagcguuccucuguucuccuuccgugacaugcagaauuagaaccuguugccaagggacacgcuggaggugugguagggaggagaaggaaaagacgcaagaauuuccucuccaggcagacuguagccacaggucuuugaagaggcaggagugguggggacagaaaggggaagagcuuccuuuuaaaucaauacagggugugcagguuccacugccucuucacagagcagguuaucuaugacucaguugugguucugugauugcuggaguaggggugugccuuuuccaucugaagagcaugccuguuuuuauaagguguagccugggaauggcagcuuuugggcauuguaaguguuucacagaguaaaguauucaagagcaccaugacccuaguugggcggagaugaagaugagauaccuuggcuuccugcuuuggaagaccuaacaguggcuuguaaaacaggcuggugaggacccaugcucccaauuacacagggccuggagaaggcaggaagaggcuuuccauuuaauuuuccauuuuaaguaguuuaauauuugucagccaguagagcuggguuuggaauggcagaggcuuuggggguggacuguuacaaagugcacacagcugccgaggccuugcaagcuuugggcagcugugggcucaaagcaggguuccacauacaguauucacaugguuuauucagagcaguuuggggaaauuucagacaaugcuaaaccauccuuuaaaauuccuggaccuuucuuuacucuuuaagcugauucgcaucauguugguuauauuuaaucuaaauauuuuuguccagcagaugcagggacaggaagcuuguguucccacaugcccaggcacccaguuuagaaagaaauauaaaguaugugguuucaucaggacugccacagggugcccugcauguguucuguuuccacugcuuaggaggagaaagggcaggcuaguaaccaguacaagaauuuacugggccccuccagucuuccucucuggaggccagggcuuagcaaaccccuccugccccuuguuucaacuguauuauguuauccagaggggagucccgcuuuauccucuuucaggagguccaaguucuucugacauaaaugucuuuagaaguauaauaauucugucauguagaaauacugucuaagcugaaugggauuaacugaauucccuaugauuaucuuuuuuauuuuuuuaagugaacuucuuuacucuuuacauguuaaaaucauuggcauuaccuagaaguuggugucugauuuucaaauuugcaaugugaaaaucuucucaaggugaaacccaacuguacccaaucaccauaaaauagcuuucaguuacuuacugugaaaagaaaaacuuuacagaguaugcuuuuaaagguguuuccuccuugucugagaaaacauuuuuucucagugacauuccuuugaauaugucuugcuuccaacuguuacaaauggaaacuguaagcuguauuaaucccaguuuagaaagaaauauaaaguauguuuucauuagaaugugugaaaaccaaucugauuuucaaacaaagcaucacugaaaauguguuuuaaagugcuuugagauaaauuuaauuuguguuuauguacauaucgugauaaaauuuuaaguguguauauuaguuucaagaaaauaggcuauuucugcauuuaggaagaaagaggauagagccuggaugagaagaaacaaagaaaacccagcuuuccuaucaaaauaaaaagaaauccuuccuauccauuaaugauagaugugcagaggggaaggacuuauucuggcugagggaggggccguuaagucagucacucucuccauucgucuuuuuaaucugccuuucuuuaccuguugagauguguaaucuccggagcauuuuuguaguguccugaaucggccuccuuuggagaaacggugcuaggacaguuccaugaagggaggggacccugagggaacaguggcugccucuccccagcugggugugucugccacacagagcagguauguaaucuaccugcccagcucucagcaccugagcuggcaggcaugagccgccacauuccaccuggcuagguggcuuucugggugauuaagugcucagaauucaagcucuucugaaugccuuuccuuugcuuuccucaugcuuacauuuguuuucuucuugcucaguuugaagcagagaggcagguaugcauuuagacaggggaauaccuucguagaaacacuucugcagaaguagcuugcaguaaaauauuagacaccugguuaguauccugcuagaguaucuugcuagaguuugauaauauuuauuuuucugccuaguugcuuaggauguuuaaaaaaaaauuaucaugggcugacuuuuaucuuccuuugacucucuccuaccuccugcuaggcuuauaaaaugaaagugauuccagagguagcuuuagaccuuuuauuuccuggacuuugugccccaagggagauaaucagaugcagaggcacacaaagaugaauuaauuguacuuuauuuuccuuuuugacuuguuguaaauccugcccuuuugauuuuaugcuaauacugcuuuguugccaccuguaucgcccugcucacuacuaaauugaaaugcuuugaaauugauuugguaauaacuauuuagacuguuucaagucuggguuaauauucauuuugcuacguugccugcaauuuuuaaaaucauccuuaauuauagaagccuuuuuuuuaaaaucucuugggugaagagaagaauuuuucuuuauguauauaauuugguaauaugcuuaaugugggaaagaaauucuuggcaaugauuugagucagcaaagagccugcuguacuuuuauucagacuguaguuggauucuucaggcuguucuauugguguagcaagcauuuauuggcgccuacuguguaccaggagcaagcauguucaguacugggacaauaaagauaaggcacagcaucuauugucaaaacuuguccacuugugggacuacaaaauggucuucuguucuguggagagucugagcaaguugugaauuacugagaagaauuuaagacaugacagugauugauaccucugacggaagauguaugcugugggcgcauaaugauaccacuaaucgaacucuuuuccaaagucuggaaaagggucauuagacugugugagaagcuccagugucugugcacagguuaugugaggcuuuaucaaaacacugugcuuuuucuggaaaaugucauguuauuuaaguccuuagacuugucucuggagacuucucaguugggcaguguggugggucccauccuccccgcccagcaccaccugcucccagccauuccuuuagguguuuccuuaguugaagagccugaugaauguggcugggaaugugcggcucgggccccuggccuugcugcaugucauagcagagcaugccuugcgcaacacaggugagcacugagcuagaaauuucguacagagaucuggcugucacaagccagcauacggggcucccagagcaaggccagagagggagcagggcccuguggcgcauuggauggggcugggcaguugcagaaggagaagccagaagucuccugaagcugaagguuaccaugcaggguuggggcgggggucccaccugggacauucuguuggcauuccaggcaagguggcuuaagugccuucacuagaccccucagguuaaaagcuguggccgcaggugaaccagggacuuuguucucugugguugguuaguuugcagguggccgggccuagguagggguggaaauaaaaguacagucuggcaauucuggccagaaagguuuaagucaggccgguuucauugugcaggcuuucccuuacacacuugggaaaauccaaaauguggccugguggcuugaaugccugcugggugugaggugugggugcacaagagagggacgccaccugucagccaagaggccuacagacuucugcgcgcguugccuugacuugucucugaucuuuuccugaucggacuuccucugcagcagugaaaccuaauuuggaaaguucuuagucacaggaggcagucucgcuacaguagugggcuuuuccuuuucuauucacuucuuccuuucauccacuuuuaugagcggccauuauguuccuuucuuguuugauccuuaauucauugguccaguguuuuaacuuuaaauucuuccugucaaccacuaagcuaaauacagagguuaaaaaauguuugcuuuuuaagugcuacuuuauuuuucuucaguuguguggggaggaaaacauuccugagcauucaugaugccugaggcacuugacauaugcccuuaugucuaauuuucucugcaacccagggaaggacaaaucacucucuucagagaguccucucaaaaugcguauuuucuauuauaauaguauauguacauaauuuauaguacauguauuugggauguaugccaagucuugucuuaauaguaugguaugaucagagcaguguagagaggccgggcauggugggucacgccuguuaucccaucaccaugugaggcugaggugggaggaucgcuugagcccauuaguucaaaaccagccugggcaacauagggagauuuuguuucuacaaaaaaacuuaaaaaugagccaggggugcugguggugcaugccuguggucccagcuacucaggaggcugagguggaaagaucguuugagcccgugaggucgaggcugcagugagcugucauugcaccacuguacuccagccugggcaacagagcgagacccugucucgaaacaaaaaaaaaccauguagagccccauucuaggauagagugggacuuagggcauucuggggcuuuccuguccauagggcuguuaaugagagucagugaguugaagugcaaaaagaacuuagaaugaagccuggcauauaguaaacaguauuccaauauucaucuuagccacuguugugauuucuuaaggaucauuacuuaauuccucaccagugaauuugaaaugcucaaaacagacauguaauaaaccaagauuuuuccuuuuccaugaagguaugaguuggggaaaguaugaaauagggcaagagaaaagaugcauugaggagucacauucauaagacuguauucuucuuauaagugggcagaaagcuuuacuccuaaguuuccugauagcuaguggaaagagagaaaacacauguggaaggugguguuuauaaagacaaaaauguccauugcccaaaaugguaccgggucuggagacgcauaccuccuuguggacccccuagaggggagaagccaagguugcagcaagccccuugcucuuuucacccuugucuucucuguagcucaaagagaagguucugaugaauuguuuguggcauauguuugguaucucugguccuuaguuccugaacaauucugggcuaaugcuguagucagguuacaguuagcuuucuucuugauguucauuuaagccuauaacuugauuuggaucccaccaaacuaccuauagggcccuggaccgacacugauuuuauuuuucuuuugcugauucuauuuuaaguguccauucaacauagaaccuucagaaggcaagggguaaaguuggauccuagcacuuuaggaggccaagguggguggauugcuugagcucaggaguucaagaccagugugggcaacauggcggcacccugucucuacaaaaauauaaaaaauuagcaaggugugguaccuguagucccagcuacuuagggggcugaggugggaggaucgcuugagccuuggaaguucgaggcugcagugagccgagauagcaccacugcacuccagccugggcaagagagugagacccugucucaaaaaaaaaaaaaaaaaacuuugggaaggugaagaaagagugcagucguauuucagagccuugcagagcaaagcauuugaugacugaguggaugacuuuuuaacaaggcagacuucaugaacuuuuagccacagauaauuaacuccuuuuauguaaugagcaccaugcaagcaaaugguguuuuaaaaauacgcuguauguauaaucagaagaauugguauuagcuauaccacuaauugugcauacacauacgugugugugugugugugugugugugugagagagagagagagagagagagagagagagagagagagagagaucagguucucuggagccuuuuaucucuauaaggugggguugaugguucucagccuaucugccuccucucaugggaugugaucagguauacgcccuguuauauuaagaaagugagccaggugcaaugaugugugccuauagucccagcuacuugggaggcugaugcaggaggacugauugaggccaggaguuugagaccagccugggcagcauagugaaaucccauauuauucaaaaaaaagaaaaguguuuuggaaguauucuaccccuguacacuaguacaaaggaagauaagacacuguccuugagacuaaacggaauguaacacuaaauugugaggcacagccuaaccucacagccuuauaaaauuuaaggccugauaagucgcucaguuucagaaugcccugugucucgaggguggcugagacccaguuugggugaugauagcaagcuguaauugacaaaagcugccaucuauacuaguccaaagaacaaaaugcuagaauuuuuaaauuauuaaggcaacuauaaacauuagccagucucugggaaaugucaaauagcacuuuuuagagauuuuuuuuuuuuaagucaucacaguuaagaugcugcccuugauguguacguguacccacaagcauuuuugagagugauugacuggguuaaccugauuaggaguuugaauuucuguaagguuggaagaaagaaagaugucguuuauuggaagaaccagcuuucucuucuuggggacuccggggcugccauguuugguguuguucuuagguuaugcagggaagccagacugauuuggccuucaucugcucagcuggaucugccucagggcucggauggagcugagccaagaugagagugucugggcuuccaccuguguaggcuacaucugauauugaaucccaggaaggagugucaauggaguggcuucagauuuuccagccucccugccucugagaacccugggacauguggaccguggaaugccucucucacaggaacuuugugagggcagcagaagggcugccucuucuuccucacuagucuccuucauauaaacacugaccuuacaauauguucauuucuaaaugguuaccccaucugggacuucucuucgcagugacugcuccugcagcugagcccuuccucccccaccccuuuuccuuccucucccugccaggaccugaguguuaccccuccgcccccucucccccuccacgagaugcugggcacaguguagggcacaugucugccagugagagccacaccuuccaccuguccugccaucaggagcucugaccuggccuucccagccauccucagcugcuccaugggucccugagguccugauugcagugcugucacuuguaacaggaagugagcuaaguccuuauuuccccugcuugagguccuaguuaggacucagaucuuugggguuugauucagaagugcuuggcacuuagggagagcacuuugacuuuugguuuaauuuuucaauuuacaaauacgugcuuuccaauguaacagccacaaaaauaaaaccaaacaaauccccuaucucccuagccuggaacucuuccugucacuuggauguuggaguagccugugaaccuaacuuauuacaauaugucugagaaaagcauuuugaguugcaaaugcuggauuuaaaugugaagguuuguaacaccacaaucuguguuaugggauggcccccauuuuuaugcuucaagcuuauuaacaggauuaccauuaauaagcaauaaucuuaucaauaaauuagaccacuccugaaaaacauuagcacacuucuagcauauagcaaaccuucaguaaaugcuagcuucugcugucaacaccaccauuggcauuuuuaugauagaaagagucauacuugcuaugccuauguucauauaaauggucuauuuaaaaacacaaggaaggcugugauugauuccaaagagguggagguaugguuuaauacugcugauggaacacuggcaaaugcugggaaucauaacgaugggcacccaaaaucagauccugaacucugguaagugagauuaaguguagugucucugaccacaaauggaauugaaguuuauucauuugcucauucauucaauuagcaagcauuuauugagcacuuacuaugugcugugcugugcuauucagaaaaggaaaagauagccauggauacucuagggaaggcuucagcauuuaugugggauuuuuuaaaauaggcaaccagagagggugauaaguccaggcugcagcagcaggaggaguaaagacagucagaauugugacaggauguccugggccacugcaaggaaauaguuuugucuuuacuucuaaaccguaaagaauauaaacaaagcuaaacccuucagacccuuugauccuaaauaacugacccugagcuaauuuaccagccuucugauacaguguguaucaucuugguguguggcuaaagcagccugauccaggagcuggguucugaaugcacuuuggcccugugcacucccauuuaacaggcguggaguugagggccuaggugacuggaauccagauagggaaagaggcaucgguggacauggccccuguucucaaggacgcagccagcguuaguucuaacaguggggcagugugaguggcccaggugaugaugaccugugguugcaaggggaucccauauggcucagcaucuuuaaauuagaagugacucuuuguagaagcuauguagggugaguauugcuucgcuuuuugaccauguucuuucugcucuuuugccaagauguuuacaaaagguuuuuuguaccuuuuuucugugcugguuuucuuucuuggagauuaaaugugaauucugcagucauaguauaccuucuccugcugguacuucaccugcgcuggauaugggaagguuuuccauuucguguugcugaggaaauaauaagucagucucucuggaucaucuugaauagauguuauaagcuuuaagggucaaauucucuguuugacuuuauaauuguauuuuuguuucuaaagauuuucuccugcaccguuucugcauuaaccauucuguuguuuguucccacucccccacccccagcaaauguuuuuaauuuggaaaguauauuuaaagguucaaaggaauuuaaugagaaaugaauucuuuugugaguaaucuuuguuaaaaagaggauacauuaucuccagguuacauaauuuuacucuuaacucugauacuuuuuagacaauuuuuuucauuaucuuccuaucagaguuucucccucgcuccucuucucuguagagugauuuagcagcuuauuuccccugguaagccacauucuucuaauuuaccaaaauacauuguauggaacauacuuugauaaaaaucuguguggacuggaaaacuuuccauugauccuggggagggcagugugcauguuuuaauucuucagccccagcugugccuggccuccuucaaaguauuuuggucuuucauuucagccacaauuacaaguucauccgaaaaugaugaccggaguggcuccaguuuggaauggaauaaagauggaaaccuaagauuagggguucagaagggagugcuucaugaccgcagggcagauaacugcuccccaguggcagaagaggagaccaccgggucagcagagagcacgcugcccaaagcagaauccucagcuggagaugguccagucccuuauucucagggcuccagcucacuaauaaugccacggcccaacucaguugcagguaaggccacaccuuucccuggaaggauuaucucagggauaccaaggugcccuguguucacugucuucacaugggaagacacuccagauacaagccagcuucguggccgugggucaggcacuuaccuuuucuaagccucaguuuacuaaucuguaaacacaauaaggcuguacuuaauggucuuuaagugauccuucugcucuggaauucuuuaaaucgauuauuuggacugucaggcucuuuguauauaagagaagaaaguauaaaaacucuccucucgguuuuuguuuuaagccuuagaaaauucauuacuguuuauuaccuccugguaaaugggaauuguugagugaguuuguuaauaucagcucgaggaucuucuuaccaaacuuacaaacuuauuuuugucuaauugaggccgauuguacaggcaagagggccgaauuucuguacaauuuaguuaaaauggagcucacggcuuaaaauguaagcaguggaaguaggagcucucaaucaaggaaaugaaaauauucgagauagacaugcuuuaccgagauaugcagcagcuggaacaaagaagaaaccacaaaggcuggcaacugucaguagucagacuggucaccaggugugugucaagcaaggagaauacagucaguccccuguaucuauaguucuacaucuauggauucauccagccauggagcagaaauacccaaggaaaaaaaucgauaaaaaauaauaagaauuuaaaaauacagucucacaacuauuuacauuguauuagguauuauaaguaaucuagagauuauuuaaaauauauaggaggauguuuguagguuaugugcaaauauuauaccauuuuauaguaggaacuugagcaucugaggauuucgguauccucagggggcccuggaagugaucuccagugcauagugaaggaugacuauagcuccagguggguggggaaaggagcucucugcaucugagcuguggggccuguuuuuaagguuucuaguuucuaaacuccaugcccugugcugaguuuagaagaggaacuuguuacagucauucuuuguuaucaguguagcacuuaacauuucucuucuacuacugcagggacccagauucuccgcuccuacgucagagaauuucucugugauuuauacugugcuuucaggaugcggugggucacucuggugguuguuggguguucuuuuacaaugggacucugaaguagcugauaaauaaguggcccuaauggaaaagugcugaggcacaacucuaauucacuuucaaaggaagugaaauggccuuguuccagaagagggauuuggcaugucugcuggagagaaauacuagagaacauuauacgaguugacugauaguccuuccacaagcuuuccuguccucccaccacugucccaccacuuuaacagaguauguggcacccaaggcgcuuuagaccguauuuaccuaguuaugaugaaugggucauuuguauuaucccagaacuugaucacuuuauuaacuucaacaaaaauagugaacuugugcucaauuuagucaagcuguuuuaaaauuaggaaacauuacuguguuaauuuuaacaguguuaaaagcaucccauuugggguuguuuucugcucgauguucuuuaugggucuccugccaugugaagugacagugggugugagcugagcuuuuccaggaggcugccgugauuauagagcagagcuuucugauuucugcugugcgcauucauuagcuucugcgugugcccuugagcuagaccuccuguggaaugggaggguuucaccucuagauuugagcaaagucuaccuggccuaauggguuugcucauuucuugugugcuacauguuuuuuaaacuaaaugcauauuuugaaaggacgugagcaaaggccuauuucaugauaucuguuaacaagcuaggagucugguagauucuucauugccucccuuccugccccugaaguugaaucucaguuaagaggaaauggcaagauuuuucaaguaccauugaagaguaagauucagguuguauagacucuaugcagcacuauuuagugauuagaaggcaggcugcuacaaacagggcagcagagaacacucaguguuagaagaaucagaauaauaugugaaggaccguauacagaaaucucuuagaaguauuugcauguuaugauccagguaaacaaauugccuuuuggugggaaagguguuuuggcauaugaggauuggcagguaaaggaagggugaugccagaccucuguucacagccuccucauggggcuggccccuaggggauugggugcagaaguucuuccuaagguccuuuauugagcuugcuacagagaaugaaauugucuguuaaccauguaguacagugacagguuuuuuuauuuuuauuuuuugacaaagauuauaaaaauaaguuggcuagguuuaaagauuauuucacuauacagauuuucuuuguaaagauauuuauuagagugggauugguuuggacaacuauauaucacaucaaaaugcaugacauggacaccucuuuccuuuauuaaaaacagaccuagaagccuuuaaagguauguuuuaaaucagaaagaaguuggguaauggguucuauuuuuuaccuuucaaaauacuuucugaguggauuauagaacacuguguuuaauuuuccaggaaacaagcaugauugcuauccaguuuuccuaaaacuggucauugcccuggacuuauuggcauggacuuuccauagguuagaccacaacuuuagcaaauguucuucuuuguucagcuuagagaugucucccucugccuugccccaccaagcccacccucaccaaaaaacggacuuuccuccacaucuugaaaugugcuucuuauccagauguuagauauggugugugugugugugugugcacaacaaguguauaauuaauuucgcuguagagauucuagcaguggguuuauuguagcaugaaauuauugcuuuaccuuuggguuuuuggggcccugaguagugucuaggauuuugaaagcguuuauggguaaauacugaaugugagucugacuuuugcauagguaacaacugagaaucuacuguaggcaugccugagagggcagaguggcccaaguuaccugcucagaggguggggagcaccugggcacauagcuaagccacugaaaucuuccugcccuauucacuggcaccucuauugguggcuucgaaaaugccucagaaagcugagauagcuggcaggugguggcuuauggcccugcugcagcuuucagcucggcuuaaucguauuugaaauugagaaucagccaagagcuguggaagugcugaggcugcucuguugcagauuuuggugccgaagcucuaguggcugggaaucugaaaacaggccuguggaaucuuaacaucuccuguaccuguuuagauacaaucuagggcauuuuugcaauccuuuauuuggaaugucuuuuauggucacauauuuuuaauccuuucaguuguuauaaauuuauaaacuguucuaaggagucaggggaagaagggaaauaggcaacacuuuugaggcucuaaagcaucuuuuuauucucuagggcugcagcauuaugucagauguucaugacuguucuggcucugaaaugaauuacggguuaugaauauggcugccugccccuucuaccugugccuuggugggugcauucaccaugaggcaugugaggagaagggucucagugcucaggcaggagccuagaaaauguuccaagcuguguuacuguagggagguaagaagguuuggggaagacaguguaguccuguuagcccuccgggagauuuuauacacccuacuuaugaagggccuagagagaagcuagacgcuguccuuggauuaccguacauucgauccauuuaaaauccccaacaaguaauuagcugagucuuucuaaugggaaagauuugugugguagcuggcaaagugcauagaauauucacuuaaauguguauacacuguggauaugcaccaggaggauacagaggcauaggugcaugcugucgugaagucaagguuucagguguuucuugcucgcugggaggaugaguaggcagggcacguguuggauugcccuuuggaggaugcagcgagaggggauaugccaacacagucaggccuggagccacccagguggcuguugaaugaaggaaugagagaggaugauauggauagugaggaagagaaggacugagaucuuaguagggggaaauggaagggugcagguaggacggauggcacuggucggcagcuggaugcugggucagagccuguugggcagccagaggguuuucagaagacagauggcccaacucgacuucuguccccugcaccuuggucccacugaagauguccccagugcuaagaaggcuuuacccaggcacuaugucucccucuaggcucucauuugcccucaagucacuguauauuuucuuguccugaaagauaauaaucugacuaagaucaacaguacuucauguugggcuuaacccauaaaccaaauuagguuaauuuuagauuuuccucaauguaauaacaggagggguuuuuaaaaggcaaaaacguguacuauguacuugcuucuaagauuucuugagaauuagcaaaauuauuuugcgguaguuguuuuuguaaucuaacucguaugaauguuugaauagaucuuuaauuuuuuuuuuuuuuuuuugagacagaguuuugcucugucacccaggcuggaguguaguggcacgauccuggcucacugcaaccucugccucccagguuuaagcgauucuccugccuuagccucccaaguagcugggauuucagagacccgccuccaugcccagcuaauuuuuuuuguuuuuuaguagaaaugggguuucaccauguuggccaggcuggucuugaacuccugaccucaagcgauccacccgccccagccucccaaaguccugugauuacaggcgugagccacugcacccugcucuuuaaugcuuuauaacaaauacuuaggugauaugagucuuacugacuuggucagagguaaacauaacuuauuuuuauaauaaaaaacaccaaaaaaugcgguaugauauagaauguguauauaagucuacacauauauuugaagcuuaggaauaugauuauacuauuacuacugagccaacuuuuaguguucucggugcuguggaauuguacacauagaaucugcccauuuaauuaauaaguugggaauuccaaacagcagaaagcuccccagagcugcagagaagaaucuagcagcaugccaccugcuugugguguuaaguacugaagcuuugcugugugccacaugauugucagauuuccucaucaaacacuuuauggugaauucugucucuuuccaggaauaauggagaauucugacaacucagucaacauaacuuuaagaaaaagaagcauuugguuuuuaccacuuuucaacuaaugauacugccagaaaaauaaacuggggcaaacaauaucaaaaugaaguuuaaguaaauuuuguugaaagccugaacugaauugcuuagugauuuauaaguuauagucacuuagguaugaaauuuaaagucaccuuugaagauacuaaacuucaguuuaauauuacagcaacaagcucaaccaaauuggaagaucugaguuauuuagacgggcagagaaaugcuccucuacggacgucaauuagauuaccauggcacaauacggccggagguagggcacaggaaguuaaagguauuuauccuggcaucagcugcgauaaugguuaugacuaacucagucaguaacuuugaaagucugugauaaccagcauugaagccaacuguguuuauaacaugauggaaaguguguuugugcuaaaagcauaucugugaggugugcuaagaggucauccucaacaguuuggggcuucuuccuuuaaaauaugugauuaacuugcuucuggaauugaaaaaguaauucugcaguaaguuauuuugaagugagggguaguuuugaagugagggguaguuuaacacucauuagguguuuauuacuaauaaaguauaagcuuuguuucaauucuuggacuaggccaggcgcgguggcucaugccuguaaucccagcacuuugagaggccgaggcagguggaucaccugaggucaggaguuugagaccagccuggccaauguggugaaaccuuaucucuguuaaaaauauaaaaauuagcugggcaugguggcagguaccuguaaucacagcuacuugggaggcugagguaggagaauuauuugaacccaagaggcggagguugcagugagcugagaucgugccauugcacuccagccugggcaacaagagugaaacuaucucaaaaaaaaaaaaaaacacuuggacuguauuggccauguucucugucuaccuguaacacaguugugugagguacacagcagccucacuguacaggcagagucaucacaccuggaugagagcagagcccuauuucuagggaaaacauguuucuguuuuauucauacagcagggaagaagcacgucuuaaaugcaguuccagaugaaccaaugagacaugauuuggccccucacauggcuuucucuaauccucugugugucugccuugaguccugagaauaauucaaagccaugacaagacuagagaguaauuucaauaggacacucuaguuuccuauugguccaauagguccaauaggguaugguaauugagguauuacagaaguauuaauagaacgagauuggaaaugcuuacagacagauccuaguggggguaaagcuaaggauuuaguguaacacacaagcaauaauauuugaguuucuuaguuuauaaaauuaugacauuuuucuaaaauuuuuuuuucuucuuuugaagcacgauuugcucccuacaagccacaagacauuuuguugaaacccuuguuguuugaaguaccaagcauaacaacagacucuguguuugugggaagggauuggcucuuucaccagauagaagaaaacuugaggaacacagaacuggcagaaaacagaggcgcgguggugguuggcaaugugggauuugggaagacggcaaucauuuccaaguugguggcccugagcugccacggaagccgcaugaggcagauugcuuccaacagcccggguucaucaccuaaaaguacgugcauguuuaauuacuugucuaguuuauuaacauaagauagauggaggaaauugcuguucacauagacauaaaauaccaauuuuccucaaguuguugcagcuacuauaucagguuugccaucaugugugaagugaacuguuucaauaugucccuccaucaugauguguauucagcuguaagcuggggcgaggccaguguucccugauguccuccugaacuguaacccccucuuccuuuagauacaggcagagaugggccagugaggcugaucaaguguccuggagaauuuggggcccuaagagcaagggguugggcuccugguagaacaagcucagauggacucuaauguggaguucuuuuguacccuguuuggcacagccuucgucuucuguauuggauuuuccaaaauuauaaagacauaggauagaguagccaaauguuugacuauuuacuguuuauuucauaugcaauaaacccacucuaaacauggugaacaagugaaucaugcgagauuuuuaagacacaaaagaauuuaauaggccaggcgcugugacucacaucuguaauaccaacacuuuggaaggccgaggugggaggaucgcuugagcccaggaguuugagaccagcuuggacaacauagggagaccucgucucuacaaaaaauucaccagucauaguggugccugccuuuugucccagcuacucaggaggcugaggugggaggaucgcuugagcccaguaaaugaaggcugcagugagcugggauugugccacugcccucaugccuguaaucccagcacuuugguaggccaagaugggcagaucaccuaaggucaggagauugagaccagccugaccaacaugguaaaaccccgucucuacugaaaauacaaaaauuagcugggugugguggcgggugccuguaaucccagcuacuugggaggcugaggcaggagaaucaccugaacccaggaggucgagguugcagugagccgagauggcaccacuguacucuagccugggccacagagugagacuccgccuuaaaaaaaaaaaaaaaaaaagaaaaagaaaaaaaaaauuuaauagaggaaacuggaaacaguacacugauggcuguucuccagggaggggaaccaguuggguggcagacagaugggaaccugugcucucauguggaccucugaauuuuggaccauguucacuccuugcuuauuaaaauaugcccuggcacaaaucaagaaauauauucaauaccacacccugcuccuacugugauguacauaaugaaaugggucuuucucugcagccucugaccccacucaggaucuucauuucacuccguugcuuucaccgaguucuuccacaagugcuuccagcacagcuaaaacaccucuugggucuaucagugcugaaaaccagagaccaagagaggaugcagugaaauaucuugcuucuaagguaaucuuucuuguuuuauuggagccuuccacauagagagauuugcugguuugguuucugagaaguagauuggaaaagggagcuuaaaacagagacaacugcuuaaugauaaaguauagcuuuuaaugaaauagugauacaguucuccaaguaaaagugugaaugacaguaaguaucuguuuuaagacauuggcaguggaccugauccaucuuaaacaauggauugaaagaguuccucaaggcagcagaagguagcaugugcacucgccacaaauccaugcuuaucugcaugugcucuuccuaauuugguaugugagcaggaaauugggagcuuuugacuugacccagaccucuuccccugcacucuguugucugaggccuuugguuuccuuggcuuucugacagagguuucucgugaaguuguaauagagccuuccuuggcuaacuuucccuucuuaaauuugugaucaucaaggucuuucugaaguuuuucuucugcuuagcacccaucacuggcucaccaaccgcacuccugcauuaaagcaguuacaucccuugcuccuagugagcuacuuaaguuucccugggcagcaguggugugagucgguggagcuggagagcugcuggagccagcagccauggggacaccuugugaggaggcccuguggggagguuggugaggggagcugaaccgaaucuugcccugcaccagauccccgucccuucugcuuuccggaugaugacugcucuuggcgccaucaccccugaugguucugaccacugguucagaacaguccucuagucaugagugggugauuugagaugagugauguagugcagacuucaaagccaucccugcuuauggugauuuucaaacuccauugacugugacccacauaagagauacaucuuacacuagagaucacucacacauaaucacccacauaacuaaagcauuuuagaacuauguuuauucuuauauccuauaauacacucuaguguuccuaaguuuauuuuuuaaaaaauuguggcucuaaauugauuucaaggccgggccuggcggcucaugcuuguaaucccagcacuuugggaggccgaggcguacagaucacuccaguggucaggaguuggagaccagccuggccaacauauugaaaccucgucucuacuaaaaauacaaaaauuagccaggcauggugccaggcaccuauaaucccagcuacucgggaggcugaggcgggagaaucacuugaacucaggaggcggaggcugcagugagccaagauugugcaacugcacuccaaccugggugacagagcaagacuucaucucaaaaaaauaaaauaaauaaauaaauagauuucaugacccacuguuggguugccaagcuguuuuugucaaaugccaugugagacugugguacuggacaucucaugaugguuugcacaagcuuacaggauccucacauguaucccugcuaauuucuguccaggugagaguuggagagcagccagcuuuccucuguugaugauaaauuuaaucuaaaccaaaagucucauggcaacuccagguuggccagagaaaagcuguugcacauuuacuuuugccacuugccuuuuaaagagucugcagacuugggaucuaaucccacaucccugacuaucugugucagguuggcaaggcaucuaaccucagugucuggugcccucagugaugaacuguggcuagugguucuuguccuacuuccugcaggcgcuugccgcacccagugggacagcagcaaggcagauacucccaaaaaacagguagcucuuggcacgaguguuuugcucuucuuuuccuuccuuaccuucuacuuguguuucuccuaucauccuccuuuggaaaaguauuggauuuuucuucuaucuauagcacgccucccauucccaacacuucagcgucuggcccuuucguggggucccucucacaaacagccugcugacacugcaggucccuuggaacagggaccauuccuuuuccucucaguaccugggcagcucccucucaacuccaacuuaucucuccacacgaugggcagagauuuggugauuucggguuucauucuucagacagugccccuguagaacuccuccacagugucccuugaugcaguguggguguggggaggggccaagaucuugacccuccugaccaggagaaggagcugcugugacucuacagccccggucucacagccacuggguuuaucaucugccuuuugggaucagcaaaaggguuuccuaaagaggugccgcugcucuugagaacagaaaccuagugaagauggcacuuuuugauguugagaauauuaggauggcuuggagcugcuguaagccaggguagguuuuagguuuuaugaaugcuguuuguuuauauuaaauacaaaaauaaaaaaauaacuugugcugauuuuuaugcuaaucaagauggcuuuguggaugcaguuaaaggucugcaaaccacauaagugaaggaaggaauaaauggaacaauuaugcuaacaaaugacccagucuuggggaauagaugcuauguaucuuguuaccagcgaaugggcagaguuguguuccuguuugagauugcagaaggagcugugugaagagggugaggugaugcugacgguucugcuucccccuaggugguggccuaccacuacugccaggcugacaacacguacacuugccuggugcccgaguuugugcacagcaucgcagcuuugcucugccggucccaucagcuggccgccuacagagaccuucugauaaaggagccccaacuacagagcaugcugagccuccgauccugugugcaggacccgguggcagcuuucaagaggggagugcuggagccacucacaaaccugagaaaugguacuucgcagcagcuacccacagccccaucucaguagugguacagcagacacaggugguccccagaaggcagguggucagccgggcugggguagaagugagguggagcauggagaggaugucgaagccuccgugcccauccacuccucuuucucagaaccagccccaugaggucgcuccuacaccaccccuaugguauaguguuaaaagaagcacccugauaagaaugaaugugaugacugagcaguuccaaaguagucagcuuguaagugugggcuguuuaggugacuugcaccacagaagacuguugcguauuuugcacuccuaaguaucugagggaauaaguggauuauuuggaggaauuuuccagcauauauauuugucagggccucugcucaguugaauugaaaccuuaaagugacuucuaaagguuuccauuuuaauuguuuguccccgacaagguaauggacaucagugaccugaugggcccuucaguuucccauccucucugcccuggacuccucaccuuuugagcuuguuuacuugcccacauggcaccucugcuggaaggugcuagagggauagaaaacagauaugucaucauuucuucucuauugccugggcagaaaaucagcacuaauaaauagaaaaccagauucaggcucgcagagaagagcccuguuggaggagucgguagcguggagcucucacgcuguguugguuguauggcuuggccagggcaguuugcccugggcugggggcagcgagggggucaguuucccuucccuggaauccacuggggagcucucauggggggaccuagugaccuuuccggauugggccucuguauguguucauuaucuuuguguagcccaccccaaugacagugguuuaugaagagcuaacuguguuauauacacgagugagauucugcuaacaugugucaugcaauauguuuguuuugugagaauugguuuucuuuuggcucugugcuccaguuuucauuauaaauuuaauagaaaauaugcuucugugaaaacuguuucuugugccauauguaaaccuuuuuaguuucuaacacuaaacugggcacuaaaauacacuggguguugcugucuuagagaaauguauaauuucuuaauuugaaaaaauuauuuuauccuguagagcagaaaauuccugaagaagaauacauuauuuugauagauggcuuaaaugaagcugaguuucauaaaccugauuauggagauacgcuuucuucauuuauuaccaaaauuauuucuaaauuuccugccugguugaaguugauugugacuguaagagcaaauuuucagguaacaaagaauucucaaaucuuucuccaaguccccauuccaauuuuacagugauaaauguuaauaacguaaaacuguuguaaaccauucagcugcuugaauuggaaacuauguuaagaauuugaaaaacuaguccagagagccagacuugggugaaacucugaccuuuuuagccccagguauauuuaucaagaugucagguaaguuuccuguuggcaucgaauugcacguucacuuuucaaaugguggcaucuagcccugguuaccgucauggaguguguggggccaagaggccugccagaguuuaaagcuacuccugcugguaguuauuugcaaggguuuacuguggggcuuuguguuuuuuugaagggaaaaaugaaggugaaagauuuuuuuuuuuuuuuuuuuugagauagagucucgcucugucacccaggauggagugcaguggcaugaucucggcucaaugcagccuccgccucccugguuccagugauucuccugccuuggccuccggaguagcugggauuacaggcaucugccaccaugcccagcuaauuuuuguauuuuuaguagagacggauuuucaccauguuggccaggcuggucuccaacuccugaccucaggugauccacccaccuuggccucccaaagugcugggauuacaggcaugagccacugugccuggcugaaggugaaacauuuuuaaggccuauucccagaggucuauuuuuucacaaaacuuaagcaugagguaacauuugcagcgagggguagggugauuuuuuuuuucuccuccaucuucuuccucacuuaaacccugaaauugugucuuaaccauugacuccuucuauaccuauccuuuuucagugaagacuuuuagacauuagguuuugauuuuugcccuuuuaugauauuuauuuaaaaacagcauuuggaauuuuuucauuauaaaaacugaaauuagaccucaguugaacuugaugcguguuuuuuggacauucaguuuguauauuuuucagucauuuuuuacauaguaagcacaauuuguccaucaguagaucauaggaaccaggaaucuuacguucuucuucccagcuguguaaguuuucagagcuucagauagcauccauguaaaaugggaauaauuguauucugcccucuuuaucuacauuguuauauuaaaugagcacgugcauuuaaauacuucagaaacaauagugggaagucuuuuuaaaaaggcaaaacucuucuuugcuuuuaggugucagaugugcuuaaucuuuggaauggggaagagaugggaagggcacaugaggcuucugggagcugaggauguuuuguuucugggugcugguuacauagguauauuugacuuagugaaaauuagugacacugugcaauugucauuuguacacaaaucauauguucauuguuagacuucaauuuaaaaguuuacuuuaaaaaagcaauucauaaaauaacgugcuauaccaaaguaggcagcuuuguuaagaugcgcugucguugagacacagcccaggggcagacucagauuuccugauuggguuacacagccccaguguuugcugcauaaagaaggaugucuuuuaucuuggcgucuggccguguucuuagaugugcaguguugguugguguuuguccuuguuauauaagcaguuucacaguguaaggauuauggguaucaggucaccugcagagucucacugcccuuacuggcccuggccucguugccgcugucugcacagggcucuuacucugcuugcuaggcucaggguccuuggaugagggccucaggauagcacuuacugauuccaucucccaucaggauuucuuucacauaagcuuuuuaucuucaccuuauccuauuacacguuuuaauacaaaacaaugagucccuguaauccaugaaaauccuccuugaaacaaaacuagugaaucugguuuaaaaugcuguuaaaauaaaaaaggaaucucuuuagagugacacuguggguuuuuguuuucucccccaggaaaucauaagugcgcugccauuugucaagcuuuccuuagaugacuucccagacaacaaagacauccacagugaccugcacgccuacguccagcacagggugcacagcagccaggacauccucagcaacaucucccugaauggcaaggccgaugccacacucauuggaaaagugagcagccaccuggugcugcggagccucggcuccuaccuguaccucaagcucacccuggaccuuuuccagaggggccacuuggucauuaagagugccagcuacaagguggugcccgugucucucucugagcucuauuugcuucagugcaacaugaaguucaugacccaguccgccuuugagagggcacuuccgauucucaacguggcccucgcaucccuccaccccaugacagacgagcagaucuuucaggcuauuaaugcuggccacauccagggggagcagggaugggaagacuuucagcagaggauggacgcccucuccugcuuccucauuaagaggcgagacaaaacccgcauguucugccacccguccuucagggaguggcuuguauggagagcagacggggaaaacacggccuuccugugugagcccagguacggcaggcgcuuucuuucagcucuuugcagggaaucucgugugcaguuggggaaaggauuuaaaugugaugcacgugucucaauggaagggcaauccagaaugacuaauucaguguuacugcuuuguuuuauuauuuuucuuccuuuuuggcagaaggaugggcaauggggaauucucuauacagaagcugccuucuaauugcuaggacucccuuauggaugguacauguggauaaaagagaagcuggguggugccugugugguccuuccuuacuguccauugucucauggagccccgucuccucccccacccagcuucugcaggaucaugcaugggaaugugugagaucagccccugggaacagggggcuucucuagagggaguucccugugugucugcagacugucauggguccucagcaccuccacuccccugccaccccuugaacauggagugacuugucccagggaucagguauaucugugagcccagagggagcaccaugauccaaucuagccuccccgcuccacacccuucacccuuuguggaugagcucugugugguggacuggaccaggcugggaugcaguucuccuugcugccugggccgcuguuaucacagugggauggggaaggaagccugucugcuguguggcuugguaacagugugagaggucagaaaguuugaggaugcagaugcguucagauauguauauggcaagcccccaacuuccacuuggcccuggcuuuggccugugucucugcugucucgaguggcuucggcuaucugugagccagaauugcccccugcuguaguaacagggcuggcaagcugcucagcugaccccuuaggcauuugaccagaugcugggauccagaaaugaagaggugaacaagcauuggugagcccugggagccucacagccacuuuccucccugugaauauugacugaacauccaccugauaggccuggcugcuguucauguuggggcuguuauuauuuucuucaguaacacuggcugaagguuuguuguuaucuuuugaaccugguuuggggcaauaaacuaacauccagguuauuuagccagaccauaauagcuaggugaaacaugugcugugacauuucuagccaagucagauuacuuucuagggaaauuccagucauuuucuaggaagauugacuauagcugaguuuguagagacauaaaaacaaauugaaagacuccaucaggaguguagguuguuacuggguuggaggcuaaaguggcuggacuguagucuucauuaagcuucgcuucauuuuggguauuggugggcauugagguuauguagccuaggucagagcuagggugggugccugugggcuccugaaugccacuguguucuuaaaagcaggcauggggacauccccuggggcaggaccuggacuagguggaggcaagagagguaccaagggugcagaauuuaaggaagcacccacuccuggguggugcgaguuguugccauuuucccaagacaccuguaguauuugagcuucauucaauugagaggauauagaacaauguuggaaggaagcuacuggauucaguucagcaacaguuuuuguuauaugcaguuaugugcaaaguacuguggcagacaccaauuguugggacaaggacccugcucucagggcuucccacacagggcaggggaggcaggaggugauaugcgagagggaggcacacuucauguggaccucacaagagggagaagcucccagcguaaguaaaggggccuggggaggugauuuuaaaacauggugaugguggguugggccucgaaaaaugguagcauuucuuccccaacucccaguugucguauuuuugcccuaauuauaaaagcagaaaauuucaacccucagacaaagacaguucauuuuuuauuucugccucuuucuguagcauuuuaaaugauauaccaaucuucuuuuucucuuggaauucuuaucuggguuuuugcuuaacacaucacgggcaccuuacuaagcuguuagaagucuuagaaaagugucauuuucauuuuucaugguugugcaaaacuccuaggaggcaaauuauuauguacuucacuauacccucauuggauuuuuuugcuuuuuuuuuuuuucagacggagucucgcugucgcccaggcuagagugcaguggugugaucucagcucacugcaggcuccgcccccugggguucacaccauucuccugccucagccuucccacguagcugggacuacaggcgcccgccaccucauccggcuaacuuuuuguauuuuuaguagagacgggguuucaccguguuagccaggauggucucaaucuccugaccucgugauccgcccgccucggccucccagagugcugggauuacaggcgugagccacugcgcccggcccccucguuagauuuuuaaguuguuucuaaauuacuuacaaacagaacaaccugucaugucuuggugccuugcaggucuggauucaaaucuuccauugauucuuguauauuuuucucugcaugaaauauauuuuaauucuccaugccuuccuuccuuaucuauaaaaaaugagugucuucucacugagugcugguagcuauuaaaucagaucuuaagacgauguacuaccucucuucuuuccuuucuucucucuuaguuuugauuaugcccuagguuagcauuccagaaauagaauuaugaagauaaagaauaguuugagucuggccgggugcgguggcuuacgugcguaauccuagcacuuugggaggcagagauggguggaucaccugaggucagggguucgagaccagccuggccaacauggugaacccagucucuacuaaaaauacaaaaaaaagaaaaauuagccgggugugguggcaagcaccuguaaucccagcugcuugggaggcugagguaggagaauugcuugaacccaggaggcgaagguugcagugagucgagaucgugccacuacacuccagccugggcaacaagaacaaaacugucucaaaaaaaaagaaagaguuuucauucauaucaccuagacuuaaacauauuuacauuuugcaauauuugcuacaucuguuuccuuuuuuuuuguugaaguauguuaaauuguaaacaugacauuuuacuuuaaauaacugaauauucaucuuagagauauuuucauacuuaaccacgcuauuacugcaccuaaaauauuaaugcaaauucuuaauaaucuuaaacauuuagccaugcucaaauuucuauuuuuuaguauguucacaucaggauccaaaaaguccauaaaaugcauucgauuaucucucuuaaucuauaguuucucuccucaucuuuuuuucuuuuuccucaaaauuuauuuguuuaaaaagggcagcuggguaguucauccuguauaguuucccaucaucugaauuuuguguccucauguuuuuucauguguuccucucaccccuauuuccuauaaauugguagugaaguuuagaggcuuguucagauucuauauuuuuaaacaaggacacuuaguaggugguggugaguaccucucucaggaggcgcaugacauugucaugucucuguaggcacuagaagccacugaugaccauuuuuaagauccaucaguuuuuugggguugcacaggaagucucaucuggaacaguccccuauuagcucuguucucuguuaacucgaggaguuaauagguauuaguagguagaacaaggcuguugcagacaggaggagcuauugaagacgucgcaucagaaugagcaggccguguucugcaacagcaaaucuaguuugacuugaccuuuuuucauggaacagaggagaggaaagagcuggcagaagggagugugcagggcacagaguguauagggccuacuauagcagucaggaguggggacuuggggggacugggguuagagacgggccuugcugacaugagguagcucuuguggcuuggccucaugggcagaguagaggaagaagagccagaaacuagguguggcauugcucuugggaaggguaagaaaggcaggugguauguggcaggcuuugcagggacagagcugguuuuaguuuucagcaguugagauugcaagauagccgucugucccaggcagacagguuccagcgccagggcgggucggcagguuggaggagaagcugacaguugaagaucuagcaucacugauggagaggugucuggcaugacucggugaggaagcucaugucauuagagaaaagauagcacugggcuuccagggcguggaggaggguuucagggagggaccuuacggauguaaguguugccaagaggugaagggaaaugacgguuaagaggaagccauuggauuuucagugagggaggaggguccuggauccuuaggagacuccgccuguuggguugagaggagagagaggagggagccagcgucuugggaugggagguggaagggcuuagggggcgggugguuuuguuuguuuguuuguuuuuuaauaacacaggagauuggaacauugucagaaacaucacugagagauaguguggagaaagauccauaaagaaggagaaauugggaauguaaggaggagggaccggggccugagugacggggcagguugccuccucuuuguucccguggaaucuguucacagcacccaguuaacugacuugcauaucguuugcguguccccucccauugcuuagagcuucucaauggaagcaccuugcauuguucccccauagaauccccccgucagacguggugccagugauaagguguagcugugaaugaauggaggacucaagcuccgcagguuaagagcacaggcucuccugucugaccaacuuuaguucaaaucucuguucugucaucuagccauguggucuugcauaagucgcuuaaccuguucaggccucuguuucuucauauaagcauaugggggucauaguacuuagucacaggauugugcagguaaaugagauaauucaauuagguuucugcaucuggcauagaguaagagcuugauaccuggaagcuuuggaaauuaacagaaucaugaaugcagauugucuuagaaggggauugcuuggucucaagaacaggagggcagggaggaacuaugggcaggguaugcaggaguauagguggggagcaguggcauggggaguugucuccucagagaggugggaugcccugugcucagcugggagcacuggaaacuuuaggcccggccaccaagggguguguggucaucacccuguaaagugauaguuagugugucuuugugauggacacgguuggccuggccacagagcucagccaacugggagacuuaggaggacuuagccugugguugggagaguggcucccaacugacaugaacugggccagaaugaauccugggaucagcccauggguaggaccuggggaggccuugggggccuagagcacuagagagaugcugacagcgguuuccaugggaauaagggaggaggggaaucccaggcucaagaucugggacauggaagguguucagggaaugacagggcaugugcucgugggaaaacuucaggccauuacaagacaauggacgagacucagugggcaguguggccuuaaacgucaugcccuccccuguaguauaaaaacugauuccuuggccuccaucugccuugauuuccucaucucuaacacgguuuauaaccuauuugagaagcaggcaugcaccuggaaagacaaaugcaguuuaaauaaugcaugcuuuuaaucaucuagauuagcaacuacuaggaggaugcguuuuaaaacauauauaauguuuaucuuuuccucccuccacaacuaccugcuuuuccccaaccaaacagcucaaaguugacaggaugauagaaaugaaaguaauuuacauugcauagaagucacuccuauuggaauaagcaacucugugugucauuuagaaacuaauuggcucaaaggcaugggauccacaggaagacagagugaguccuauggacauggagggcaaaugggcaggauggcccuuucacaaaagggaaaugggcaggaaaauaggcaggaugguaccuucacaaaagggaaaugggugcuguuggcuggauguccaccaugugccagccacagcaaacccacuuagaugccuuagccuucuucucaccacaaggacuugugugccauccaagccuagaauucucugcuuucuugaucaugagcugucaccuagcacggccuggcuuuucucuccuucccacgugagaccuuguccuuugucuaccccuagugguggugauccugaggggaccugaaggcuaggcccagggaugguucugugcucugugucuauucaugcaugcauuccagaaacacauuugaguguucaccaagugcucagcacuuugcuaggcauuaugacucagaugagacccuuagccucccggaguuuacaucuuugucacgggcauaaaucagugacuaaggcaauggguggugaauugagggugggucugcggugugguggaaugggcucuucugcugugagccuuuguauuccuuccccuaggaacgggcacgcgcucuuggcauucauguucucgcgucaggagggcaaguugaaccgccagcagaccauggagcuuggccaccacauccugaaggcgcacauuuucaaggugagaugcacaccaacuuggggaaggguuucuuuguugucauuuugagguuuugcuuuggagauuuuagacagcucugucagccauccaagaaacgcuccaugcaccucagcccaaaugcaaccuccuccugccuccccucuccaaaaguaaccgcuguucugacucagccugggcauuuccuugcauuuugcuauaguugauugcucaaguguauaucagagugcugugcuuaaguuuuacuucuuuccaccuuuaaaucucugauaaguuucuuuuuaucuaaagguuccacuuuguucauuacuuuuuguuuccuuauuauugauuuguucgagaaccugaguuucuugaccugugugauuuuguaccaccuggacuuucugacuguguuugcccaggcuggagagcaguggugggaucauagcuuacuggacucaagccauccucccgccucagccucccaaguaacugggacuauaggcacgcuccaccuugcagggcucagauggugauauucuaauucugucauuuauucuuccucuaauuuacuuccaacaugguaaaaccuugucucuacuaaaaauacaaaaauuagcugggagugguggcauguaucuguaaucccagguacuugagaggcugagggaugagaaucacuugagccugggagguggagguugaagugaguugagauugcaccacugcacuuccagccugggcgacacagcaagacucugacucaaagagaaacucucaucugccaucucucucccaaggcacaaaguuaaccuagugaaggcaggcugguuccuugacccuugguuucagguagugaaagcucgcauguccaggcauucuuugugugugaccccgugccuucugcagguaucugcacccucugcggcagacccacuuucagagugacccugcaggugggaaggagaugcucaggcagaucugucucugauuguuuccaagaucugucucgauuguuuccagggccucaguaagaagacgggaauuucuucaagccaucuccaagcccuguggaucggcuacagcaccgaggggcuguccgccgcccuggccucucucaggaaucucuauacucccaacgugaaggugagcaaccuucugcacagagagccggagacccagcccuggccggcugcuggccguuccuccaacagcccuguuucccucugcccugggugguggugagaggacgcagaggagcuucuaaagaugugcuucccugaucacacgggcuugggugcuguauuacucguucuuccagaaguuuagcuuuucuuuggcaggaagauguggguggucagggcugcucugagcacauguggugacuguuucacagcagaugugauaaggaagcaauuuacaaaagaaaucaaagaucagagagauuucuagggaaaacggauuuuuuaaguguccugcguuacuaaucuggaccaucucuucagaguucaugggaaauuaagcauggaugggugaugcauagagauaaguacacagaaaaacaaacaucgagguuucauguauccauauuucugccuauggaaaggguaucagcauggccuucuguggagccaagagcuucuucacuucuuggucaguggcuuucaugucaugauguuccacucagcuuuuuaagguagauuuuucuuccugauuucauguagccugggaaucugaagcacacagaggccaagcagccuguuaaggccacagagacaguguccaggccuuucagcuucaggcccugauguacccggcugccuguggaagcccugggucaguuuagggagccaggucuuccccccgaaucacucacauuguuucaucuuucauuucagcuaagaguguaucucucggcuucuccauaacuaauaaaauucuauaaucauaagaaagaugagaauaaaaauggcaauauguuuucauauguuaaugaauuucugggcauagaauuuauuuuaauauggaaauaaguaaaugggaaacaucuguugaguacaaguuuuuaagacaguaaauuuaaagguacugcauaauaguguaaugagcauggcccuccugagauuauaaacuuugcucuuuaacguaugugcgauuuuaagaguuaaucauuuuuacuuuguuuuguaaaacuccagugucaccuacaucuacaccaucuccgaaauuauuucuauaaugugguuauagaaucuuaagucuuuucauuauccuucuguuucuuuuaucuuucaaggggggaaaacgguuuucacaggaucuugaacaaauuacaguaauuuuaaauuaugcaugcaauuaaggaacuuuuuuuagaguguauuaaauguugucauacaggaaugaaugucauuuugaacaauaauugcaguuugccacuuugguaaauuaaagugacuugcucugggaugauuacuugguagauggauuuuaguugcaguggcaugccagcagucucuaaccauguugucuccuguggccaggccaggauggggccagccugggccccgcuggcccacuggagucccauccagccagugguuuuguuguaccaucucauaggacugguggccagccgcaagcuguggccucaggaggauuuagguugcaguucuuuucucagcugacaacagaaaggagaggagaacaggagcuagguguggccuuuggcccaacuucccuuggccgggagauccagucauauccuacaucauagucaggaaggacacauuuuaaaacaauugugcuugugugagcuuccaguguacuuagugggaaugcugaugcugcccuauggccacccuggccaagccucuucugguccucaugaucguauugccucgcauauccccagcucccuuccuguuuuccuguuuucauuaaauccagaaguugagagauaccaccacuucugaguguuguccaaggagggcuucugugaucauggucggaaaauuuccauaucguugggggaaaaucuauaggaugaaucauuuaaacagguuccuucagcacagugccgucucagccaagacugcugcucugccaccuggcugcucugugaccaucauuagcuuugugcuuagcgcucagcucggccuuacucccucugagccuuggcuuucucaccuauaaaguggagacacaaaagaggcugucucucaagugaugagaaaccuuacugagauguuaaagguacugggaacauacuuggcauuuauuauguuuacaugaauuguuguuagugcuuugccucaucucuggaaacaguggcucugcuguaggcaccugggaaguuuuggaugugccaguuggugcuuguuaacaggagcugccgaccuugaggaugugaugguugcaggugacuuaccucugcccucaucucggcaugaggugucccugcugcucugugcuggugaacagcccaggcugggcaugcagggugauguggacaggagggcagagcucccuccugugccuuccagaggucagggaccugaguucuugucguuucugaagacuccaugaaagguugauuauaacaucgauuaauguuuauuuaacauguacagaugcugagugcugugcuaaaugcuuaaugcacauauauauacauacacuuuuuuuuuuacacauugauuuuuaaucuuuacaaccaccaagugaagugaaacuuuuauccucauuuuuuuagaugagaaaacugagguuuagggcaguugauacuuuccaaaaucacacagcuggaagggcgccugacacucagcaagcccuugcucugcaggugccuuuaucacuugauguguuuacagcccuggcugccagcuaaaaucaccugggagcucugggcaccacagccccagccccaguuaagucagaaucuccaagaguggggccaggguauuggaaacuuucaagcucccaggugguuucagugugcaucaagguuaagaaccauaguuuaggggaaggugauggaggguuaagugguaaaaauacguacagcauuacaccgacaaaggaaaauguuauucccagaagcagaggaagugugaauugaugacaucuuuaggaaaccucugcccugagcacaugccuuccagguaaacucuuguaagggauucaucaugguacuccaaguauaccuuccaccauuauuagcaaaagaguaccuguuagauagaaugggauggcaugcugcuguuuucuuagguggcaccuaaagcacagagagguugaggaauuuucugaaaaucacacaguagguuaguuugggggcuggcugagaacucacaccacuuaauccuucauuuuuuaggcccauggaucucaagaagguaugggguugaugggggaggacagaauguaacuggcuggcaaaauuauccagggaauuuacaaaugauccugcccauccuguggcuagcagagucuggugugccccuugguggcauugcguguauuuccagauguguaucuucucuacuccucuugcugaggacugguuucauuggccuuaauaaaauccuauuucuucagcauaaucugauucuguccacgcuguuacucaaagggauuuuuaaaacacuuuuauuauuuuauuuuuauuuuuauuuauuauuauuauuuugagauggaguuuugcucuuguugcccaggcuggagugcaauggcgugaucuuggcucacugcaaccuccgccuccuggguucaagugauucuccugccucagccucccgaguagccgggauuacaggcgugugccaccgcaaccagcuaauuuuuguauuuuuaguagagacucaguuucaccauauuggccaggcuggucucaaacuccugaccucaggugauccacccaccucggccucccaaaguguugggauuacaggcgugagccaccaugcccagccacaccuuuauuaauguuguagcauaaugcagucuuaaaaugcuuuugaauuagaucagagucugguggcauuuuuaaaaagcaagccuauauagaucuguagagcaggcuugguggggauuaauuaagucauuugccugaaguugcccaugaaacagcaguguuaggacuggacacccuuucugaucucucauccauuccuccacaaguacaaguugacagcgagacccuagaggcuggguugguguucaccuggaucuggcuagacaguggucucucugaugguguagacagcggggugguggucaggugguuggcuggcuccuugucacuugcacauggccuguucuuccuuaaauguagauggcagucccagcagugugaagaaacugaugugugggucauccccauccauggaggggcucuguuugccuuucuucucugugaacuucuguaucguagaaccagugucuggugcaguggacuaagcaggaaaacagagcaugcugagggauagagagggccugggugcacaggguacccucucccccauguccuggcacuggagcagagcccugcaggaagugauuauauuuauggaaugagcauuccagucagggaacuaaaaggggguaaagaccaugaggccggcccugcuuggcauugucacagcacguguuggguccaagguggcugcagugagggaaggauucugcagagaagaucagagaggaagcuggaggccuguaucacagagguucaagcuucagcagccaagacaucuucaaauuugacaccugggguucuaaccugucacuaugccauugugaguuaugguuucacuacuugguaguauaauuuuccagacccauuuguuuguaaauauucuguuugucagcuacucuuguggacaucuaucacugaaauaccaugaaguuuuuaugccuugucaucucucuguaucuuuuaaugauccccaugugucucuagucaauaaaugauagucucugugguuuucacauuuagugggcagguggaggaccugccaggcuuuggcaggggcagugauugaugugggucaggaccauugaaguaagccauugaaagaaacacacugggcaucuuaauagcuguuaaaggagcaucauuuguaucuaaugaucugaagaucugaaaaaaaaaauauuauuauaccuaaaauuugcguauguucaguaauuuuauuuuaaaaccuguagauaaaaagcuuuucccaauaccuagauccagggagauuacuaagugggggauauaguaauuaguggaagcagcacauuauuuucuagcaguauuaugcugcggacaaucauggcacauguggacauuuccauauuuucuguuucuuuuaggaacacaucccuauaaaguauuuguauuuacuuuuggccuuaucucacuauuaacaccaugacuauuuuuuucuuuuuaaaaacauuuuuuauagagacggggucuugccauguugcccauguuggucucaaacuccugggcucaagcaguccucccuccucagccuccuaacauacugggauuacaguugugagccacugcacccagccacaauuauuacuucauuaccaggaaaaugaauuuccugguuuuguugagguuaaacagugauuuuucaaagugugguuccccaaaccaagagugucaauaucaacgaggaacuuauuaaaaauguaccacccagauauaaugaaucagaaaucaggggguggggcccaagaauuugcaguuguuuagguuuuuuuuguuuuuguuuuuguuuugcuuuugagacggagucuugcucugucccccaggcuggagugcagugacguaaucuuggcucauugcagccuccaccuccugcguucaagcgauucuccugcaucagucuccugaguggcugggauuacaggcgugcgccaccacgcuggcuaauuuuuguauuuuuaguagacacgggguuuucacccuguucuucaggcuggucucgaacuccuaacugcaggugauccgcccgccucagccucccaaaguggugggauuacaggcaugagccaccuugccuggcuauuuguuuaguuuuuauuuuuaauuaugguuaagaaacacauaaaaggaaauuuaccaucuuaaccauuuuuaagucugcaauucaguaguguuaacaauauucacauuguugugcgauagauguccaguacuuuucauguugcagaaucaaaacucuauaucccuuaagcaacaacucucauuuccccugugcccaggcccagaaaccuucauucuacugucugugaauuugauuacuguauauaucucauaaguaguuucacucaguauuuguucuuuugcgucuggcuugcuucacuuauuucacuuccccgagguuuacccauguugucacauauggcaggauuuucucccuuuuuaagcaggaauaauccauuguauguauauguaccacauuuucuucauccauccacugaugaacacugagguugcaucuaccuguuggcuguugugaauaaugcugcaauuaacaugaggguacaaauaugucuuugagauccugcuuucaauucuuuugaauauguacccagaagugggaugacugaucacauggccguucuauuguuauuuuuuguuguuuuguuuuuguuuuugagacugagucucacucugucgccaggcuggagugcaguggugcaaucucagcucacugcaaccuccaccucccggguucaagcgauucuccugccucagccucccaaguagcugagauacaggcacacaccaccacgcccagcuaauuuuuguauuuuuaguagagacgggguuucaccauguuggccagauggucucgaucucuugaccucgugauccacccgccauggccucucaaagugcuggaauuacaggcgugagccaccgcaccuggccucuacugacauuuuuaauuaaaaauuuuuuuuuuuuuaauuuucacaucagggccuugcuguguugcccaggcuagagugcagcaggcuguucacaggcaugaucauagugcacuacagccucaaacuccuggccccaagcaauccucccaccucagcuuccugaguagcugggauuacagucacgugccuggggcaguaguucuauuuuuaauauuuugaggaaccaucuuacuguuucccaguaagcuacacuauuuuacauucccaccaaugagaaugugcauuguuaauauauucccaggugauacuggugcacauucaaguuugagaaccacuggauuaaaaugauaccgaaaauugaggauacugcccauuuccagaaauguuuagaugacauacaugugacaaucuuguuggggggccuuguccaacaggugagccgucuccugauuuugggaggggccaacgugaacuacaggacagaaguguuaaauaaugccccaauccugugcguccagucucaccuuggccacgaggaaguugucacucugcuccuggaauuuggugccugccuggacggaacgucagagaacggcaugacugcccucuguuacgcagcagcugcuggccacaugaagcuggugugucugcugaccaagaagggagugagaguaagcggcagccugcucuuuuggggcuggggcagggaaauggcuucaucucauugcuagaauuguuauuugcugggccagacucucuugucucugaaaccacagcauacacagaaagggucgggcuccagggauuggucacuuuguaauguggcagccucagagagguuuguuuugcucauacacagcaacucugcuuaauguuguccaggggaaggcagaauuccagggagacccuggcuccuagccgcaugaggagggccagccuuuaaaaagccugcaaguaucgaucuagaaagcaccaagauugguuuaaaauauuuuaaauguuugcuuuuuuccccucucuucuucuuaucccauuuuauguccuuuuaaaacaguaggaugaguuccaugaacucaugaagaagccaugugccugagcuccaggaacuagauugccuggaaucuucaucuuuccacuugccagcccuaggguauugggcaaguuauugagccuauauaugacuucaggcuucuuaucuguaaaaugggcauaacagcagucccuaccacagggcuguugaguaagcauucagucauauaugaaguaaguauguauugcuauacaaguuacucuagagcgaucaacuuuuuuuucuguuuugacagucucacucugucacucagucuggagugcagaggcaugaucuuggcucacugcaaccuccaccucccagguuuaagugauucuccugcuucagccuccaaguagcugggacuacaggcacaugccacugugccugguuaauuuuuguauuuuuaguacagaugggguuucaccauguuggccaggcuggucuugaacuccugaccucacaugaucugccugccuuggccucccaaacuguugggauuauagguaugagccaccacgucuggccaggagcugucagcuuuaauagggugaaugagaaugauaucgagcucacaguaaaugcuagguuuacuggaagcauuuuuuugggaaaugugccuuuugaauaacaguagagauaaacugcuaauuaucuuuugucuuuuaauuaggauauuuaaaguucaaaaaaauuaggcuuauaacagcugugggagauuuauuuuuuucucucaaauccaacauuugggacauacauaaacuucaguucauggagaaggaaauguguggcuaagccuuugggguggguauguuacugcugcacaucaccgcaccuccauuuacggauggcagcugggcuuuacacuuuauucugaggccagcaggccuccccccaucacagcugaaagcucuggaguaggaggcugagugcuaugucagggggcucuggcaaagccucugaaugaggguacagggcguccccagaguuggcaggcaugcaaggcuaggcccugggcucugcucccaggcccaguacucugggguuuagacagggcaugaagggcugccgcugcuuuggggccuugaggaguagguguguggcacucacucacuuuuucugccuagcuggccugcccugacuuuguggccgcccccccuuuacuugccagcaugcccaggccaccggccuacaugagaccuccuucccaaucagaugccacuuggacuccuuuccugcccuuccacacucagcuguuuuuccacaucccucucuuucuucggauccccuggcucagugaccagagaguggcucuacuccuucaaauuauagcuugucacagcagacuuagaaugccccacccaagcaaccaaaguugggaaauacagggauuuguccgagguuuuggucugugucuccacacaugcucacaagagaguuaggagcuuuguguaguuugcugcagggacaugggaguaaggaggguguuuugugacccugaaucuugcaaagggaaccugaggccuggaaugguacauucauuaccaucuggaaguaauccagacuaagguuccauguucuccagaaagacaaguuggaaugugaaccccauguacgcuuacagggagugggguuugcacacagcuagguggugcaucugcaugcucagaggcaaaguaaugcucagcuguaaccuuccccuacuccugcccccagguggaccacuuggauaagaagggccagugugcgcuuguccacagugcccuacggggccacggugacauucuccaguaccugcugacuugugaguggucgccggguccuccccagccaggcacccugaggaagagccacgcccugcagcaggcgcugaccgcggcggccagcaugggccacagcucggugaguggggcagggguuucccuccugggaaacaagaagcuguagcccagcaagucaguugacacacugaaggaccgaaagaaggaggaugccaagaacuagcauuuggcguugaccaccugcaguagaaggucuucuaugggcaccacauccuucccgugagugacagugcacacuccuaugcacacgugauggggacaggcaggcuuauuuuucuaugggaagccuuuugaugacauucacucucagcucuuccucaugucucuccuccuucccugcucugcccucuagaccugcuguuuuaaauuuuuuccccuuugauucguuucuucuguccuuguguucauuuaaaaauaaucacauagaauccugauucuaaaaucguuccugaguauuugaaggauuuuuaaaaauagagcuuuaaugcuuugauagcacacaagaaugcuugucauuuacagcuccuccacugaaugaaaacuccaugcaguaguuaaauagagcauuuauuucugacagauguugguauuccucaguuugaagauuuaauugucaccuccugaccugugugucuuggcuuucuuuaucugugaauuuaauaauguuuugcucgcuuccuccuguguauuucuuacucugaauuaucuucaagcaauuagaggugccaguauuugguaagauucuuuuucuaaaaugacuuuaguaaauucgagugggaagcuggcuggcugacuuuggcauucaaaacucaugagcggacacacacacaagcaugaaauaguggcuggcuaauuucugguuuaaacauuaaacacacacacacacacacacacacagagagauacuguuaaacacacauaugaaaauguagauguuuuccuuuuuuuaagugugaaaagucaucauugggaggaccaugaaugccuaggaaugaccuuggucuuaauccaugcuaacccccuuguuuuaaagcugguugggaggaaaugcugagcgaaaaucaccucagcacagccaguagggugaaaaaagcaggguuuguucaccauaagacuuggaggguauguuaguuuccuaaugccauuaucacaaauagaugcaaccuuaguggcuuaaagcagcacacacuuacucuuagaauucugauggucagaagucuaaaaucacacuauugggaggucagccuuccuucugaagucucuaggggagaaccugucuccuugcuuuuucucaauucuugaagccaccuguauuuuuuagcucauggccccuuccuccaucuccaaagugccuuacuuucaccuuagccucugucgucucauuuccucuguccucugaccuggacuccuccugucccucuuaagaggaugguugugauugauuagaucagguguguaucagauauagaccuugauaauuugagauaaucgccccauuucaacauucauaaucacaucugcaauuccuucuugcccuguaaggucacauucacaggcuuugaagauugggauguagacaucuuugggggccauuauucagccuaccacaaagggugugggcuaggagacuggaagguggcuuugucguguucucccguugcucgcugcuguugcucagggugaacgccggcucagguccagggcacagaugccuugucucccugcaagccaggcuuccugccuccauaccugugacuugacccgcccuuugacaggaagagucccauaagggaaaaagaauaaugcuaccagcagaaaauguauuugaacaauacuuuguaaaaauuugcaaaaacguauaucgcuuuguuuuccuuccuugugaaaaacugauucacuaucuugugauuuaugcagaaacugcacuuugugugaucugccauguccuuuguugauuaggcuggcauauuugggucauguuggaauucauuagaauucugaguaccuaguaauccugaaccauauugcugaaauucacugagauuuuuuuuuaauucuucuccaacugaaagugugaauagcauaugaauuaugcuugaaaacaguuuucauuauauuuuucucuccuugggcagugugagauaaugguuaaaaaacaacacacugucuccuuugauacaugggcuauaauaagcaccucuugcuaagagaacucauuaaaucaccuugccacuucugacaggugguccagugcuugcuggggauggagaaggaacaugaaguagaagucaauggcaccgacacauuguggggagaaacagguaauuauaaugccacugcuuguagucuggggcagcuugcuugauguuuuagcccuauuuuggccuaauugucuuaagaaugacugauauauguaguccuguuucuauuuuaucacaagcauuugaaguuuagagcuccuugaacuuucuacaugaguagcaaaacuuugcuggaagcguaagauuuuauuuuuuaaagcaauccuauuaacugauuauuuugaauuagacuagcaguuacgguacaucugaugaaugucagauggaaguaccuaacuaagguguuguuuucugauuugccaaaucucacacaucuaaccaaugugaucuuccugugaccugugcauggcgagccaggcaugaacuucuguccccaucgucacacgaaucaaaggcggcucagcacagaaggcaguggccugcccugcccuguacagaaugaggguaaaacucagccucgugggguuuacucacauuaccguacgaaugcaagcuaucgggucauuuccauuggucuuuacagugagaagccugggcugagcacauccuggugaagauuugagcugguuacuugugagacuaaaaguaaugcugcuuuccaguuuuccacuugacuggauuaguguuagaaaucuaagacuuuaaauuacaaguuguuuuuaaauagaugucagcaugaguauuuaaaaugaauuuccagguuauguuucuguguguguaccugguauauaugauuuccauuuuucuugcacagauuuguuuccaaaugcuucuaaauuauuuccuaauaagccaaaugguggugugaagagcuuauuagauagcucacccuaggggaaagccacagagcuucaccuucuggcaggagugcaggccuguccuucagagccucacagcuguuuguuccauccccuuuguggguccaaagaaggagcugggugugcucccaggcgcagagaaaguacagaauuccagcggaguuggauuaugucuacggguaaaaguauguggauugaaauauugccuaauucuuuauggaguccuuccccuucccuuuuaaacaguauaggcugcucuauaauuuggugaaagaaaaguuuccaucacauuccaaaugauguggugggcagcaguguugcugaguggauaagagcaugacugcugacagccaaaagguccaaaccccuguucuuucauugccuagugauaagagccuccuggggcacuugggcuuagacauucugauucacuagggggaaagcccaggauuugauuuucuuaacaagcaucccaagucauuucagguuacuccuagcucccugcagagcugucuagaaagccugacauagggugacacacagugagagguacccaugaagacgauggacaucaggucuagcagccaugacaucacacauuuagcucaagugagaauuucuaacauuuuaauauucaagaugacuuuuuuauuuggaagaaaauuccagagaagggcugacuuugaaggcuuuguuugagcucucuucucucaaugaccaguccugaauugcauuaucauccugcuugagaaucugccaaucaguugauggcuaaagacacacaugagaaacaacagacuucccaccagucuuuaucuagaucagaauucuuggcacaguuuggcuggauucucuacuucaggaucuuaccaggcuccuaauuggguauuggcuggggcuguguucucgucagagacuccacuggggaaagacccacuuccaagcucucagcuguuggcagaauucaucuccuuguaguugucccuugggucuuaaugaaaagguaaacaguaacuuggccccucccuuccaaagccucaugaguaaccuucagaccacuuugcaaccugggaagcaguucacacucuuccucaccaggcaucagggugaauuucaucaggcaagaguuuacuugagacguuuguuaaaauuuaaagcaagaagaggcaagcuaagugcuguuuuucaggcuuagccacaguggcuuucuguggacugcaugucaacaaaauccaccuugccuucucugcauuuuucugucugguaccuuucucuugugccccuucaaagacaaccacuaucgucuacugccccaagccuuccuacuuuccaggccugcauuugucagaggaauacccugaaaucuugcaggggguuucagcugagagaacaucugcaaauauagguccuuacacaaauguauacugcaugcucuggaaugugacaucccguguuuugggauuuggccacguggggucuguuaccgacccuaaaugugggaaugaaggcagaugaggcaucguacagagaacugaaggccuugagagugaaugggucagcucacaguccugguucucaccaaggcucaacuucaagccaugggccccgggauuccccagccuguguggcuguacugcugugugcauuguugcucguugcuauagggacccacagaagggaaaguagugguuuugcauccuguucucguuugguccucauuccuggguguagucaaugguguuuuguguccaaaacacucuaggauggacuguaucugucccuagccacagcacaaggauaggaucccaagaguaauacuuaucugggauaugggaagguggcagaaaaacuggaagcuuuguguggauaacaguucauuauuuauuuugaaaccuuaaguauguuuacacaagucuguccagcauagauuuagcugugaacagcuuggcuuuaaaaugcuagcugaugaggugacaaggcagagcuuccucgucuguuuugacucaccugccugccuuugaacagccugugguuuuccugcagggauacccccguuaggaggacagcuaccugcccaucucuucucugccauugccagagccaguggcgcaggagcuuaaauucacgcacaaauucuuccuccaguuuucugcuaggagagccuugcaauucagugaaucuauuccacauggcagaagugugguugucgugccuguugcugauuggaagcauuggguucuugguuaagaaugacggccaccagccagggaacagcagccccguggaggucccccucacucaggccgucagugugguggcacugggcacagcagcagcccuccacccuuagagcccugcacaucugacugcuggugacccugagucaaugaaugucaucacagaaguagguggcuccuguguuagguugaaggagacaagaaaauguacaauagaauuuuaagacguucauaaaaaaugggaacaguauuuaguuuaggguuuagggguuuauugcaaucaacccacagccuuuagaaaacuugcagacugucucuacugguuuuggagagcagagggcuuaacuuguuuaaguuucuguuuucaccagcauccaggaccauuugguuuuugucuguccaauguuuagggaccagccauucagaacucaguucugucguuccaguagcucucaagcucucccucuccccaugcauccuccccacccucaaacaaaaggcccuaguggagaauaaguaguaugauccauucaucagaagaaagcucagagcagaugaugaaugccugcaucuaacaguaccacccucaggaugccaaggcucuuggcucggugauauucacagacucagucagugucuguuccguaguuucucggcagccugaaacauggugagaacccaccagaugcuuauggcaucuguuucaggcauuccacagcugugacaacuccaugcugccucccagaaaguucuggcuacacugaguuacuaucuccaugucaguguuugcugugaaucagcccaagccgaaaugaccagagaugcuuagcuggugaccucaugcugcuguggauuggcagaaggacuguguuugcaaguuccaagccacacucaagugugugagccugcuugugggcuucugguuagaaccuugcucugaauagaagagaacagaggcccuucugcuccagcacuugccauucaggcagaugguccugucugguaucagagccuuaacccucuccacucccuuggcucacucuccaguucccuucguaggacuuaccaucaguacaucuuauucgauaggcuuuucuuuucuuuuuuuuuuuuuuuugagauggagucucacugugucaccaggcuagagugcuguggugcaaucuuggcucacugcaaccuccaacucccugguucaagggcuucuccugccucagccucccgaguagcugggauuacaggcaugcaccaccacgccaagcuaauuuuuguauuuuuaguagagaugggguuucacuguauuggccaggauggucuccaucuccugaccucaugauccacccaccucggccucccagaguggugggauuacaggugugagccaccacgcccagccuugauaggcuuauuugauguggcuuauuugauaggaggcugcuuuucccaaauugugagcuuuuuuggguuuguuuuuugagacagggucucacucugucacccauguuggagugcaguggcacaaucacaguucacugcagcaucugccuccccacacucaggugcuccucccaccuugggcuccugaguagcuaggacuacaggcaugagccaccacaccuggcuaauuuuuguauuuuuuuguagagaugcaaaacauggggauucgccauguugccuaggcuggucucaaaccccugggcucaagcaguccuccugacucagccucccaaagugcugggauuacaggcaugagccaccacacccagccagucaugggcuuugugaaggcagaaauuucccugucucuuguccacaccauuguguauggcaaccguccguucuagugcugcccaauagaacuuuccguaauaauggaaguggugucuguuuuguccagcaugguagcuacuagccacauguggcuauugaguacuugaaaugugacuugugcaacugaggaacaauaguuuaaaaucucaucuuaauuuaucuaaauuacaugugacagguggccaccaaauuggacagugcagguauagccugguccuugucauauagguauugaccaaguggacaaguggauuuaaaugaaacaaagucauauuuuuagugagggagauguucacuugcagaauaauuugggagaaauaccugugguuggagggggagcaguaaggggccuggucacucauaaagacccaguguccugauuucuugguguccuagcucagaccaugcucuguuggacuccaagauggcucagauccucucgccaaguccucgguggggcaccugugcugaaggcauggugggcugcugguuuggaucuuugggaacacagcuaauagccaagcauggugugggcauagccccaucuguguccauaacaucucccucucugcagccugggugugcuguguccucaugcuggucucuggcagucguccugcccugucguggucaccuccucagagguccuucuguuugaaagaaggucgccagcacacccagagccccaugcuucaugcacaggacgcuggcggcuccccagggcuacgcuucccuaauuucuggaaggggaugcccuaucggaguugguuaaaagugugacugaaauacuucaugugaaguguuuuuauguuaagucaguaauauuuuaauuguugaauacuuucuaaaggaguuuagucagguaaauaauuuuuauugucaaagcuacuauuugccucuguucagaugggccagauuuucuccgcugugaauugaaugggcuauuuagcugcgucguaggccucccuuuguguagcgcauugaagcaauuccacuuggcaugugugcucaccguaguuuacuguucacuaauucuggauggaauuuuggacagaaccugcucccucuggaucuugagccucaggcagugcccugcagcugggguggguguuuccaggccccucuugggggugggguccucacaccuguuuccaaauugggcugcgaagcuggguccuguuguauuugacacuuugaugauuuucguuucccucuuguuuccaugggacugcuuuccuuuccccuuuuguggcucuuuuggcuucagucacagggaggccccaggcguggacggugggcuucccacauccaaggcugccccagagcacagggagcuggaugccuaauuacuguugguguaaaaaugacccguucuucauuugaauuuaccuuaggcauuuuggagagagaaggggcuguucuuugguaagaauguaaaauaaaugucaggccuacuggauugagccuugcagucacauauacagccaucccccacauaaugauguuucugucagcgauggacugcaugugagaagguguucccauacaauacugugucuuuauuuuuucuauguugcuacuuuuucuauguuuuguuacacaaguaccaccguguuacagcugccuacaguauccacuacaguaacaggcuguacagcuuagcaguuuaggagcaaaaggcuguaccauauagucuaggcauguaguaggcuacaccaucgaaguuuguguaaguccacuaugugguauuagcacaaugauacaaucaccuaacgacucauuucucaggaugcaucccugucauugaugauguguggccuuucucaggaaguauccaccucauuaggugaugcaugcacaucucaggacagaauuucaggugagagauuggaaggaaagcguuugcccauggcuuguuggggcauguggagaauauguguuacauggaacgcacauggaggaugcuguagagaaaacugcgacuugcugucguacacugaagauacuggauuuuucagagguccugagcaucucaccaguacugguuuuggaaauuuuuuaucaaggcauuccuuccucugcaaguguuuguucuaagaagguucaguaagauuagugggcauggaaguccagacugcugucagucagaacuauccucggcaaagcaacacgauggggaguaagccaguacccucaagggugcgugggagggaccacccaggauccugaaaggagcaagaugggguggggugacccugugcccuguaaggggagggacaaagugggguuaccaacauggaagggguaacagggcucuggauggaggaggauguguauggggguccuccaaacaguggaggcagauaggggaucagaacugagggggcuggguuuguccauacccuauccuccuggucucacagaccccuggguuuugccccugauguggguggguuccggagaccacuccucucugcgaagaaggcagaggggucaggucagcauguccccgcccuguagggcaggcugaguggccagcagugagcagguagaaacccagggguggugucucaagcacgaacaaauuagccccuugaccaccuucaucaagcuguucuugcuguacagaguccauuuuucuagugagugauuccugaguauuuaauaaaaaauacuucugccuucaacagaaaaauguauucauucauauuuugggaaggauuacacucccacagaaaaaucauccuuguuucuucuugaaaugauauuuggauucuuucuguguuuugggggccagaugugagguuguguaaaaugcuuuuguggaaaugcccccuuuuuacacugagaccucaugugguguccuggcauguaaugaaguccucagcacaagcuuagcccuuaccgagaggagagagagaaccuuaugccugcuuuaaauaacuugguguguaacccagccuuccacaugcgaacauucucagcacacuuuagaagugacagcuguccaaagguccggucuucucauggauucuuagaagaacaaagucuguaugaaagauggcuuauguuguugaucuuuuaggaaauuauuuuuaaauugagguuacauuauuuauagcacacacauuauuccucaaaggauuugaagagacuuacuugaaaugaugcagauaagaacuuuaaaacacuaagucaggaauaggacaugaggaaccgcucaaacauucgugccauggcauacuaaauugagcuacuacuguggcuguggaaugccauguggccagaauuagaggggaacacaauccuuguaaaccauuuuuauuguccaugggagaaaucgcagcaguuccucagaaaaagagaagcacuuucugguacuuucauucuaaacaacucucauagaaggcuguuggaugcuuuagauauuuuuaaaggugacuuccuggaggcagcauuguaggagcuaagaacucagacuggccagguccaguggcucacgccuguaaucccagcacuuugggagacugaggcggguggaucacgaggucaggaguucaagaccagucuggccaacauggugaaaccccgucucuacuaaaaauacaaaaacuagccaggcgugguggcggguaccuguaaucucagcuacucaggaggcugagucagggaauuccuugaacccaggaggcagagguugcagugagccgagaucgcgccacuguacuccagccugggcgacugagcaacacgugucucaaaaaaaaaaaaaaaaaaaaaaaaaaaaaacaacucagacuuagccacacucccucuagcugugggaccuuaaguaagugguuuaauuucggaggcuuauuuuccucaucuguaacagagaacuaagaguagugcuugccucauagaaguugauuguguucacugaauuuaugaauauggaggaccaagagcaucguguaggcagcccuuuacaaauggcaugguauguuauuuaaauccaauagcaucuuccuguuuuaaucaagagcaugacuucagguccauucaguugcuuggguuaaauuucugauacugacacugauucccuuugugauuuggggcagaugauauaaccccugugacucaguuauuucaccucaguaacaugggcaucaucaugacaccugguucaaaagguucuuaacaagauuaaaugagaauccacccaggguauuuugugcagcucucagcaguugauacguguugauacaaugcuauguauugucaggguugugauaaguugauuaauauuauuaauauaauauguuaauguaugcuauacauuugucaguugaauaaguggauguauaagugauggaaucuucaauuuugcaauuacuuuggaagauggagucauaagugaaggauggaaaagaaaggaauuuugaucacacacaugaaguccuguuuacaggugcaguuacacauuuuauuuuuuaaaagaaguuggcaauuugagguuccuguuuaaucuugaaugcacauacaggcugacaguguuuuuacaguagaguuuguaacauggucaggaguguucugguuacccagauuuggauucugcccuguauucaccucuguuagauagcucggugaaaauggguucaugucugucggcagagggagccacauuuuuccaugaugcuugguugaugccuguugccuuauaacacagaauccccauacuuggcuccagccaggcugcuucugcaggccccaucauggccauugggagaucuggcccuccugggagaguuuugccaaugggaaacaauaaggaagguguucaaaaccacaacuuuuuaaauucgugcaugagauaguucugagagaugcauccuuaggcgauuuggucauugcgugaaaauccuccaguguacuuacacaagccuggauggcacagccuauugcucccaggcuccaagccuguacagcauauugcuguacugaauacuguaggcagcuauaacacaaagguaaauacuugugugucuaaacaugucuaaacauagagaagguauaaaaauaugguauuaucaucuuaugagaccacugugcuauuguauacgcagucugucgcugacugaaacaucaucacacagcaugugacuguaccugggcagugcuggcuuccauuugugaggucacugagcagcagcgccccagccugcagaagcuucaguugaggcuggcaguguuggaggcuugucccagacaccaaggcuugggguguuugucucccagugcaaguacaguuuucuggaagagccaucuugauuaccuuucauuuuauccuuuaaauuguugaggauuagguuagauaacugccuugucuuuguagaggugaaaaauuuauagcucuuggaaaguauguucuucuuucuaauagaagccuuccccucgcucagagacgggaggaaaugccuaacaaagaacacagugaagcuaugaaauuuggcuucuguaaaucuuaguccuauuucuagaagguggggcggggaggcaaggcacauugccuggccuuuuggggaaagguugcugcuuucagccagggaaugugggggccagcuucccugaggcccucagugugacggccgagcucccaguggcagcaaagcgagccugaccggucagccgccauauagccacuuagagucaguuaccaaggcagggugggcagucauucccagaguuuaaaaaaaagaaaaaauccuaaaaucccucauuacauuuuaccauugagauaaaguagcugagaaaugugcagugugucaggcacacucuuuccugguguucucugccuuuacaguugagcaggguguggccaucgggccugccacugagggucaagcaucacugccuucaccacaucucacaguucucaccuuggccacaauuagaugacauuugugaggacccugcugcuuucaauuaauguugacacucauuuuuuucauuuuccacucauuuuuuaaaauaugggagaggccaggauaauaggaaguaaauugcacaugugaauacaagcaaguaaauugcacaugugaauauaagcauacaagcagagcccagccgcccugcccugcccugcccgcagugcccucucagcuagcaggaaguggguucugcagguacaagcuguucucuggagguacucaguuccaguuugcagaaugguuuucauacauccguggguaaugcaugaaaaggucauagucugccagcgggaagcagcuucugugugcgcugacccugccgcccuucucuccaagcccccaaguuggguccaaaagcaaaugugggugggaauacagacccauuguugugaucuguaagccaagcgauccugagccuggggagcacauccugugaauuugagugacagaucugcuuuaaaauuuuaggaauagcccuguuuguggaaugacuguguccccggcaaguugacaauugaguuuuugcaaaucaaaucuuuucccagagaacuuuaauauauaagagauuccugcaaaccauccauuuuauggugcaaaaagcucucucacugcuguuuccaauacguucagauuguugucagguuuuguuuguuuguuuguuuuuuguuuuuuuuugagauggugucuugcucuuucaccaggcuggagugcaguggcgagaucucggcucacugcaagcucugccuccuggguucaagugauucuccugccucagcuuucccgaguagcugggauuacaggaaugugucaucacgcccagcuaauuuuuguacuuuuaauagagacaggguuucaccauguuggccagaauggucucgaucucuugaccucgugaucugaucugcacgccucggccucccaaagugcugggauuacaggcaugagccaccaugccugaucuuuuaauuuuuuuuuuuuuaagauggagucuugcucugucgcccaggcuggaguacaauggcacaaucucagcucacugcaaccuccgccucccagguucaagcgauucucuugcucagccucccaaguagcugggauuauaggcgcgugccaccacucccggcuaauuuuuguauuuuuaguagaggcaggguuucaccauguuggccaggcuggucuugaacuccugaccucaggugacuugcccgccacagccucccaaagugcugggauuacaggcaugagccacugcaccuggccagucagguuguucuuaaaaugaacgucugccauuacaaaccuacuugccuucucaagacaggacaguguugcugagguaugugcuuucaugggaaucuaauucacaaaugccaucuuguuaaggauuuuacaacuagaagaaauuguguccaauuugaguccuaaaaagugccaucuguucacguugauuuuugagcucccauuucauaccaagucuuuuuuucuccaucuuuguauuucauuggccagaaggcaagguacugcccauagcaaggcauucucuucuccugcccuccccugcccucuuuuccuucgggucagguggggugcauuaacccucacuggagccuggugggcagcaccagaggucggccuuugcagcagaauagcuggaauuccugagcauaauuuagccaugguucuguuugcuuaagcauguggguggcuauucuucagucucucuuguguucguaagucccuguggcugcuaaaacuugagauccccugaaaauggcagagccucaggaguucgccgugauggccccagaauacucaaucugcuuagaaaaaggaaaacacagaucuuguugucugucugcaucauuuguaaacgagagccuugucaggaauuuguguguagaacgugaucuguuuuaagccugagcauagucugccugugcuuacagguuuuuaguugccucaagagggagucaccaaauacauagcaaggguugugaaggaaaaggaggacaggguccaacccaguugccaugcccgggguggcgcacucgccccuugucaguugcuccaacuugugguuucucugaugccccugugaaacagaggucccuauuuuuagugcuggacugucauuucugaugugcugcuguugcaaaaauucaguagcagcuuuaacagaaauccugauuuaaaggccccguuuauaauguagaugaagcuuguuuaccaaauaaaagagcagaaugcugugguggauuggcugcuucagaucucaucaaauggaagaguccuguguuuauuccuuugcauggcaucaugcaaaggcccugccucugcguggagcccaugcgucuuuguuuugauucauuccuucuucuggucaaccagggagaggaggaagagggaguuguuccuugccuagaggaaaauggcagagcagcagcagauccagguagugguucaauacccagaucuucuagcguaagaaucaugcguguucagggucacgaucaaaucaauccagaaaauguauauuguaggagaggaagaaaucacuucaucccuacccuucacaguucuugggacagacugcagcaacgaaagacagauuaacacaaacagaaguugaauaguagguauaucuuguguuguauccaugggagauacccagagaaaugagucaguguccaagagguggcuuagauuuuaggcuuaaaaaccaucaucccggcugggcauggugguucacgccuguaaucccagcacuuuggaaggccaaggcaggcagauccacgaggucaagaguuggagaccauccuggccaacauggugaaacccugucucuacuaaaaauacaaaaauuagccaggcgugguggcacaugcuguaauccuagcuacccaggaggcugaggcaggaaaauggcgugaacccaagaggcggagguugcagugagccgagauugugcuacugcacuccagccugggugacagggcgagacaccgucucaaaaaaaaaaaaaaaaaaaaaauuucccugaaacaaagauaaaugguuuggggaaggccaguuauggggagguacccaagaaaagcaguuaacaaagguaagguuugagagccagauucuccacugauagaaaucucuagugauguagucauccuucucuucuugguaauagaaaggaagacacccaugaauuuugucuuacaagaggauaacuuaucuguuuuugggauaucuccugugucugcagucucucaaaauaaucaacucaaaaucuuuaugcgaaaaggcauauuuugggguggcauauucuggucucucacaauauaaaaguaccccaagccuuauguuaguaggaaucauuaacguuaucaucguggcaggaagagacuacagcgagaauuccugggacagcagggaccagaacugguuuguguagauucucagaguauagauaggaucacauuggacccugguuuccaaacauuuuagguaugggaacccccccaccucugucucagugccucgguauguaaaacugacauaaauaccauucugcuaaugguauuuaugucaguuuuacauaccgacacgcugagaugaacuuuaaaugucugcucaguaagggcaaugggccuguuugcauaacacaaauaugaaugguaccugcaguccagaucagcuguagcaucccugcccuucaguauuuuguucugguugcacugucuugaaagaauccacuucgucauccagaucagugaugcagauggcaauauuuguuaagaacggcucuuccuguaguucuaagaaauuaucugacuagaaagaugacaggaaaagcacuauuaugagacugcccagugauaaguuauucugggcacccaugguaaugcgcugggccccaagguauuagaauuuaguaacagcggccgggcacaguggcucgcaccuguaaucccagcacuuugggaggcuaaggugggcagaucaccugaggucaggaguucgagaccagccuggccaacauggugaaaccccaucucuacuaaaaauauaaaaaucagccgggcuugggggcucgugccuguaaucccagcuacuugggaggcugaggcaggagaaucccugaaccugggagguggagguuacagugagccaagauugcaccacugcacuccagccugggcaacagagcaagauccugucucaaaaaaaaaaaaaaaaagggggaauuuaguaacagcaaauguuguggugguugggugggggguggguauuguguuuguuacaaauuuuuaaauaagcugcauuuaaaaaaugaaauuuggacuaagcauuugcggaaacuuuggccucuucauaacucuggucaggcucaacucuuuagcuuucugcaggggaaaacugaagcucacagaccuugaggauuugccaaggucauacauagcaacugggacuagaucauaucuucaggugucuugucuuguguuacauccuggaccuugggacuccagagcugagcagucucucaccugcugagaaccauggugcacaggcccccugugcccuccacuagggugacucacugaacacacauguugguaccagcacugacuucucaugaggaccuuggcucggcuuaccagcuaccuccuuggagagcugcaagggacuaugucccagugcaugugaaggacuguucuaccacagagaacugaaguuguuacgccucuuggaaaaauauuguagcaucaggugucagagcaucuugacagcuggcagaugccugcucccucuggugcucagauaaggccuggggagcugggaaucagcuccugacuuguuaccuccucugguccaccaccgcuuuagugcugucugcugcaaacauagauuaagaggcuugaggacauccaacaggacagagcccuuuaaaugcauuuuucuggagaaaugugguggccuccuuucugaaaagaaacaggccaucaucuggguggugaggaauagggcguggaacauucggaaucagccaggccuacagacuggcccugagcucccugggcugccauguaaacucuuaugaggggcuggucugugaugaggccacugaagaaguuccccucacugcugagguccacacugacugaggaccagaagcgaagugagagcugccuuaccguucuggaaggauggagaaggggaugcuuuccccauggucauccuggaccuaacccuuacauucuuagguccacaagaccaggacugccugcugcccacgcuuacucccucacuuuccggugacgaggccccagauagaacgcagagcucaggugauccacgggagagauguggcuaccucucugugacaugugaagaggugagguugccagccacacugcaccauggcccuaaggacagucgguagagacuguucaguaggagagcuaguuucuugcagggagauaacagguuugccgccuuuuguuuauguggcuccuggagguuaaaccauggccaugcugacuggugugaccagaggaggucacaaaucagcaacagacucccagcuucccugggcauuauuguaggcaccagaggaagcaggcaucuguuagcugcucugaggggugucaaagaagacaggcagaccaaggggugugugcagacaccagcaucacugagcccuuggcucccggggcuuagcucugagacccgagcucagaaggugcgcaggagacaaaccaggucccgcccuugcuaaucggaagcccacagaugacccucucccgagauggcugucguggcacucugcuuuugaacuauguaugaacaaaauccucuguguguuuucuuuuggguuugguuucuuucaauccuuguuaaguuugugagacugacuuggucagucguguuuagccacaugguguuuauucuuguagacauguaguguucugcugauugacuaugccacuuucuugaagcuugcuaaugaugaugaugaugguuguuuggauuguuugcagcccggggugcggugagcauuuuugcuuguguuucugguacaccuugagagugccugcagggugcaucucugcaaguggguugcuggguggggagauacaccugucuucaacuuacucguagcgucagccuguuuuccagagcagccaccaugcaccuuucugcuagcagggugcaagcuuuccuguuguuccgcauccaucucucguuaaugagccugguuacuaauggggcuuggugcucuucauaggcucccuggcauggggaccacaccuuuugaaggccuguucuuguguugccccauuuucagccugagaggucugucugccugacugacuuguaagaagacuucccuauucuggaaacuggaaauauauagguucgaggcuguauuuagaaacagagccaucccaggcacgugcugggaauagagccagggugcugugcuccaucuccuuccucccuccagaggaacagccaucccucgccacucagccuuuuccuggccucuggucccaccaaagagcugaucauccuggccugggguuguuucugccaccuccuccguccuccucucuagacaaugauucuugcgaugagcagaagcaacucuucgaacuacacccccugcuuauuacccccaaauuaagaaucggggaguggggaugcccaggcugacgggagggugucgugaguaccccgccucguuguccuuucuccuugcaugccauuuuucuuucauccuuagcugacuucccgcagcaccaccacgacagugggcagcucacugccucugggccagcguguucacuugggcccucuacaguuggaucuucuuuucuuucuugacuuucuuaacccugaaucuugacuuguuaaagagauucuuuaacaaggggggagugacgugcacucuagacugccucagugauuauucuuguugaaugaaauuuuaugauuuuaggguaagaggccaaacuagacaauaauaccaaccuguguuugcauugcacuguauucugguuaucucuuccugagaaaaacaaaaacaaaacuuagccaccucugaaucuauaguuuaggccgggcaugguggggauggcucaccucugcucacauggcuuuagcuggggcagcuugacccaggcugguggauccccuuccagaugggacaugcauguggcuggcuggcuggugcuggcugucugcugggagcccaucuggaacuggcagccaugcccaggccucaguucuucucucugugggucucaccacaggacugcuugggcuuccucucagcauggcauccgagcuccaagaaagaguguucaaggaagugcaagcagcccaucucuuaggaccugggccuugacaugcacacagaauugguucugcuguguucuguuggucaaagcugucacagagcccccgcagguucaaagggggaggacauauagaccccaucucccacugggggagagaacuguuaaagaauuucuggcuaucugugcuccaccacaugcuaacagauuccccuccaugugacuuuccuuuagcccugacugccgccgcaggaagagggaagcuggaggucugugagcugcugcuggggcauggagcugcugugucgcggacaaacaggagagggguuccaccuuuguuuugugcagcacgccaggggcauuggcagguacccagggggccccugaaugcuucagaagcaaugaguggggauggaguucacuauugccuggcuccccugagaacacaaugcagcuccccugagccugucuguuccccauccucggcuucugcugugccaucaggacugcuugauagagccacguuugacaagauaacacaguuggccacguaggcuggggagcaaggcugcucaaggcugagcuauccaggucagagacacagccacugccuucagcuguggagggaaguggaguggguggauucaucguguuaacaggagacuugcuuuaacauaugugcuguuguaguuuggugacgcauuuguccaacauacuuggaagaagagcaguucuuuugugcucuuuggaaaagaaaauguuucccucugguccagcacugauucaggcuggguuuuuuguuuguuuuugguuuuuguuuuguuuuguuuuuuuacuaugaaaugauguauuguugugguucauucaagggagcagggaauccuugcuccuucauuucguaaacagugaccacauaccuacccuacaccuagcaccaaguuacacauacacuauggaugcaaaggauguuaugaccauuacaaagaagaauuuucuagaccaaaguuuuggucauggaaucgcgucucugcugaugccugcuggcucccuugguaggagcugugagugcuuccuggcaggauucuucuccccuuuccauuccuaagagcuugguuuguaccaucucuucccugucacccucacugcuucaccuugaucaucuggcuaauccuuuccuggcccugcuguguccuaagucacggggaauuuuggaaagcauuuguuaguggauaaacgagcaagaaggcagugggauuguguugccuccuguugcugcggccauguaacaggugauguguuggggaaaaaugggcuaagcuacgggugaagcaguuccugcugggaugguggugaugggauaccccugucugguuuucuaggguuuuuucuccccaaacuuaugacuaugcaugguugaaaggcauauuucuagggcugagaaucuccucaaggugcuuugcuaaaaguugccuuccccgaagggcaugccauccgccaaugcugcaucuuaggaaagcccauggcuuggguguguggugggcgagcuucuuucugcgacccccucaugcccugcacucagcuguagguacuuaguuucagugcccgugggggaccccaugaccgcugcucgccccucuuaguuaugcuucauucucccacgccccuguggcugucuuguccuuguagauagugauuggcaucccuccucccccaaauuaccauuucucucugguauguguauauuuaguugauaacagcaaugaauugggcauguuaaaaagagugcauauuuuggaaaagguucuguucaaaggaauacaguggaaagauuuuccaggccccaugguucacacaacuuacagauuuuugaaagaaagucauuugacuauuuuuaaagguugagaaaccugccuggguauagcaggugugguggaaaaugcagcaggaggaugguaauuccaaaugucucuuccagauuguuagacugcuguuggaacgcggcugugaugugaaccuaagugacaagcaaggccggacgccccucaugguggcugcuugugaagggcacuugagcaccguggaauuccuccuuucaaaagguagcagcgugaugcccucaaagguuucuuuuggacggacacagagagaacuucagcagacccauucagugcuuucugauucaaauucuaaguuuucuguuaauggaaauuuucuaauaaacaguagagagaauaggcaacacagccacaugccugguauuccucuucagcagcgaugaccauucugccagcccauccggccagugucacccuucacagugcuugacugacacuugguucaggccggguguuccgcaggugugaaacaauuugcuuucuggcuuugucaucucauaauguucauguucugugaaugggcuuuccuuucaggugcagcccuuucuucucuagacaaagagggucugucagcauuaagcugggcuugucugaaaggucacagggcagugguccaguaucugguugaagaaggagcugcaauagaccagacagacaagaauggccgcacacccuuggaccuggcugccuucuauggcgaugccgagacugugaguaccagcagguguuccccaccuccaccugcauuggaaagaaaccccaggaagugaacagcucaauccagggccugcaugagguugugucucagugucaucagagagugugugugugugugugugugugugugugugugugugugugugucuugucagggaucuuucauuuuucucuaauucugugacaugcagucuauuccaggacuuaagauuuuagucgacucuuaaaagcuuaaaaauaccugcuugcaaauagcacauacaacagacacauacgugaauaugcauacacaugugcauaugugauuuucucagucauccauauaaauaaaacuuuugcauagaucauuuagaaacuacuuuuauauaugguaagugacuaaucaaaugacuaccugguugcuuuuuuuuuuuaaguuguuuuguuuuuaauuuauuaauuuuuuuuucccaagauggagucuugcucuguugcccaggcuggagugcaguggugcgaucucggcucacugcaacuuccgccuccuggguucaagcaguucuccugccucagccuccugaguagcugggauuacaggcaugcaccaccaugccuaauuuuuguauuuuuaguagagacaggguuucaccauguuggccaggcuggucuugaacuccugaccucaugauccgccugccucagccucccaaagugcugggauuacaggcguaagccccugcaccuggcuuauuauuaauuuuugagacacagucuugcucuguugcccaggcuggagugcaguggugugaugacugcagccuuguucuccuggucucaagagguccucccaccucagcccccugaguagcugggaauacaggcaugcaccaccguaccuggcuaauuuuuagagacacgguuuuucaccauguugcccaggcuggucucgaacuccugggcucaagugaucaccccaccuuggcuucugaaaaugguaggauuacaggcaugagccaccaugcccggacaaaguuuuauuuuuaauugacaaaugauuguguauauuuaugggguacagugauguuuugauacuuguacacauuguggaaugaucaaaucaggcuaauucauguauccaucacccaaauaguauuucuuuuuggugagagcauuugagaucucuuuuagcuauuuugaaauaaagaauacauuacuggccgggugcgguggcucaugccuguaaucccggcacuuugggaggccaagaugggcagaucacuugaggucaggaguucgagauuaagcgaacuugaggucaggaguucgagaucaagugaacuaguagauacuauuuuaguaucuacuaaaaauacaaaaauuagcugggcgugguggcgggugccuguaaucccagcuacucagaagggugaggcacgagaaucacuugaacccgggagguggaggcugcagugagccaagaucauaccauugcacuccagccugggcaacagagugagacucagucucaaaaaaauaauaaauaaaaguuauuaauucuaguugcaguacugugcaguagauaccagaaguuacuccuccugucuaacugaaucuucguacccuuugaccggugccuacccuuuccgcaggucccccugucucccagccucuuucuguucucugcuucuguugugaguucaacuuguuuagauuccacauauaagugagaucaugcugucuuuccgugccuggcuuauuucacuuagccauaauguccuucagcuucauccauguuguggcuaaugacaggauuuccuuauuuuaaagccugcauaguauuucaucauguacauauacugguuguuuuuaaagugauauggcauugccuaaaaauaauauggaaagcuuugggcacuaucuuuaucucuuugccaaaugcccaugucuaaucgagguuugagggaauaaaaccuugauaaacugagaaccgugaaaugucuuucagggcagaaacugauuuuaucaggcuccaugucccaggcacccagcaggugccagagaaauggucagcuacaugagaguuaccaguuuccaauaauucaauacaucuaauggaaggacuagcuggagagacagaugcuugcaaaccuggcaguggaagccauggcccuguaccucugugccuuggugcuuuuagaaggcagcgcugucagaguucaaugguauaaacuucaguaccuuguaaacucuacuucaugucaguuuucaaaaacauacucaacuaaaucucacaugucuacacuuauuuuucagcuaccuucccacauuguguaguuuaucaaaauuagagaagagugaaggagcuuagcauuccaacauaauuuuuuuaauaccguggcaaaaacacauagcauaaaauuuacccuuaaucauuucuaaacauauagaguucaguaguuuaaguauauucacauuguuguacaaccaguauccagaacuuuucaucuugcaaaggugaaacuguauuuguuaaacaacucuccaucucccccagcccaucacagccaccacucuacuuugugaguuuuuuuaccccuuuagauaucucauguaaguagaaucauauaguauuugucucauugugacuggcuuauuucacauagcauaauguucuccagguucacccauguuguagcguguguuagaauagcauuuccuuccuuuguaaggaugaauauugcuccauuguacguauacaccacaucucguuuauccagucaucugucaguggacacuuagguugcuucuauguuuuuugcuguugugaauaauguugcaaugaauguggguguccaaguauuuauucaagacccuguuuucaguucuuugggguauauauccagaagcagaauuucuggcucauauagugauuguauuuuuaauuuuuugaggaacugcccuacuuuuuuuccacaguugcugcaccauuuuacauucauagcacagugcauaagggcuccagaauuguuccacaucgucaccaauacuuguuuuuuguuuuuguuuuuuugaguuggagucccacucugucacccaggcugaagugcagugguagaauuucaacucacugcaaccuccgccuccuugguucaagcgauucuccugccucagccuccugaguagcugggauuacaggugcccaccaccacacccagcuuauuuuuguauuuuuaguagagaugggguuucacuauguuggccaggcuggucuugaacuccugaccucaggugauugccugccucggccucccaaagugcugggauuacaggcgugagccaucacgcccagccaguacuuguggaaggacuagcuggacagacaggugcuugcagaccuggcaguggaagccauggcccugcaugucugaggugcuuuuuuuaauaguagcuuuuuuuuuuuaauuguagccaucguaauggguauaaggugaacaucuucucauaugcuuguugagcacuuguugaucauuuuuguagaaaucuauuccaguccuuugcccauucuaaagaugagguuauuugguuuuuguaguuggguuguaguucuuuguguagauaaucccucuaguuagugucauuuugaauaaugggguggaugauaggaagcauauauuuuuagauucacaugaaaaucuaaaauagccacaggcuaaaaaauggcuacaggcuaaaauggcuccaguaaauggagaaauuuuaguggccacaguauuucuuccucuuguuuccaguuugguucaacugacagcuauuauaucacaucaaaucagucuuuguaccgugguaucaaacuugccaucuuuacucucccaauuuccuucacaucucuuugaaguggauuauacucggguccauccggucccaagcugccaaucuuaacagucugccgugcacagguugugugggucugaguauuucuaaagucaccacugcuguggccugcucauuuguuagagcucauugaagaagucugcugccuacuucauuggagaugcaaaggugacuaugucccgucucuguggccugggaaguggugugagacagagacagaucacgcaugugugcacacacccaccugugguagcguguccccugcuuuccucaucccugacagcaaaaucucuucagcagugaagguuuuagcuguggauugcagcuccucuucucuguuucguguccacuuuauuucuagucuaggauccuuaauaggcagaggcaucuaaaaucagagugaagcuaagacugcccaccccuaaauccgugugcgccccugaacuccuguucccagcugcugcuuaggcuucugcugucucugcaggugcuguaccugguggagaagggagccgugaucgagcauguggaccacagcgggaugcggcccuuggacagagccaucggcugccggaacacaucuguagugguggcgcuacucagaaagggagccaaguuaggucagugagcacugccuccauugagcaggaggagcggugagcucccgauuguagaagccuagacagcacagagagugaccugcucccagguuaggaaguaagaugucagauguuugcagaucucugucucagucucacuuaaucaccauuauacacaauguguaaguagcucacgguguuucugcggggaggguguggaaagcagaggcugguguugaaggacagucuggagugguaucaguggccaggaaccacgccagagaggaaccacagccucuugcugugggguggggccggguagugcugcugaaagcucccccaggugacucugagcagcagcggaggcugagccacuguucuagagccaccagucagcuguguggggaaauggccaccacagcaaguuucugugaagaaguaguaguaugauuucauggagacaaacuaggacgauacuugaggauugugugggggacccugaguagggaaagcccuuuccacguggcuggcuuugacacaaacacaccauuccagauguggggagggucacuauuuugguuugauguauggagcccuuggucaggagcagcucuggguagggcacugugaugaaaaugcuauucacuaauacugucaagcagugaauagugccaggaacuauccaagcaguuucgcccucugccuuaaucccuaccacagcccugaaagucucagugacaaucccaugauuuuacagaugaggaaaccaaggcaccgagcagcuaaauggcuucccccaggacugccuugugguacucgccguggggaccuagcagcuggcuccagggcugugcucuucagcacuccucccacagugucccgagagcucaggcagggguuagagagguuguggccgagcuguaggguaggagagagaagccaugacaucucggaguacagcagaugacacagcacagggacugcgugcugagaacacaugccugcacgguggccgcugcaggaacugaggagguuaugcuaaggccucauuuaauuaauuuuccccacaucccacccggaagggaggaaugaguuuucgcugcucggaugccuucguuucucauuacuuuuuucaguaaaauaacaaggacagauuugagugcccaggucagugggaaaggauuagcaacagccucgccggcguccugcucccucccucaucgugcugugguccuugcagcugggcuccugcuggugcugaccuccagccguggggccacggaggaauugggauccuuuccgcagggccucugaagugccucugaaugcguguuuguuuugcaggaaaugcugcuugggcgauggccacuuccaaaccugauaucuugauuauacuuuuacagaaauuaauggaggaaggaaaugugauguacaaaguaagugguuccgcccuuuucuuugccauugaaacugccugggagcacccucuuaauuggguacauaauggcuacagcugugcuacugcacagucuccauguaauagaagugcaaaaaguggcugggugggguggcucacgccuguaacuccagcacuuuuggaggccgaggugggcagaucacuugaggccaggaauuccagaccaaccuggccaauauggcaaaaccccaucuuuacuaaaaauacaaaaaucagccaggugccuguaaucccagcuacucgggaggcugaggcaggagaauuguuucaaucugggaggcagagguugcagugagcugagauugcaccacugcacuccagccucagcaacagagugagacucagucucagaagaaaaaaaaaaaaagugccaagaggugcugaccuggccucaugcccguuguuggcuuaauaucuuuccggcagaaucuuaaagguagaaagcaccucucuuugugucugagagccauuauuucugagcuaauccuugagguuguaguggugacuuccugucugaagccauggcgugaagcugagucaccucuaggucaacugaacaucauagagaagguuccucagcccuucacauucugaguucagaacaccaugcugaggcacagucaugagacgugggagaggaacacccagcagacauuucuagaagaaaaggguuauucugucuccuaagccuuuccuaauuuuuaauaucuauuaauuucuagaauuugaaaguguuguuagagauuuuuacuuaauacagucaaguaauaccucaguuacucagaagacugaauuaauuuuuuccauuuucccuuggaaauggaaauaugauuuacagaucaauaaacuucacuuuaaauuuuuccaaauaagacaucaguuuaggucagaggucagcaaacuuuuuuuguaaagggccagacaguaaauguuuuaggcuuugcagacuguguggccucugucacaacuccccaguucugaugugggggcacagauagcacagagugaaugaacacagcugugucccaauaaaacuuuauuuguaaacacagguggcuggccagacuuaguauccaagcuauaguuugccaaccccugguuuagauagauaugcaggccauuugcauaggucacuauucuuugcagcucugugauuagacagaauuaaaagauuauaggggaaaaacuagauuaugaccauguuaauccuuuuuacuguuaggcagcuguauuugguauguuguagauuuuuuccuucucauuuuuuaaaauaguaacaaauaaauaggcaauauagcaugacccagcaggguuccuggcuuggaaucagcuugaaauugaguugaguguauuguuguggcuuugaagugcuuuuaauauggauugguaggcaauuaugucagaaauaggaagccauuuucaacaggcuucauaccugcugugcaaugggacugacugagcaaauggauuuuuuuagcuuugaaaaugauguguggugcuguucugauuuuuaaagcccauguuuuaauuccucuuagaagaaaaauuauuauucugcagcaagcucucuagguuuaucuacaagaugcuacuuguccuaggaauaggaucaguuuuucaucugauuucuauuacacuuagcauucaaauagauuugagaucauucuugaaauaauuuucaaaaauacauaccagaagguaaucugauucauuaaguuugguaauuaucaaucuagcaguuuacagacaccuuauuguaaaaccagcuucuuucucacuguguaaccacaggaugcgggugcaugugaggacagugaagcccucaugugccagcccaguuagugaacuagcucccaccuugacacuuguuuggaugcuuucaauguucugucguggguuugcaggggggaguaaacuccccacgguguuccaggugugggaguuauucauuuuagaaccucugaaaaaggacaaauguuugugauuuuugaauccuagaaagggaaaaugaaagaggcagcccagagguaccaguaugccuuaagaaaguuuccucgagaaggauucggagaggacaugagacccuucaaugaauuaaggguuucccucuaucucaauuugucgcgaugccgaagaaaaacaaauguaagcugugccccuuuauuccaacccagucuuccagcaacagagcccuucuccagcagugaaggccagcccuucuccagaccagauccugggcccuccuguccaauuugcuugcacauuuacaugaaccuggcaugugggaaacagcuccuauccgugacuaucguuuggucacggcugcuacgcuccucgcaugauguugaaggaaugcacuuggguuucguuuccuuggccucaguaaugagaagcaaaugcagucugcuccucugcagcuucccaacacuguugcugcuggcacugccguccccggauucaggagaguccaacccaagccuauuguggugggccugccuucuguguuagguuugcucagagggucugccaguaacuaauuuguaaccggucguggggaacucauagucgauuuguaacuaguagaucuguuucaguaguacuuccuaccuuuuuuuuaacuguguccuccugccccagucuguugagcugcuugcuucugugcccugcugccggaauagaugcagugucugcgcuccucucugaggcugccccuccaccgggcugugagguuccaccaucuggccuucuuggggcacuguuacuaccacuguuuucauaguggauucuucuccuaaugauauuaaucaaccaucauuaucuccucacuuuaaaacaagauagaaaacggaacuuucccuuccucccucucuggcugugccucagagcgcugcuacccuuuagaacaaaacuagacgggcuucccacaaucguguguccaggcugcuucugacuccuguauuucuugucgacaccaggacuuuggcauggcagaggaauuugcuuccaaggcucucgaauugaagcccaaguccuaugaagccuuuuaugccagagcaagagcgaagagaaauagcagguaccgucugugguuaucuuugugucuagagcuuuuuuucuugugggaucaaaccugccuguugaauuuggggagguuuugcugcagaaguguugcucaggugccucucauccuuuuuaguagugaauuaguauuacuaccugcuuccaagaggcauaguaguggacauuaucagugaugaguaaacuucuauuuucuccugacgucucaauaaucauuccuucccaccccuccccccacgugaaacuuacugcaacaugaacuuccuaccuaguuuaguccauauuucaaggaaacugccaacuagggacauuaggaaguucagagguggggaagagugauauaagccuguugacugagagaugggcacaguguuaccaugggaugguaacaauauuaaaaagauucuggcgcccacugauucaugcuucucccuauucccaguccaguggucuuuauggagagcagggcuguagagucccaccuaccuagguuagaauucagcacugccacuuagcugaguuacucugggcugguuaaguggguccuggccaccaccguaaguguucaaaacucacuugcuaccuucucuuuccuuugagcacagcucuuuuaugaacaguuacacucugagcauguucgugugugguuuguaauguuaccuuacauuuuccuacaaaggcaauucguggcagcucuggcugaccugcaagaggcugugaaacucugucccaccaaucaggaagucaagaggcuucuggcccgcguagaagaggagugcaaacaacuccagaggagucaacagcaaaaacagcagggcccgcuaccagcuccacucaacgacuccgagaacgaagaggacaccccaaccccuggcuuaagugaccacuuucacucugaggagacugaagaggaagaaacuucuccccaggaagaaucuguuuccccaacucccaggucccagccauccucaucugucccuuccucauacauccgaaaccuucaagaaggguuacaguccaaaggaaggccgguaucgccacagagcagggcaggaaucggcaagucccugagagagccuguggcccagccagggcugcuccugcagcccuccaagcaggcccagaucgugaaaaccagccagcaccugggcucuggccagucggcagugagaaauggcaguaugaaaguucagaucucuucucagaacccuccuccaagucccaugccagggagaaucgcugccacuccugcugggagcagaacccagcauuuagagggaacagguacuuucacuacaagagcugguuguggccacuuuggggaucggcugggccccagccagaauguccgccugcaguguggugagaauggcccugcacacccuuuaccaaguaagacgaaaaccacagagaggcuucugucucauuccuccguggcuguggacgcagccccuccaaaccaaggugggcuggcgaccugcagcgacgugcgacacccagcuucccucaccagcucaggcucuucugguucuccauccagcagcauaaagaugucaaguucaaccaguaguuugacuucgagcagcaguuuuucagauggcuucaagguccaaggaccagauacuagaauuaaagacaagguuguaacccacguucagagcgguacagcugagcacagaccccgcaacacgccguucaugggcaucauggauaagacugcgagguuccaacagcagagcaauccuccaagccgcagcuggcacuguccggcaccagaggggcugcugacaaacacgucuucugcagcuggccugcagucugcuaacacugagaagcccucucucaugcaagugggaggauauaauaaccaagccaaaaccuguucuguuucuacccugagugcaaguguccacaauggggcacaagugaaggagcuagaagaaagcaagugccaaauuccaguccacucucaagagaacaggauaacuaagacuguuucucaucuguaccaggaaaguaucuccaaacagcagccucauauuaguaaugaagcccacaggagccaccucacugcagccaaaccaaagcgaucauuuauagagucaaaugugugaaccuuaagaaauccccauuuguggaauuuggaaacguguguugacuccuggugguaaauuaaauaguuuuuuucaucagaaaaauuauuuuuuagccauuuuuuuucuuugggguggaucugaugccauugauauaucuaaaaugugggauaaaacuucuuuaauagcuagaaaucaccauaaauaagaaugcuaaacagaauugaaaauuauaucaacuuaaaauuuuaagacagcccagaagacauuaaugacucucacuuaugaaauuguuuggcuuuugccacuuucuuccuugccuuugcuauaugguagaaucacagaacuuacuuagagaauaaauaugucuauuguucaagaguaacagguuuaacucaugaccaagugauguacauccaagugauguauucuggaaacgauggaauuuuacaguuacaguuccauugagucaaaucccauuuuauauauacauaaaaauuaaguucugagugaguucuagcuaaauauaagugcgacuguaaacgcagccaauuuuuuuaagcagaauaugagaacaccuaaguauucucuucauagcaguuccuauaaagggauuaaacacuuauuucuguguuaugguucuuauucauauauuuuuauagcacuuuuggaaccuauauuugugcuugaagguguuuuugauauuuggaaacaguauaagccauuuggagucaugauugguggucaaguggauucaagcuaaaauacuaagaccagcauucuuaguggcgcuuauaaauuagcucucaccugguuuccaaacugcuuuuaacaaugguagugcuccuggaacaauccuuccaagcuccucuaaggacaauauuuaauucagauacuaaagguaagacugguuguuacuuuuguuuuguuguacaauuaguacuuuauagucacauguuguauauauuaaauagcccaguuuuauucagacuuguaaauagaacuauuucaauguaguuaaucuaaaaacaaaaaagaaaaccccagucacgauuugcauguucucuguaagcuucauccaugcugguuauugcacugaaugauauauuauuagggcauguuaacaguauaccaguaacagcacuuuaucucauuuauaugaacaccuuugaggugcuacuuaaguccaagcucugauguauuauucauuuguaaagauaagguacaggaaugaaccuugguuuaaagguauuuuuauaugaaaaugguguguuauuggaagauguuaaaaugcuaauuugagagaaguaggaguguaucuguuuuauauguugggaugugaaauuuauuuucuaaaauugaggagaaggaaguuauauauuugcagaauguuuuaaagugaauuguuguaaugaaguuccugugaacaucauuaugguuuuguacaaauaggaaccucugaugucauucuucaacguuuguuccuguguguacaauuguacuuuguaugaacagcuuuaucauuuuuauaggcuuuccaugaguuuugcuguaacuacuauggcuuauuuauuuucuuuaauauuugugaaagucuuacuccuuuguuaguuuuguuucugcacaacuacuguacuuuuccauauggaauaaagacuauuaauagaauguguuuugcacuaaaugagucaauggauaaguagagaacagccugaugacagcuaucucuguugcuuuuaaucuuuguuacccuagagggaauagugaaaagcauauuuuauauuaacacuacaaaaugcuuauuuaauuucguuuuauaauuucagaauaagggugacagcugcuagaaauuccacaauacucaagggccaaauuuagucuuuuugccucaaauagaaagaaagcaugcaggaaagcaauauauacuuccuaucuaucuguuucaagacaucuuggugucuguuuuuacuggcaacgggacaucuuuacuacuguaauucucaaacacuuuggcaauacacugaacacuguuaugacaguuuguucuuuaacacauuuguauuaucuuucaguuaaaaguaugucuuuaugccuacauauuucaaaguaauaugagagagaacauuaaacuguguuguauugugauaaaauucuu

SEQ ID NO: 13207 - RNA, 2559 nt, Homo sapiens
uuguuuuuggauuaaaaaaaaaaaaugaaacacuugagauccuggaguaucuguuugcagacacaguguggaggcagcagccacugugcugggguguugcggucccccugcugcacauaggaccuacauaggaucaggguccuccugccagucccaagugagccacaggcauggcccuguuuguuguggaggugaauucuguggagccaagcuccugcagcugcucucucugccuccacggcagcugccaaaugggagucauuucuggcucucuacacagaguguuucagguugaaccagaagcuagacauucuggggcauaaucacaaucgggagcaguguggagauuguuucgaaagggaagggggguguggaguggagaaacugcggagaucugcccccucacccacuucuucccuuuccaucugcguccuguucccucccuccagcccagcugccaccugagauaaaguagcugcccugccugggcccggggcagaggcggagggagggcggugccauccuguucugagggccucaccccuugggugugccucugucugcugaucugguuugguucccgcccuccuuucccaaacgcccagcuaccuugagaaucaaaaugugcuuugagguaggaagggaccuccuguagagcggcuuuggcaugaggucgacccgcccugggguggcuccuuuucccuguguuggcuuggggccacugccccuucauguuuggcucacaugguccagaagcaucagggcucuuuuaacccagaauagucaagccuugguuuccuuaccccugcaguuuuccagagcagcuaaaaaacauccaagcuggcaaaccauucuuccuacuccaaacauuaggagcuuuuaccaguaagcaaggggugggaagcuuuuccuuucuugaagaugcugccagcguaguuucccuuguagcugccauccugggugcaugacuugcaaaacugauaugugagugacaauaagccagauggccuuugcaaaagcucugcuuauuuugauuuuugugguuccuuacaaaaggcgaagugagcauugaucuuuguuggugcuguuguagcucaacggcaacaucacuguguuguuuccucauuuuauuuuuccuaaaaccuuuacccauuaucugcagauuuucacaucuaagcaaaauagguucauaugaguccaguuaccuagacaauuaauaaaaaagagcaaaauguugagugacuaugucauagguuacuuauuguuaaguuacagcuuuguaagcagcuugcuuuguaaauuuuucauccccugauggaugcugauuuuagaaggugagagacguguuagaaggaugugaauaucguuuuauuuauuggccauaauuaagugccuuugggcuuuuuggguacaggguuaaacuacagcucaacauuuaaaucaaauccaaccauaaaauucucuuaaguacaaaaaaaccagaugaccaaccucagggagaacccaagaaaaggugggcuuucccagcauugcugugcagcauucugagaauacagcuugauuuuucuacaucuuugcaugggcaacagugguacuggguccugucucuugggacaaguuucacugugauuuuaaauuuuuguuucaacuuggauucuucacgauugaccgucaaguugaaauccugguuuugacuuucacuacugugggaugugcacaggaaguuuuccaccaaauuuuccacgucguuccccuggcuuguuuaaugagagcuuggauuucaguuuuacuccaacaccuaaauagccugggucucuaccagcaugccacuaggguuuuacuucauuucagccuccugugggcauuggacacccggcacucugugaggguaacaugaaagauaggcccuuuucuuacccaagcugaugucugaaguacccguuuucacaugacucggaauuaggaauugccgucagauaacacugggcucuucucacucacccuuugcacuuggaguuuuuguuuuacuguuuccuuaaccugucacagucccuuaauuagaauguauugcuagaggacagggugcguuguccaacuuugugcgcauuuuauagaaacacacaaaaucaccagacaaagcagcuguagugugaacucauccagaugcgauacugaaauuccccagaggggcaucuucauuguuuucuuucuuuguuccagaagcaaaggccgauaaugaaccgagcuguucgccggcagcucaagaacuguugacaaggcugggauuuuuacugggagaagggaucccaagugccacacacauaaccauugaagacaaaaaugaaaccaugguaaugcccgaggaagacacuacauugcauaccucuucagaggaugaacgaagcaauaaccaucuucucccuuuccuugagcagggaagccauuguucaguuaaaugaguucugggcuguuguguauugaaauuuauuucaacaguuugguucuggguuuuugcaguggggagguagggaaaagcagaaagaagcagaacguaagaaa

SEQ ID NO: 13208 - RNA, 1883 nt, Homo sapiens
auuugcuguaccucuuuauguuuucauuucaucgugcucuaaauuugacacauuauaggaaacuaagauggucauaaaucauugaaacaauugaaauaauaauuuucugauuuaaaauuuuguuuuguuuugguguaugaauuacauacucaaagcuacuuaugugguaggaauuacaucucaaauuuucuauaaaggaaauaagaacuguguuuugcauuccaugugacuacuaugguuuuuaaauuauuuaauguuaacgugaccaagaaauucagcuggaaauguuaacuucguaguuguaguuuuuugaaaacuugcuauuucaugugucauuguaguaaagguggugauuagugauguuagcaacuugcauuaauguggcucaauaccgaauacauacuccuugaaaugacauauuacguauauguaaugagaccuguucugagauucuauacccuuggcacagucuucucuccuggguguucuuuuuguuauuuguuaucauucuguuuuguucuauuucagugcauuauaacuuuauuuugcaaaaugaauaaauacaaaccuaauuuaaguaguauaauuuuaauaucuuaacaugauuauauuguuguaacgggcucuuaagagcuuuuugcauuaaaauuaaaucuuacuuguucuaaauaguuaggauauugaugcauggccuuaguaaauauagaauuuuaaagauaaaugcaaauuuuaugaauuuacagaauuaucuagauuuuuuuaaguaguaaauuaguuuaucauuuugauggaguuggguuuuuuguuuguuugauacccauggcuaauuuaaaucuucccucaucaaacuacacuaaaaauuucagagagugaaaaaacagcaauuuggggggaaaaaaaaaacuauggacaaagaaacuuaguuuucaagcuaacaauguuuuuaaaaaaugcucacagguuaaauauuuuguuuuguuuucuuuuugauauaugaguuuaaaaugauguagagaaaaguuucaaauuauguaaacuuucugaucauaggaauuuuuuuuucaaagacugccacauaaauuauaaagcagucuuauuuugcaggaaguuguccaaauaaaaaaauagacaugcuuugaccacaaaacaauuaauuuuggucuuuuauuauaacucagaaauuuauuuuguguacuuuguuguagcagcugaaauuuaaagacuuuucuuuauuuuuggcagguuuuugagcaguuauucuuauuuguuagcauugcuuuguuuuuauaguuuaucugccagaagugauuuuugaaaccugcuuuuaaacagugccaguuuucaagcauuccuaucaugugaguuuaugugaggaguaaacccuucuuuaaaaaggaagaaagaccucuucucuuuauugucuguuugacauuaauaaaauuaagaaaagaacgauuacuugagacaucaaccuuaccuggcuuaguuuuaucacgugagcauucacguuugcuggugaucuaagugcuccaccugccuuucaguuuguuuaccaggaaaucaagauguguaaacugcaggaaguacuauuugacccucuccgacaguaucucauuacaauaauugcuaaucucugaauaagacagccauguuuugugaguaacugagagagagagagguuguguuagguagauuuuagguguuucaacaaauagagcauuguaaaugcuuacuuggauuauguuuucaugauagcuuuugauaaaagacauaugcugacccuuggggucagcaaagcuaggacacaauaguagguauucuuucaugccuuuuaacugaaaaauaucacggcuuguuguuuuggagugcugucacugcucuga

SEQ ID NO: 13209 - RNA, 101559 nt, Homo sapiens
ugcgggcggggcaggccgcgcucagcaggcggggcgggagccgcgugcgcccgaggacccggccggaaggcuugcgccagcucaggaugaggacaggcugggcgaccccucgccgcccggcggggcuccucaugcugcucuucugguucuucgaucucgcggagcccucuggccgcgcagguaaccgcgggcacgccagccccgcaguccgcugggugccucgacgccacagcucugcugccuuccagccuggggcagggcugcgccccuggggcaggucacggcugcuuugcuguuggggcgggggggcucuggagccggaagagugagucgcaggggaggucuggcagaggaagcgccccagugcccucgggggcccggaggagggcgcgguggaugugggaggacagggcccuucuggugcagaggggacgcggugcaccguagaguaggcgcacggaggcuuuuuuggccgggugcgcugcuccaucgucgccucucuuauauaauguugcuggaguaugggguuccccaucugcccucuugcgucccgucccucccguucucgcuuuuccuucggcccuuggucaccuuggccacagggccaagaggagccuccacccacagcgccaaggauuccccacgauucccggauuucacugcgccuacggugcgcaucaggaaggaagucagguuaaauaaaccaucuccuccgaaagugaccaagaccaagagucagcuaugaugcccucacccaccgccuagagcaacaaaccuuucuucucauugguuuaucagcuccaaaugaccccgcucccccaaggcugacagccucacggugaagggcaggucgccugcuuggggaccugcugccucucacugcggaagcaggaccagaaacagacagccuucauugauguucaggguagugccagccccaccacaccacaccccuuggcagcaaccgguugcuuuuacuuucucuuuuugccugggcgaggggugugcagagaacuuuguuucuugguuggacugcaucaugggcacucaaugggccacccuccaccggccacuucuguuaucgugccuguaugaggaaggaaaagauuguccaggcaguuugaaaaacauuaaauuguugguggcucuuauuuucuuugcagcuaagcuaaguuaccaucugguuuagacuuccuucggagagcgaugggaagagauuucucagagugugaauggcaucauccuaucuacagcaaggaccuggaaaugaacccugcucugagucacacuucucuauucuccuuugacccugugugcuaggaacuaccaaaagaauccuuuaaaauaagauccuuuauugccuugauaauuuauucugccugccccacaauccaagguggaaaaguucacugcagcaacuaacuacagugaaaaugcacuaacuuuucaaucacuaaccucuugguucccaucgacaucugcuucaguccuguuuuuaucuccuucacaaauuucaggauuucccuaauucuugcaaucucugcaaucacugcccuuuaucacugacccaaagcaaaaagcaccagguuuaacucuguucccccugugcuagguccccacagguuuuguuauccuguauccuuccuuacuccuagcagcuacucugaucgauuuucucucacccucagagcagacuuguggccuuguuuggggaagcacuggaauuuugaacccccagccauuugggucaauuguuuggcaagaguguccgcuucaugaugcuggugauggcaugcaccucgucacaugugcacggcuaggcuugugcagguggccucuauuacccaaacacugaaggagccccucuguguccuuggagagaugccaggugcuuaguuuacauuuuugccugcuuggagagcuaacagcuugaaguaaaccaauccaucagggacuccugagguuuucaccagccaacaccacccaaucgugcgugaagacuuucugacucccuggacauugccauggacucaacugucacuucaggaccuguuuuugaacuaacaaaccuagacuucugauucucucuugcugcaccuaccuguacauuccgaacacaugguagagacucuacaaaaugcuuaauaugugaucuauggacgguuccccugaaauuauaaaugcugccaucuucauccuucuuguuuucccaagcuauuucccuauccauuugucugugguuauaaaugucaauauccagcuucucuuuggaaugugugaagcucuuuggucuagggaccaaaggcaggaauuauuuagugaucagacaauaagaaaacacugaaagagaugauuugccuuugauggauguaaaaauacuaaaaauuuauuuucaauuuaugguaaugcuacuuagccauuuucucucaaacaccacuggagaauuuauauaacaugaagcauauacaaaaugcaucuaggggguaaugaggcuucucuucaucaacuucugccuuuuagauuugccccaauauuguacuuggagguaaauauuaaaacuccauugaggacugguauaaaguuguaaagugaacaaaacccaguagaaagcuauugauaaagaaucuauuuuauaaaauaaguuuuauacaauaaaaucuacucuguaauuaccuuuucaaaguauauuucuaaaauagcuuauaugcccuucuguaccaaauuuucuaaauaagggauuauguucacacuuucucaguccuccuuccagcucuucaaccuacuaucccaauaagggucguaagacugaggcaguuucaacagcuccugcuaagguuaaagaaagauacggggaagcaucaugaaaggauaggacucucccuaucuaauguauguuuauacauaccuuauauauggaggcuaauaaguuuccuuuaaguauaucaauaauuaagaucuguacuaagugaccacuauaagugucacauugaaauugcauacuugguucaaacaagggauuagucugagaaaaacaucuauauucagagauguagcaguuuguuaggaaguuuggcagcuccacuuuaacauagcuacuccacaccucuccuguaguguuuuaguguuucaaucucggacuccuaacuccugcuuuuuccacuguauaaagaaauguagcuaauccauuggauucuacaaaaauuuugaaaaauccagaacugcaaacugcaaaggaaggcaaagcugcugcuuccccaguucaccuguuugggauccagcacacaaagcagaaugcccgggaaagacagcagcaagacuacagggcaggagaggggcuguuuccaacaagggugaugggcacgucuccugcaggagcagacuucuuuuuucuucuguaauuuuugauacuuuggaaugcaagauuuauuuuggagaggcaagagagaauacuuuggaaaagauguagaucagagaucugaguagcuauugaauugugggagaaggccaugagagaaagugugaguaguaaucuuauagcacauuuuccuuuuuuguugacugucuucccagccuguguccaucaaguagaaaauggcagaggaaugucaaagaagaaagugugagggauguggcugggcacgguaucucaugccuauaaucccagcauuuugggaggccgaaguggguggaucaccugaggucaggaguucgagaccagcuuggccaacauggugaaaccccaucucuacuaaaaauacaaaaauuacccgggugugguggcaggcaccuguaaucucagcuacuugggaggcuggggcaugagaaucacuugaaccugggaggcggagguugcaguuagcugagauugugccacugcacuccagccugggcaacagagcaagacuccaucucaaaaaaaaaagugugaaggaugaaagcugcuauggcaaacauccuuagcugcaauccuguggaauacuuuuaaaauucagauuuaaaauaacuuuaagcuuuaaaggauuguuguugcuguuguuguuucucuugucguugcuucuguuauuuaaaacaaaacaaaaaaauccuuccaaaguucaagcugcagugagacuuaauuuuauaguuauuauuuacaugguaaaauuccccucaagucaccagucccugguaugggaauuuuuaacucugaaagccuuugaauuauuacuaggaaaagcaucugguguuagugaaaccagugacugugaagcugguaucaaaaugaaagugccuuuugggaaccaaaauuuuacaggucuuucugcugaacucugguucacugacagugauugcuuaagcuugucuaaaauauuucagcuuuacucuuaucaacaugauuugugcuguaauuguuuaaaauuuuccuuuguaaaauaacuaaccaaauuaucugauuauaguuuguuguaacagaugugaaucuuauuccacaaacucaggugugcaagaaacaaugcauuacuuuauuuucagaaauccaaauuaaauuugaugcugagcucccauuccaccagguugccagaacuucaauaauuguccuuacuggggucuuugccagcucaugcaaagugccaggggaacauucagggaggauucuucuuuagucauuggaucccgcugguuaccucuggguuuuccauuguccaaacccacaggaucuuguaucugguggcucaagacucaucagccaucacuuugguaguuccuggaguuugggguucagccuucuuaggugauccacacugucaauccccccaggcuuuccccaggcccugucgccuuccugagggugccacaagccaguguauggcuggauaguugcagacgacugugaugaaacugaggacaaugaaacugccacaguggagcuggccacagguucuacccucagaacccagaccucuguuucuucuuguuucuguaccccacuguucugcugcucccucagaaauuuccccauuuccucugagauaccucaaugaauuuaggucuccaaaaaauaucuagggggaaguggucuuuaagaaaauuguccuuaaguuuuccuuuuuaguggccccacuaacuugcccuaaggcagaggagcacagaggccucacuauguacuuggaucugaagaaaggaacauauauauagugcacaugcuguguuaagcaucgacuuuucauguaauaauuuacccugccguaguagcuaacauguaagcaaggcagaauuauggucccaacuagacuuuucauugagaugaaaacuaaagagcuucuuuugucuuauuaaaugagaagggaaaaaucuuucaugaaauagcaacaacaaauauacaugcuacucuacacgcuuuacauggauuagcuccuuucaugcucacaaccaucauaugaaaacuggagcacagagguuaaaugauuugcccugauccuauggcuaacaaguagcaggagcaaaauauggacccaggcggacuggcuccagagcccguguucugacccuacacacugcacugccucucugcucaccacugucccaccuuuuguaguccccugcagcuuaaaaagagugggaacagacugaggaugggaacaguccaguagugcucagacucuccucagcaggcagggagcaaggcgcuucaaccacauaaucuacaaucugucuguccauuugacucagcuaaugaccccuucaccaucguccauggaaauacgggcaagugcaucaagccaguguauggcuggauaguagcagacgacugugaugaaacugaggacaaguuauggaagugggugucccagcaucggcucuuucauuugcacucccaaaagugccuuggccucgauauuaccaaaucgguaaaugagcugagaauguucagcugugacuccagugccaugcugugguggaaaugugagcaccacucucuguacggagcugcccgguaccggcuggcucugaaggauggacauggcacagcaaucucaaaugcaucugaugucuggaagaaaggaggcucagaggaaagccuuugugaccagccuuaucauggugaguauuagagagggacuuugaccgauuugcuguugugcuugucacauguggcauuaaacaugcacaauuuaguaaaaauagagucguacauuaguaagggcagugaguaagcucuucacuuccaggcacugugcaguuacuuugagcgacauucuuacaaguccaugguauuugccucuacuuugcagguaaggcuaagagagauaaagugccuugucugaggucacacagccauguugugauaaaccugggauuucaucagauagauauguacuucuuaugauggucuucuaaacccuagaggaaaggaaacccuagaggaaaggaaucauuagauuuguacaggcuaaaagucaaaugaucuaauaauguugaucuuauucuaaguuuuaaaagaagaagaaaggucaggcguaguggugcaugguugcggucccagcuucucgagagacugaggcagcaggaucacuugagcacacaggaguucaaggcuguaguguguaaugaucacgccugugaauagccacugcacuucagccugggcaacauagugagacacccauccuuaaaaaagaaaagaaggagaaggaggaaaaauauauuuuuucuugccuacggauuuugaauaaaaugggaaaauuuugaguggauuuucuuauuuauuuucauuuuugcauggcaaccaaauuuugauguuuauauuuaugauucagcauuuuaagaguggaguuuuucaguugcuuccgaaaauaaguauauuaauauugccuugcggggagcggaccauggacuuagcccugagucuagggacuggauugcaacuaauuucuaaguuaaagaaugaguagauuuauuuuuuuaaccauuaaauguaauuagcuaucucccaagcaaauauuuuucauuauguugcucuaaauuacaccaaaugucgauaugcauauaauuauguccucuaaguccuauuauuuccccuugccuuucuuuacaaauuucccuagcuuuacaguggcuuucuucuucucuuaaagaucauuuaagcuaaauuuggccucaaagucacuauagcagcuugcucccauacuuuccauuauccaucugcacaaguuuuucuuucuagcuuucuauuuccuagugaggaugcaagaauuauucugagaaugucaaguucuguuguggagaaauauuagagaauuagagauaggguuuccuuuucaucauucccuggccuuugaauaguugacagucuguuucugcgagccaguuuccuccuaaaaguaaagcaguugcuuuuuggauaugacuuaauggcaaauuuaaauucugugccacaaaagcccuucuccaacuugccaacuaagaggaaacacagagccaaacaaaaugccuuuuaauuggauuuaacuuguuucauuguauuuguccagggaucagaaaggauaauuuucuuggcaggguucuuuuagucuccugaucuaauucuuuugaggggcauaguuguaaucuuaaacucccucaguccccagugucuucauuucaauauaacugguuuuccuuuuuauccuauguauuuuauguaugcauuucuaauguucuucugagacagggacuguggauuucacccagcugccaaagagaucaguagcacaaaaaagguuaaggaucuacccaggggaccacccagagagagcuaagcaaugccaccagcauaacccaaaggcaugaaguguuucuugaccuuuucaaauauaauauuugaaacacuaaagcuuuuuuuaaagcauauauaguugugacuagucaaggcauaccucaaguuuuaauuugcacagaaaccagggccaaacuugccaccucuucucuguuucugucugggugacugguaccaucuaaguucuacaugucagaaaucagcaagucaccugagagguuucaggcucgccucuuccaccacuccaauauaaucaaauaugaaguccuggcaauucuacccuuuucaauuuauguauaucccuucuuguucuuagguuagggacugcugucuuaaguuagggacuuucucuaggacuccgcucucagacucucgauacugauuguuguccccaccuucuuaucuagcaguauauaaacaaaacauacaagauacccaagucccaacaaagugaaauccaagguuaccugguuuguuacagcaaagcuagggcuuaaaaccaguauuccauuccccaaacauagcuucuuucuuucccccuuggcuuuagcaguauaaaccaaguuuucacuugugauacaagaacauuaauuuaucacugugccuuggguugccucucaccccaacuccuauccugugugagucguguucaucucagagaaaacugaaguuguauaaauuuuaugagugaacugcuuuugacuagcacccagguguacauuaauaucauuaagauaccuugaucucacuagcacuuuucaaauuuugaauguuuggugaaucacgcagaggaaauggacuuuuuguggcaggguggcugcagaacuaucagaauucugggcaacucuuagaagccugccaacaaccucuuuauccauugaaacuauuuugucucauguuacugaugacauuaauuugcuaguuuucugcauaaucaccucaucucacaaauuuguaacuauugcauaauaaagcuguuguuuuaaggaugcuaucaucauaaauuugcacauucagagaagauucuucccaggaaagucugucuugcuaaggaagcccaugguguguaagaggccagcaucagcaaagaaugugugggaacaaaaugcuuagugaauaguuagcguaauuuagcugcuucugguguggugguuguaugcuuaucauucuucaaagcauauauugugacuuagagagcuuauuaauugaagcccagcuuugagcuaugaaauuuaacuugaaacuugagaaggcacccgcugaugucacaaguuguccuuauaggucaagagucuaaucagagagagcccauucucauuccugucacuugcagcugagugccugaauguaucacuugacuacucugcaaaaauggggauuucccagacaaguauaauaccuccccuaugaucucacagguuuaugauaaagaacaaaugacagaaauguauaccaaggcacuuuguauuccaaaaaucaaagguuuuagaaaagaaaacugauggcucuacaaggaacagucuuuguguucagggacuguccucuuagguuuguaauaugggaaaagaaacuggucaugagcuauugggggguuuugaugcgguuaaacugaaacauagguaauaagcagaauccuuauaaaauauaaggucaacacacucuuuaacagaaguacgcuuuugaaaacuguuucuaugacacagcaaaacaaaaccagugaucuuuaaaagacuauuugccaagaaaagcauccagauuauuauuaccuuuugcuauaggucugcuuauuacauucuaagcuguuaaauggccucacacuuuaguuagacggacacuggaggaaaagaaaguagaaucaaauacugucuuaagcacacuuuuaagcaaaucugugagacauuuggaggaacccuaauugccugguaaacggugauaagaucugauuacuaugauuuaccuaauggccauuauuugaucuguuaaugacugagguuuuuagcaaauuguggaccgagguuuuggcaaauugugacagggauacagggauagcuguucuauaaaaacaccuuuccaagagaauuaguauugauauaaguaucaaacauucuuuccagcauuuccaggcauauuugagguuggaaucacuuuucaguuccuccccauguaccagggaaaaugauugaaguaaaagcuaugucuacuaccucacuggccccccgccggucacaugacugccccauugaagcugcugcuucuuucacaccccaaauuaccaugccuuguaccuucccaagaaucugcucagaaauucagcagcucuuccuuuuacuuccucaaaaaccacagucucaauucuaccuccagucucugaacaaugggacuauuuguccaucuuucuaaugccgcaggugguuccaaaguccacacccacccucagugguuccaaggaauuuuucuggcuccaacacuuucuaaagaaaagaaaauagagguaaauguaaccucagccagggcacccuuucuggugaagugcucugcggcccacagcagaguuaguagacccucaccugaucaagccaggcucuuucagcgccucaucacaccacaguaagugaagcuucacaugguugaucacugaacgcuauccccaguuugcaaaagcagaaacagaggcuacuagagguuggauagcuagcccacaggcaaacaguggguuagcagggagccagcauucauauccagaccugacagcacccaugcucugaauuccuacacucggauauuguauucuaaacaacguuucuuuuaaaaacaguuuuagaaauuagccaccugacgcugacuacccaguuuuuaacucucuuuuccccaacuuccucuccaacccagagaucuauaccagagaugggaacucuuaugggagaccuugugaauuuccauucuuaauugaugggaccuggcaucaugauugcauucuugaugaagaucauagugggccauggugugccaccaccuuaaauuaugaauaugaccgaaaguggggcaucugcuuaaagccugguauguaugggcugguaaauuuuauguggaaagguaguacauuuauaugaggcaauagggagaaggaagaguucaaagugacucaaaagugacugcaaaaauauuaucccggauaagaaguguauguuuggaggagaagagagagguaauguguagccaugaauuugccuucagaagcaggcccggaagugaaccaaggcggauggugucauggaggaggaggagggaguguuccauagcaccccagggagaggaaguguggaaaaggcaugcacaauuaggaaauugcugcugaccuuuaguaguuucagaagacuagaggggguagaagcuggauuguaguggaaugaagcaugaacagaaggaaguaagccucguaaguuucacggagcagaagaagagacaguuggcaaaggacaaaauugcaacaaauuuauguaguuacaaucuuauuuggcuuuauugcaauucuagaaucaggcaacaccucauuucauaaaauagacuacuguaaguguuccaguucguugaacagaggggauuggcuuuguagacagaaaaagggcugaagaaagcaaaaacagaaaccgaagaguggauuggucauuucaacguaacuuuccuuguaagagcaauagagaaauaauugauuggucaacaucaggugacuucagguuaagcauugaaacagagggaacuucauuaucaguccaauuaaagauugaaacuggccuguuggggaaauuaggcaguugucucucucuccugauuucucaaaagaccagaugacaaucuguuucaguuuggugauguggaacuuuggcaugggugacuccauuuugauuuuugaguccuagaucaggagcuuaguccaaaacaguggcuuuuuuuuauuuaaaaaagcaaaggguaguuuaagaaagagaucaguugaaaaacacuuuuagaauggugaaaucuuaaguauguuuauggccugaagcaaagagcgggaaagagaagagauagaucuuccuggcucaaaauuggugacacuguuccuuccaccauuccuguguguuugucagagugcuuuuucucguuacuuuuuaccagaagcaaacuguucaggauuugcuaaagaauuugcuguucuuuagaaagacagagagagaccaaaguagcaaucacaucauuaucuggcacauaacugagacacaguuucucaccaauuaggugagaguuacaggggaucacgguaccugacaugugauagguacucacaaaauauuacuuaauggacaauagguugaaagaaucuauagcaaagagaaaggaaagagcuccagaccuaaguaauaauaguuaauacuuaacagggcucugccaggugucagauacuguuucaggcucucaauauacauuaacucauucaguccucacagcaacccugaaagguaccauacuuuauccccauuuuacagaugaucacagugaggcacaagggagauauguaacuugccuaagaucacacagcuaauaaauaucagaacuagaauucaaacccaggaagucuggcuaugaaguccuugucccaaacagcuacacuaggcugacucauugaguagcuagccaggugguauuaguaaugcugaucccuccuucgggaaugugagcuucagaaugcagaagcucuuggagagcuuggagagauuauacuggguuaagacuuaagauuucagggugcaacagaaucacauggagaguuuguuagaacacagauaucuagggcccagagauucugauucaguagauuuuuggugggccccccaaauuuggcaaguuuccagguagugcugauaaugcuggucugggaaccacacuuggaggauuacauaucuaauuagaggcccaggcuucucaacaccuguaaccuaccuacuaaaauagaaaaagccaguauuuucuucagcuauaauugauaauaagcagaguuuggucagccagguaucaacuucauuuaacucuccuuaucauuuggaucagaaauuuagaugugaaaguuugcuuagagguaauccaauguaaaccccuguuucucaggugagaggcagaaggcccagaucagugaaaugaccugucagggucagaccacauuuuuguggacacuagugaaggauucuuuauccuccuuccccacuguacauauuuacccccacuguaccuugcugccuugacaggaauguaucuuggugccuuuagccuccuguggguguugugugugugcuggggcuuugggggugugacacauacagugguguuaaugcaugcauaugcuuccuagaguuacuuuuuauggaagaagcaagagaaaguuucucaaaccugagggcugcuaaaucauggaggucauguuguauagcaaacacacugccaucccacuccuggaagcuucuggauuuacaaguguagggccucagugguaauaaugaaccuuuagacaaugugcuuucaaauccacccuauuuuguuuuuaucaaaugucagaaucucuguugcuauuuaugcuauagaaaaauggcugaagcagcaggaugugccaucagaggaucaacaagaccagugcccucauuauagcucugucacagucaccucuaggucuuuguuccugucuguuaaauaaggacauuagacaagaugaucucuaaaggcccuuccagcuuauaggaucaugaguauaacaucugauauguaacuggcuauaggaggccuuuuggaaagucccccaguuggagccugggaugcacuugacacagccugcauuggacuuccccucuuguggggaguacacaggaggcucugaauauauuuugaaccaguuguuuugaaauuuuuauuucucauucaggaaacagcuugcaguuucuuugucugaaauuaugcauacucuacaaacacauauguauauauguuucuaugcacauauauacacacaaauacauauauaaugcauauguaaugugaauuacauaucauauauucuuuauuaaaguauuaaggagaaauuuggacauaguuucccaaauaagguagucacuugggcucaauaucuuggccauuuaagcagcaugucugugcacacacauaaacauacagugguuuuuaugcaggcugugggcaaacccucugucaucugccacuauguucaaaugagcuuguuuuccauuagcucaguguucacaacaugugcacacugagacccauaucucaggcagagggcagucagggacaugggcgaaaacacagcauuguaauugauagggauaaaaggagaauggaaaauaagaaagaguggaagcuucaaccagccugagucauuuggugugucaugauuccaauuuuauugugaucaaaauauggucuaaaugagugauggcagucucccuuugggcauauccuaagaguaugcaaauugacuugcaguauuucuaagcauucuaaguaauagaaaacauuauguccuuacuuuaugaucacuaacgugucuuuaucaacagaaaacgguugugaagauaauugggaaaagaacgagcaguuuggaaguugcuaccaauuuaauacucagacggcucuuucuuggaaagaagcuuauguuucaugucagaaucaaggagcugauuuacugagcaucaacagugcugcugaauuaacuuaccuuaaagguagauuuuauuugcaugugauagagcaaauuggcuaaaauuguaaagguacuucuucuucuguuuucauauccagauguguuucuuuguauguaacuuuucugaccucucuugggauuuaaacuucuacacugaaacccauaagcaaaaaaguacugaauguaaucauauuucaccauugagaaauguaucuugugauggaaacuaaagagagauugauguucagaaaacaagguuggguagcaagauuaaacugcuacccuaauccuaaaugaaaggauuuucaaaaagcgaauaauuaaacucuuugaacauugaaaaauagagaauuaaaggaagggaaggaagaugguuaaguuacacuagauggccucaguaaacauccuuacauugagugaaaggguacaguccucaggggcaaggaguguuuuacuaaaucuuaaaguggauuuaauaacauggacacagaauggguaggacuuuguuuuguuuuguuugggggaugguagugguaauuuuuuaauuuuuaauuaugaaaacuuaauagauaagaauaaauaaaaacuuuaaaagaccauuuauccuaucauaagaauuuaaguaucaccuuguuaauuucaauaacaaacccuauuggaacuuugauuggaauuguauugaaucauagauucauuaaagaggaauuggccaggugcgguggcucacaccugcaaugccagcacuuuaaaagguaaaggcaggaggauuacuugaagccagggguuugaaaccagccugggcaaagugagaccacgucucuacaaaaaaaaaaauuuuuuuuuaauuggcuguuggcaugugccuguagucccagcugcucuggagacugagguagaaggauugcuugagccugggagauugaagcugcagagagcuaugauggcaucacugcacuccagccugagugauagaggaagaccuugucuuaaaaaauaaauaaauaaaagguauugcaguuucaauauugucuucucaaccaugaaaaugauaugcuuuucuauuuauuuaggacuucuuuuauguacucaguaaaauucuauaacucuuuccauagucuuguauaucuuucaaaagaaacuauauaaacaaauuuuaauauuauauuuaaaaaucaaggaaccuaaguuacugagucccugaugaguuauucuuugaaugaaagacaaauaauuguaauauaugauaaugaugaugugccagacagacuacuaaaugcuuuuuauacauuaucuccuuucaucccaucuaacuaccuuaugagguggacguuauuguuauccucauuuugcagaugaggaaugcgaggcucagagaggaaacauaacuuguccaaagucacccacaaguauuuagcagagccuaaauuugaagagucaguuugacuugaaaacaaauuguaucacacauauaaauggauucaccuuuuauaagacuguaaguucuuugcaggcagaaaugggucucauggguuguuuuucacuuuugcacaaagcuguaagcuuuauugcuauauauuaagcaaacauguauugucuaaguaauucagaugcauucugucacacuauuuuauaauaacuggaaauauuugauaaaugcuuacuguaagcaagcccuacuuucuccagauaaauccauuaaucauuacuacaaccucaucaaacaaauguuuuaucacuagauaaggaaauugauccuuagaaauaauauacccaacagcauacagcuaagaaguaucagauugggauuugaauaucaacauauagaauugcagaacucuauuuaugugaaagagggucucaauauguugcccaggcuagugugcaguggauauucacaggugugaucagagcacacuauagccucaacucuugggcucaagcgaucuucccaccucagucuuccaaguagcuaggacuacaggagcacaggaucaugcccagcuuuuuuguuauacuacguaccccucuuagauaucuuuaucucuuuuuaucauuaaaaggccacaggucuuuugucgcucuuuuuguuuacagcuuuauucagaccuccuuucuuacuuguagcuuuacccuuuuccuguauuguuuggcacuugaauauucagaucuuuagaaugaaaaucugccaaauaagccaaaugagcuaguguuuggcauuggaguucuauuccagaccucacugaagccucagaaaaaauauuguugcgaaugaaaagugccgauaaauucaaguuuccuagaauauugacauuuggaaaccgaugacuucagugaaggagaaaagugccaaagugugacaaucaaauguugcacgauucuuuaugcaucaguuuucuuuaauaacucaugaaaguaauguaauaugguaaaggaccuuauuguacccuacuccuggccggacaugccccguauuuaauacauaucauuaauuuuagaaguauaucuguuucuaauguuucaaguuccucuuccagugugaaagcuucuuaggcauaucaauacgccuaauuaugacuauugguuucccaagacccaagaaaacuguguuuuaaccucuaaaacucugcuuucuaucuuucuuucuuuuuucuuuuuuuuuuuuuuuuuuguuguuguugagacagaguccugcucugccaccuaggauggagugcaguggcacaauaucggcucacugcaaccucugucuccuggguucaagcaauucuucugccucagccuccugaguagcugggauuacaggcacacgccaccacaccuggcuaauuuuuguauuuuuaguagagacaggguuucaccguguuggccaggcuggucucaaacucuugacuucaggugauccacccgccuucuaucuuucuuaauugcugauagcaucuggucaucaaauaacaaauuugaaugaucuaucuccacuguaccacgugugugugugugugugugugugugugugugugugugugacucucacucucauucuguaucucuagucuaaacaggacccuuugggcccuagagccauaagccacauauauauauguuauauuauauauaauauauauauauauuccauugucuaugaaacagcuccuauacauauuucugacccagucccagaaaaacuugaucauauggggauccaugucugucuccuucuacuagauugaaauucucaugagggcaaggacuuugucauuucaguuuuuacaucccuagaaccuggcaaauaauaugugugccuaaugaauuuaaauugucagucuagaauacagucagaucuucugaaucuagaaguacaauggaaacugcuuuugauaagucuucuauauuaauaaaagaggauuaaaaauagauagugagacagcuacucuaagaagcuucuguccuuaccuuagaugaaagggaauuugacaagcuaauaggagagcagaacugaauuaacuuaucagccuuuggguuucucaauagucugaagauuuuugucuauuagcauugccuaccuuugaugcauaaacagcccucuacagggauugcugccuuacaaucaaggucugcagauuuguuuguuauuaguagaauaagucuaauuuagauaauaacuuaggcaacuuugucacuuuuuaaaaauuuuuuaauucuuacagaaaaagaaggcauugcuaagauuuucuggauugguuuaaaucagcuauacucugcuagaggcugggaauggucagaccacaaaccauuaaacuuucucaacugggauccagguaacugcucuuucccuacccccucugcacagaacaaaucuucaaaaaagcaaaagcuucucacucaccaauagcuuagaaaaguuucacaucuuggcagcucuuacuaugguuaccucucagaagaauuuuuucuuccuaaaccauucuuaauugugguacuguuauugccaagcugaaccacaccauggacaacugagcauuugaaccucuagaccuuuagaacaacccuacauuuuuauguaagagcaaaaugagcuccaccacauggcccaggagccauucuaugucccuaaaggacuuggcaugucuauaacucacccaugcuguguuucaucugcagcugaacucuaauauggaauuauccgcucguuuucaaacucuuggggucucuccccacuauagcacccaaguacugacaauauaaugguuguauuuuauaauacaaauaaauaccucaaagaaagucuuuuagggaauaaaacaagcaaaaugccacuuagccaaaaagcauucuucccaaaggaaggauuagacaacuuugaaaaauaaaaucuuaggcuuaugacaaauguagaaccuaaaguuaacacuaauuucaguauaaagcugccugcacacauaguaggaaaacugaguuaagagcaauaaaauucaaauuagccacuuuaguuaauuuaguuugcuaaauuuccuuaccagcaaaugaaguaauacuuuuauuauuucaguaaauagaauauuuaaagauaauuuaaucuuuaacucaaggccuuaauggcaugacaaugauaaauuaauauuuuuauuuuauggaguagcagauuaagagcuacuaagcauagaauauggccuggaagucauuugaggaaaaaguuugguuuuuguuuuuaaaauuaacuacaacauaucaugauguuuucccuuuagauucuauauuuuagaagaaagacauauuuaagcacauaauuauucauugaggcuuauacguuucaauuuaguuaaguuuuaacuauaauaugaguucccauaaaagcauaaaauuaggaauacaaauuauucuuucugacaccauccuggcccuaacuuucucauucuaaugcuuugaaaaauguucccuuuuaagacaggcccagugcaccuacuauagguggcuccagcugugcaagaauggaugcugagucuggucuguggcagagcuuuuccugugaagcucaacugcccuaugucugcaggaaaccauuaaauaauacaguggaguuaacagguaucuuucucacauacucauacaaauagacaaauaggucuuaaaaucauaguuuugugaaaacaaguaaaucuuuuccaacauccguuuccaccuuuccuucuccugauacugacaguacagaaaaguacuugauuuuuaacccugugguuagauauuaucaaccauauaugaauaaagcuuuauuugagguaaugaagaauauuaaauauaaauauguaugcgcccagaagaaggcagagauauucgagauaggaaauauacuucuguucguguguggcucuuuuuucuccagagcagugguucuccaggggugguccccagaccaacagcaucagcaucaccucuuccuguuagaaaugcaagcucucaggacccaccccagauuugcuacaucagaaacuacaggaugggguccagcaaucuguauuuuaagaaacuuuccaggugguucugaugcguauucaagucugagaaccacugcaguucaugccuccguaaugaggcaaaaccuauagacacaggaguaagcccaggcuucucuaccuugugccccacagcacccagcccucuucuauccuucucugucaggcaagucuuugcauugaaaaaucaaguaaaaaaggagaggugcagagggacaaaauguguacaauaaggggguuuuuccaggguguuuggggaugaaagugacacaagaacagcugaaguuuuugaggaguggaagggugugaggaguuuuugaaagaauggagaagaggaguguauugacugucaagcacagggccugauguauaccugguauuuaauuacauccucaccaaaugagagaaacuaauacucaaagcuggagggauguauucauccguuuucaugcuacugauaaagacauacccaagacugggaagaaaaagagguuuaauggaccuuacaaucucacguggcuggggaggucucacaaucauggccgaaggcaaggaggagcaagucacaucuuacaugaaugguggcaggcaaagaaagagagcuugugaaggaaaacuccgccuuauaaaaccgccagaucucaugagacuuauucgcuaucacgagaacagcagggagagaccugcccccaugauucaauuaccuuucaccaggucccucccauaacacaugggaauuuaaggugagauuugggugaggacacagccaaaccauaucaaggggaaaggaugauuuuuaaauguccugcuuuaaggaacugugagugaagggaauaaagcauucaaaugucuugucaucuaaaaaggaguauagagcaauuuuuaaggaaaaacuagauauaaaauaaagaaucugaggggauauuuuaagauaauaggggaaaugaacauuugucuuccaaguugauucaaaccaaauuuaguccauacaacaaaaggcauaauagaaaagccagcacaaaugaaaauaaacuagagcaauugaugauagauuaaguaaauaccuugcaguagcaauuauuaaauaaaucaugauguuuccacaugauugaauaauaugcauuuacuaaaauaacugugccagcaggaaaauacaaagaacaaaaccaaaugauaugccuacuuaucauuuuaaucuuguaaaaauauguauucauugagacaaagacuagaauaugaaaaugauugcauuaaguuccauuaugggugauauuuuuccucuguuccuuuaucauaauuauaaaauauaacaauaauacaugcuauuucagaauauuaaaguuaauugaguuaucucgcaaguguaagaggcuagcugaaucugaaucacuuuauccuuuaguaaaaaaaacaaacuguccacauuuuuuuuucuuuuuuuuuuuaauuauacuuuaaguuuuaggguacaugugcacauugugcagguuaguuacauauguauacgugugccaugcuggugcgcugcacccacuaacucgucaucuagcauuagguauaucucccaaugcuaucccuccccccucccccuccccccaccccacaacaguccccagagaugcuguguuuucuuacaacaaauauuccaaaugguucuaaaucagugaagucugaguaaccaacucacuuucugguuuuguuaacggggauagaaguauucugugggguuucauacuucauucuuuuuuucuaaucuggaaagauuagaccuucgauugugagcuuucucauggucaaaacagaaucacuaauuccaugaggaccaucugucuagcagaggggaggaaagaaguccagggguaaccuuugcccucucaucucuuggaugcgaaguguauaaaugucuuauucugucccuuaaaucucugccuguccuuuguucaacggugagcguuaaucuacauccccuugcuaagcuggccauacaagaaaaggaggcuugcccucuuauaaucuucucaaggacagagacuggagggaaaccuaacaaauuccauauccaggaaaaaauuugucagaaaaugacuuaaggcacaucuuucuacugucuacuuggacuaagggcaaucucccuugacuguguccaagcccuuaauagucugugcucagccauauagcacauugaagcauguuaaagucacaucauuuucugaaucccagcgggaauuccuaugaugcuauauauaccucauuuaugugguaggcaccacaugaauucaugucaccguagcaucugacaucacguccccaguuuuccaggacucucauuauucaagaaaaaagaauuugcaauguuauugauucacaauagauguaucuuuacuggaauauaaauagcugcuuuucccccagaugucuggacauacucagauacccgcugugaugcaggcuggcugccaaauaauggauuuugcuaucugcugguaaaugaaaguaauuccugggauaaggcacaugcgaaaugcaaagccuucaguagugaccuaaucagcauucauucucuagcagauguggaggugguugucacaaaacuccauaaugaggguaaguuuuuaaaaauacccuauuugagaggcuuaagccauuuuaaaguaucccugguuuuagacucuuugugggaaugaaaagcuuacaguuugaucccacagaucagcccugucagauaggauugucucuggugauggaacuguucuacaauuggucuaguaugguggucacuagcaacaugcagcuucugagcaguuggcauguagccagggcaacugaggaacugaauuauuacuuuuauuucaucuuaauuaauuuaaguggccgcaugugccuaguggcaaccaauuugacaguacugccauugauugauuucccucuucucaugagcuaaauucuauuuaaguugcucaaaaaacuuaagugauaauuacuucacuuuuguaauuauuugaaagcuaaagacugguaaaggaaaauauacuagacggacaguauuaugaucucuuccuagaauagaacucuuagcuagaauagcuaagaguagguaccuacucagugccagccuggugcuccuuguuucacuugugaaggcagcagagucauaccagggcagcaguggacaguauuucuauucaaauugggauauguaugauuguauuuauagaauuucauucaccccacaaagcaaaguuuaucuacaccagauaucaggaacacccagccugcagauguucuaccuguguacuuuacuugcauaaguuacuugaaaagccuucauuacccaaccugccugucguaucaacauauuaauaaccgaauuaagaauacuacaaaggcucuuaaaacuccauaucagaauauaaaaauuuguauaacaauguacauauuacaguauuuaauugagcaaaaccaaacaaauaauacauuuuucuuuuagauaucaaagaagaaguguggauaggccuuaagaacauaaacauaccaacuuuauuucaguggucagaugguacugaaguuacucuaacauauugggaugagaaugagccaaauguucccuacaauaagacgcccaacuguguuuccuacuuaggagagguacgaaaccuccugugguuucuuuauauucuuccuguuuuaccuaaugauaauauuaagacuucuuugguugggaaguuugcguauaagcuggaaaauaaaagguaagagcacucuggaucaggguacagagccacggaccauuaccuguuaagaauugggccgcacagcaggaggugagcggcggguaagcaagcauuacugccugaacuccgccuccugucagauuggcagcagcauuagauucuccuaggagggugaacccuauuaugaacugcacaugcaagggaucuagguugcacuuccuuguggaacaguuucaucccaaaacuauccucuuccccacccucuguggaaaaaauugucuuccacaaaacuggucccuggugucaaagguuggcaacaaauaaucuaaagucuagacugucuuucugguagcuacuuuaaaaagguaaauaaaagcaauuacuaaauaagcaacccauauccuaucugagagcaucuuuucuggucucaaacagauacagagaaucccuuuagaacucacauucuugugcugacugauucuagcaaccugcuuucucucaggaccagggccugcacccaccuuucugccaucagugugauauucggcagauagccacaauuuaaccugaaaaaucccaucuuccaaauucauguucagauuguuuuauaucgauacuacuuugagaaguaaaaaaaugguuuuauuuaaaaacuaggccuaacauuuuucagaaaccaccuuacuccuauagaaugcuuaaacauuuuuugaacaucuuuuacuuaauaauccaaaauaggcugugucuugagcagaaaagauauauguaccucuacguuuuguuuguaucacuuuccuguggaccccuaauugguuaugaaagugacugugucacucagacaucuaaagagacuuaaguggaagcaauaaauauuauguguauuuaaaagaaguuuagaaaggugucacauuugaugcucuauuuaaaaggacauccaacaugucuuuagaagaacaucagaaauggaaaaguguucccaugggcaagagugaauugauggcauaccuagacagcauuccaauguucaaaacugacccuuaucacaaucgacuuauuagaauuuaauucaaacaaagcaaagugacguagucaauuaagcaaauuaauguuaaguagcauauaugaaagagagaauuuugaaguccagauugaaguagaguugaaagaaacuuuugaccuagaauucauggagaauagcuauuuuagccaccaucaucauuuuacacgugaggaaaccgagaaagggagguugaugauguaccuaaaaguuucaaacuuuggcuaugccauucuagucuagaagacuagaaugcuggaacugugggcugaguucuucucucuucaacuuuuauacuaagugugcuuugaugguuuuauugcuacucuuauaagaaaaugaaauuuauccacacugugaccuggaggugaugcugagguaacuggcugugagccaucacuuugcaggccuguugaguagcauuuucuaggaguguguucucacauuugauaauucacuuauauucauuucucucucucugucucugucauaguuuuugugaguucaguucugaauaugcgguaaauaauuuccuuuccaagcaaauguuuuugucuccuuucaaagcuaggucaguggaaaguccaaucaugugaggagaaacuaaaauauguaugcaagagaaagggagaaaaacugaaugacgcaaguucugauaagauguguccuccagaugagguagguaaaaucccuauguaaauuuucucaagcaguauuacaacuucuugguuagaaaugguagcugagacuuaaauaacucagacuuauaaaauagaggaaacuacuagcuucuguucauuuaaguuagaacaagccagaaggcagugagucauagcauauuggccuucuuacagaagcagaaacuugaaaauuucuauaaauauuuguagaauuacuauccucaaggcugaugucuuuacuucccccacuaauaucaauauucaaaaauaauucauccagugaauauuauacucuuaugaugagccagccacccauaugagaaguaacccauacuuuuugucugacacaggcccacagucuuguggagguuaucugugaaauugcaucccacccucaucacauguaugauuucaauagccauguccucaauuuccacaaguucuaagacguuaucaauguagcagaaacaugcuugccagacgggacaccaucaagucuggaaaagaguuugacaauauuuuuccucugacuuagggcuggaagagacauggagaaaccuguuacaagauuuaugaggaugaggucccuuuuggaacaaacugcaaucugacuaucacuagcaggugugaccaucaguaaacuuguacucauaaacuuucaacucugaauucuuuugccaaacagucuuccuaaguaaaaggugcaucuucaaauagagucaaucauugugaaacacuugccaauuugauucuccuuuuguagauuugagcaagaauaccuaaaugauuugaugaaaaaguaugauaaaucucuaagaaaauacuucuggacuggccugagagauguagauucuuguggagaguauaacugggcaacuguugguggaagaaggcgggcuguaaccuuuuccaacuggaauuuucuugagccaggugagugucuuaaucuuugaaguaguaguauacugugacuagugaaaggcagcacuccucccaaagauguuccucacuuacuuuugaaaugugagggacaugaugaucuucaggauuggagucuaucuauggaaccauaaauagaagcaguggcuaugucuucccuauuauguccuugggaauaauccaaugaaagaaauucaaaaacuuaguucucccaaaccaccaucuaauggcucagagcuagaagcaccagugugaguuuuuaaaaucuuuuccauguaaaucucaaauagaaucuagaagcucccgugugaggcucuuuacauuuucaucucucugcuucuuaaccuauuuucaaaacugaauguguuuucuuccauuauucucaauggguaagaauuauggaggcuaucuuguauuauuuauuuuguuuuuguuuuuguuuuuguuuugagauggggucucacucuguugcccaggcuggaaugcaguggugugaucucggcucacugcaaccucugccucccagguucaagugauucuucugccucagccucccaaguagcugggauuacaggugcaugccaacaugcccagcuacuuuuuguauuucuguagagaugggguuuuaacauguuggccaggcuggucucgaucuccugaccccaaguaauccaucugccucagccucccaaagugcugggauuacaggugugagccacugugccuggcuucuuauuuauuuugaaaguuauuuccucuuucuccaaccagccuaaagcauugaccauaauuugccauagaaucagaacacuuaagccggaaaggaccucagaaauacuuuuagaguuaagaaaacagagacuuuaaaaggugauuuacuugacaaagaucaucugguuauugaauuaaugaaauccagaguuccugauuuuuaagccaguggcuuugaauaagacagcaguauaaagcauucuacuuuucacccugugaauuauuuauauuuuauuguguuggucuaaugugaucaugaagacuauuuuuuauaacacagagauuggaaaauaugagcuuacaauugaacauguuauuugaaauagaaaaugcccacaaaaguuaggacacauggucaucaccaucaacaugagugauguugcuaguaacaaagucauccuuuuaugucugaaaaagauagaguauacagauguugauccugguuaaaucucagauuaagaacacucuaauggauaaagcacauagauuucuuuuuuucuuuuucuuuuuucuuuuuuuuuuuuuuuuuuuuuuuuugagauggaguuucgcuccucuugcccaggcuggagugcaauggcucgaucucggcucacuguaaccucugccucccguguacaaacaauucuccugccucagccucccaaguagcugggauuacaggcaccugccaccaugcccagcuaauuuuuuuuguauuuuuaguagagacggaguuucaccauuuuggccaggcuggucucgaacuccugaccucaggugaucuacccaccucagccuccgaaagugcugggauuacaggcgugagccaccgugccuggccagauuuguuuuauagacacuaagaguaaaggugacguucuugauaacuaagucuuggugguuggagaggugcuugggaaguagcuaccaugacuacuuccuccauucuaugaccagaaaggcuaugugaagcucucuuuaccauuauugcacccauccucagccaacuuggucuaucaugggcacaccguggauagaaggacugaacagggaaaaauagcacacccauucaggguagcaaggcaauuauuuuucccaguuucuuauuccucuugcuguuuguguauaugagacuauguggcuucucuguuuggugggauagaaguuguccuauuacuuuucaguauauguaacucuucuugucuuuuaccugcuucaggcagugugauguaauggaaaauggaacaugauguuuugucagacaaaucugguuucaaccccaacucuaccauucacuaacucugacugugggcaaguuacuuagucuucauuuacaaaauggaacugauaauucaaacuaccuuuuaauacuguuaugaauacauaaaauuaugacugucauaaaauuaacgguaaacaaauguauguuaccacauaccuccuucuaccuuuauuguaccagcuuuuccuuuggaucagaaucugggagaguuguguuuugagguuaacuaaguuucuuaaaaacugcucaaaguuuuuaagcuaauuugaaccacuauccuaagcagcaguaguauuuaggguacagcucuagaaacagaccaccugggcacaaauccuggggcaaccacuuacuaauucuaugaccuugaacaagucacuucauucucacuguaccucaaauuaugacaauagaauccccccauagguuuguuaugaggauuaaucuuuuucaaaaaguacuuuacaaauaauaaacaccugucauuauuauucugaacaacauauuucuuuccucucuuuguuccauuuuuuuuuuauucucucuccccaacuuggcugaaguaaagaguagaaacacuagaaaauguuugaacuuuaacguuuuaauuuuuaauugagcuuuccacuucaaucccagcuuccccgggcggcugcguggcuaugucuacuggaaagucuguuggaaagugggaggugaaggacugcagaagcuucaaagcacuuucaauuugcaagaaaaugaguggaccccuugggccugaagaagcauccccuaagccugaugaccccuguccugaaggcuggcagaguuuccccgcaagucuuucuuguuauaagguaaagugacauucucauucuauccuucaaugaaguuauuuuuccacuacccuuguucauguccuuguacaaauuaugcucuucuccauaguacuauguaaccuaacuaaagugcucuggagcacagaguccuuggcagggcaucgcugaaccucuggugugaggugccucagccccacacccugcacguguccuaccugaaagggcaggcccaaagccagaaguggcuccaccccaaggucuuuuuuucccaguaaguugguguacuauaugccauacugccacuaugccuaugauccucauauuccucuaauucuuguugucaaauuaacagcuccagcacuccuaauaauguaaaaaaaguguauauauauuuacacuuuuacaaacauauauauauuuguguguauauauacaaauauauauauuuauauauacaauauauauauuuauaaacauauuuacaauauauauauuauaaauauauuuauaaauauauuuacaauauauauauuuauaaauauauuuauaaaauauauauguuuauauauuuacaaaauauauauguauauauauuuacaaaauauauauauauuuacauauauuuacaaaauauauauauuuacauaaauuuacaaaauauauauauuuacauauauuuacaaaauauauauauuuacauauauuuacaaaauauauauauuuacauauauuuacaaaauauauauauuuacauauauuuacaaaauauauauauuuacauauauuuacaaaauauauauauauuuacaaaauauauauauuuacauauauuuacuauauauauauuuacaaaauauauauauuuauauauauuuacaaaauauguacauauuuauauagauuuacaaaauauguacauauuuauauagauuuacaaaauauguacauauuuauauagauuuacaaaauauguacauauuuauauagauuuacaaaauauguauauauuuauauagauuuacaaaauauguauauauuuauauagauuuacaaaauauguauauauuuauauagauuuacaaaauauguauauauuuauauagauuuacaaaauauguauauauuuauauagauuuacaaaacauauauauauuuauauauuuacaaaacauauauuuacaauauauuuauauauauuuacaauauauauauuuacaauauauauauuuacaauauauuuauauauauuuacuauauauauuuacaauauauuuauauauauuuacaauauauauacguuuauauauauuuacaaaauauauauacguuuauauauuuacaaaauauauauacguuuauauauuuacaaaauauauacguuuauauauuuuuacaaaauauauacguuuauauguauuuuuacaaaauauauacguuuauauguauuuuuacaaaauauauacguuuauauguauuuuuacaaaauauauacguuuauauguauuuuuacaaaauauauacguuuauauguauuuuuacaaaauauauacguuuauauguauuuuuacaaaauauauacguuuauauguauuuuuacaaaauauauacguuuauauguauuuuuacaaaauauauacguuuauauguauuuuuacuauauguauauauuuauguauauuuuuacaaaauguauauauuuauguauauuuuuacaaaauguauauauuuauguguauuuuuauuauauguauauauauuuauauauauauuuggucugcaucagucagcuaguuccauaaacaaaccacuagaugccaucccaaaauucgguggcuaugacaacaaacauuuagccucacauucucacagaucuucaggccagcuagaguuugacugaucuaguuugggcuugaauggugaccucugcucccaacuucaggucagcugugcugggcuccagcccuuccuucuagagcucaggcuaaaagggcaacagcucacagggguuuguuguucucaugguauaucacuggagcccaagaaggcaagccaaccauauaagcacauuucaggccucugcucaguuuaccuucacuaauaucccaucaacacaguaagucauauggccaagccccaugccaagguacaaagacguauacuccgcccaccagggggcuguggcaagaccaucuaauuauauuacaaggaacugaagaauugggacaaauauaauucauccugucauugugucaucaucucuucuuccuccucugccuccuccuccuccucuuuuucuucuuucuucuuucuucuuucuucuucuuucuuuuucuccuuucuucuucuuuugaaacagcccaaguuccagguuuacuuuugccacuuucugucaauauucacacaccagugcagacugcucuuugguuguuccucgucagaaaauagugcuauuuuugugugggucacugugucuuauauucgaaauuucuauuguuagcacauuucuuugccaaaggcuacucccaaagcauuuauauguauccuuuacagccuugccuccugguucauuuuaucuuucaagguccuaggaauacaggagaacguggaucuuguuggaauaguuccccagccuggcugaggaaggccauccaucugaccacaaggacuggcaucugugcuggccuuuaguugaauugacacuuucagcaggaccugucugugucucaguauaugugcauuuaccuaugccuucacuacaccuuuaagaauucauuucaggggcccacacaugugacaguaauugacuuuagcacuaugaaauacuuuaugauaauaccauaaaacaaauuaauauuauauuuugcuaagguauuccaugcagaaagaauuguaagaaagaggaacugggaagaagcugaacgauucugccaagcccuuggagcacaccuuucuagcuucagccauguggaugaaauaaaggaauuucuucacuuuuuaacggaccaguucagguaauacuuuaagaaugagaauuucuaugcugaauuugauguccucuagauauucaaaauugacauguucuuacccucacucucuguuggaaaaaaaauggacauguuuuauuaucuaaaaggucauuuggugcuuagcagucauggaacauuaagcacucuuaaugugcagacacuaugaggaaucuaaaaaugaaugagauguauucccuacccuuuguuuaauaaaguccaacagcaauguauggcagaaaaucuagaauauaggcaaggaagggccuugggaauucagaggagggagggaguguuucugggaguauaaucaggaaaaaugucauaaagaaggcugauucuuggaagguagguauuauuucaaaaggcaagauaggagaaggagaaggagccagaaaaaaaacagaacauaagcaaaggaacuaagaccagaauauacagauauggucaaggagaaaugagucauacaaauuagcuagaaaauggaauuuggauaugaaauuggaauguccuuguuugcaagggaaggaguuugaucuuaaguaauuaaacacaaccaaacaaaaaacaaaaacaaggugcguguguguguauuuauaucuacacacacucacauauaccugcauauauacauauauacacagagaggaagggguuggccaggcuggucucgaacuucugaccucaggugaucugcccaccucagccucccaaaguacugggauuacaggcauuagccaccacacccagcccauuaucaguuuugauuaagugugagucugcaaauuuguucaauaauaauaaaguccaauucugcacuuuugaaagagacuuaaaacaaagcuugccaauuaguacuuauccagcucuaagacuauaauguucuuuuccugggaggaaggggccacaaaauacuacaaaauugugaaauucuaauaaaaauccuuaaaaauuuaaaaauuuuuuaaauuuuuuaauuuuaaaaauuaaagcaacuagcaacauuuucauugugcaacagauaaaaguuagugcugaguagcugguggccuccugaaauggggccugacucuccaauuugccaggucucuaauuuauuacuucuugaccccacuucacuugcuuauguuaugugcuugucuuauauuuacucaaauagcaauugaguuaauaaucacaagucaugugaucaucuuaauagguacugaaaaugcauuggguaaaauccacuauucauuccugguuuaauacauaaauauacacuuauauuuaguaaauauaacuaauauguaaauucuuauuugaauagaagaauagcucaaauuaauagccauaucacacuuaaugaugaagcauuguuaagugcauuucccugaaagucagaaaaagguaaguaucccuauaucaucacuauuguuaaucuugguuugaaauucaacuccugcacauuaagauaaaaacaauacuauaauguguaaauguuuauauauauuaagcagaggaaaagacagauuaucaaagaguaaaaaauauacuauuuacauuuaaaacuagacugcaaaaaggguaauggcuauuauaucucuaggaaguaagauuuugagugauuuuuaaagucuuuucuaugggcugggugugguggcuuaugccuguaaucccagcacuuugggggccugaggugagaggauugcuugaaaccaggaguucgagaccagccuggguagcauagggagacccuaucucuauuuaaaaaaaaaaaaaaaagaauuagcugggcaugguggcacacaccuguaguccugguuacucaggaggcugagucaggaggaucacuugagcccaggaguucaaggauacagugagacaagauagugccacugcacuccagcuugggcaacagagugagaugcugucuguaaaaaauaaaugaauagaauguuuucuuugaaaauuucuauauuuuccagauuugcuuuuuguuuuguuuuuugagacagucuuguuuugucacucaggcugagguacaguggcaugauuacagcucacugcagccucaaccucccagacucagguaauccccccacuucagccucccaaguagcugggacuacaaucacaugccaccacacccagcuaauguuuguauuuuuuuguagaaacggguuuuuccauguugcccaggcuaaucucagauuccuggcucaagcgauucaccuuccuuggccucccaaggugcugggaucacagaugugagccacagugccuggcccagauuugcucuaauauagcuucugcuguguuuuucucauuagagaauguaguuucacuacaguguacugggaaucuaaugcaaaauaugauaccuguguuccauaaauauuuauuuauuaagcaucuaucguagaaucucagguauucuagacaucauuguccaguguuagaaauuaauauacaaaauuucacugcagacugacccaaggcaauuuguauauacuaaauacuaacucuuggguucuuugugaggugaguguuagcuauucccucaaccuugagaauagauuauaacaaaugcaaaauucagaccaaaauuuuccacacauacagacauuugcuaugcaaacauucauugaagcagacacaaaacauuuuauacaacguguuuuguaagcuugacaacauuccagcaaucuguccuuuuugguguuuuaacuaucaccuugcacagauuuacuugaagcagauguggcaguguucuguggcagcauucuguucccauuguagugaguaucaggccaucacaaucaccugacccaaugacuggaugugggguuguuucgaaucaagcccuacuaagauacaggcugcggccucgcaagauucuaauacacucuugagaagugugagaguuucucuaaauauuuuagcuaaucccugcaucucaaauaacuuauauuucaccagugagagcccaauccuaccaucaugcugaugaacaagcuuccgauuucacugacauuaacccaguucucacauucauucugcucaugaccaaagccuccagugugacuuuggugaucauggaaguccucaugguggccaccucuggaccauggccuuucuuuuucuuuuuuuuuuuuauuauuauacuuuaaguucuaggguacaugugcacaacaugcugguuuguuacguauguauacaugugccauguugguuugcugcacccauuagcucgucauuuacauuagguauuucuccuaaugcuaucccucccccaucacucugccccacaacaggucccggugugugauguuccccgcccuguguccaaguguucucauuguucaauucccaccugugagugagaacaugcgguguuugguuuucuguccuugcgauaguuugcucagaaugaugguuuccagcuucauccgugucccuacaaaggacaugaacucauccuuuuuuauggcugcauaguauuccaugguguauauguguggggcauggccuuucaaauacaccaccaauacuuccugacauguaaguuucaagcagggcaacuuaauggcccuuagauuucaagcuugacacacacaauaucauauuauccagauaaaguauuuuuaaguaaaaugcugacauaagcucuagauuccaagcaagagguuaguaacucuaacuggaacgaggagccauggauaaguacuaaugaaugagguuguagauauuugugagaaacaauaaguagaaaacauuggaauaucauaugugauagaaaugaccauuaagagcauccauauacagaacgaauuacacuaggaaacaaaacaugaaaggaaauuuuuaugauuuguuucuuuguuuugaaucacacuuguugagcacucccuucuuuaaaaaauuaauacaaguucauuauauaaaauuuggaaaauauaaaaaugaguaaugaagcaaacaaucaccucaaauccuagcuccugauuauaaacauaguaaacccuuaguguaaacccuuucuguuuacuuacaucucuacacauuuagcuuuuacaaaaccuauuuuccauagaauguacuauguuuaauuuuuuucuaaucauaaaaguaaugcacauugaauuuagaaaacagaacagcacagagaaaaaacaaaucuccuuaaucccuucacuuauaggaacuguauuuuauuuguacucugauccuagcaguuaacacaaugccaugguaagcagacugcuuuguuugcuuaauaacuucuccauaauaaagaaauuguuugccugugcugugcuuagagaacauauucuaaaaccaaaauuguaaccauggcuuaaaggaaagaaggaagcaaacccauuuauauuagaaaaugauucuaaagcauacuccuugaaugccuuggcuuuuuauugcaggaauugaccuuucucagcaagauauccauugcccaaauuguguauugcaugccaaggaguuaagucagauuacugcuguaccucucacaaucuaaguuccacaucucuauuuguauuucagugaaaaggauucauggugcaccaaaucauuaaggcucugagaucuuugcaacucuuaauggcagcccaacagggacagccacuguagggcaaaaauagccauaggauuagagaagaaagccuuguuugcaaugccauugcugcuguguacacuacccccugugauguggcaagaauggauuuagacauaaaucuaaggcuuuguagaauaagcacccucaucaaauaguauuuauuggggcuuauggcugagauacuguuuuccuuagcaaccaaaugcagcaggaaauuugauugagaauaggaauuuuaacacaauuacacauauuaaccuuuuacgcuaucucuucuuaacccaauaguuuuaaaaccauauacuuagugcuuggaguaccaggaacuuauaaagagagagagggaaucucaguuugacuugauuccccaguuaugaucaggugcaauuuuuuccuucacauuuucuaaaaucaacauuggaagugugcaaugaucaaugugauauccaauuucuucuucccuuuaucugccuacagcuaaacuaggccaaaccaggaaugaguuacaauugaggaaauauuuuccacuucugaucccgcacaaaaaaaauacauacaugucgcuauuauuuucuguauuuaugacaugcuagugaguucuuuaaaaugaagcugaaaucuguaaauuucuguguucaaaugaaacuuuuuucaaucuguaaauuucuguguucaaaugaaacauuucugaaauacaguuucagaaaguaguggagauuagaaauuuuggacaaucgagcaaacucuuuucuguaggaagcuguccucugaggugcagcaaaggagccagaaaugggcuugaaagcagagauguuucuaaguggaaggaaggggagcuauuagcugagagaagacuggguaagggcuugaggagccuagaaaguugaggaugaaccucuaaaaaggcuaccagugggagccucuacaaugcaggugacaaaugaucuuugaucgucuuccugguuguauuguggauuguguaaagaagauaaaauagcuaaugcuuacuuuagggaaacacaaaauucuacacgaauuccccaggcccaaauauauaaugugcaaagauuugggagaaaugcaguuauuuccccaaguaaauaugaggaagaaaacuuaacugccucucuauuuuagccgucuggcuuuaauugugcuguguaugccaauugucuagacccugugguuuagaaauccagcacucgggcaguaugauacacucggaagccuguaagagagcuccgaugagcugaaggcauaaacugcaaauuccucuuguagcuacuaaauuuaaacuggauuuaauugucuccacuggauauaucuuagguccacaaauugguggaucugucucuaugaaagaaaacaagauaacaauaaaaaccaaaacaggacaguccucauucauauuccauugcauuaaguccaaaagccuugagguugaaaagaugaaaaaguacuuauuguuguuaaaauaugagggaauguugaacaaagguaagaaauaaagaaaagcaauuauuuauuaaaaaauaagaaaucaguuuaaaauucuuuguuucagccuuugauucacuaguacauuuuauuaaaaugcacuuauauuucucuguagacuuguagcuauauguuccauauauucugcugaacuugagaguaugcauuguuuuuagauuuggaaucuaccccuucucuaaaauguaucuguauuacacuuacaggcauauuacauuuauauauauguauacacacauauguacugaucauacauaccauguaccaacaaaagguuaaauuauguggaauauuauuggucgccuaaaaguguaauaaauuuuagaaaacauuuucaaauggaguuagaggcagagaaaauuuucugugcuuauauuacaucuacuuaugcuggauauuuaucccuggccagagcauaaauguauuugaggggaaaggauuacuuagacauauguuccugccuccauauugcuuguguagauagucuuccuuggaaggccuacccuucuuccucuuggccaaucugaauacuggcauucagaucaugacuagaaagaaauguuagccaucccuugaagaauaucuuuuguccuaccaaccucacaaagucuuucuucauuuucugcaguccgcagugaccucuccuuucucugaacuuuugugucaccuaaaauguauauaacucauuugauagcuuucauaaauggucuuuacuuuuuuguucauauauaucuuaucucucuauuucauauuacauuucaggguagauguaggucuuauacuucucugugucaucauugcaccuagcucaaugccuuuuacauaaaaguauaauacuuauaggugauaaguauaaucacuuaaauuauugcuuaauuuauuuuucugguauauuucuuuggcacauaggcaauacucaaaugcuuguuuaaacuuaguggauaguaggaacucaacuauguuucaaauauuguuuaacaaaaauuuagccaaauaguucugcauuuuaaagaagaauauuugauaguguuauagacaaacacuuuaaagaaaugccauuguugccuuugacuguaucugaaaguauuguuuaauauucaagcacuacaguaaaagucuuggaauaauuuccauuuuuuuccucuuaaaauucaaaguagaaugguuuuugccuuucauaugaagaaaacagcuuaauauguaguuuuaaaaguaugguacuuuuucuguaacuaccccacauuaagggcuuaguuucauuucaaaagacuucuuuauguugcuugaaacugugcuuuucaauuagugaugcacauuagacaugugagugcuaaauauuuuugccaagcauuguccuguauuuuuaacacuugcuuuuuacauaguggccagcauuggcuguggauugguuugaauaaaaggagcccagauuuacaaggauccuggcaauggagugaucguacaccaguaaguuaaaacguuauuguuuuagguaguauggaaacacuguuuguuucaauaacaaguugauuguuaaauaauacauugacaccuaaaauuuauauggaaccacaaaagacccugaauagccaaagaaaucuugagcaaaaagaauaaagcuggaggccaucacacuaccugagcuugaagauacaccucaaagcuauaguaaccaaaacagcaugguacuggcauaaaaacagacacuuagaccaacggaacagaauagagaggccaaaaauacauccauauauuuauagccaacugguuuucaacaaagauaccaagagcacacaaugagaaaaggacagucucuucuauaaaugauaguaggaaaacuggauuuccacaugcagaaaaaugagauuaaacccuuaucucauaccauauacaaaaaucaacuccaaaugaauuaaagcccuaaaugguaggccccaaacuaugaaacuacuaggagaaaacacagggggaaagcuccaugacauuggucuggacaaggauuuuuuuggauacgaacucaaaaacacagacaacaaaaaccaaaauagacaaaugggauuacaucagacuaaaaagcuucugcacaauaaaggaaacaaucaacagagugaagagacaacccacagaauaagagaaaauauuugcaaauuaucaucugauuaaagguuaauauccaaaauacagucguacaucacuuaacaaugggauacauuuugagaaaugcauuguuaguuaggcaguguuuuugugcaaacaucauagaacauacuuaaacaaaucuagaugguacagccuacuucacacauaggcuacacaucuaggcuuuauauugcuccuaggcuacaaaccuguugaacauguuacuguacugacuacuauagggauuuguaacacaaugauaacauagaaaagguacaguaaagauauaaucucgugggaacacaucuucaagggauggcuaacauuucuuucuagccaugaucugaaugccaguauucacacuggccaagaggaggaaggauaggccuuccaaggaagacuaucuacacaagcauauggaggcaggaacauacauguaggccaucugugguugacugaaaggccauuaugcaaugcaugacuguagauaaggaacucaaacaacucaauagcaagaaaacaaucugauuuuaaaauggccaaaugacugaauagacauuucucaaaagaagacauacagauggccaacagucauaggaaaaaaugcucaacaucacuaaucaucagggaaaugcacauuaaaaccauaguaaguuaucaccucccaccucucagaaugauuauuauaaaaaagacaaaagauacauguugguaaggauguggagaagagggagcuuuugcacacuguuggugggaauguaaauuaguacaaccauuauugaaaacacuaugaaggucccucaaaaaauuaaaaauagaacuaaccacaugaacagcaaucccacuacugggcauauauucagaggaagugaaaugagaauguuuaagauacucggagggugacugcagcacuauucaugguagccaagauaggaaaucaaccuaaguguccaucaacagaugaauggaugaagcaaguaugguacauguacacaauggaguacuacucagccauaaaagggaaggaaauccugccguuugugacaacaugggugacccuggaggacauuauguuaaaugaaagaagccaggcacagaaagacaaaugccacgugauaucacugagauguggaauuuaaaaaaaaaaaaaaaggaucucauagagcuaaagaauagaauggugguuuccaagagcuggggcagaugaggugggggacuggggagauguuggucaaaggauacaaaauuucauuuagauaggaagaauaaguucaagagaucuauuguacaacaaguugguuauaguuaauauuuuauauucuugaaaaaugcuaaaaguagauguuaaguguucucaccacagaaauaacugugugagauaaugcauuuguuaauuagcuaaauuuagucaguccacaauguauauauacuucaaaacaucauguuguauaugauaaaugcauauacuuuuaucugccaauuuaaaaaauaaaauaaauacauucacguaucauacaaccauuaaaauuaugugucuuuauugaaaugaaaauagagucucauauaggcaguaaggaaaagacaaguuacaagucuucuuuuuauuuuuaaaaacccauauguauagucucucuauauauagucaaaaaauuguaaagcuauaaauauaguagucaucuuuggguaguaugagugauuuuuuucuuuuugaaauggggucuuacucugccacccagggugaagugcagugcugcgaucucaacucacuacaaccuucaccucccaggcucaagcgaucuucccaccuagccuccccaguagcugagaccacagaugcaugccaucacgcccggcuaauuuuuuuuuuuuuuuuuugagacguagucucacucugucgcccaggcuagagugcagucgugcaaucucugcucacugcaagcuccgccucccggguucacaccauucuccugccucagccuccugaguggcugggacuucaggcaugugccaccacgcccaacuaauuuuuuaguagagaugggguuucaccauauuggccagggugaucucuaacuccugacccugugauccacccgccucagccucccaaagugcugggauuacaggugugagcuaccgugcccuuccacgcccagcuaauucuuauauuuuuuuguagagauaggguuucaccauguugcccaggcuggucucaaacuccugagcucaggcagucuacccaucuuagccucccaaaguguuggaauuacaggugugagccacaucuggccacaagugauuguuuucaaagcuuucucuuuauacuguuuauuuucauuuuuauaguaagaagcuuuucuuuuuauuaucuaaauauggaagaguuauacaaaaaauaaaauaucuuuuucuggggggacuagguggggaugacagagucucacugugucacccaggcuagaauacaguggugccaguaugacucacugcagccucaaccuccuggguucaauugauccucaugucucagccucucaaguacaggcacaugccaccacauccagcuaauuuuuguauuuuuuguagagaugggguuucaccauguugcccaggcuggucucgaauuccugggcucaagccaucugccaaccuuggccucccaaagugcugggauuaccagcaugagucacugugccuggccaaaaguauccuuauuggaggaaauuauuuguuuggagaaaccucuagaaaauccuugcuauuauuccacauuuauauuauaaggauauauuaguguaauaguuauaggagcaaaauuauucucagauauucaauauuuacuccaauuuuugucaccaaaaauuggugacuccaaugucaccuccuuuuuuauucuuucuaaauguaaaacuccuugaguuuauuuucaaauuggagcauaucugagauuaguuaaucaaauaaugagcauuucaacacaugcaaaaaaagaaaaaaguauuuugcaaaccugauucucuaugacuccagcggcgaacuuaauacacuauuaacuuccacuucugaaacuguggcuuccuuuguuuggaaacuuaugacauuaugacauuugcuaaguccucucaugauuuagcaucaugauauaaaaaagagauggaaaaguuuucuuucuguggcauaucaacgcacuugagugauuaaggcugccuaaauuacaucuaaauugcaaauauuuauacaucagucuuaaauucucaagccucucuugucuuuucaggugucuacuauuaucaugccaaaugaguuucagcaggauuaugacaucagagacugugcugcugucaaggucaguacaaugcuggaaaaucugcauauuuaaaacauaaguccaucaucauaugcagucaaguaacagauccauggagugucuuuuuaugugaagcaugauguuagaugcagugagagauaagcacacccauggccuggcccucagcagccuaacuuacacuucauuugagaggauaaaauucauauucaagaaaaccucucucauuaccacgcaguaauaugcuccaaaugagggggcugaggaaggcuaaugaaauucagaggagaaagugagucccauggccauuucccaggaagaggugggacuugaacugggacuuuaaggauggauagaguuucuacaaaugggauaggguaagguuuuuucaugaggggaugguaugagaaagugguauaaaauaagguggaaguggaagagggcaguggagaacagaauacagaucaagaaguuucauuggugcuguccuugauaacaguauuaggaaaucagauugaugccacuuuaaggaauuucuacacuucuugauaggcaacagggcauuuuuuaaaguuucugaguagggagggucacaugaacuaaggaggguaugaggaagauucaucuugagacagaugucaaaagcaacagguaagauuggaaggcauagaagaccagugaggcaucuuccuuugcagaaugcauucauguauccauuucauaaacaguccaaggagucagugaggcacugggugauagaacaaugacaagguacaaagcauagccauugucuucacaaaacuaaagucuaguaggaaauaaagacaaguaaacaagcaauuacaacaccacugaguaaagacuaugacaugcgaaauacaaguuuuaugcaagaacaagaauauuaugaaagaauaauaaggauggugauggugaugguccauggugguggugaugaugaugauggagcagcuaacacugauuaacuccuuuaugagccagccacuauacuaggcaugucacauaugucacauagcacauaagcaaucuugugagguaggcacuguuacuguauucaucucacauggaaauuugagcugugaguaauuuaccccagcuuacauggaguaaauuuaaacugaaagaacugaaauuuacacccaugugugucugggucugguacucuuaaccacuaugcuauaugacuaggcauuuauagaaauagaaaggguauugauuuaugagaaaauuguauguuuuaguucagauauuuugaauccaagcuagcuauaagauguaugcuaugguaaguugagaucaagagucuugaguugaaaggaaaauguauauuuuuaaaaaaagggccaagaaguggauuuggaggaacugccaauauauagagugaaaaaagaugaagauggaggagacaucaguuaauaucuuugauuuguaguccaagaaagagauucaacaagguggcugaccagaaauguuacaggaaggcugagggauauaagaacugacaaaaccacaggaaagcacuguuuucaaaguaacucuucuaguaauaaacuguguaguacaugucauuuuuauagaauucccaauguaacacaggaaaaggugaaaacuucagagaagcuuauggaauuuuuaguaguguugagaacacugguacaauaaacuguguucuagggaaauagaguugccaaguauggagagauuugaaaaucuaccaaauaaauaaagagauacuaaugcaaccugcaucaggaacaagcccagccagggcaguguucuguaaggaaaaucuuaccucaccugccacagaacccccagaaacuuggucuuaagagaaaauagucuaagaagugauggaugucucucccaaguaaugccuuccccuauccuuuuuauccuacuugcugacuggaauuuguaaugagccauccuggaccauguggagaagggcaaaauccuagaaauggcaugguaacaccagagaaggagccugagccacugaggcuggaccuuuaugucgcuuucugaucuaauuugaucacagcuuggugcuuggauaccucugaaauaaauauucuaacaaaaauugucaggugugggggagaaaauuugcauuuuggacauaaacaugacuuuacaacauauuuccuuuguuagccccuuugagggcucuugcucaggguauuacuguuuaaauauuccauuaauucauguguucauuuaucgaacaaauaucuuaggugcuagagcuaaaauagagaucaaagucauagggcuuacaguuuaguguuccauaagggauguaucaacuucaaaauauucugcaauacuuuuccucuuauagguauuucauaggccauggcgaagaggcuggcauuucuaugaugauagagaauuuauuuauuugaggccuuuugcuugugauacaaaacuugaaugggugugccaaauuccaaaagguaagugguaguuauuccuuuucacaaccuucucauguuaacauugugaaugccuagcucaaaguagcuaggggagcauuuugaucuauaauucugaugucuaaaagccuaugaugaugaugcaauuaauauguggagcacccccugccugacuccggcuucuaauagaaggcuagcuuauugaaauuuagugauaucuuacucuuugaucauggaagaauuugcauagaagauaaaaugugaggcucauucagggagauuagauuuuggaugaaauauuauuuuaagcaaaaggagaaaugcagaaucauuuucguuuuuauuuugaugcaaaaugaaaaaauaaagauaaucuugggaagaauaaggcagaagucaagaaauaaaaauuuggcaggucccuguaaaauuuagaagcaauuuucaaugaacuauaaaacugcuaauacuuuauauaaauucaaauuugagaagccaguuagauugauaguauagccuuugauaacagaagggagaguggggagaaauguagauaccauuuuacuuuacuuuuuccaggaaaacaugaaauauuaagaaaaauguuaagacuuuaauucucaaauuauuauuauuauuuuuuaagacagucuugcucagucuuccaggcuggagugcaguagcacaaucuuggcucacugcagccucugccucccagguucaagugauucuccugccucagccacuggcguagcugggacuacaggcacccacuaccgcaccuagccaauuuuuguauuuucaguagagucaggguuucaccauguuggccaagcuggucucgaacuccugaccucaggugauuggcccgccucagccucccaaagugcuagaauuacaggcaugagccacugcacccagccucaaauuauuuuuaagcagagauuggcuguaugaaauuaauuagcagaaaacccauagaagguuuuuaaagaaaucucugaacugaauguaaacagaucauugaaacuaaagguauauccuccuacaaguucucaaagaacccaaaguucacaucauggaacugccuauuagaagauuguuauuccuaaaauaguuaaaagagcuucagaugugacaucagguaguagcaaaucucuuucacaaaggcaaacugucaaaccaguuguaagggaaagacaguuguguugauggguuuuucuaaaggauaaauuaugccuaaguuauucuugauuauuuuauuaaacccaaaaaagggacaaaggaaaaccaguuuggauauccuuuaaacaaguggaaaaguaacuuguauauaauuaauucggacaaugucucuguuuugaaguguuaaugugagccucccauuacucucuggcauuuguuagcauuccacagacagugucauuguuccaaccaaagugcccucgaugggagcugcugcccccaccuccuguuugagcaguggagcagaccccagaguuuaaacaagggcaaccuuagaaauggcaaauuagccaccagaggaaauaguaugaagggcauguggagguguauauauauuuuuuuuaauauauauuuuuuaacaagagagaaaggaauuaacccacuuaaaaauauaaaucaauuaaucgaacaaaucuaaauaauuccaccuccauuauccccaugcagaaauaaaauaaaaaacuaaacuccuguucucagccugucccaaucacuugaagaaaucaaugauugcuugcuccaggguuuaaauguuauguucacccuuuuuugaccguacuguaccuaacuuucuaaguuacgaugugaugcauucagcugguuggauauuuucuugguuauuagagcagccuaaguuuacucaacuuguauucaucuguauuuucugguuuucuuaaagaaguuuuccucuuauguauucuaaaucaccaugccucuucucuggcucuugccuuuuuauuacuugguucuaauuaauccucucuucccuaaaagagauauuuugacaaccuguaaauuugaaguuaccucaaccacaguggauauuuguacuuuuuaaauauuauuuuuugagaaaacugugucaaaaauaaggcucauaaaaguguuuuuaggaaaauuaccuaugaugccauuacccagacauagcaauuuuuauuguauuucuugauaccuuguacacacauacauguuugcaaucuuguauaaaaaacaccuugcauccuacuuuucucacuaauuuaaagauauuuaaagguuagccauagcuuucccucccccacacacaaauaaucagaagucuuugacaagauuacagacaagaaacuauguacauuuugaacugacuugcaacauuauuguuggaaauuauccaauacgaauagaacuggcucagagagagacuaaagaugcuggcuauucaggcaguccucugagucaggucuucugaugccugccugaggcucacaugccacaccaaaauuaagaccagcuauuuuacucuguaauuucuaagauuaagcaaaugaugucuuugacuugaagccagugugaucuguggccagaaugaaaagggggaggaacgcaaauaggcucccauggggaacuucccugugccugguccugugcuggccacuuccuccagggcaucacacgugaccuucacucucugugagucagguagccaucuaguuuucauagaggagaaaaucaaggcucagagaggguuaagccacucauccgaaauaccauggcagcaaaaugcauaagggcauuugcacacugacccgcccagcuuccaacccggaauucuguguagcaugccauuauuuacuccguuuccaucugggaauccugagucacuuuuaauuauuuuccucucaguuuugucucaucuucucaaaagguucaacacuggagcauuguacauuguuuccaaggauaucuuggaagacaaugaacucuaucaaccuaaguuuacagaacaguuaaccuguuucauuagaugcagaagugguuccugaauaacuucccuuuucaaugaccguuauuuugguuccuacuucuuaugcuucuguguaacacauacaauaucauuauuuacuuguuuuuacuuucuaauucuuagcuauauuuuaucugucuuacuucuuuugugaccucugugacacaagguaaaagacugcuagaaauacuucauuaauauuuaacguaucugccuuuuggauuucuccugaagcagguuuagcaucggcccuacaaaauacaacuaaagugaucaaaacgugaaguggguuggccagaaauggacaagacucaacaauacugcaaguccuuucgagcuacauuaaaggccguacuuauaguauacccugaucugucauggaauacuaaugccacuugcuuucuuccucauacaggccguacuccaaaaacaccagacugguacaauccaggugaguuaagaaaacugaaauuuaaccaaagcugcuuuuaccuugucacuaaugcauuuaguuaauuauuuaagugccagcuucuucucuauacaucuucaagugagacaaaauuucuccaggcaaggaaggugagcgacugguaugggaugaggugaugagggugacuuuuuccuucccugugaguguaggggaguggcagagucacuggcucaggaaucucuuguuccuuguagucaguacugccccagccagagagggccgguaaucugaauuacuauuuauaguuuugaacauuaacucaugcuuagaggacacaguuugcuuugcauagucauaauucuaaucuuuuucuucuucuucuuuagaccgugcuggaauucauggaccuccacuuauaauugaaggaagugaauauugguuuguugcugaucuucaccuaaacuaugaagaagccguccuguacugugccagcaaucacagcuuucuugcaacuauaacaucuuuugugggacuaaaagccaucaaaaacaaaauagcaaauguaauuuaaaagaauauauuuuaaauauauuucuuauuuuuguauuuauuccauuuaaaaauauuacaaaaauuuugccaaaaucuacaaaaguuaaauuuuucuuuaauguaaaaucugccucacagcauccaaauuuguuucauguuagaaaaauuaaguagaauugcuuauguuuuaaaauauacaagauuaauaauaaaugucacuuuauaagguaaacaucaguagauaauauagaucauucuaauuuccugucacauuuuuuacuaaaagucaacuuuauaguuaacuugaguuucuguuucuacuaauaaguaacuuugcaaaauaauuuuugggaagaaaaauaauuucuguauuuuuaaauuuauaaucaauugcaauaggauacuguaugcccacuuaaaguauuagucuaauuaauauaugcccauaauuacagcuaccauauuuccuguacccacaauaggaucuguaaauauacugagaaauuucaacuacucuuuggcaaaagguucuaguuuguauaauuuugaaaucuaaguaaggaaugucuggaaauuuuagugguuagugauuauaguaagacaauguauucgaaucaaaacccucaagaaagcucagcacauauaaggauggauguuuggcuuguuuuucagauaucuggugauggacagaagugguggauaagaauuagcgaguggccaauagaugaucauuuuacauaguaggugacaucauugauucuaccuuuguaaaguuaucacuuaaaagaagcaguuccuuuuacuaaauggauuucuauuuauaaguaguuugaauauuaauccauaaacugccuaaauuagagaaaccaagcccuuuugcauguuagcaucaagaaaaaagggguauagaguaaugguauuaacauuaaauuuagaaauaaaauaacuuacaguaaaaagaaaaaaauggaacaccuaauuacauuacgaguugucaaaucugucauuuucuuuuagcucacgauauccauggcaccgcuuuccugugacauuuggagaggaaugcuuguacaugucugccaagacuuggcuuaucgguaaaguuaauucuaaauccuuuaaugcugauuauguaauaugugaaguucagguucaguuucuagcuuaaucuuguuuuccuuuuaauuauauguuugguaauuucaucuuauucugauuuauuauuagcaacaauagcucaaauucccaaugcaaauaaagguacuuuucacugugaauauuuuaacuuccuuuauccuaaagcaguuacuuaguaauaaacuuaccacuuuccuaacugauaagugucuaagcaaauuuucaaagauaagcaggcagcaguucuaaaauauaguuuaaguccccucccccugauuacauugccccuucaacucucuuccuaccuccugccuucacccugggaugguaugguagucacacaaaaugugugcuguuucauagacaguauugguaugcuguaaccuacugauaaaaauaaucauagaagacagaaauggcuagagaagaaagggaauauauuuuaagcauuuaggaaagauugauuucaagagccuuucuuuacuacuggguugcuuuuaaaaugugcugacuuggccgggcacgguggcucaugccuguaaucccagcacuuugggaggcugaggcaggcaaaucacuugaggcaaggaguucgagaccagccuggccaacguggugaaucccugucucuacuaaaaauacaaaaauuagccagguguggcagcaugcaccugcaaucccagcuucuugggaggcugaaguaugagaaucacuugaaucugggagguggaggaugcaguaagccaacauugcaccacugcacuccagccccgggcaacagagcgagacucugucucaaaaaaaaaaaaacaaaaaaaaacacacaaaacaaaauaaaaauguacugacugaaaaauucucaccauaguaauccuggcuuuucauuucucagacuuagguaaaccaacagacuguaguaccaaguugcccuucaucugugaaaaauauaauguuucuucguuagagaaauacagcccagauucugcagcuaaagugcaauguucugagcaauggauuccuuuucagaauaagguaaaaagagaauugcuacauuaugcaacaaugauugcuuccaugcugguuuuauagccuauggcagaauggcaacccauuagugacaacaucacugaaauagacucugcauguuucaggaucccaccuggcccucuguguugccagaaaccguggaugauaucaagaauuaacucucaaguuggucaugccuacaggucuuuuaaagugcagcauuucuauuuuguugcuacuaacacuuaaauugcuuaaguugaucuguugagggauugggaugcauugaauagucaggacugucucuauggccuuauaggaaacugacuuaauuucuggcuuguguuuucuuuuuccccucaaggagagcauccaagcagcaucugccaaucaaauuagaccagcauuucacaaacuacuuuuuggggacuacacacaugcuacaaaauguuaaucauugaucuugccuccaaauggggguuuuaugauuaaauagguuugagaaaugcugcauucuguaucugccucuuugagaugcauaauccauguugguauauguauguauuaggaaaugcauuuggcuucugaaaagagguugcuacaguaugagaaaagauuuauucugucacauuaaagacauuugaagauaagcagguuuguguggaaacaccaugaagucuucaaaaucaggcuucuuuugguuuugcucugccauccuuaauauaaggcuuccgagcuuaaauucaggguguucucucuagggucuuuucuagaaguuacccgaugaguuuguccacauuggguagcuuggcucauuggccacuccagucuauaagaaagcugaaaaaaaaauuuuuuuuguaagauauuucaaggaacacaauuugggacauaccacucuacacuaaagugaucauaaugugaaaaagggaaaaaagagaugugucugacagcugaaagcaucuguaguaaagcuagggguacauuuuaacuuuuuaaaauuaggacaaucuuuuuaauuccucaagguaauaguacuguguuaauuugcauagcugauauaaauuugaauuaaaauauccugccaagaaagagaugaauuuuucaacaguguuucuugacauaaggagaugaugauuaaggacacagauuuugaaauuagguggaacagaguacagauacugaccuuacuauuguguggcuauuucacuuauggaugaaguuauuuaaugucccugugccucaguuucugucuccauugugagaauuaaaugagauaauacuacacaaacugcuuaacacauaggaagcacucaauaaaugagagaucuuuaaauauauaaagauauaauauaaaauauauauuaaagauauaauauacaauauauaucuuauauauaagauauaauauauauauauauauauauauauaugaaaguuugaagaccgcucuucaguuguuucaauugagaagguagcuugagccuggaagcucaagguuacagugagcuaugauugcaccacugcacuccggccugugcaacagagagagacucugucucuuaaaaaauuaaauaauuaaugagagcauaaacuugaauucuuaugguacuacauugcaaauuaccauaucucacagaccgaaaauuagcagcccucuaaaagaugaagcauuuuacuuccuaugugagcguuccugugucuggaaucucaugcuucacauaugucuuuguuugcaguguuuucuaaagaucaaacccgugucucucacauuuucucaagcaagcgauaccugucacuccuaugguggcacccuuccuucaguguugagccagauugaacaagguacuggaauuauuugggaaacauguuuuauucugaucuggggccagguuaguuuuaggaggcuauggggaauuaacauacaaaaauucuuauuaaacuucuuuuguuauggaacagauaaaagacuauguugauagauaaacaaaauauauucauugacauuuuuaauguaucuuuaauuugaauaaaucaaaugcuuuuuaaaaaucucuuucuaacagacuuuauuacauccuugcuuccggauauggaagcuacuuuauggauugguuugcgcuggacugccuaugaaaagauaaacaaauggacagauaacagagagcugacguacaguaacuuucacccauuauugguuagugggaggcugagaauaccagaaaauguaaguuuuuuuaaaaaccaauacucuucauaccucugugaaauacuugagucuuucauacauuuuuggacuaagcaaaaccccacuguauuauuccauuuguaugaaauguccagaauaggcacaucuaagauaguaaguagguuagugauugcuagaggcuacgggggauggaaggauugagaauagugccuaaagaguauggaguuucuuuuggggauggcgaaaauguucuaagauuuauggggugaugguuguguaacucugugaauauacuaaaaacuauugaauauguacuuuaaaugagcgaauugucucauauaugaauuauagcucaguaaagcuguugcaagaacaacaggugccuccccagccuucugauggauguacugguuuuucacaguagcaucagauuccauagcacuuauuucauaaccauauaaaaccaucauguagugaguuguaaauagaagcaaauacagauguuuugcuuuacauuuugggacuuugggcucucagccucagucuccugaggcaaaaaguacaaaauugguaacuggugaucauuuuuccccaagagcuaaauauagggaagucagagaagggaagagggcauuauacugacaguaguuaugcugacaccacaguauuaccgcccacugcuucuguucucuauacuuucuggaugcagauuaccuuuugcacaaagggcaaagauugagaaauuaacauaaaagucuaauuccaaaaguaugucuuagacaguaaucaacugauauuccugacauaauguuacuuugcucaaaguugauguugguagcaaaggaaguucucaaucgugaguaacuauguacaauauaaauaucaaauuauuacuugguuauuauagaagauguggaaguuagaguaaacgcagcaaugaaaaaugucaacccuaaucuuaagacaguuuaaacuuuuaagcauaaucuauaguaagaaauacauuuaaaucaccaucuaguauauagauauagauauaauauuaauugaaacaaaaguuucaagaaacaauacuuacccuuauaauuuaugcacucugauauguucguucucuucuauuuuguuccauucuccugucuuauccuauccuuuacuguccaauccuacuaucuccuauucuguucuauuucauuaucacaaauacuugccaaaauccacuuaagugauuucaugauauacgaaaugagucucaaccauauuugagcccuagacuagggaauuacaaugaguacuugagcaucuuuucuucuagggcuuuuccauacacuguuuucuugauauaagugagaucauaguauauauacuauuacucugcuuuucucaguuuguauuauaucauaaguaguuucuucagccauuaaaagaucuacuugauaagcuuuuuaaugguugcuggggaacaggugguguuugguuacacgaguaaagucuuuaauggugauuugugagauuuuggugcacccaucaccugagcaguauacacugcacucaauuuguaguauuuuaucccucacccccuucccauccuuuccuccuaagucccccaaaguucauugugucauucuuaugccuuugcauccucauagcuuagcucccacuuauuagugagaacauaacgauguuugguuuuccauuacugaguuacuucacuuagaauaauagucuccaaucucauccagguugcugugaaugccauuaauucauuccuuuuuauggcugaguaguauuccuccaucauauauauauacauacauacauauauauacauauacacacacacacacaccauauauaaauacacaccauauauauaccguauauaugguguguguauguguguguguauauauauauauauauauauauauacacaccauaauuucuuuauccauucauugacugaugggcauuuggguugguuccacauuuuuauaauugcgaauuggauugcacaauauuucuugauugauaugccaucauuuaccuaaccagugcuggguguuagguuguuuccaguuuuacacaaucauaaauagugcugcaaugaacaccuuuguguauaaucuuagccuauauuucacauuaccugcagagagauuuuggaagucauguagccagaucaaaggauauagguaauauaaagcucugauuaccaacuugcuuccagaaagguuuaugaauuuacauuccuauucacagcauauugugauuguccuucuauccucaccagcauauuauuaauuuccaacauauaucaagcaguuaagaugugccaggcacucugcuaauguaucacauacauuauuucauuuaauuugcccaauagcuaugaaauaaagauguuaccccugccccaccuuagaaaagugaagauggagucaguaacuugccagagaucaugcagccuaugcaugcagagucacgguugacaucugguucugggugggcaugguggcucacgccuguaaucccagagacucuggaggcugagagggggaggccugcuuaagcccugggguucaagucuguagugagccaugauugcaacacugcccucccaugugggcaacagagcaagacccugucucuaaaaaaaauuguuuuaauuaaaaaaugagaaaaaaggcugggcgugguggcucaugccuguaauccuagcacuuuaggaggccaaggugggcggauugccugagcucaggaguucgagaccagccugggcaacacagugaaaccccgucucuacuaagaaguacaaaaaauuaaccgggcauggcagugugggccuguacucccagcuauucaggaggcugaggcaggagaauggcuugaaccugggaggcggaaguugcagugagcugagaucgugucauugcacuccagccugggcgacagagcgagauuccaucuccaaaaauaauauaaaauaaaagagagagaaaauaaaauugccuuuaaagagcacuugguuuuuaaaauucuucuuaauuugguaguuugauaucguauuuucauugaucuuucucugauuucuaaugaaaacaaacuucaauaaguuaaauaaucauucguaguucaucaagugggaguguucuuuuucuuugcaaauuuaucuaucaaacccuucauguauuucuuauugauuuuaugacuuuggaaauaucaaauaugcugauccuguauuucuuguguuuauugcaaauacuuuccuaaguuuucuuuaagucugaaugccaaaaauauuacagaaauaaauuuugacuauuuuuuaauauguucaaaucuguauauuuccuuuuuauuuuuccucuguugcuuuuagguuagaaaguccaucauguaaauuguaaauauuaguuaaauauauguccauauuuucuucuaguuuuguuucauagguugccuuuuuuuguuguuuuuucugacacagggucuuacucugucacccaggcuggagugugguggugcauucauaacuuacuauaaccugaccucaagcaauccgccugccugagccuuccaaguagcuaggacugcaggagcgcaccaccaugcgcagcuacauuuucuaauuuuuuuguagagacagggucucauuguguugcccaggcuggucuggaaccccuggcuucaagugauccucccacaugguccuuccaaagugcugggauuacaagcaggagucaccacacccagccucuguuuuuuguguguuuuuuuuuuccccuuucugauagcauguuacauccaugguauaugauacauguugucagugcaugcuuaauuauuuucccuaauccuagccacuuguucuagcaucauuuauuacauauacuuucauuuguuaaaaacaauauaggccugggcuagcacuuugggaggcugaggcaggaggaucacuugagcccaggaauuugagaccagagaccagccugggcaacacagcaaaacccugucuauguuuaaaaaaaaaagagagagaaaacaauauagcaauauaggaugccucuuuuaucauauauuaggacuguguguguaugcauauauauguguauguguauauauauauacuguauuuuauaauauuuauaucaguaugguagcuauuuaaaaauauuucucauauacauaauguguguauguguguauauaacauacaaauacagucagcccuucauauccauggguucugaaucuggauucgaccaacugcagguggcaaauauuugagaaaaaaaauuuuuuaaccuacauccuccuguauacuuaaaucaucucuagauuaccuauaauagcuaauacaauguaaaugcuauguaaauaguuguuauacuguauuuuuuagggaauaaugacaaaaaagucuacauguucaguacagacaaaaaaaauuuuuucucaaauauuuuccaucugcaguugguugaauccagauucagaacccacggauaugaagggcugacuguauugauauguuauauacacacauacacauauuauauauaugagaaauauuuuuaaauagcuaccauacugaucuaaauauuauaauuuuaccauauuuuuaaaaacuauaauaggauuaauuauacuuuauuacaugcccuuaaaacauacuuuuagauauucuuguccauuuuuccaggaaaacuuuagaauuauuagucauuuuucauccaaauaguuaaaauuuuaaaacucuugaugagaauuugacuacauguuugggagaauugacaucuuucuauuaaucuuccaauucaugaauuugauauaucuauuuauucaacucuuccuuuagaucacucugugaaguuuuauaguuccaucucuuucucauugucauuaacaauggcaacuuuagcuauaaaaagaauggaaucauguccuuuggagcaacauggauggagcuggaggccauaauccuaagcaaauuaacacaggaacccaaaaccaaauacugcauguucuaacguacaaguggagguuaaacacugagcacaggggagagggagggagggggaccuggguugaaaaacuaccuccuggguacugugcucacuaccuggguccaacacacccauuuaacaauccuacacaugugcccccauaucuaaaauaaaagcugaaauuuaaaaaaaaaaaaaaaaagaaugacagcuuuaaaaaauuuuucuuacugauuuguggggaagcuauuguuugaauuuguuauggguuuuuuuuucccccauaggcaucugucucacuaaaagcucuuucucucugaguuuuucauuagauuuucuuggguuuccuaaguagcuaauaauaauauacaagcaacagugacccucguuccuauaguuaccucucucguuuucauuucaugccucaccacauaugcuagaauuuccagaauuuccauggcaaauaccaggagcaguaguagccaccauuguagacuugaucuggaccucaacagguuguuaaacauuauguugacucuugguuuaagauauagcauucuauaacuagcuuguuuagaacuuuuaaucaggaauaaguacuggguuuucuaaaacuuguucccagcaucuguuaagauugccauauaguuuuuuuuuuuuuuuuuuuuaccauuaggccuauuuguacgugguauauauuaguagauauuguauuaaaccauuuuacauucuuguuguaaaaucugggugcucagaguggauuaauauuuuacuauucugcauuauauuuguuagaauuuuacuugggaauguguuccucucucuucauagagucaauuucuuaugcuauauugucauauuuuuuucugaucauguuagccucauaaaaugacuggguagcuuuccaucuuuucuguguucugaaauucugacucagcuuggggaauucucuuucccugaaaguuugggggaacuaccuacaaaauguuagaacccuuauccaggagcauuuuugcuuuuuaaaaaauuuuaauuauuccuuauuuauaauugacucauaauaauuguaccaauuuaucaggugcagugugauguuucaaugcaugcauguguuguauaaacaaucugaucaggguaauuaccauauuccucacuuuaaacauuuaucuuuucuuuguaaagauaacauucaaaaccuucucuucuaugugucuugaaauauacacuacauuguucuuugcagagaucauacucuaaugauaaaggaauuuggugcagcagugaagggcccaagcucuggagucagauugccuagguuugaauuccaguucagccauuuacuaugccuuuggagguuuacuuaacuuuucuuaagccucaauuucuuaucugcaagcucuaauucuguugcauuaccuuauaaggucaauauaaggauuauauaagauaauuuauuuaaagcuuuaucaauaguaccugacagacaguaaaaaaaaaaaaauggccauuauuaauuuuccauuuccuucaaagugauuguuacauuuugguauuuccauuuuucguuaugacaauuaugcuaauuggcauuuuucaagaaaguugucuauuuaauuuagauuuucaaauguauugaaguaaaguugcuuaugguauuuaaaaaaucuccauuaucuuugcuaacauuuuuaguuugcauuauuuacauuuuuacaaaaacagaugcauguuauugguuuuguccacucucuucuccacccucuacuccuauugcuugaccuguguuauaaauacuauuucuaccuuuuucuaccccauuuuucgugggguucuguuuuuguucauuuuccaaucuccuauauugaauucaguucauauuuccuuuaaaaaaaagagaauauauuuaauaauacacauuuggcuccacauaaaguuuuacucauaccaauuuuuuugacauuucucauuuuauucuuuccuauaauuauuuuaguucauuuuugguuuacuauuuauugaguagcauuuuuuuuugucaguaucuccugguauaaacuuacuuuucuuauuuuucuaagugugauauguuucaaacauacagaaaaugauagggauaauauacuuggaauaaauuuucauaucuaauauuauugauugugauuagaaaaugaaaucuagauacuucuguuuuaauauauggagauuuuuauagugacuaguauaggaucagagcuuuaagguauauucuguuaugugguacacaacuuguuacaaaaagucuauaaaaaucuaauaaguugaauuaauaaucauuauguuuugcuuauacuguagucgaguguuaaauauugcuggagguguuuuaucuuauuucuaauaguuuaucucuuuaaaaauauguuuaucaagauugccacuauuuuguuuuuuauaaaguuaauugcccuuuauccaugcuuugaaaguuuuuaaagauuuucuaggaaaugucauggucagguccuucauggaauucuuuuauagggggacaaauucaaucuagaaucuaaacuuuucuugcuaggagcuucagaccauuguuacaugauugcauguauguauuugccuuuuuguuuaguuuuuugaggaagagucucgcuaccacugugcccuaauacucaaccuccaaaaaucaccguuuacugggacguggaauuuuacauccugcagugaacgccacuuugugucucucugucagaaauauucagguaacaauuauuaucuagauaacuaugguacuuuaugcuauuacauauauauauauagagagagagagagucacuuucuauagggagggaggggaacauagguugaaaaauuaccuauuggguaguaugcuuaccaccuggguccaauacaccauguaacaauccuacacauguacccccuguaucuaaaauaaaagccgaaaaaauuuuuuaauacuauaaaagaauuuauauuaauuuauaaucauauggcuuaaaauuucagcauggcuaaauccauauuggguuagugagucagaguuuaucaaauggaaugugauuuuuuuaaaggaucauugccauaauuaauuaaauuaauuaauuguaucugauggaauuuguuaauaguaguuaucccauuauaguaauugaauuuuguucuuuuuucuacucuggcauuuuucagauuuuacauuuuauuaugggaaaaggagaaaaaaacuucauauuuuuaauugagugcaguauugaguauuaaguccacuaauaguauucacuguuaaauuuagcauuaacaaauaaacaaguggggguuugaaacauuauaaacagaucacugucuaugccuuuccauaauccaaauaaaaguagaaugcauacuuaaaaguaggcaucauccauauuuugaaaaauauauuuuuaaaaaaguauuacauuauuuuucauugaucacaauguguuuuuaacaaaugaucaagaaaaaauuuugucauauaaugagaacuguaaguagauaucucaugugcuuuggcagaauuuuuuuuugcuaaauuaaucuuuacccauuuuuuccauguuuuuaacuaacuccuuuauuagcgaaguacuauaaagcaauaauucaaauaccuccucuuguggaugguuucuuacauuucuucaugcuagcucucccaggugaaaacuuuguaaggggauacuuaauacauuuauuuccuucaaacaaaagagguauuuagcaccgacaugacaugauaaugcagguuacauuuauuugcagauauucucuucauaaaucagaaaaaugaaacagaauguuguucugauuuuagaaaacaaauguugcagcucacacauuuuccuuaagguauacagcaagacauaccuaauucucucacccaaaaucuaaaauaaauaggcaaauaauaucuaaauuagauuaguauggggagaaaugugaaaaaaaugucccauaacuugcagaguguggggaaggguuuguuguuguuguuguuuucuuuuacaugcagaaguuaaaagcagacagacguugcagaaugcuucagaaacuguaaaguaucuaaauaaucuguacaaaauaaucccaaagacucugacuuggcacagugcuaaaagggagugucugaaaaguaacaugcagcuggugagcaucacggacccuuaccagcaggcauuccucagugugcaggcgcuccuucacaacucuuccuuauggaucggacucuucagucaagauguaaguguucagucccaacugccaggacugggugauggaaagcgacauuuuuuauugugcauagcuucucucacagcagacuaaaacaaacagaagaacugaaaaucuuacuccaguaaauuucauggaauaugucgggguuuuuaaauuuuguuuugagacaaaggcucacacugucacccaggcuggaguacaguggugugaucacacuucacugcagccuugaccucccgggcucaagcgauccucccaccucagccucuugaguaucugggacugcaguuacacaccaccauaccuggcuaauuuuuguauuuuuuguaaagaugagguuuugccauauugcccaagcuggucucaaaugccuagacucaagcacucugcccaccuuggccucccaaaggugcugggauuaccagcaugagccauggcaccuagcagcaauaugugguuuuuagaggcaauuaucuuuccacuauugaaagaucuaguacuucauuguuuaaaugaggaaaagguucugguggagauauauauauauuugagcacuucuuuuuauuuauucuaaucaaagacgagcuagaaucuggagcugccauaucucuucagccaaugaaaagauaagggaagaauuuaaaaaucaguuguguggaagcacuauggauaguguuaaagaguccuuuccaucccuuucucuuuuuucuuuuucuuuuuuuuuuuuuugagacagguucuuguucugucacccaggcuggaguacaguggugcaaucucggcucacugcaaccuccaccuccaagguucaagugauucucaugcuucagccuccucaguagcugggauuacaggcaugcgccaacacgcccagcuaauuuuuguauuuguaauagagaugggguuucaccauguuggcaaggcuggucuugaacucuuuaccucaagugauccgcccgccccaggcucccaaaguguugggauuagaggugugagccaccacgaccagcuuccaucccuuucaacaucagcagcauggcugggcaccguggugcacacccguagucccauuuacucuggaggcaagaggauaacuugagcccaggaguucaaauccagccuggacuacauagcaaaaccccagucucuaguuuaagaagaaaaaauucagcaaaguaaaauuaagcaacucugaaaaggagguugaauaguguuuuccuccaucucaagugcugauccuagauagaugucucaagcacuucucauucauuucagagcccaacaaagaaugcuagucuccuacuaauucgcaucacuaaccucugcacauguagcacaaaccggaaucauuacacagcugaaguuuuggcuauaauuaaauaagggauuuuuaaauaaagcugugguauuccuauuggcauuauaggccaccucuuuucucagccaugguauaucccaaaguauaccaggaugggucuagggaugcauggaaaaaaugcgauugaagacucagaauugaacugaagaauggauggaaaaacaagaauuguuaucaaaagcucaauuaaaaguagcauuuaggaauagcuuaaagaauagucucucugagccacaggguauucuaaaguuaacccagaucggccgggcaugguggcucaugccuguaaucccagcacuuugggaggccaaaguggguggaucacuugaggucaggaguuugggaccagccuggccaacauggugaaacccugucucuacuaaaaauacaaaaauuagcuggguaucauggcgggcgucuguaaccccagcuacucagaaggcugaggcaccagaaucacuugaaccugggagguggagguugcagugagccgagauuauaccacugcauuccagccugggcgacagagugagacuccaucucuaaauaaaaaaauuaauuaauuaauuaaauuaaauuaacccagagcaagccaggagauggggaagcugcuuacucaguccucacagucucaauuguuuuauagcauugcauuuacuugcuuuaucuucagcauuggaaauucugugaaacgcuuuguugugucuguugugaggaaacaauaggugauuacauuuccuaguuucagucacccuaaaucuuuugagacaaaaacaguauugcaauguagaaaauuugucaguaauuaaaagaacaaaauuaaagucaccuguaaugccaguaccuaaaaauaaacaugauucaaucaauauuuugguauggaucuuucaaguuauuuuucuauguguaccuauuuauuuuuuagacaguuggaaucagacuauuuuguaacuccccuccccacuuaaugauuugggucuuacuucuuauccuauuuucaaccuuuaccuaugguucucuuuucccuuucacccuuaauuuuaacauauucuguguagcuguuuaacuauauauccuaauagcugccuuaauucuuugaaaaugacaggauguuaauaaauacuuuacauugaaagcaaugagaagauauugaaagauuuuaaacagaguaguggcaauauaagacuuuacuuaaguagacgacacuguguggaaggccggggaggacgcaagcagcuggagagagggagagcaguuauuuuucuauaaauucaugcaggaaaugcuguuggcguuuacagugucugaggagaggcagcucuggguuaugugaagugcagaguguggccaugcagugggucacucaaguacccagcuugaagaaauaaaaauacauagaauuaaaggaagucaagaaggcuuggaaacaugaacacaggcaucccaaguuaaugguaggaccgggaggacagcaagaauugggacaucuuagugaaugucagggaggagcaaggcgaccaaguccucagugaaugucauggggaguuugcagugauacaaggggaauaauccugaaaggaaauaaaaggagauaaaaauauccacuacuccuuucucauaguccugugguaucugagaauagaauaucaaauagucuuccccugugggugcugaaaggagauuauucccuuggaaaagccagauuuauguauuuauuuaagauucaggggguacacaugcaggauuguuacaauacauacacugugggaugcugaggcuugggcuucaguugaaccugucacccaaauagugaacacaguacccaauagguaguguuucaacccuugcuccacucccuccccacuuuuggaguccccagacaauaucaugcccaucuuuacauccauguguacccaauauuuagcucccacuuauauaagugagaacaugugguauuuggucuucuguuccugcauuaauuuacuuaggauaauguccuccagcuacauccauguugcuguaaaggagaugauuucguucuuuuuuauggcugcacaguaugccaucauguauaugugcuacaucuucuugauccaauccacugcugauggacaucuagauugauucccugucuuugcuguugugaauagugcuacaauaaacauaugagcgcagguguauuuugguagaacgauuuguuuuccucuggguauauacccaguaaugggauugcuggguugaaugguaauucuauuuuuguuuuuugggaaaucuccaaacuacuuuccgcaggggcugaacuaauuuauaaucccaccaacaaugugugagcauucccuggaaaagccagaguuaaauuaagaucaauuaagaucaagaauuuagugaaaagauauuuauagucuucauacuuuguauucaguaaaaagauaaaaggugugggaugauuuauuuagauggaauggaaauuccaaaggaucagggacaggguuagguggggagugcagcaaaggggaagaaaugcagggcagucugaaugagugcaggcaaagucgcauggccgaagggccacacuggaggccacaguggcuuaggcccuaacuggguuagguuaggggcuaggauuacagcuggaacucuggucaugaacauuucagaaugaagcagcgagugguguugaggcuugacuguguugcuguuuaugguuuacuaaggagacugugucgcuucguuccauauuucaaauaaacuagugaugcagauugucuugggacucaggaaagcuuagcucagugggucuguuaggccagcaccaggcccaccaguggguauguaaggucucuggcagcaccauggggaagcucagacaggccuguaccccacaauccaucuccuguaccuagauggguggucaggaccuuggcaggguguaaaggcagacguucacagaccucuagcacacaacagaaucuagugaaugaagaagcuucucuccccaacaagugugaaaacagugaugugagagccacagcgccugaagaguucagaggaagggaaccaccagcucucugugugccagcuagccccuggguugcgggcuuuacacauguuaucccauuaauuccagccccacgaaguuaagugucacacuuaacuugguaggggauggaaauuuggagagauggcacaugaaagcuaguaagugacugaaucaggauucaaaaccauguagguuuagcuccguagcccauauucuuuccacuaugccagguggucucugaucuaaucaguacuuauagugauccucaccccauuuuagcuuucugauuucugauaaccaguggauccaauuaugugugaggcagcguagcauaaugguuaggacauagacucuggggaucgacagccuggcagaaaggcccagcacugugguuuguauucugugggacuuugcacaaguuacauaccuuuaguuuccucaucuuuaaaauggagauaauaauaguaccucuccuauaugguuguuacaaggauuaaguaagccaauauuuguaaagcauuuagaacaaugcuuguuauguaguaaaugguauguaaauguguauuaaauauuaaaaaaauuaaaaaucauuagauugaccaugggagucaaaauaauacaaaggguuaacaucaauauugccaccugaaauguacuucugcuccuuacaggaugaacucaacuuugguuggucagaugggaaacgucuucauuuuagucgcugggcugaaacuaaugggcaacucgaagacuguguaguauuagacacugauggauucuggaaaacaguugauugcaaugacaaucaaccaggugcuauuugcuacuauucaggaaguaugugaauuucagaucuuuuaauucuuaaauuauuaacagucccauaagugguagaauuucugaggagugguuuuauaaaaucugguuuuggaauugugaagaaauuauagucaugucuuuuuauggcaacauuuguugugaaaauuuguauucaaguagaauuauauauuacauauauuauuauuaaugggucauuuuaggcauguuuuauuuuuaugucagcugacaauggggauuaacacuuaaaaucccauuguuacucuaccucuuucugcauauauuuauaguuguagaaagcuuacauuugugagaauucuuuugugauucauaauaucacaacuaacaggacuuuuaugagucuuaagauucacagcaaccaccucaagcuagcuuaagacaaggggaaauuuaggauccccaaaacggggauagagcugaaccuauaacuggagaugaguugacaauuucuaaauuucacuuuguaaaucccuagagaacaucucaugaacuuagccugagucaggugugcagucucuagcccagucagaggaaaguguuuuuacaacuggcaaggucacauuugugggucugugguagaaagaagacacugcuucauggacaaagggacuuauugugauccaggagagauacugagugaucucugccacauauuaaaucaguuuaauguauuugaguggaauauguuuauauuuguaucuuugugaauguauggccuuuucauaaaauggaaaaagaucauaaucagauacuguagaugucagauuuuaaauauuauuuuuguuugacuugguuaaagcaauaacuuauuuagaacaucaauguuucauuuaaauguuccuuuaaaauuaauaguaucaguagacagaaacuuuaaaauaaauucucagaguuauaguuaggugacuuuuaauaaugaauauguuuguacagcaucucuagggguggucccuuguacuugacauuugguaaugcaggaagacagaaacugcauuuaaccuaauagcaccucauuuuuuacauucuuccaugccacagcagggguaagaaaauugugucaaguaauuuccuuccuauagaaagcuggcuuuuugugugcuauaucugaguauaaacagagacaggcuucaccaggauauuacuucucggcuuccugaauauuuccuacaaaucaagccuaaugacugcaaacaggauuuaacauuuauaucucaaauuagaauucuuaccauuaacucuuuuucuagaugagacugaaaaagaggucaaaccaguugacaguguuaaauguccaucuccuguucuaaauacuccguggauaccauuucagaacuguugcuacaauuucauaauaacaaagaauaggcauauggcaacaacacaggaugaaguucauacuaaaugccagaaacugaguaaguauuauauuaguccauucucauguugcuauaaggacauacccgaggcuagguaauuuauaaagaaaaagagguuuaauggccucacaguuccacauggcuggggaggccucacaaucauggcagaaggcaaaggagaagcaaagacauguuuacauggcagcaggcaagagagcaugugcagggaaacugcccuuuguaaaaccaucagaucucauaagacuuacuaucacgagaacagcacgggaaaaacccacccucaagauucaauuaccucccaccaggucccucccaugacauguggggauuaugggagcuacaauucaacaugggauuuggauggggaaacagccaaaccauaucaaguauauuauacugucauuacuuauuguauuuugcuaauuaaaaaaauauuuccuguguuauaaauauuucuaauuagcacuaguaacuagaugacaaaaauauucaucuccuaauaucuacauuaucagugacaaaguauuaaaauuuguguuaguuaaaauggaaaguauaggcauaacuccuuucuuuacucuuccauucaagaacuagucuauguuuguaaggaaggcagguucuccuuuaaaaggaaaagaaaugggcuaggcacacuggcucaugccuguaauccuaguucuuuggaaggcugaagugggaggauuguuugaugccaaccauucaagaccagccugggcaacauagugagacuuucugucugcaaaaaauuaaaagcaugguggcacaugccuguaauucuagcuacuugggaggcuaaggagggaggaucuuugaacccaagagguugaaggugcagugagcugugauugaaccaccugcacuccagccuggauaacaggugacccuaucuccaaaaaaaaaaaaaaaaaggaagggggaaagaaaugacacacaagagagcagagaacuggacauuaaaucaagcuaggcuauggggaagugaaaauaaguuaguuggagcagucaaaagcuuagauacaccacaaggcagcagcuaagcuuaaagaagugcacauuucacauuuucagcucucaagagucuucagauaauuccuaugagauccacuaaggauuugugacuuccaaaugauggaacuguuggaaccaauggaacaaugaacuuagugaaaguugcuauagaaaauaucaaaccaguauuucccaaagcaugcuccguauaacaucagucuugagagauggucugcaaaaaguccuuagaauaagguugaaaaaaauaaccaacaaaaaagaaaaagguugagaaacacuagacaccauagcuuccuguuggacauuaacaaauguacauuaacauaugccuuaagaaauacuggcauaaacuaguuuaauuuuguuuaaaccaauguuugcaaacuuuuuuuaaaauccauguagaucuuuucugaaacuuccuuguuaauuuugugaggaacacccuuugggaaauauuaagccuuuuuaacccucauacugaaaacuaaggaaaaggaagaucugucguauagcccagcaguccccaaccuuuuuggcacugacagggagggguggaugguuucaggaugaaacuguuccaccucagaucaucagaccuuaguuagauucucauaaggaguauguaagcuauaucccucgcaugcauaguucacaagaggguuugcacuccucugucaaucuaaugccacagugcucuaacaggaggcagagcucaagcggugaugcucgcuugccugcugcucaccuccugcuguauggcccgguuccuaacaggcccgguuccuaacaggccugguuccuaacaguaccaguguguggcccggggguugggaaccccuguuauaguucaucuaagagguucuaauuauuauagcguaaucuuugacaguauaucauuacuauggguggauuuauaccaacugaaaaauuaccuuuaaauaggggaaagugaagugaaucaauguuuuaaauucucuacucagcuacuaguuuucuauuauaccauaagaccaaauuuaacaucaaaacauuugaaaacuccuuaaccuauuaauuuuaguacaaugggauaauuuuauuuuacauauguuucuaauuguccaauauuguuuauauuuugaaguauauuaaacugagaacuaaaauguuuuaaacuuaucaaauagaaguguacuagauaaguaauuguuaaaauuauugauuauuuuuuauucaacagauccaaaaucacauauucugaguauucgagaugaaaaggagaauaacuuuguucuugagcaacugcuguacuucaauuauauggcuucaugggucauguuaggaauaacuuauagaaguaaguuguaaaucugccaacuuucucuauuuguuuuuguacuucauuauaacauaauuaucaagccauaguucuucaaaguacaugucuaucaauacgugaaaguauaauuauguacuuagcauaacuuacauaaauaccaagacaguuuuuaugucucugcucugccuuuaucaucgaguuuaaaguuaaauggcggaaaauaauuuucugaauuaguuuguucccgcacugcuaaaaagaacuacccgaaccuggguaauuuaugaagaaaagagcuuuaauugagucacgguuccacaggcuuuacagaaagcauggcugggcagccucaggaaacuuacaaucaugucagaggcgaaugggaaacaagcagguuuuacuaugguggagcaggagagagagugaaggaggaggugcuacacacuuuugaacaaccagaacucauuagaacucacucacuaucacgagaacagcaagggggaaaaucaccucccaccaggccccuccuccaagacugaagaucauaauucaacaugagauuuggaugaggacacagagccaaaccauaucaauuuucuuuuuucacucuuuuauguagcaacucaagacuaacuaaaaaugaucaccaucccauauaaaucuucaauacuuauuuuuuguuuccacuaacuaugugagaugagcaagaacagaaucacucuauuaguguugcaguuuuggguuuauaacccuggcuuaguuuauacuggcccacauaugauaagcauuagaaaaaugagacacauggccagguguagcgucccacgccuguaaucccaguacuuugggaggccaaggcggguggaucaccagaggucaggaguuugagaccagccuggccaacauggugaaacccugucucuacuaaaaauacaaaaauuagccaggcauggugacgugugccuaguuacuugggaagcugaggcaggagaaucacuugaacccgggaggcagagguugcggugagccaagauggugccacugcacuccagccagggcaacagagacucaagacuccaucucaaaaaaaaaaaaaaaagaauagaaaaaugagacacauggucugacaaugggcucgaauauuuggaauuuggacuaaauaccaccaauccaaaauaugauugauaacaaaauuuuuuaaaacagucuaauauagaggaaacaaggucuuguuucuaaaugcuucugagcauuuagaaagaugcucagaaauguccugaaaaucauagacauuuuggaauuaggaaaaccuuuccacggccauagagcaucaaaagcauacauuuacucuaaagaggguuugauaaggggcacaggacaaugauaaccagggguagggaaggaaaagaagcuaaauuacucaaaucugccuguuuuaaaaauaggcuucuccuuugcucucuaacccaucuguuucuugggguuaccaauguuuuccugaaauguuuaugguuggcagagggguuaauggaaauuaaacuaucaagcaauagauaaagacuugguuuaccaagugaggauaaguucaucauaguaggacuuaguuggcccaaaccuuuucucugaugacacuuaacuacccuugaauuaaaauggagaaaaacuagcuggaaaauucugaggcuucaccugaaagugacugaagaaacaauggucuuguauugagccauagagaccacacccaggacagagagauugaaauuguacccuuugguauacuuuguaguuauauuaucagaagcaacugaaaaucuauuauaaauucugaaaaagcauuuuuagaucagaagacucccuuauuguuuuaccuucuuucauaaaauguuugaguaauaaaauuucuauuaaaauauacaggcauaugagggacauauagaaagacauuucaggcaaauggcacauuugauuugaaucucauucuuacugacuuaauuuacaucuguaaguuacuguuuuggguuacuuugauauacuuauauuuaauuuuuuggccccuauacaaggaauucuguuuuuaaaacagcuuugacuuuucaauagcagggccaugaauagaaaucacuguaagucacuguuuuugguuacguugauauagaauauuuaauuguauuuggcaccuacccaaagaaguuuguuuuuuuaaacauuuuugauuuuucaauagcagggccaugaauagaaauuacuaugagaagccacaguaugucaacugagagauacauuaagccaagugaaaaaagugacuuuuucuuaaaacaacuuuagaaaucuaccauugcacaucauauuggucagaaaauugauaacuuugaaguuuaggagaagggaagaggaacuggaaggcaugagaugauauaaagcagcaaacaagaaccaaaucgugugugcagugcuucuaaugugucauugcugcaggcagauguuuaggggucuugccuugggagaugguaaucaaugaagaccagaaauaaccaggacaacauuggguguguguagguagugauggcaucaaucuuuauaccaauuuauaauuguaauaugccuagcaccuuuuuuuaaagcuuuauugcaaucaucacuaccccaaaaagaaacacaauacccacuaguauucccucccugucuccuaguccucagcaaccacugaucuacuuucugucucuacagauugccugaauguaaaauucuggacauuuuacauaaaugaaaucauaccaugugugcuuuuugcgugugacuggcuuuuuccauuaagcauaaagauuuuaagguuuauccacauuguagcauguaucaguacguuauuccuuuuuaugacugaauaaaauuccauucuauggauauaauacauuuuauuuauccauguaucacuugauggacauuuagguaaaacaaccuaaauuuuaaaccauuuuuaauuauuauguauaaugcuucucugaacauucacguacaaguuuuugcauggacauauguuuccauuucucuuggguaaaccccugggaauagaauugcugcaucuuuuguuuaacccuuugaagaacuaccagguuguuuuccaaaccagcuauaccauuuuccauucccgguauaugagaguacugauuucuccguaucgaugccaacauuuguguguuuuucauuauagccaucuaagugaguguggaaugauaucucacugggauuuuuauuucauuucccuaauggcuaaugauauuaagcaucuuuucaugugcuuauugaauauuuguauaucaccuuuggggaaaucccuauucagauuuuuugcucauguuuuaaauugagucuuuuuauugucgagggguaagaauucuuuauauauucuggauauaaauacuuuccaguauuuauauauaaauauauaaauaauuuccaaauuauuuuaaaauuuauauaaaauauaaaauuuuauauuucuggauauaaauaauuuccaaauauuuucucccaugacuuuacuuaugccacaaaaguguuuuucuuuuuuuuucuucuuuuuuuauuguacuuuaaguucugggguacauguguagaacgugcaguuuuguuacauagguauacacaugccauggugguuugaugcacccaucaacccgucaccuacguuagguauuucuccuaauguuaucccuccccuagcccccuaccccccgacaggcccagugugugauguuccacucccuguguccauguguucucauuguucaacucccacuuaugagugagaacaugcgguguuugguuuucuguuccuguguuaauuugcugagauugaugguuucuagcuucauccaugucccugcaaaggacaggaacucauccuuuuuuauggcugcauaguauucuaugguaucuaugugccacauuuucuuuauccaguuuaucauugauggacauuuggguugguuccaagucuuugcuauuggaauagugccacaauaaacauacgugugcauacaucuuuauaguggaaugauuuguaauccuuugaguauauacccaguaaugggauugcugggucaaaugauauuucuaguucuagauccuuaaggaauugccauacugucuuccacaaugguugaacuaauuuacagucccaccaacaguguaaaaguguuccuauuucuccacauccucuccagcaccuguuguuccugacuuuuuaaugauugucauucuaacuggcaugagaugguaucucauugugguuuugauuugcauuucucuaaugacgagugaugaugagcauuuuuucaugugucuguuggcuguauaaaugucuucucuugagaagugucuguucauauccuuugcccaauuuugaugggguuguuuguuuuuuucuuguaaauuuguugaaguuucuuguagauucuggauauuagcccuuugucaaauggauagacugcaaaaauuuucucucauuuuguauguugccuguugacucugaugauaguuucuuuugcuaugcagaagcucuuuaguuuaauuagaucccauuugucaauuuuggcuuuuguugccguugcuuuugguguuuuagacaugaagucuuugcccaugccuauguccuggaugguauugcccagguuuccuucuaggauuuuuauggucauaggucuuacauuuaagucuuugauccaucuugaguuuauuuuuguauaaggugugaggaagggggguccaguuucaguuuucugcauauggcuagccaguuuucccaacaccauuuauuaaauagggaauauuuuacccagugcuuguuugugucagauuugucaaagaucagaugguuguagaugugugguguuauuucugaggccucuguucuguuccauuggucuauaucucuguuuugguaccaguaccaugauguuuugguuacuguagccucauaguauaguuugaagucagguagcaugaugccuccaucuuuguucuucuuguccaggauugucuuggcuauccgggcucuuuuuugguuccauaugaaguuuaaaguaguuuuuuccaguucugugaagaaagucagugguagcuucauggggauagcauugaaucuauaaauuacuuugggcaguauggccauuuucacgauauugauucuaccuauccaugagcauggaauguuuuuccauuuguuuguguccucuuuuauuuccuugagcagugguuuguaguucuccuugaagagguccuucacaucccagguaaguuguauuccuagguauuuuauucucuuuguaacaguugugaaugggaguucauucaugauuuggcucucuauuugucuguuauugguguacaggaaugcuugugauuuuugcacauugauuuuguaucuugagacuuugcugagguuccuuaucagcuuaaggagaauuugggcugaggugauggggcuuucuaaauauacaaucaugucaucugcaaacagagacaauuugacuuccccucuucccauuugaaugcccuucauuucuuucucuugccagauugcccuggccagaacuuccaauacuauguugaacaggagaggugagagagggcauccuuaucuugugccaguuuucaaagggaaugcuuccaguuuuugcccauucaguaugauacuggcuguggguuuaucaugaauagcucuuauuauuuugagauacguuccaucaauaccuaguuugagaguuuuuagcaugaagggguguugaauuuugucgaaggccuuuucugcaacuauugagauaaucauguaauuuuugucauugguucuguuuaugugauggauuauguuuauugauuugcauauguugaaccagucuuucaucccagauaugaagccgacuugauccugguggauaaacuuuuugaugugcugcuggauucgguuugccaguauuuucuugaggauuuuugcaucgauguucaucagagauauuggccugaaauuuucuuuuuuuguuguguuucugccagguuuugguaucaggaugaugcuggccucauaaaaugagugaaggaggagucccucuuuuucuauuguuuggaauaguuucagaaggaauguuaccagcuccucuuuguaccucugguagaauucagcugugaaucugucugguccuggacuuuuuucgguugguaggcuauuaauuacugccuaaauuucagaacuuguuauuggcuuauucagggauucagcuucuuccugguuuagacuugggaggguguauguguccaggaauuuauccauuucuucuagauuuucuaguuuaucugcauagagguguuuauaguauucucugaugguaguuuguauuucugugggaucaguggugguauccccuauaucauuuuuuauugugucuauuugauucuuaucucuuuucuucuuuauuagucuggcuaguggucuaucuauuuuauucaucuuuucaaaaaccagcuccuggauucacugauuuuuugaagguuguuuuuuugucucuaucgccuucaguucugcucugacguuaguuauuucuugucuucugcuagcuuuugaauuuguuugcuguugcuucucuacuucuuuuaacuuugauguuaggguguuaauuuuagaucuuuccugcuuucucuugugggcauuuagugcuauaaauuucccccuacacacugcuuuaaaugugucccaaagauucugauauguugugucuuuguucucauugguuucaaagaacaucuuuauuucugccuucauuucguuauuuacccagugucauucaggagcagguuguucaguuuccauguaguugugcgguuuugagugaguuucuuaauccugaguucuaauuugauugcacugugguaugagagacuuaugauuuccauucuuuugcuuuugcuuaggaguguuuuacuuucaauuauguggucaauuuuagaauaagugcgaugaggugcugagaagaauguauauucuauugauuugggcuggagaguucuguagauggcuauuagguccacuugguccagagcugaguucaaguccugaauauccuuguuaauuuucugucucguugaucuaauauugacagugggguguuaaagucucccacuauuauugugcaggagccuaagucucuuuguaggucucuaugaacuugcuuugugaaucugggugcuccuguauugggugcauauauguuuuggauaguuaacucuucuugcugcauugaucccucuaccauuauguaauggccuucuuugucucuuuugaucuuuguuaguuuaaagucuguuuuaucagagauuaggauugcaacuucugcuuuuuuuuuguuuuguuuuccauuugcuugguaaauauuccuccaucccuuuauuuugagccuauuugugucuuugcacaugaggugggucuccugaacccaucucaucugaacagcacauugaugggucuugacucuuuauccaauuugccagucguguguuuuaauugggggcauuuagccccuuuacauuuaagguuaauauuguuaugugugaauuugauccugucauuaugaugcuagcugauuguuuugcauguuaguugaugcaguuucuucauagugugaauguucuuuacaguuugguauguuuugcaguggcugguaccgguuuuuccuuuccauguuuagugcuuccuucaggagcucuuguaaggcaggcuugguggugacaaaaucucucagcacuugccugucugucaaggauuuuauuucuccuuugcuuaugaagcuuaguuuggcuggauaugaaauucuggguugaaaauucuuuucuuuaggaauguugaauauuggcucccacucucuucuggcuuguaaaguuucugcagggagaucuacuauuagucugaugggcuucccuuuguggguaaccugaccuuucucucuggcuguucuuaacauuuuuuccuucauuucaaccuugguaaauuugaugauuauguguuuugggguugcuccucucgaggaguaucuuuggguuguucucugugucuucugaauuucaguguuggccugucuugcuagguuggugaaguucucccagauaauauccugaaguguguuuuccaacuugguuucauucuccucaucacuuucagguacaccagucaaacguagauuuggucuuuucacauagucccauauuucuuggaggcuuuguucauuccuuuuuauucuuuuuucuuuaaucgugucuucucucuuuauuucauuaaguugaucuucaaucccugauauccuuucuuccgcuugaucaauucagcuauugauacuuguguaugcuucacgaaguucucaugcuguguuuuucagcuccaucaggucacuaauguucuucucuacacuggguauucuaguuagcaguuccucuaaccuuuuuucaagguucuuagcuuccuugcauuggguuagaacaugcuccuuuagcucggagcaguuuguaauuacccaccuucugaagcccacuucugucaauucaucaaacucuuucuccauccaguuuuguucgcuagcuggugaagaguugugauccuuuggaggagaagaaguguucugguuuuuggaauuuucagccuuuuugcacugguuucuccccaucuuuguggauuuaucuaccuuuggucuuugauguuggugaccuucagauggggucuuugaguggacaugcuauucuuuucuguuuuuuaguuuuccuucuaacaggccccucugcugcuggucugcuggaguuugcuggaugucuacccgacucuguuugccuaguuaucacccacggaggcugcagaacagcaaagauugcugccuguucuuuccucuggaagcuucuucccagaggggcaccugccugaugccagccagagcucuccuguaugaaaugucugucggcaccuacugggagaugucucccagucagaauaccugggggucagagacccacuugaggaggcagucugacccuuagcagagcucgaacacugugcugggagguccgcugcucucuucagagccaucaggcagggauguuuaacucugcuauaagucccugacuguggcugcugcccuuuuuucagagaugcccugcccagagaggagaaauagggccaucuggccacagcaaccuugcugagcugcagugggcuccacccaguucaaacuucccagcagcuuuguuuacacugggagcguaaaacugccuacucgagccucagcaauggcggaugccacucccccgaccaagcucuagcgucccaggucaaucucagacugcugcuaugcuggcagcgagaauuucaagccaguagaucuuaguuuccugggcuccauaggggugggacccaccuagccagaccacuuggcucccuggcuucagcaccccuuuccaggggagugaacaguucugucucaccggcauuccaggcaccacuuggguauggggaaaaaagaacuccugcagcuaguuuggugucugcccaaauggcugcccaguuuuguccuugaaacccagggcccuggugggguaggcaccagagggaaucuccucguuugcagguugcaaagacccugggacaagugcacuaucugugccagaguuccucaggcucagucccucauggcuucccuuggauaggggagaaaauuccccgaccccuugcauuucacaggugaggcaaugccccacccugcuucagcucgcccucugugggcugcacccacuguccaaccagucccauugagaugaacccgguaccucaguuggaaaugcagaaaucaccugccuucugcaucaaucuugcuuggagcugcacacuggaguuguuccuauuuggccaucuugccagcaauccaucacaaaaguguuuuucuuuugucauuugugcauauguaagaaggcuuugcuuaccccaggguuaugaagacuuacuccuauguuuucuuucuuuucuuuucuuuuuuuuuuuuugagacagacuuuugcucuugucaccgaagcugaaguggugcaguggcaugaucuuggcucacugcuaccucugccuccuagguucaagcaguucuccagccucagccuucugaguaccugguauuacagacaaccgccaccacgcccagcuaauuuuuguauuuuuaguagagaugggguuuuaccauguuggucaggcuggucucgaacuccugaccucaggugaucugcccaccucagccucccaaagugcugugauuacaggggugagccaccaugccuggccuuccauguuuucuucuaaagauuuuauagcuguagcgcuuauauuuaugucugugaucuacuuuaauuuuuguguguggugaaagaaagggguccaacuucauuuuuuuuuuuuuuuuacauguggauauccaguuuagaagacuauucuuuccacacugaauugucuuggcauccuucuuaaaaaucaauugacuggccaggcacgguggcucaugccuauaaucgcagcaauuugggaggccaaggcggauggauuaugagaucaggaguucaagaccugccuggccaagagggugaaaccccaucucuacuaaaauauacaaaaguuagccagccgcgguggugggcaccuguaaucccugcuacucgggaggcugaggcagagaauugcuugaacccaggagguggagguugcagugagcugagaucgugccacugcacuccagccugggugacagagugagacugugucucaaagaaaaaaaauauuaauugaccauaaguaugcacaacugugaacaguuuauguccagagaagagauuucuguggugacuuuuauaacuuaucaaucauguuuuaaauaaauaaaauaguuauguucauuuccaugcaauuaaacguauauguaagagaaaauaauauuuuuuuauuucaauagguuuuuggggaacagguggugguugguuacauagauaaguucuuuaguguugacuucugagauuuuggugcacccaucacacgagcaguguacacuguaccuaguguguaaucuuuuaucccucauccccucccacucuuccccccgaguucccagagucuauuguaucauuuuaugccuuugcauccucauagcuuagcucccacuuggugagaacacacaauguuugguuuuccauuccugaguuacuucacuuagaauaaugaucuccauuuccauucagguugcugcgaaugccauuauuucauuccuuuuuauggcugaguaguauuccaugguacauauauaccacauuaccacauuuucuuuguucacuuguugauugaugggcauuugggcugguuccauauuuuugcuauugugaauugugcugcuauaaacaugcaugugcaaguaucuuuuucauauaaugacuucaagaaaagaauauuugaugacaaaaaugaaauguuauuacugaaggaugguggaauuauaggucaauauuuauaguuuguauuuauauucaaauuaaaaaugagcaugauuuacuguuauaaucagaaaauaucuuaaaggguuauacauaaucauacaaccuuuuagaagguugggaaaagagaaaauuagucaaguuugaaaucuuaacuguauaaguguaauucaagucuugauuuaaucucuaagcauaggaaaaaauguuucuucucuagauaagucucuuaugugguuugauaagaccccacugucauauacacauuggagagcaggaagaccaacuauaaaaaaugagaaguuuuuggcugguuuaaguacugacggcuucugggauauucaaaccuuuaaaguuauugaagaagcaguuuauuuucaccagcacagcauucuugcuuguaaaauugaaauggguaaguauaguaaaauauagaguuuucuuucacuccagggaaagaauauaaggcuauuaguuccaccagugggaaucauacaaucaaaugcuuccucuguauucaguccugugcgagguguuacagagguuaucgaggaaggaaaagauacgggcccugcugucaagguuuugacccuaaggaguaaaauguaguuguggagacagcauuaaauuccuuaucauuguuuaauguaaauuggucuuagauuaauugauacaggcuuaaauuguggggaagucaaaaccgauacauuggaaaggggaauaacaaaaaaaaaaggaaaggcuucaagaagaggugaaacuugguugggguuugaaaaauggauaggguuuauauaaauaagaaaguguuuggggaacgaguuuuaacauuccgugcaaagugaaugucucuccaccuugcuuaaucuuuaaauaaaucuauuuuuaaauauauguuaguuuuaauuuuuucacagcuuaaaaacuguuaauuauuaccacugugcccuaaaacugucauuacucccacugugcccaaagcucccugcucacugggagcccguaaagguggagugcuggcuaguuggcucacuuacagcgccgcagucacuucccaagaccguguccaccagcaaccuccagggauuccuuauucuaaccuacuuugagugcauguaaacuuuugagacauuuuagaaacuuagucucuauccccaguuucuaggccuucucccaguucccuguuuuuccccauucuugcucagcaaagcaucuuuuucucaaucaagcuggucucuucauugucccaggcacaguguaugcccauccucauacuugcaccuuuauguuuuccuucugccaagaaguuuuccaauuucuuucuuucuuuauuuuuuuuacaucuuuaauaaacuuuucauuuuaggauagcuuuagaguuacagaaaaguugcaaagauaguacagagcauucccaucuacccuacaaucaauuuccccuacuguuggcauauuacuuuaguaugguacauuugucacaacuaauaaaccaauauuuauccauuauuaucuuuaacuaaaguccacacauuauucaaauuucuguaguuuuuauuuaacauacuuuuucuuucuaggaucccaccuaaccuuuaguucuccugccuccuuaagcuccucuuggcuggcuguuuucucagacuuuucuuauuuuugcuggccuugacaguuuugaggaacacuggucauguauuugguagaacgucccucaguuuggguuggcguauguuuuucucaugauuaaacugggguuauaaguuuuugagggaagaccaaagaugugagggagcauucucacuucacauggacagcauguacuauucauaugacuuaucacuggccaccuggcccaagguaguguuuguuagguucucugcugcaaaguuaccucuuuuccuccuuuccauacugucuucuuuccaaggaagucacuauguugaguccacacuuaauaggguagaaaguuauccuccaccuuccuaugaggggaguaucgauauaaauuacuugaaauucuucugcacaggauauuugucuauuuucuccaauuuuuauuuuauuuuauuauuuuauuuauuuauuuauuuuuuuggagauggagucuugcucugucacccaggcuggagugcaguggcgccaucucagcucacugcaaccucugccuccuggguuccagcgauucuccugccucagccucccaaguaccugggauuacaggcacgccccaccaugcccagcuaauuuuuuguauuuuugguagagacgggguuucaccauguuggccaggauggucuugaacuccugaccucaggugauccccccgccuuggccucccaaaaugcugggauuacaggcgugagccacugcaccuggccccaauuuuuaaauuuauucagucauuuauuuauacccucaucauuguaguuuuuuuguuauuuguuuguuuguagcacuuccauacuuucuccuuaccuucuuuuuauucuugauuucccccaauccucuagaccuaguauagguucauuguuauuuauuuuauacuuuggauuauaaucuaacauacugcauucuguaauauuuugcuuaagucuuuccagcuuuggcccuugggagcucuuucacuuggcucccaugucccuugaaauaaccucgucauuguggcuuugcuguuugugcuuguuuuaagcacuuccuuacuuucugguucccuuauuucuuuuuagucuuaauuucaccuaacccuugagaccugguuuaucaaguagucuuccugacucuucucauucaaaugaaucucuaccaauuucacauacccuacugguuaacaguuuugccaucauuucagccauuguuguuucugucuccaacuaauauaugagcuucuuaaaucaaagaaaauguuuaugccuuuuaaaauaucaaucagagaacuuuaagagccuaagauaugugucauaccaguaagaaaaauaaaauauacauuugaccucccuuauuaauaagaaacccaguuuuauuuaacuuuugaaaugauugcauguugucucauccaaaagauguauuugaaauaauuuaaauuuuaaucaccagugcuuuuaauuauuauaguugacuacaaagaagaauauaauacuacacugccacaguuuaugccauaugaagaugguauuuacaguguuauucaaaaaaagguaacaugguaugaagcauuaaacauguguucucaaaguggaggucacuuggcaagcguucacaaccaaaauggccagcucuuucuggaagauauuguaaaacgugauggauuuccacuauggguugggcucucaagucaugauguaagucuugcuucguuuuccagaaacuuuucaaauguguuauuuugaggguuagaaauuugagcguaaaguauuaacacaaaguacaacauuagaugaaguacugggacuccgcuugcauagcauggugcuuucuuaccuuuuacaacacagaacaaauagaaaauuuuacuguagcaugcacuaggacaaaugaucaggccaucccaagggcccaguggaugacuaucucaacaacaccucuauagccuauuugggacagacaaauuggaaagcugauaaaaaugaaauagcauagaaucagaaaacccugaguuugaguaccaguagcagaucuuccauuuaugugcugggugaucauuaaccuuugcaaccuuauuuccucauguagaaaaucaggguaauaauaauuucacugagauuuuaacacaaaaguuuauacaaaguaccaucuaaaauucuccacaugguuaggacuaauaaacguauaccuucuucccacuuuuccucuagaaaauuauacuacuuaggauuaauucugcuaguaaagacaucugugccacuauuugaaucauauuauuuaaucauuuauguacuuacaguagggucuuguguacaaaaaaugguuaucuauugagacuagaguuguaguuuuaauuuaaauaaucuuuagaacagaguggggaagauuuuuuuuuaaaagcauggcaaguuaagauuauaaauucaaggaaaauucaaaaauagucuucccauuuugaguuucuugggaaguguuucucuuuucuagcucccuacugcuugguguccucuguagugugaaaaauguagccagagacacaaaacacaaaacuauaaaacacagaaaacaauauucagaacaauaugaagguugggauuguaaauuuguaauuaugacaaauggaagccauuugcauguuguuuaauuucgagugucacauaaacucauccuucaaaaaaaucugaagaccagguguaguaacucugucuguaaguuuaaaguucuccauaaacuguaucagagcaaaugucccaaaucaaugcaucagaaguaaaucagaccuacaauaauaguagguucagaccuacaauacuguaagcaaauaauuaauauuccauuauaauauuucuuaaaguauguauguuguucuuuguauucuuuuugaagucaaacaucuggauucagguuaucucuauuguucuuacaacagggaagugaaucaaguuuugaauggucugaugguaguacauuugacuauaucccauggaaaggccaaacaucuccuggaaauuguguucucuuggauccaaaaggaacuuggaaacaugaaaaaugcaacucuguuaaggauggugcuauuuguuauaaaccuacaaaauguaagacuucaauuucaguaacaguacauuuaugaaaaugugacauaauuuaugcacauaauuaaaagcucaguggaauuuuuauuuaaagauuuauucacaagggccgggcgcaguggcucgcgccuguaaucccagcacuuugggaggccgaggcgugcggaucacgaggucaggagauggagaucauccuggcuaacaaggugaaaccccuucucuacuaaaaaugcaaaaaaaauagcugggcaugguggcgggcgccuguagucccagcuagucaggaggcugaggcgggagaauggcgugaacccgggaggcggagcuugcagugagccgagauugcgccacugcaguccagccugggagacagagcaagacuccgucucaaaaaaaaaaaaaaaaaaaaagauguauucacaaauaauuuuugugaaaauaauuuugauacuuuguaaauggaaacaaauacaguauaagcacucagggaauuuauucccaaugacuuucauuuguucugucaccagguaaauucuacccuagaauuugugaauucuaauuucacuuagcaauguuuuucaaaggcugagaugcuuauuucaaaaaagggucccacaacauauaaauuuggggaacaccucaugugauuuaccguauuaaaguuucuaagagaguuucuuuucuuuucuuuucuuuuccuuucuuuucuuuucuuuuuucuuuucuuaucuuuucuuuuucuuuuuuuuuuuuugacaggguuucagcucuguugcccagacuggagugcaguggcaugaacauggcucacugcagccuugaccuccuaggcucaagcaguccucccaacucagccuccugaguagcugggaccacauacacaugccaccacacccagcuaauauuuaaaauauuuuguagaguuagggucucacaaugcuguucaagcuggucuugaacuaggauccuaggcucaaacaauccuccuguuucagccucccaaagugcugagaguauaggugugagcuacuacgccuggccaaagguucuaagagaguuucuguaauaaugaagucuguuuaacuuuguguaaccaagcauuuuccaaauuuauaugauccuuaaaguuuaagggaagagccucuuccauuagaggcuggacuuagggucaccccugguggauaaagcaugaaccuugaggaagaccacaaaaaaacaaacuaccggggacugcagaggccugcaggacaggcuggggggugguggcauugguuuccgaagacucugguucucaaugcucaccauguuuucugcucugaagaaucuugaacggcagauucaacauuugguugaacagauucaggccgaagaaaaugugaaaacuuuagagaagcagguuaauaaaagaaagggagaaugauauaaaggaugaggaaucaagguacaaucaagaacugacuucucaguuguuaggcacagaaaacaaauguaacucuuuagaaaaacaauuggaauacaugagaaauaaggcaugcagaaauagagaaacaggcuuuauaggauagagaaugauaagauggccagacauaaguucugugcucuaccagguugaagagugccuccuccccaaagauucccguccagucagaaccuuagaaugugacuuuacugagaaauagucuuuacagaucuagguaguugaggugaggacauauuggauaauggugggcccuaaauccaaugacuaguguccuuauaagagggagauacagacacacagagggaaaaaguccacgugaugacaaaggcugagauugcagugacagagugauaaaccaaggacugucggcaaccaccagaagaugagagggaggcacgagacagauucuccaauacagccuccaaugaaaaccaauccuaacacccucuucaauucagacuucuagccuccagaacugugagagcauacauuucuguuguuuuaagccaccaauuuuguggaauuuauuauggcagcccaaggaaacgaauacaagggcuaacuuuaaaaacuggaucuucaaaaaaaaaaaaaacaaaacagagaauaacaggcauuagugaagauguggagaaaauggaacccuuaugcacugcugguaggaauauaaaacaguguaaccacugugcaaaaugguguggcaauucuucaaaaacauguacauaagauuacuaugugauccagcacuucagguauauacucaaaacaacugaaagcagggauucaaacagguguuuguacaaccaugucauagcagcauaauucauaauagccaaaagaugaaagcaacccaaguguccauggauggacgaauggauaagaagccuuaaaaaggaaggaaaugcugaugcaugcugcaacacagaugaacccugaagacaguaugcuaagugaaauaagccagucacaaaaagacaaauacucuaugauuccauuuauaugagguaguacccagaguugucaaauucauagagacaggaaguggaauggcaguuaccagggacuagauggaggggaauauggggaguuauuguuuaguggguauagaguuucaguuuugcaagauaaaaaauuuuagagaugggugguggugauaguuguacaacagagugaauucauuuagcaccacgggacuguacacuuaaaaaugguuaaggccagauguggugguucaugcuuguaaucucagcacuuuggggggcugagacagguggguggcuugagcccaggaguucaagaccagccugggcaacacaguaagacuccgucucuacaaaaacguguaaaaauuagcuggacacaguaguacaugccuguaaucccagcuacuugggaaacugaggcaggaggaucuauugcacccaagaguuugagacugcagugagcuaugauugcacuacugcauuccaaccugggugacagaauaagacccugucucuaaaaacaaaacaaaaccaaaaugguuaagaugguaaauuuuauguuauguguauuuuaccacaauuaaaaaaaauggaucuucuugaacaggaauguaacacacuuaccacgaugcaagcccuuacagaaaaaaaaaaaaaaagaguuggaagcaaaacuucaugaagaacaagaagaaaaaaaaauguacgcagccuaagagaccccaguugcagacuauacuagaaacaaauagaccaaagauaaggcaguuccuuauguugccagugcaagaaguaauguuaaaaaaaaaaaggucaaaccauucagaaaaguucccuauccuaaugaugccauaauaaucaauguucaacaaguuuugcauuaacaauugagcccagugcaacaaugaguaaucagcaauauaccuuugcccaaccaacuauuuucauaaggugguaaaaacaagaacuuacuaguaacauuucuuuucaacagcagcauugaugaggaguugugagaaguuuuauagauuguauagaugaauuuggcaaaugcauuuugaucugcagcagcugggaaacuuacccaggaguccaacugcugaacugaagacuuaguacucaaauugguguguuagugagaagaauggaggcaaaagccaaucaaauaaccgaaguucaaaaagaucaagucugguuucuaacagaagauagagaagcagcagaaggaacuaagggccacuaaagagucucacaguagccgccauuccucucuaaucacagagaccacaaauaaggacucugccaaguggagauuuggagaaaaaaacagaaaaagccuuuacuuacugaaggacauaaagaucauacagaaugcauuacaaaacaauaguuuggguugagauuacugacugguaccaggucagauauuugauucagauaagcuguaccgcacuaauacgacauugacaauuuacuuuccaguuuucauaugcucuucgguuggaauuaaaaacagguguuaaagggcacaagcugcauuccucaggcugcuucuguuacucagcacaauuaaaaaucaauuuaaauggaaaccaggggcauuuuuaagagcuaagaagccacuccuagucuuuuuuuguuugagugauguugcggugcugauguauuaugcuuuguaaaacaaauuagcuauuuuuaaaaaauaguucuucuuaugacuaaguaaaacuagauuuauuuagauuaucaaaauaaaaaggaauccaacgggcuaggcgcuguggggucacgccuguaaucccagcacuuugggagccugaggcaggcaaaucacuugaggugaggaguuugaaaccagccuggccagcauggugaaacuucgucucuacuaaaaaaaauaauaauaaacaaaaaaaggaauccaaagaaagaaauaauuuuaauuauuauuucagaguacuuucaggucugccuggccugucuuuacuucuuuuucuagucugucuuucucauuguuucuacuuuaguccaaaucagucuuagaaagcuaaggcacuuuccacuucuaucaccuagguuuuuuaaacgguauuccaaaaaguuaauuaaaauauguauuuauagagugugggcuguggcuuucucugguaugaguuaaaugcuacucaaccacaaacgcaacaguuccaaucagggacauugaaguagauuuugaaaggcagucuuuuuuuuccaugcauuguuacaacugugucuaacauuuuuauagcuaaaaagcugucccgucuuacauauucaucaagauguccagcagcaaaagagaaugggucacgguggauccaguacaagggucacuguuacaagucugaucaggcauugcacaguuuuucagaggccaaaaaauuguguucaaaacauggugaguuaaaauuuguugauuuucuuaugacucaauaauuuuuagaaauguuucuuaaggauauaauuugaagcaaugauuguauuuuugaaaauauuuuuaaagcacuuuccauuucuaauagcgcuauaaacuaauugcccagugguagggaaaugguuaaguaucugaugacauaggaacucaaugaaauauuggaauagccauuaaaaacgccuguaaucccagcacuuugggaggccaaggcgggcagaucaugaggucaagagaucaagaccauccuggccaacauggugaaacccuaucucuacuaaaaauacaaaaauuagcuggguguggucgcacacaccuguagucccagcuacucgggaggcugaggcaggagaaucgcuugaacccaggaggcggagguugcagugagcugagauggcaccacugcacuccagccugggugacagagcaagacucuaucucaaaaaaaaauuaucaauguuaauaauaaguacauggaaaauaauaaguuggaagaaguagaauuuuaaagugguggcugggugcgguggcucacgccuauaaucccagcacuuugggaggccgaggugggaggaucacuugagguuagccauuaaagacuagcgugaccaacauggcgagcccucgucucuacuaaaaauacaaaacuuagcugggcgugguggcgugcaccuguaaucccagcuacuugggaagcugaggcaggagaaucacaugaaccagggagguggagguugcagugagccaagacugugccacugcgcuccagccugggcgacagagcaagacuccaucucaaaaauaaauaaauaaauaaaauaaauaauaaaaauaauaauaaauguaaaauaauaaaauaaaaguggcuaagugaacugcuaaguaaaaauacugacaaaugauuggaaacgguuuuaccuauagcuagauaugcuuagaaaaaggaauuaagagguaaaauuuuuguaaaguuagcuaaguaguaaauaaaaauuauaguuguuccauugcuuaguuauuaauacauaagcuuagccucaccaggguaacaaaucaaaguaguaugguuguccauccguucugcaauaggauuggccacauccucugaccaccauaaagggcagugcuuuuugccuucagauuuagcuauuuuagaaagaguagcaaugauuggcucuuucccgugacaaauuugauccauagucaaacuguaaaaugacuucuaggggaacuaccuagaguauuucaaagaccaaaacuuguuuaccugcuuccuuggguagcaaauuagccagguagauggauggcauuuaucuaauuuauucugauaaccguuguggagacacuugacugauugaaaaaucuuguaguuaccgggaacuuuugugugggaaccauucgguuuuauaccugaauacacaugauggaaacuguuguaagauauauguauguuuugaaagucauaaaccuuuuucuccuaaaggagaaaacagaaugguuuacuguaaaacuaauauguagguuaagcacuuaagacuuggaggcaugagggucuggguucaaaucccaguucccacauauccuagcuaaguggcauugggagguuacacaacucuuucucuuuucucaucugaacagucagagaggucucagggguaggcaguuccagggccaaaaaaauauugccagauaaauauuuugaagaaacacaaaauuucuuuauacguguuuggaaguaauuuuuuugaaguacuuauaaaauuuugaccuaaauaccaguuuuuaaaaacugucucuguguaaggcuugaauuuaucaaugaucuuguuaauaauauauguauuuuucaaauggcuaguugagaauaaacuacuucucuaguuuccauaaagcuaauugagaauguguuuucuuucaacagaucacucugcaacuaucguuuccauaaaagaugaagaugagaauaaauuugugagcagacugaugagggaaaauaauaacauuaccaugagaguuuggcuuggauuaucucaacauucuguugguaagugaaauaauuguauguguagugugcaaagagaguucuaacucauccuaaauaacaagucguccuugcuaaagaauguuaaguaguggcuaauucagaugccucuucuggauaaauaagcuaggucgcuggcuguucuggaugguuauaaauuuugaaugaauccaugaguuaacuuagcaaugacggaaaccacuaaugacacagaaaauccuguuaaauaaaguggaaucuuucuagaggcuuauuucugggauccuuggaucaacaucaggacauuuucuucuccacaggaaugucuguguccccacaaggaacccaugccugccuucucuuagaguucuagugccugucaccgcauggauuugcagcuuauaacuucguuauucagaaaguuaucuucuuguuauucccuucucucuaagaauauuuuuaccacugguuaaaauuaugucuuaauaguaaucuuuaaaaacugucuuaguguuagguuggugugaaaguaauugcagcuuuugccauuacuuuugcgccaaccuauaaaauugcagauaauugauucaaagaaaauuuguggaaggauuuuuuaauacgaaauaguagauacaggguuuaggugaacuuggaauugguagaaauaagaguacaaauaugacagaagauaagguuuuucacauuuuaugcaaaguugaauuuuaaauuauuaaaaugugaauuuuaaaauguuaaguacuugucaaaaaauaaaaggauuccaaguuguccaucuaaaugaauccuaaaucguguuuacacugucaccacaagguggugccacuucagcuggaaagcaaaaauggaguccuggugguggugugggagaaagguggggauggagauuccugcacccuuccucuuccaccagcauaucuuuaaugauaugacuuuuuacaauuagaguaggggaaggauauggguccuuagaaaucucucccucacaaaauaaaugugcaagcauucugcacuuuaacggaaacaccacauucucuaucuguguuguccaauagaacuuucuacaaagacagaaauguucuauaucugcacuguccaauauaguagucacuggccacauguggcucuugagcacuugaaaugugacuagugcaacugaagaacugauuuuauuuuuuucauuuuuaaugcauuuuauuuuaacaaguggcucucauauuggacagcacaguucugaugaguuacaugaacccaugcuuguaacuuacuaguuuaguggcaguagacauaguuguauuuaauuucuuucuucagaccagucuuggaguugguuagauggaucagaagugacauuugucaaaugggaaaauaaaaguaagagugguguuggaagauguagcauguugauagcuucaaaugaaacuuggaaaaaaguugaaugugaacaugguuuuggaagaguugucugcaaagugccucuggguaaguauggaaccuguccuuaggagacuuuuugcagaacagucaggaaauaaauguacaauccaauuauguacaaaauucuguauuuagucuugaaguauuuaguccuuaaaguauauccaacuaucuugauuaagucauagagauuucccccugaaaaauagauuacaagggacgauaacugcacaagauguccaggacuccagucuacauuuuauauaauucuuuccuaagaaaaacagaaguugccaggguauuagggaaguaauuucuuuuaaaauguucuugagauguauuuuauucuauaguuugauuauauaaaagcuuaaaggucuauuucugcaguuaauuugcuuccuuucuuccuaaucccauaaaacucaugguuaauuuuaaaacaaugcaaaacuggauuuaguuauugaaaacauucaggguaucuauaaaaaaucauaauuugaacuuacauuucauuaugaauugauacauaaaauuaccauuaaaauguuauauuaacuucauuucuggagaaagagcuccaaauuuuucacaguaacauuuuuaaagaucuugcauaaaacuuuugcuucuuguauauaaauauuaaagauaaaaccucaauucuagguaaucaguauccauguauacacacacugagacaguaaauagagugucuacuauaugccaugcccuguuuugcacacugggaugcaccugagaacaagacagauaagguaccuguucucacagagauuacaaucuggugaagaaagauaaguaaacaggucaauuuuuuaaagagaggaaaauaucaaauaguuauaaacucuaugugauggagacucaguggauagcuacucuagauuaggaaaccagggaagaagccuagaagcaggagacaccgaagcuaagaucuaaaaaaucaagccaagcaaacuucaagggaaagggcauaacagacagagguaccaguuggagcaaagagccuaaggcagaacaaguuggcugagcgcucagggaagaacugaaagguaggcaggugcuagacauacagagcuuuggaagcaaggcuugaguucugguuuuauucugaguggaauggaaagcaacuggaagauuugggggguugggugggagcagaguuaggguguugcaaaucaaaaguucuacguuggccauuuugaguuauccauagagggacgagauguguagugugcauagcaaugguauuuaaagucauggaacagagcgaauccaucugggcaguaugcagauaagggucuuggaacagcagcugcacuaaaugaacucaucugagagacuuaaaucauuuugaagcaaauaacacuuuauuuagccccagguaagucaaaaacaaaaauuuauagcuuuuagcaauuugcuaucaaaguaggauaauauacaaguagugauguucccaaauugguguuaggaagggggaaugugagaauaaucauagcgcauuaaugucuuuggaagaaaauuccuaucacaaugaagaggauuugaaugaauaggaaaacacuuacauuugaaaagaaaucacuuaaguguuucuuuugaucugacgaugaguuugaauucuauguuagcgcuaugaaacaaucagauuuauuaugucuguauacagcuuacagguuuacaugugugacacaacccauaauguauaaaaucaauaaugaucacuuuuguauucucuccuccaacaucaaaccuuuuccuguuccaggcccugauuacacagcaauagcuaucauaguugccacacuaaguaucuuaguucucaugggcggacugauuugguuccucuuccaaaggcaccguuugcaccuggcggguuucucaucaguucgauaugcacaaggagugaaugaagaugagauuaugcuuccuucuuuccaugacuaaauucuucuaaaaguuuucuaauuugcacuaauguguuaugagaaauuagucacuuaaaaugucccagugucaguauuuacucugcuccaaaguagaacucuuaaauacuuuuucaguuguuuagaucuuaggcaugugcugguauccacaguuaauucccugcuaaaugccauguuuaucacccuaauuaauagaauggaggggacuccaaagcuggaacugaaguccaaauuguuuguacaguaauauguuuaauguucauuuucucuguaugaaugugauugguaacuaggauauguauauuuuaauagaauuuuuaacaaaacuucuuagaaaauuaaaauaggcauauuacuaggugacaugucuacuuuuuaauuuuuaagagcauccggccaaaugcaaaauuaguaccucaaaguaaaaauugaacuguaaacucuaucagcauuguuucaaaauagucauuuuuagcacuggggaaaaauaaacaauaagacaugcuuacuuuuuaauuuuuauuuuuuugagacugagucucucucuguugcccaggcuggaguacaauggcgugaucucggcucacugcaaaucuccgccucccagguucaagcgauucuccugccucagccuccugaguagcugggauuacaggcaacugccaccaugcccggcuaauuuuuguauuuuuaguagagaugggguuucaccauguuggccaggcuggucucgaacucgugaccgcaggugauccucccgccucggccucccaaagugcugggauuacaggcaugagccaccgcgccuggccucugcuuacuuuuuauauagcaaaaugauuccucuuggcaagauguuucuuauauuauuccaaaguuauuucauaccauuauuauguaaauaugaagaguuuuuuucuguuuauaauuguuuauaaaacaaugacuuuuaaagauuuagugcuuaacauuuucccaagugugggaacauuauuuuuagauugaguagguaccuuguagcagugugcuuugcauuuucugauguauuacaugacuguuucuuuuguaaagagaaucaacuagguauuuaagacugauaauuuuacaauuuauaugcuucacauagcaugucaacuuuugacuaagaauuuuguuuuacuuuuuuaacauguguuaaacagagaaaggguccaugaaggaaaguguaugaguugcauuuguaaaaaugagacuuuuucaguggaacucuaaaccuugugaugacuacuaacaaauguaaaauuaugagugauuaagaaaacauugcuuugugguuaucacuuuaaguuuugacaccuagauuauagucuuaguaauagcauccacuggaaaaggugaaaauguuuuauucggcauuuaacuuacauuuguacuuuauuuuuguauaaaauccauagauuuauuuuacauuuagaguauuuacacuaugauaaaguuguaaauaauuuucuaagacaguuuuuauauagucuacaguuguccugauuucuuauugaauuuguuagacuaguucucuuguccugugaucuguguacaauuuuagucacuaagacuuuccuccaagaacuaagccaacuugaugugaaaagcacagcuguauauaauggugaugucauaauaaaguuguuuuaucuuuuaaguaaaaguaaaagugcuggaguugauccuucuugaaaaaaaaaaucucuagauuggguuuuuuauguuaggcauauaguacaagaaauaaauugaccaccuauuguaaagcgaggcauuugcuaagagauuuugugugcauuuuuuagagaauaaau

SEQ ID NO: 13210 - RNA, 924 nt, Homo sapiens
aguaaaaucaaauggggaacuuugaauuuaauuguuugucaggcauuuuguauaucuccucugggguuccugauucucccuucuguacucccuuccuuuaacuccccacuuucagaacucuccuugggguuucuuuccuauuccacagaccuauuuggguuccagugcauaaaugcaacuauaucucaccuucccagguaucugagucaggugagaagccucuuucccuuucucugauuuuauggucugauagcauagacucuuucauuaucccuggucuacgaugacccacauuccucuuaaccuccuccuuucuugcaguguucuggggucagucacacugcaagacacccagaucagaacugggaaucaugagauuaguucucauguauugccacaaauuagccauguauuacuggugaaaucaaagaauauuucuaagucuugcuuuugucaucuguaaaacugugcuuaaaacagauuugugaucucucaaauacuaccauguaauaagagagaugagagcugguagaaguggccuaguugucuucaaagaaaaggaaggcuguguggagauggacuggaacuuaaagaugaccauuaugucucaggccugguuccugguuucaagccacagaaacauacucuuuucugguccaggggaugccaugcuuuggcuuacucaacuaaacaccugcaaaagcugagguagaugucguaaugccaauauaugacuguucugccaucuaagaaagccuggugucccuguuguggaaucacugcaccaugacaaguuccucaggucuagacccccuuucuggugagacugcccacaccuaugcaccuccuacagcaauguuccagagcugccacugcccaaacaaaaucauacaugagacugaggaggacaucacaaugucaguu

SEQ ID NO: 13211 - RNA, 3015 nt, Homo sapiens
ugugguacagugaacacagcgguaaacugaggcaccccaaagcauggcuaacuacaugguagccauaccucaacuuccacaucugaagaauagagggcuagaguagacaaugucucagguucuuuucaauguuaagauuuuguuuuuccauuuuguauugacaguaaaaacuugacuucaaaccuguccagcuuacacuugaaauucuacucaugcaggugacuggagucagggagagagccugugccugugcgaggaaugguacauaaccuccgugcuccuuggaaaaucagcagcagcauuuucauaucugaagaaucucuaugccaacuaugucaaccuuuucagaugugcaaauugcaccuaguagguacaagggcuagcagauggcucuaauuucagagugcccuugacuacuaaaaagaaggcacugaugagaauuugucucaggccaguauuugguucugcuacauauagaagggauuagcccuucacucggaggaucaccagcacauacucucuguguggcccaguccaacuucuguccugugggcugcugcccuguucuaccaccuagugcccaggcaaaacccacauuuuaaaaugcaaaggaauaaccacugcaugguaaacuuagugggaaggaaucauacauacuacaggaucagaugugcauccacaggagcaauuuucugaauugaccaagaagguaagagcaucucugacuuuggucacuuuagaauaagaauggucuuguucuaccugccccugauuaagccuccagggagcuuaggaaacacagucuagaaaagacuaccucaaaaauguagacauauucuacuguggaggaaaaaaugugaacgcagauauugaucacaucuuguguuaccccuucucuccaaacuuaucuccaaaggcagagaggauggaggcugucuggaggcuccuccuggcauauuuaacucccuccugucccccuccuacuugcauauauggacuucugcacuuaggcgcaggcuucucugccugagguggcccauucucaaaugcgggccccugcaggccagaaaucucuccucccucucuuuacacaaccuucugagucucauguguaguaggugcucaauaaguguuugcugaauugaaccccguuuuuccacugagagagacuaaggcauaaaggcuucagaucacgcaguucauggagccacuggggcuucucucccucaccuggccugauguuuucaggcggggugcggugggucaggccuguaaucccagaacuuugggaggacgaggugggcggaucacuugggcccaggaguuggagaccagccugggcaacauggugaaacuccgucuccaccaaaaauacaaaaauuuugcugggcgugcgggcgcacaccuguggucccagcuacucgggaggcugaggugggaggaucgcuugaccccgggaggcggaggcugcagugagccgagaucccgccauuacacuacagccugggcgacagagcaagacccugucucaaaaaacaaacaaacaaaaaaaguuuuccuuaaggaagggauggacuggggaggccuggcuugggggucacuccuagguggcgacgcagacccugagcgcuugcuuugcaaggggacgaacugagccaucuuuuugcuaucauuuauccgucccaaauaagcagcucucagaaaguuuccguuuugaaacuucuccgacacuccuaucccgggcuggcuccgggcgccagagccgagaggaguuaccugcgagaccaagcccccccgcccccgccgcccgacccccgcaggagccaggagggugccgggccgcgcaaguggggugcugggccuagacaagaggcugcaggacaccacccgcuccccccaugcucaggacugcugacacacgaaccccuacaaacgcggccgcccuugcccgccagcuuggccccuagcuucgccccuucuuccucuccuucgaccaccccgaccccccuccccaacguaccgauccaguccccgacccugggagacucacccugccacuccaggagccgcucggggguaagcgccgccgccacacccucggcgcagccccgcggcgcccccagcagcagcagcagcagcagcgacggcgacagcagcaucgcuaaccacugggcucuccgggagccccuugucccgggagccccuuaucccgggagcccagagccgcgucccaagcacccggccccgccgcgcggaagcggauccguagccuccuccgcgccccacccccuccgggggccuugccagcccagagcccuggagacccacuccgccaccgcugucuccacagugaaccgacacucggggcucugggcugggaugcgggaaagucgcggagguuuuccucgccccacccacugcggcuuggggaaggaggaggaggaggggugggccaucugcccaucccagaaauuccugccuuugggguggggacaggcggagugaggcugcucgggucacacucuccgcuccucuagcuugcagcccugcucucuccuuucugggggaggccgaagaggaguugugggugagcgauuugagaaucuccgggacaaggagccugacauccggguuugcaaaccaccuggauucugguaaacaccgcggauuugcagcgggcagccuagagugaacccagcugcuccgcgacgcaggcgcuuugggaggguccuggacuccuuugacuuguggagcacuggagacaccugaggggccacgccguggucuccaccuuccuugccccagaguaacccggagauucuucuauucagcuccuucgguuuugaaauaaccuccucuuuccaacuccuuugaucccccaagccccgcaaaguagccggggucccuauuaucccauuuuuacagcugagaaacccugcccagaaagucgaagugcuuugcucuagguuacuuccuaauccagcaaaaguuacucucuagcaaguaggacagccc

SEQ ID NO: 13212 - RNA, 4280 nt, Homo sapiens
cugaaaaaaggucuuagggaaccccagggguucccaaaccacacuuugaaacuaauuacugagcuggauuaaacuaacugaauuaucaucacuccacauucuuuccuuuuuuucuuucuucucuaauauucacgagcucaauuaaaacugaaaaaaaauaauggcgagaauaagaacacuagcaugaaacaauggucccucauuacccacuugcuuguguggaaugaccagcaaggucuuuuuuuuuuuugagacggagucucucucugucgcccaggcuggagugcaguggcgcgaucucggcucacugcaagcuccgccucccggguucacgccauucuccugccucagccuccugaguaagcuggggaugcaggcgcccgccaccaugcccggcuaauuuuuuuguauuuuuauuagaaacaggauuucaccguguuagccaggauggucuccugaccucgugauccgcccgcuucagccucccaaagugcugggauuacaggcaugagccacugagcccagccugaccagaacauuuuaagccagaucuguaugcauucuggaagugacuggguuuguugaggucaucucuacccucgugccaccauauaucaccagcacuuccugguuacugcuuguuaaucuuuggagauaauuaacuuauguuucacuuugucuaccucuaauucucuccuacuuauuagugaguucaguaucccuauagcagauccuuuccaaugucuguucucucaguuccuuggccuccccacuucuagagauauuguucuccucuuuaccuuggccacuuauucccauggauaaacaauuguacuuuuaccauaacugcaaacccuccauaacaucaauuuuaagcagcuuacuauucuggucaauaacugcuauuuuucaacucauuuccugaaccccaauuccaauagucccccaaccucacaaacaacuacaaucugccuggaacucucuucccuaauuagucacuuggcucaauccauccugccgucuucagucuauugauccugcugguuuuccuugcagccucacuuacuuccucauuaucuugcuuaaauuucauggucacucauuauaaucacucccuuaaauuugcccccaacuucucugccuuacuuuuguucaucaaacucucuuggauaaagccaaacccuaguuaaauuugacauucugccuacacugugacuacacucacacaaaugaauauaucuagagaaaaauccacuaacgacaucaauauagauucaugaucauuaacauuaccagggcgauuaacacugccuagcaauuguacuguauuucccuagauaauuuacuguucuacucuccuaugugguuauuucuuaccuucucucuucucagauuccaacaccuccucccccauccucauucccagcuuauggcuuugcuuccuguguaacuaagaaaacugaagccaucagaagacacccuccauguccuccccugaugcauguguguacacauguuccaacucucuuccugcgauauaguugagccauccccauuucugaaggccagccccuccaguacagcccuggauccccucugcucuaaccuacucaagucauuguuccagccauuuucuucucuccucucucaucaguguauccucucuuuuuugucuguauugucugguaaaaccuuucaucauccuauugucuuuguagcuaaugcccauucuuuuccuuaccuuaagaaaaaaaaguaacaaaacaaaacacagcucuuugaaaaagcuguuuaucauugccucuaauuuagcuguuccugcucucuguugaaccuacucuaauugaaauuuauuucauuuuuucccccaauuugcuccuaucaagcucaccaguaacuuccacauugcuaaauccagugcucaauucucaggcuucaucuuccuugaaaagaauuugacauuugacagaauuuuucacucucucccucuuagaaacucuccucaccuggcuuccagaauauguugcugucuuggguuuccucugugugacagcuaugaaggaagaaaagagcagaguguugguuggaauugcacaggucuccguauucauuaggagauuaggucagaaagaaaagcaguugaagagagaaggcucagguggcucacuugggacugaaagagagcgagaaaaugaccuuugcaugacgugacaggaagacauugagccugauaagaucaucucagugagcagauggauauugacauucagcacaucagguccugaagaucaaggaucuaagcaaaaagccaagagaugcagcaaugacagggaaggguaaagauaaggguaauaauaucaaaaaucccaacuucagcgugguaaccagauuguacuaaugcauauauauguacuaccaugcauauauuuacugucuaacuuuuacaaaguguuuucacaucuauuaauugauuucuucacaguaucccuaggcaacacaacuauuguuauccuaauuauauagaugaagaaacugaggcuugcagagguuaaaacaacugucuaagauuauaccaggaauuuuaacagaguugggacuagaagccugauccagaaaaaucaagaagcaguucccaggcaguuucuuucuaacacagaaauccugggcaacugagucagaagcaucugauggcuugguccagagagaccagagaaucagcaucagaucuugagacugggugccagguauggauggcacagggcuggguggaaauauguagcaauacugacaagccagcgucuguguaaagggcacuuuaugaaggccaggaucccaguagaaggagaugagcugagcugagcugagcugagacagguagccuuagcagguggguucaccugauugaggggguacaguggagguagaggaagacaaguaauaucugacaaucaucccaaagaauaaaugaacccacaauucucuguggaaaaucugauguuuaguucccagaguuguuaggccuccagccuagggaagaggaaaauauuugauguuugauagccauuggagacugagugagagaugggaaagauagauuuuuucccucuuaaauucaucauuugaggaauuuuaaacaguccauggaaagugcauaauccucacaaaguagaggaauaaacaaguuauuuccuugaccugccauuugucacucucguuggaacaggauuuuugaaauuuccaguauaagaaguauauugaacaagcauggcccauugugaaaucacagcacuccccuucaaguguucaguggaguuaaccuucccuugccccaguugaacauucacgugcaucccaggacuuuucuagauacucuuggguguguaugugaggacaagaacguccuacaaucccuuuaguaacaagugaguggaauucaguaaucagaacaucuuacauaaccagaaacugaaacugauuuagcacuaaaccuuuuccugucccuguuccuuggcugcuccgcuguggauggcuuauucucuauuccucaccuagugcuuucccuccucccuucugaugcccuccccgcagcuugccagccaguuucugggcuaaggccagagcuagaagagagacaugguaaagggccaggaaauguccuucuuguacuggcuucgggcuuuccaggccuggcaaauguuugcagaugagucuuucuuucaugggcacuuucacgggcauccuguagguucccuggugggccccugcccugcaguccuguccuggguuaaugcauccuauuauggguggcccaagguagguagggugaccaacuaucccagcuuguccaggaauauucccauuuuagccuaaagggcccacaucuugugaaacuucugagauccgggcaaaccagaaugguuagucagggguuacucaugaguccuucuguagcccuuaauuaucugauauuaacuucaacuucuggcuucuggcccuucaaccaucuaggguccuuguacaaauucauaaaaaacccacacugacucacuugcccaaucaccccacacauagcuaguccacagaaaauauuccuuugccuuugaaaucugaagguauaagcuuuccauccugccugaauucaauauuugugaaagucaucuccaugugcauaggcaaagcagcucgcuggccucccuuccccuuuucuggagagaauucaggauuguccugggcccauuugaauggauucauucccaucaccucugagaaggcuuggcaau

SEQ ID NO: 13213 - RNA, 1482 nt, Homo sapiens
gcuccuccggccgaguuugcacaaacaaaacgcccuaggaaaacuuuucccgaagagaaguugggagggcugaucucucuuuucccacccaaggcuccuacguucuuuuccaaaggagacaguagcucgccuguucucccucgcggcuuccucuccuacucuucccuuccccggcccgcgcucuugccgcucggcucucaagccaggacuugaauggagaagcggcaaccccugcgaggcucagcccagcgcgggcagggccgacucagcaccuccccugucccgcgggcggggugcgggcgcuggcugggcgcugggggccucgcuggagcccgcucucucacucacccugccccauuucccugcccggaguccgggagcucgccgccgccucugcagcacggccgcacauaaguggggaccagcucggcggcauuggagcgagggaagcagcgagccggagagaggaacggggcgggggugggccgggagcaaguuggaauuuccuucccccagggcuucgggucuuugggguccggcuggggaagcugaaccgaaagaaagcucccagacgagguguucccauucccaccgcuaggcugcgcuucgggaaggcuggugcgccugaaccggacaggugcgggggaagggagguuaccugccuugccaggauccgcggggaggauuggggccuccgcggaaugcggucagaaacucgcagaguggggccugcagcuugcccccccuagaguccgacccucgacguccaggaucguuuuuuuaaauuuguguuuuuaacuugaccuuuaagauugccauucuuuuaaaagcgcaccugugacacagaucuuucuaauugguggcagguuuaagcuugcccugucuucagaggcauuuuuuguaaaagccuauaacagcucugacaugagaacuggacaacaguaugucuaaugacagucuauaaacuaagaauuaaguaauagauuguauucacuuauuggaacuuuuacaaggguaaaggaaucagacacagcugugugcuuguuuguacguuuuaguauccacgugcaugcccuuuagaugauucuuuacaccugacagacagguacuagguuggugcaaaaguaacugcgguuuuugccauuuuuuuuuuuuuuaaaaaguaaugacaaaaccgcaauuacuuuugcaccacccuaauauauuuacauauuuuauauuuuucauaagcgccaauuguuuuaagaugcgcgccauucugaugggcccaaaaauguguuuucagaaaacaacgugacauuaagaaaugaauuuaaaauuagaguuuuaaaaacauauuuggauuaaacugauggagagaucuuacaggaaggaacauccugcaggggacuucuguuguagcacuaacaucaaguaauaaaccuguguuagccacugauagaauaacauuuggcagguauuacaauuaaauugauauuaaug

SEQ ID NO: 13214 - RNA, 4771 nt, Homo sapiens
uauguuaagcugaggcuucuuucuuuauaaaugcaucauaaucccucugcugaaauuuaggaagcauccuaccuuaaucaggaacauacacauuauugcuuaugaaaguuaguugucuggauagaucacuaauggccuccauuuuaugaguucucauuaaccuauugguuucacagagugacauucucugacuucaaacucuauccaaaagaauaucauauagauuguuuuaggaagcugcagacuccaaaucuaaaagcauauuuuaaggcaugaguuuauuucauauacuuuccaaguggugaauuaauuauaugccuuauuuuuaacauuucguuauucaaacuuuauugggagaagagguuuuuggauaaaaggagaagggagggggaaaaaaagcaauagaagucauaauggguaaggaccaucaucugcagguaaauuauuguuacucgucuuugacaggugaaagaacuaaggagccuaaauguuaaaucugaaauacaaacugcucaauaaggauuuuacugaaauagaguuuuauuuuuucuguuucuauacaaaacuaaaacaugacuguuugaaucccauuaaagauaaagucucacuaauucuuggaauugugugcauauggcaucugaauaguugucauuaucuucaauuaucuugaccacacagugcuugaccaaguuuucuucauaguagcuugaggguacuugauguguuaaauaaugaccuguaaucacaguuaucuguaauggagcuagaaauagaauccacaaacuaguucuuauguagcauuuucugcuuucuguauguuuuuggggcauuuauguuuaugcaucuuauggucuaaaauuuuguuuucuuauagaaggagcauaucccagcgcucuugggaauggcaacggcuuauaugaucuugaaacagacuccacgagccagaaaccagcugaagcguauugcgaaaaugaauuggaaugcuauugaugcugaagaguuugagaagaguuggcugcuacuugcugauauuuacauucaaucagcaaaauaugacauggcagaagaccuguuaaaacggugccugcgucauaauagaguaggugauugaagaguaaaaaauaauuauugaccuuuguugcauaagcuuuccauauagauauuguugaguguuaguccauuuccaaggauuccugugugauuuuugaaaauuaaauguuuauucuuaccacaaucaggaaacaagcauuaauaauaagaaaaaagccauuuguccuuuaaaguuuaaaaaaaagaaagauuuaugcaauuucaaguuucagcuguagugaugcccuacuuaacggaaaguguuuuuggaaugucaaacgauugccugugauuauccaucucaucccagaacuaaugaaaauugcagaagaacauuaauugcggacgucugucccucccauuaagaaauacucuugaugaauuuacugcagcugcaugucauuuucucauuauuagaaucuauuaugcauaauauauuuugugggagaaaaucuuuucagcuuuuaauuucauuuguuuaauaaaaauuccuuauauuuagguauaaaauugaauauuauaaaguccuuagaauuuaaggcuuuuuacuaacauuuugauguuuaauuacaaaagaugucauuauaacaguucuuuaaaguuaagauuuauuuuuuuguugagaaauaauugcacacaacuuagaaaugauauuuaucuucauauauucauaucaauuacuucaaaaucuuaaucacaguaaaucuguuuuauucucauugagcgaauuagauuacaaauggaccguuuauuuuuuaaagaggaauugugauuaucuaguacuauuaagauacuuuccuaggaacuuaagaaccugaaagauccaagcauuugucaauuuaugcacuauucuagacgauuagcuacauaaauuuuauguuaaauuggcuuugaaaagccgaaugcucauuaauaggcuuugaaaaucuaaacugcugaauaguuuacccuucuauaucuagucuaggauuaaccaagauugcaugagaauuucagugcacauacaauuucaguuugccagaacgcugauaacaauacauugcaugguugaacaugauggcugcuuuagaagcuucauucagcccugcugguugaauauguugauauugaaagcaugauauuuaagaacuaaagcuuaggaaacuugaauuacauaauuuaaaaaauggaagucauccauaucuggggcaggaaauguacaagacgacacuagacugucuugccauaccagaugaugaaggaagcuauccaugaugauuagaguuugugugaaagaucuaggggccaacuuaaagacaccucuaguagccgaaguugggaugcuuuaaguauugauaagaaugauaacugcaauauauugaaauacauaaaaucuguuuaaauccaugacuucucgaagauccaaaauagaaaaaacaaaacaaacaaaaaaccuaauugguaaccacugcaguaugcuagugaacugacugcuauuucuaaagcuugcaaauaaauauccugccuuuucuguacagaauugguuaaccaaauagucaaugagacguuucucaucauagacauuuuccagcuaauuaaugaagaaagacugauaggcuauccccauuuuucaacccugauaaauuuauauauggauguaacaucacaaaaagagggagaaucagacauucugugccucccaacagaagaacagacaucuauggcagggcuaggguugggaugagacaagugaaacacuuaguaaucaagauaaauaauaauuuaaugcagcugugcugagcuuuauuggagccugaaucaaaagggaauaugugcauuccuauauucauauuuuuauguuuuuuaaaaaauggguaauugguaaugguuuuaaugaaaauauuacuggugagauuucuuccauuaaagugagaaaaguaaaaugauaagaaauuaaguuuagguauaaauaaaauguucagucuuaaauguagugauuuuuaauauauacuuucagauuuuucaauauuuuuaaacucauauucuggaaaaaaauuacaauuaagaaauauacaaaaacaugcauccauguuuuuaugccucaguguggcuuaucauagcacugauguuugaaguagauucaccucucuccuccagaaucaaaauugaauccaaaccucuacaucuaauuacaacuuccagaaaacgucagugacauaggaauauauuauauaaacaccacaaggaugcagucaauuaaccugcguugugagaaacucggggauaaauauucuuguuucuauuacauuuaauuucaagaaaagagacacagagagacagacagacauaccagaagggaaaccucuggaucaagagacuagaucaaaacauugaccaguuacaauguuugguccuuauuucaguccucaaucuaacaaaaacaaauuauauugagacaauuaaaauuuagacaguacuggauauuuggugcuauuaaggagucauuaacauuuuaggugugauaaaauugugguucuguuuaaauaacgucuuuuucuuuuacagaugcacacuaacacauuuagacuuaguugauacaauaucugaggauuuuuucugguaauacagaaggguagguuugugagauagaggugaaacaguauuagucaaaaaauaauuauugaagauaaggguucauggaguucauuaugcucuuaucucuguauuuguauguguuuaaaucacucauaauaguguaccugugcuuguguaaaacacaagugcccuauuguguauuucugauucuguaaagaaaauccugauucugcagauaugugauggagacuugccaucagaaucauuuauuaaguucaguaaaaaauuugauugccuagccaagguugaaaaccauuguuugauuugucauuuaaauggguugauaugauugaccucuauagucacaaacaucccauaaaaucuuagugauaucaaguuuaaucuauugaugucucccauuuuucuucagucuugcugcaaagcuuaugaauauaugggauacauuauggaaaaagagcaagcauauacagaugcugccuugaacuaugagauggcauggaaauauagcaaucggacaaauccggcaguaggugaguuuggcaaucaccuagauuuuucacagaaaaauuauguuguauuuauuaauuuucauuuaaaugcauuugauuuuuuucaaaacaaaauaaacauugagucaauuuucauugucaaccuuucugaaaggagaauaaauuuuauauucauaauauauuauuagcuacuaauaguucaguuuccugaguuccaaacuuguccucagucacuuaguguacaucuagucuaauucugcccccuucucuuccuucuaaaagaaggugcuauuuugaaauugggaaugccauggaaaaagauguuuccauugccaaguaaguuaggaaaauauugcauuaaauugaauuacacagguuucuuuacuucucaaagccuuuaaacacuaacguauauugcgauggauaucacagaggggccauguuucccacaauuauuugaccaugggacauuuuuuuuuucuccugagcaucuagaaacaucauccagucccaggcuggauguugcaggcuguuaguuuggguaaugcuagucuacagugucccuaacagagguggca

SEQ ID NO: 13215 - RNA, 57392 nt, Homo sapiens
auuauuuagcuuuuaauuuuuaaaaggcuggauaauacaauuuaaaaaauacaaaaccaaacuguuuauuauaguauaguuuauuuaauacaauguuuaacuauaaaaguuaauacagcuuccaaguuucaauuuuguaaaaugcaguuugcagaaaaguucaacaauuacuagacuaaugauaagagaagcagcauuuugaaacuaauuuuacaauugagaagacaacagcuuuuuuucuaaacuucauuaaaaaaauauaaucacagugacuuuugggcuaggaaaagaagugcauuaacuucauuuauguuuuuuccuuccacaaagagagcggccacaauuuuguacaucccacauacaaauacccaauucauuuaucuuucaaaauacuauauacacacaaaaggggaagaaaauauacagcaugugcuuuugguaacauauggaauuugcuuaaagaaaaaaagucagaaacacaaauccaccccaccacucccucacauaccuuuuaaaacaaacuaaaccccucaacaacucccuacuccaaccuuguugacggaauuuucuuauucaugucauuuuucuuuuccuuuaauauauaccucuuugucacacaauaggccaaagacuuugcacuugcccgaauccacugaaggcaguuaguugggaagcucacuaugggcaguugugccagucaaugcuguacuuccugggggcuuauuaauuuuuaaaacaaguauuuguaacaaaacacaucuuuucacaauaaacagcuuaucaaccuauaauccuuauucaauuguaaauguauaaauccaaaaugaaauaauuacaguaaacauaaucaaaaggaaacagaagaacacccauuuuguuucuuuauaacaaaucagcuaugguagguauuuaaaguaccuucuggugaaggcaaacccaacaagcuucuacagaaauuuaguauaaaaaguuuagugugaugaaaacuauauuaccaacuggaaugaaguacaauaaacuacuaacaaacauacuaacuugcuacauauacuaacuaaaauaaauuagaauugucaaguuaauaccacuacccaaaauaccagagauccaauaugugccuauccauaaugaagaguucuuuaauuguuuagcuccauaccuuccacuaggcacaaauaucaaaggucauuccgcaaagccguccaugcaucaguaucacauuugugcaaaggcagauuuaucagauaaauucuuugcaacuucugagggcuucaauuaaguaacuuaaaacuaugaacuuaccaacuauguaguaauuuaaucaaagaauguuuuaaagcaauccaguagcuucucuacugcucauuucauuaacauuaaucucaccauagugucaauuucuguggcagauggcuuacccagaaaaauaauucauacaaaauaaccaugaaaauucuacauauugaaaaaauuuucucagcuaucaccaauugagcaauaaaucaguuuaaauauuuuuaaaaggauauuaagucaaaaauacuuugacaugaaccauaaauuuagacauaacuauaaaaccaacuugaugggaaaguaauaguugacuuuuaggaaaacaauguucaaagcaaaaacuaaagauggcacaacuacuaaauguaacaaaaggaaaggaccauuugagccgugugcuauucagaugcaugcgcagauccugagguacaguuaaugcuguuuaaucauuuuaaaaauguucuuuauauucuaaaaauaaaaucuaguugauuguccucucaacuccuucacaucuguucuguaaagagagcuaauaaaacuuuaaaauaaggacuauaaauaaugcggagcauggaguugcucuuuugauaacccaaacagaauauugccuauagaaauuacuacaauuuuuuucccuaugguuacuuuuugaaacucuaagauuuggaaauccuuauguauaauuuuuaguagauaaagcucugggaucagacaacauguaagaauuuuuacuuagcauggacuuaaaaaaaauauuuaacuguuauuagaaauccuuucuuaaauagcaccuuucuuaaagcucaaauaguuuauaacaacaauuuuaaaaugcaguuaacugaaauuaagacaaacaauaacuugcuuaaacuacauaacguuauauagcuugggcacucagacucaauuaucccuaauguggguuuguggucagucucuaaggaaucaaucaccuuggauuuuauaauaaacaucuacuacuuuuaucaucggaaaaaaaaauuuuggaaagaauucauuguggauaucuguauuacaauuuuccaagcaaucuuauggucauuacacuauucauucugcaacagcuaccacaacgccaaauauaucaauauugcauuaaucaauagugggaaguaucauguuaauaauugcuuuauucaguacaaauagcauugaguagcuacuggauuuaccaagaagcuaccuugguaacagaguugacacuacacugacaaauauuaaaguacaaaacucucuagagaauccuauuaauuggaauuuugaaauuccuuuucaaaugaggcagguuuuauguuugcuggauguucaauguuuuauuuagaagagauuacagaauaaaaggccacacaucacaaaaauggcaaaauacaacacccaaaacucuaaauggacuuuggauauguuuaguguuuaacucuguaaacuaucaaaauuugcaacuuucuacucuacucuauauggcaauguuauacaugccaaguuaaaauaacauuaacaguaaugguauaaaaccaccugaagagaaagaaaccagagucauaaacaugcuauagccuaucgugauacauauauagaaaagaugcauuuucuugccauuuggaacucacagcuaugagaguuagagaagucaguucaauuaaaacaaacaaaauccaugcagaguuaacacucaauucuauauagguuggaggccaaaaaagagaaaucuuagaaguuaaugucucaauacuaacaauuuuuagaaucuguauagcuuaaggaccugcacaaaugguauguuuuaaugagaaaagcuuuuuuuuuuuuaaaguuuagagaaggguaauuaauaauuaaaacguucccaaaacucuucaaaccaaaagcaacacagaacugagaaucacaaucugauuuuccaagguauaguuccugucaaaugcuguauaacagcaacucaagcucaaucaguacaucaacugaaaaaaauuacucuuacgauuuuuauaggcaguuaaguaaaacacaacuagacaggaaaagcauuaauaggaaacaagcuauggcucgaacuauaaagaauagaguaugaagugcaauauaaauacaucuauuuuaaagcacaaauuacuauaaaaucaaaagugaugauuuaagaucucagguuauuaggacccugcuucuguguaauuaaaagaaaccgcugcaaaccucuauuuauaacgcaaucagaaaaucuauacaagaugucuucuaguggcuucuaaaguuacuuuaaucaugagaaacacaagcuuuugcaacaaugcauugcaaccauuccaaauggcugacuaaacaaauuaggaugcuauuggcuaauuguugcaacacaguaaugcauacauaaaauaguuaaacacagcacacaguacuacaccaaaguguuuuucucaugucgaguuuauuaaaacuuuagcaguacaaauuauccagauugcagauuaucaaaaaaucaacucaaugaaauccacauuaagaaaaaaaaggacaaacauaaaacaauccaaaaacaaugaaaaggaaaacaacauaaaggagauucauuagcaagucucucaaacuuaaaauccgaaacagaauggaaguaaguuuauauaacucacucauccgcuuuugucuucaucuguuccagggcuugauucaugaucaaauuuuuuauuuuuuucauguacauggucauuuucuugaccuuuugauuuuugguuuucuuuuuccacugaggaucugaucuucucauccuccuuauuuuucaacauggaggacuuuaauucauuguccugacugcuuuguuuuauuuuugagaagggacuuugaucucuaucagccuuuuuuucccugcuguuauuugagcuauuaugaucacgacuuuuagaguacauucuuuucucacucucagaauuuucuuuucugugugagcucuuacucucuugguuucuguauuugucuuuguuucugcuuugacuuucuucucucucugagcuccgugagucucuccuccuucuccuccuaucuuuacuucuugaucuuccuggugguguucuucucucucggcuucgugaccguccucuucuccuguauuccuguucucuguaucuaugguacuccuugcuucugcugcgaucucugucauggguucuugaucgcacucuucugcuucugucccuacuucugcuucguucucuuguucugcuauuauaacuguguuuaccuuuaguuauaucacauucucuacuccuggauugugcgcgucuauccuuuuccuuacuuuuacugugaucaugcucauuacucuuugauucuaacuguuuagacuucucuuuacuucuacuccuuuccugaucuuuuccuuuagaaucagacugcuuuucuuuuucuuuaacauuuucaugaucccuuccuuuacuccuugaccucauccucuuuucuucauuucuauuauguuuugaaucucuuucuuuacucuuugauuucucuuugcucuuacuccuacuuuuagauuuggcccuuuucuucacuuuguuuuuauacuugucaucuuuuucugaauuucuucugaugucucucucuuugcuguuagauuuauggucuuuaacuuucuucuccuuuucauuuuuucuguuuggacucucagauacauuccugugaucuguuauuuuucucucuuuuacucuaacuggacuucucugauuuucuuuuauuucauucaacucacuccuaaaaaauaagaaaaagaauuggggaaauguuauuaggaaaagaacuguagauauuauuagcuaaaaugauauucuacuuuucuuaagguauucagcaauaacuaaaaugacaauaacuuuauguauaauaguaaaagcaaacacuuaucauuacauuugaaauaauaauaguuaaaucuuacuuaucccccuugauccaucuuucaccacuugauacccucauucuuugagcucucugcaucucuugccuccaauguggaggagucucacuacgucugaaacgaucccuugaucuggaucuggaaggaguucgauaacgcuaaagaaaauuaaaauagggaaaaauuaauguauagaaguauagagggacucgcaugggugcugggagggagggaaguacuggggugagggucaggagguaguaagggguacaaaauaaaaaaaauauaaaaagcauugaaacaguagcuuaaaaguauauguuuccagguuaaaauaaaacgucugauauuucuauacccugaaaauuacuaaaauuucccaauuuucauauaggaaaucaaugaggcagagaaacuuaaguugucauguugcaaauuccaagaaacauuaaucacaaaaacuuuagcugcuagccauacgucuucuccauggaagaguccuaaccaaguaaugcuagagcaacucauaaguugccaaguuccaaucuaaauguuauauauacuuaauguuucaaagcaaauauuucucauauuauggggaaaacagaguaaauguguagauguucacuuauucaacccuuaggaugaccaaacacucuuauuacauacugagagaacaucagugagccaagauauaugagugugcuuuccuggaacucauauucuacaggacuuggagagcaugugaaugaacauauaaucacauauguuaaacauauaugcagcuauaauagaauggguauaaaaggaaaagggaaaagaugcugacaggaagguucugaguuaagaagaaacauagcaugcuuuagaaaugaugagaagacagaccaaacauggccaaaucuaaaaacugcaagggaaaguaguacuacauaacauugaugagguaagcaaggacuagguuuuguguagugucauaggccauuguaguuauuuuggauuuacccuaagaucaaugguaaaggaguggcacaaaaaucagacuuucauuuuuaaaugacaauucuggcuacuauuuuaaaaaaaagaucagacagugaaucucaaagugggaucuaggaucuaaagacucggggucaaaacuauuuucauaauaauaucacaauauuugccuguuccauuuucauuauuucauuaucauacaauaguguuauucaguuuacauguuuugauaucauuacuuucacagcuaauggaaugugugcuuauauauucuuauguuucaaguauuucucaguacuaauuccugaaagaguaaauauugauagauauaacccacaccaacagaaguucuuuuggguccucaguaauuuuuaacaugaaagagguacugagauuuaaaaaaauugagaacuaucaaaauuuacagcucagacaauaugauggaguugaauuaacauggcagggguaaagcuugaaacacaugaauuucugaauauuuaggaggcagaaaugacaguauucggugauggguaagauauauucauguaucuuaccauaguuaaguuacuugcauaguuaagguauaaacugaaaggggagaaucagauuauucuugggaaggaacugcacaggugguggugcccgucacuaaaaucaguaaccuaaagaagguucagauuugaagaggaagagcuugugcucaacuuuguaaaagccaaguuugagguacucauuagucaaaugagucuuuggagcugaaaaaugccgauaaaaauuugacaguuaccagccaugggagucaugagauugcucaaggaguauaugcagugugagaagauuugaaugggaacccugagguacuacaguauuuaaagguuagguaaauggguggacacgguggcucacgccuguaauucuaggacuuugggaggcugaggcaggcagaucgcuugagcucaggaguucaagaccagucugggcaacaugacgaaaccccauuuuuacaaaaaaauacaaaaauuagccagauguggugaugcacaccuguagucccagcuacuugggagggugaggugggaggauugcuugagacuggaagguugaggcugcagugauccuugauuguaccacugcacuccagccugggugaaaaugagacccugucucaggcagguggaucaccugaggucaggaguuuugagaccagccuggccaacauggugaaaccuuguaucuacuaaaaauacaaaaauuagccgggcaugguggcaugugccuguaaucccagcuacuagggggagcugaggcaggacugcuugaaccugggaggcagagguuaaagugagccgagaucaugccacugcacuccagucugggcaacaaacugagacuccaucucaaaaaaaaaaaagggggggguggaaagaauauuacaaggagcaagauuaaguaagaugaagacugaaaagaauccacuggaauuugugacauggagcugauuauguaucaagugcuguuuucagcagaacaacgguaguggaagacaacuaaaaugcuugaggaauaaguaggaagugaagacauaagacaggaaaguauagccaaguuucuauaaaguuuugaaagcacaagauauuuaaauucugaugaggacacucuaguaaauaaaaaaagaauaaaauacaagaauaggguuaauuuuuauuuauuuuuaacaagaauagagauacagugauugccaagaaacacgggagacaagaaagaccucgaucccauuuuauaccauguaaauguaaaaucuauucauaucucauggauuuucuguugggaaguaccaacauacagaagcugcuuaagaaagagaauauauaauucaaugccugcaucuccccuaaauuuuaguuacuugcacauuaaaauaauauuuaagaaacacccuaaaauuauuuaaggaagacaaaugcaauauugugaagaucucuggggaaagaaucaccuacccuugguccucuuccuuuaauuuuccugccagaucuaguaacuaaaagucgucucugguaugaagcaggcugggaguuagguggauuacuagaaggaagcaaacagaaaguuaacacauuuuuuuaaaaacuuuuguuggccagacauguuacuuuaauaaaaaugaaucugggccgggugcgguggcucaugccuguaaucccagcacuuugggaggccgaggugggcggaucaugaggucaggagauggagaccauccuggcuaacacaguaaaacccagucucuacuaaaaauacaaaaaauuagcugggcaugguggcucaagugaucugcccaccuuggccucccaaagugcugggauuauaggugugagccacuaugccuggccaagaauuuuauuacuuguauuaugacaauguauuucugaucauaacuaagaaaaauauuucaauauuccuuuuucuacuuuuggacauaguuauuauuauuauuauuauuuuugagacggagucucacucugucacccaggcuggagugcagugccgugaucucggcucacugcaagcuccgccucccagguuuacuuaugccauucuccugccucagccuccugaguagcugggacuacaggcacccgccaccacacccggcuaauuuuuuguauuuuuaguagagaugggguuucaccauguuagccaggauggucuccaucuccugaccucgugaucugcccgccucagccucccaaagugcugggauuacaggcgugagccacugcgcccagccuggacauaguuauuaaaaugacugauaaagaaccauuagcauuacagauauuaauaauguagauuuauguaguaaacuuuuuucaggauuugaacaugacaucaauuuuuauuacaauguuguaaaccaaguaaggaaaacagcaguuuuuccuauuagacaaacugaaaaaccaagauucuuacuugcuuaagaguuuacuguacacaaauaacacuauaaaacacuaucuuguuuuacugguuaaagaguaucuuguuauuggcuuggaaugcugcuuaacaucucuuuuuuguauuaguguuuauuauguguaacuuuacuucagaaccuacuuguaauuuaagucaauuucccuuucuaguuaugugguuggcaaaaaagaacuuugcggaagaacauuuuauaaaaaagauuucaaucuugggacaaggucaccaauuaaaucuuguuuaaaauaaauaacuuuuuaaaaagaaaaguucuaugguaaaccauguaaggcaaaauauacauauucacauaccacucucuuucccuuucucucucucuguuuuuccuuuccuucucaucagcuuuaggaggacuuuuucucauuaggaaucuauuuucagguauaggagggaucucuucuggacggacaguagacugggguugugcuucaagauuuucagcuucacucucacuagaugcacuuaacagacagaaacacacaaaacaaguuacaguugguuauuauguccuuacggaaguauccaauuguugguauuucuuuccuuuauaucacuauaauauaaacauccuguccuuaccaaagaugugaucgcaugggaaaaaucuucuauuccucugacaaaccaacuaaccaaucaaaaaacaaacaaaacaaaacguuucgauuaucacacucucaaaaaauauuuuccuacaaaauggauaaaaaauaugaaacuaugugagcaaugcacucugauaaauuuaaaauacuuuaaaacauggguaaagaaauuaacugcauuugagccauaggcagaugaagacaaguuuuaguacaaacacagauuauuucaagcaaaauggaaaagaaaguaaaauacacugacauuaucugcuuucuauccuuaugcuaucguaagagcaaaggggacugcuacugaaaauaggaaaaacaacuggugguuuucugcaauuuucauaaaucccauaauccuccuauaaaacacacaaaucuguaacaccaaagcuguauuauuucauugaguacacaaaaaaaugaacugauagguuuucuuucaaaagaaaaugaacguacccaaaauuuaaucuauagacuguggaauaucaaaaguccuacgcuccaugcuauauuucucacuauuuuaacaguuucauauaauugacccaaaauccuaacagauuuacagaaaggaaaucagaauauaaagcuagcauuagaaaaguaaaauuaagaccucuucuugcuuuucuuucgcuuuuucuuuucuuucuuguguuuucgggaauuuuuccgauguuucuuuuuucuuuucuuugauuucucuucaguagcacuuucggaaucagaggaaucagaagaggacugagaaucacuugagcuaucugagucacuagaugaggaggaggaagaugaugaugauuuaugccuuuucuuuucuucuuucuuaacuuuaauaaaaacaaaaagguuuugaucaacaauuuuuagacaaacuuuguggaaggagauuuaaauuuucugcagauucucacuaaguucaguauuuagcacuuagaucauccagcuaugugaacugggaaguacaggaaaggagucaagacucaggauuagaguccagaucuccagaauucacuggucaaaguuuuaucuauuaauccaaagaacuuuaaaaaauaggugagucuaaaaugcuaaacuaauguuaacaaacaucugaauaagaauuuuuuuuaaaagcacagaauaacaaugaagagucccauguucuaaucuuguaguuuuccacuuucccucuuauuaucaagauuggcagaacuagugcagggaaauaacagaaaaacugcuuuacagcaacauggagagauaagaaauggauuucacuggcaugggcuuauauuucagugcccaagcagucuucuaauaauuaagaaauuuagcucaagaggagacucauaacagagggaagucaauugcccaugaugaauagaauguuuuggggacucuacaaaaagucauuuuaaauugaaauuuuauuucaguuaaggaagcaguaacuuuaaaaaggguaaaaaaaaaaaaacucagaguuuaaaggaucaauuaauauaaauaagugaagcuagaagguguaacauaacaagaauuagaagaagauacuacaaauugggaggagcuugacccaucuaaagguauacucauucaaaucaugguggauuugaagaggcuaacuggggccaaagaugggacaauauugauauauacaugagaacuacaauaaauugagauauaucagauuauauuagaaauacauuaguucacagugauacucauaaaguauaaagcauuuaucuugccuuugugguacaaacugcaccacuggcuaaugaaaugaaugaagggaaauagcucuuugucagaagcauuccaggaauaaaugaaaaagaaauuauaguguuaaaauaucguuuuacaacuucuugugaggcacugauaacccauggcugcugcaaaacacagagacaacuuguccugugugacuccuguuuucauuaaaaggaauuucaagucacaacugcaucugaucaacauuacauaacacaguaaggacucaauuaguaaaauccaguauguucaauuauagaaaaugcuacaugacaaaugaccuaccuuuucugagaaauacauuucaaggaaacauaaaacaagauggugagggaauuuauuaagaaacaaaacacaacuuacaagaccaauuucaaugucugaacuucauuuggauugauucacacagcaaaaaauuaauuaacauuaaugaaacaauuacaaucugaacacugucaggauuuuuaguauuuaggaauguguauguguguaucauuaugguacuguuuuuaagaaucaucuuuuagaaauaacauuuauugauaaaauauuaugccuggaauuuguuucaaaauaauaggaaagggaaaaguggcuagugauggguaaaacaagauuggccauaaauaaacuccugaagcuagcuaaagaaaaaguguuauauuauuuuauucacuuguguauaaauuaguauguuccacaauaaaaagucaaggaaaacaaagaaaauauaucuuuggauuaucuguugguuguuugguuacagaaccuuaguugaaaggguuaacagcugauuugugaccuuuccuuuagccccaccuuagccucaggaacaucugaagauuugguauuuggaaaauuuauccuugccuuuuuuuuuuuuuuuuuuuuuuuuuuuuuggagacagggucuugcucuguugcccaggcuagagugcagaccauagcucacugcagucuugaccuuccgggcucaagugauacuucugucucggccuccugaguaacuggaaacacagguguaugccaccaugcccugcuaauuuuuuuaauuuuuauuuuuguagagacaaguucuccccauguugccuaggcuagucucgaacuccugggcucaagggaucuuccugucucaaccuccguaaguguugggauuacaggugugggcuaccaugccuaaccuuguuuauuuaugaagauggggucuugcuauguugcacaggcuggccucaaacuccugggcucuaguaauccucuuucucucagucuccugaguagcuaggacuacaggcacaugugcugcugugccugaaucauccuugaaauuuguaacugauaauuuacaggaauauacuaaacccaagauacaugaaaaucuggcugaaguuacuuguacuugaccaaggacuucugguucacugugcagacugcuuuuccaguacugaugagauguugcugcacuugagaaugggaacaagguauaaaagcugaagagaccguagauguaauggcuucacugaacuaagauaauccuuccuuacccaguuauguuucuaaggaacagguacauuaucaagugugagauguuugggauauacgcaagcugugccuggaaaucaugacagugccucuaugcuguugauguaccagccaugccguuuccugcccuauauccuuucuuaaggguaaguaaucuuagugccuggugaagcuaauuuugucucacgagcccaacuguuaaccugaauccaauaccuaugcugcuggugagacagaguggguaugaaaaaacauauaaccugaaaaaucuacuuauauaugcuaaacuaauaaaccugagggauaugcagggggaaaaaaucaaauuuuaaggaaaucuaacacagaaaauaaauucacaaugaaauaaaaacauaaaauugugcaagcaaaauaaaaauacuacacuuaaacauaaaauauacuuguuaaaauaugguaacucuuuaccccacaauuaaaaaagcuuuaaucaccagucugauuucuauuuauuuugcacugagauucuuuccuaugagaaauacaucacaguugauuuacuuuaaaagcaagcccauuuaguguuugaaauuaaaaaaaaaaaaaaaaaaaaagcaagcccacuggcuaggggcauggcuucucacgccuguaauuccagcacuuugggaggcugagcagggagaaucacuuaagccugggaggucgaggcugcagugagccaugaucgcaccacugcauucuagccuggggaacagagugagaaccugucuccaaaacaacaacaacaaaacaccauaccacacaacagcaagcccacuuaccaaguguauuaaauacauuucauaaacaauuauuuaauuuacauaucacuuuugaagaaaacauucuagugaagcaagauaacaugauaaaaugaaaagucugggugcaguggcucaugccuguaaucccaccacuuugggaggccaaggcuaguggaucgguugaggucaggaguucgagaccagccuggccaacauggcaaaacugucucuacuaaaaauacaaaaauuagccaagugugguggugcacacgcguaaucccagcuacuagggaggcugagguacgagaaucgcuugaaccccaaagguggagauugcaguaagccaagauugcaccacugcaauccagccugggagacaaagcaagacuccuccucaaaguaaauaaaugaaauggaaggccagaaagagauuuauaacuguuuuuauaggaauauaaucugcucaagaaucagaaaacauuaacuauaagaggaaaauaggccaggcauggugguggcucacaccuguaauccuagcacuuugggacaccaaagcaggcagaucacuugaagccagggguucgagaccagccuggccaacauggugaaaccccgccuccacuagagauacaaaaauuaaccaggcauggugaugggcgccuguaguuccagcuacucagaaggcuaaggcaugagaaucacuugaaccuaggaggcagagguugcagugagccgagauugcaccacugcacuccagccugggcaacagagugagacuccguccugauuuaacaaauaaaaaagcucuaagauuaaaaaguucaguggagagugguggcucacgccuauaaucccagcacuuuggaaggccaaagcaggcagaacaccugaagucaggaguucgagaccagccuggcccacauggugaacccgucucuacuaaaaauacaaaaauuagcugaguaugguagaggguaucuguaaucccagcuacucgggaggcugaggcagagaaucucuugaacugggaggcggagguugcagugagcugagauugcgucacugcacuccagccugggagacagauugagacuccguuccaaaaaaauaaaaaauaaaaaguuccucucuuuugauauuuggcaaauuuaauuuauguuccuuuuuguauaagucugcucagaaaaaaaaugagagaaaauaauugagaaagagauggcauuaaaggacagaaggguaaaaaggcaaaaaauugggagauaucacaauaucaauauugauucuguaagacuguggcuugaguuucagaauguguguuaaccuaaauuuuaaaauaugauuaaggcauauugagaauaugauugaaacuguauccuucucaaagucacaaguauuauuuaacugaacaguauaccaauauacauagucaacauaaugucagaacauggagaugaagagccauggucccugguacugauccguggccuguuaggaaccaggucacacagcagaaggugaguggcaggcaagcaagccuuaccacuggagcuccaccuccugucagaucagugacagcauuagauuuucagaggagcacaaacccuauugugaacugugcauacgagggaucuaggcugagcacuccuuauuaaacgcuuaugccugaugaucugagguggaacaguuucauccugaaaccauccccuaaacccugaugaaauaaagacauuuucagaaaacuagaauaauuuugucaccaguagaccuaaccuuaaaaaaaaaaauugguuaaaggaaguucuccaaagagaaaggaaauagcaggaggaggcuugaacuucagaaaggaagaauaaaagaaugguaaauaauaggcgguaaaggaaucaacaaucgguucauauaaaaagaaacauaaauagcucuuaaggagacacuaacaucacacuccucagagaaaugcuaauugaaacuagcauuuguuaaaaaaaaaauccauuaggcuggcaaaggugaaagaguuuacaauaauacguaguuuuauacaggguguagggcaacuuauccucuuauauucugguagcagugucuaccaaauuacaaaugcaugaccucugcaaacuggcaauuccauuucuaggaaauucauucuacaagaucaacauucacacacacguggaauaauguacaaaaugugagaauggaaacucauggaaagagauuuucacagauuaucauuuuauacuuucugaauuucgaaccaaauaaauguauuaaauuuuuaaaacuaggguacaaaguuucaguuaagacaggaagaauaaguuuguugagaucuauuuucauagcauggugagaacaguuaauaauaauguauuguacauuucaaaauuccugagauaauaaauuucaaauuucugaccacaaaaauaguauuugaggugacagcuauguuaaauagcuugauuuaaucauucugcauuguauacauguaucauaacaucacgcuguauaccauaaauauauacaauaauuucucaguuauaauauuuucaaauuaaaauuuuaaauuccgaauacggcaacaguuguuuucagcugacucuucaaaaaaccuacuuccggcugggcgcgguggcucaugccuguaaucccagcacucugggaggccgaggugggcggaucacgaagucagaagaucaagaccauccuggcuaacauggugaaaccccaucucuacuaaaaauacaaaaagaaauuagccgggcgugguggugggcgccuguaguccuagcuacucaggaggcugaggcaggagaaucgcgugaaccagggagguggagcuugcagugagccgagaacgcaccacugcacuccagccugggugacagagcgagacuccaucucaaaaacaaacaaacaaaacccuacuuccuaacuacuuacacaaaauugauuucagcguuucuuuuaauggcauguaaguaucguuaagguaaaaugaaauagcacuaaaagcaaaaaccacaaugcaaguuaagaaucauaguggaugaaaaagaauuacaaagaguaauaacacuuucaacuugggccauuucugguuaauuaguuuagauuacgcaguuugcuuauuauuaaguagaaugauuucccaaacuucuucacugaccuuuacuuggggguauggugugauguaaccuuaucaauuagucauuuaacuuacuaguauaauauuaagguuaaaaaccaaauuccauagcucauaucuguaaucccagcacuuugguaggucaaguuagaaggaucgcuugaaccaggaauuugagaccugccugggcaacauagcgagaccuugucuccaccaaaaauacaaaaauuagccagguguggcaaugcacaccuguagucccagcuauuuggaaggcugaggugggagaauugacugaacccaggaguucgagguugcagugaacuaugacugcaccacugcacuccagccuggcaacagaacaagacagucucaaaaaaacaaaacaaaaccagaaauaacuccagaauauuuuauuuguaaaaaccuaagguaacaaaaugcugcuuuguuuuuuauuugagacccacagauuuuacaccaauaaauuucacuugaaaucuugaaaaugaaggaaauucugaaaucaccaucaaaauaagauuugaaauaaagaacaaaaguauuccuaaaauggucuuuagacaauuucauuucacauuauggguugcaucuccuaaaccguuucuaaguuuaacaucucacuauuuuccaauaaaagugccaaaauuacuuucagaauaaggacacugaaaugggacccugucaccauagaaaugaaucucuaguguuccucuucacuugucuccugaguacaagauucaccagcugcuuccucuauugugcuauuuguucuguauugucaggcaaucugccuccucccauuucuucucauacaacuacuuaccgccauguugccacaacucuguucuuguguuucuguguacuauguaacauagcaauccucucaucucuuaguuucauuauugguacgcuaagcuugugggaguuauguauauccuacuucucaaggucauugccaagaucugauuuuucacacaaaaaacuugcaaccuccggcauaaauggguuaacaacugcagugaacucugaauugaacagcaugaucugaggucacgucagcuccugaaaaacuaggaaauaucuuaaucaagguacuggucuguguucuauccuccacucugacuuuugacagcccuuugcugagccucuacaggggaugcagcuuuuauuagcuuccaguguuccaucucugcaucugcuggaagguuuuucuccuugacuuugaauuuucucuggcacacucaaauagucacaaaaagaaggaucuccaaucucaaaauugcaaagagagaaaggcccaggaagauugauugcccagacuccccaagaacacauauagauggaccaagacugucagauuucuucagaagucuuuuuguuuucuuucaggaaguuaaaaaaaacagguguaaaucucucauacaagguuuuaaauauaaugaugauaaauaccacaguguuacaaugcuuuuugacuguucccaauuaauuaagaaggccaucaaacuuacuaaguggauguaagauauagcucugcuuauauguaagaugcaugacaaaaucuacucugaccaauguucugaaugguaacugaaggauuauggaauaacaggggcccaaguguguguuuucaaacuaaagaucuuuuccucuuuucacagugugauucagaacagaguagccauuggaagucuggcucaaaacaaaucugaccuuuuagaaacuccugggcagauacauauuaauaaagggccaaaucucagauugcugaaacugauaagggcaagguaugcuagguuagcaugaguuugagggacauacaguuggauguuacaucaacuuuuagcacaacuuccuggccccaauggcaugggcaaaaccaucauuuauuucuucagaugacaaugcauuauaaagauguaaguaauauauaaagagcuacauucauuuacuuccuccuuuaggcaaauauucaaguacugcccuuuuaguaccaaaagaaucuuuacaacaaauuuauuagagagucuaugauuacuguuuaugguuuaaaaugcaaacuucuuuuuuuuuauuuuuaguagagacaggguuucaccauguuggccaggcuggucucgaccuccugaccucaagugauccguccaccucggccucccaagguguugggauuacaggcguaagccagagccuggccaaaaacucuuuuauuaccucaaucucuuucugaacauauaaaccacgcagcauccuuaacuuuauuuauuuauauauuuuuuagagauggggccuuguugugucacccaggcuauagccuucaacuccugggcucaagugauccuccugccucagccucccaaguagcagggacuacacaugguuaauuaaaaaaaaauuuuuuuuuuuuuugguagggaagagucccacaauguugcccaggcuggucugaaacuccugggcucaagcgauccuccugcuucagucucacaaagugcugggauuacaggugucagccaccgugccuggccacuuaacuuuuauaaggaggcaacagauccuaacacaaguguccuuaaagacuaaaauauuaaaaaaaaaaaaaauuaguugucaaguagagaauaaaugaugaagauuuucuagaugacuugggaagaauaaugccuuaaccuaaaauauuccuacuguacuaaaaacacucuaaaguuuaaacaucaguagguucaggguuuagaguaacaaacaucauuacagauuuuuuuuauuuuuaguauuuuuuaauguaaauaauugcauuuguagaauauuacucaaagauucucaacaucuuguuuuuuacugaaucuucaagaaaaaaggcauacauuacaccuguuguuuguaaauaaggauagccagucucauguacaucaagaaaucccaugagcugaagcauacaucugcaauaauuuauugcaauaacuuaccugugaauauuuauuugacaucacauggaagaaaauaaaauuagcagacucaaaauggaaugcagacaaaaaaaauuuuuuuaaauaaucauuuugccuucuccaugcccaucucggauguuuuaaaauuaaaacaaaacaaaauguaccuguuucuaaauauuauagaggaaaucaguguaccuagaaggugagaugagaaucaucuacuuagggcaauucuuaagaaauuuuaaggacauuuaaacuuuaaugagucaguaacauauaacagaaaaaguucuaauucucgaacuuggguuugaggucucuuuuccugacacaguaaagaacuuaaucuucuugacuaucuuugucuguaaaauagggauauguaauacuauagaguuacugugagaaucagaaagcauuacagaugacucucacaugugcuaacucuaagaaacuaauuacugauauuauuauucccuagauuaguaagaacagagucaguuuaagguuuuacuacuuucuauacagguuugaagguaaucucacuccauuacuuuuagaaugucaagcccauuaucuguaauaaaauaguaucagccacauauuucaaauauaaagacuuaaaauauuuaaaguucuuaccauuucagacaauauaucaaauuagucaugucagcaucaaauggucucgucuaaauaaaagaaguuucucaaacauguuggaugcuucugaaucuaaguagugcuuaaagaaaaaauaauuuauucccuuaaaguuuccuaaucuaucuuccucucuugaauugccaucuagccccagagucucuuccuccagaguauuuauuuacuagguuauuuagacaacuacaguuaaaaaacaaacaaaaaacaacaacaacaaaaacucaguggaagcaaaagggcaaauuauugcaaauuaauaaucagaaaaaguuaacugacuucaugguaaaugaagaaaaugagaaguaggauaaaacaguuaaaaaaacaaaauugccaagaacacacaauggggaaaggacagucucuucaauaaacgguguuggaacaacuagauauccacauguaaaaaaauaaaaucagacccuuauaaugcauauaaaaaucaacuaaaaaugguuuaaugacuuaaacauaagacuugcaacuguaaaaccacuaaaagaaaacacacggaaaaagcuccaugacauugguuugggcaaugauuuuucuggauaugaccccaaaaccacaggcaacaaaaagcaaaaauaagacaaaugggauaacaucaaacuaacaggguucugcacagccaaagaaacaaucaacagagugaagauacaaccucuggaaugggagaaaauauuugcaaaccauacaucugacaacggguuaauauccaaaauauauaaggaaugcaaacaacucaucagcaagaaaacaaccugauuuaaaaaugggaaaagaaucugaagagauauuucucaaacgaagacauacaaauggccaacagguauauggcaaaaaugcucaaugucacuaaacaucaaaggaaugcaaauuaaaacuacacugagauagcacuucacaccuguuacaauggcuauuauaaaaaaaaaagaaaacaagggagaggaugugaagaaaaggacacucuuguaaacuguuggugggaauguaaaucgguacagccauuauuagaaaaccgaaugaagucuccucaaaaaaucaaaaacagaaagagggcauuacauaaugguaaagggauuaaugcaauaagaagagcuaacuauccuaaauauauaugcaccaauacaggagcacccagauucauaaagcaaguucuuagagaccuacaaagagacuuagacucccacacaauaauaaugggagacuuuaacaccccacugucaauauuagacagaucaaugagacagaaaauuaacaaggauauucaggauuucaacucagcucugguccaaguggaccuaauagacaucuacagaacucuccaccccaaaucaacagaauauacauucuucucagcaccacagugcacuuauucuaaaauugaccacauaauuggaaguaaaacacuccucaucaagugcaaaagaauggaaauccuaacagucaagucucucagaccacagugcaaucaaauuggaacucaagauuaagaaacucacucaaaacugcacaauuacauggaaacugaacaaccugcuccuaaaugacuacuggguaaauaacgaaauuauuuuaaguucuuugaaaccaaugagaacaaagacacaacguaccagaaucucugggacacagcuaaaguaguguuucgagggaaauuuauagcacuaaaugcccacaagagaaagcaggaaagaucuaaaauggacacccuaacaucacaauuaaaagaacuagagaagcaagagcaaacaaauuucaaaagcuagcagaagcuagcagaagacgagaaauaccuaagaucagagcagaaccgaaggaaauaagagaaacaaaaaacccuuuaaaaaaaaaaaaaucaaugaauccagaagcuggucuuuugaaaaguuuaacaaaauagauucuggccagaugucugcuagccagacaaagaagaaaagagagaagaaucaaauagacacaauaaaaaaugauaaaggggagaucaccacugaucccauagaaauacagacuaccaucagagaauacuaugaacaccucuacacaaauacacuagaaaaucuagaagaaauggauaaauuccuagacacauacacccuuccaagacuaaaccaggaagaagucgaaucccugaauagaccaauaacaagugcugaaauugaggcaguaauuaacagacuaccaaccaaaaaaagcccaggaccagauggauucacagcuaaauucuaccagagguacaaagaggagcugguaccauuccuucugaaacuauuccaaacaauagaaaaagggggacuccucccuaacucauuuuaugaggccagcaucauccugauaccaaagccuggcagagacacaacaaaaaaagaaaauuucaggccaauaucccugaugaacauugaugggaaaauccucaauaaaauacuggcaaaucaaauccagcagcacaucagaaagcuuauccaccacgauuaagucagcuucaccucugggaugcaagaaugguucaacauacauaaaucaauaaacguaaucuaucacauaaacagaaccagugacaaaaaccacacaauuaucucaauagauguggaaaaggccuuugauaaaauucaacagcucuucaugcuaaaaacucucaauaaacuagguauugagggaacacaucucaaaauaauaagaacuauuuaugacaaacccacagcuaauacauacugaauggacaaaagcuggaagcguucccuuugaaaacuggcacaagacaaggaugcccacucucaccucuucuauucaacauaguauugaaaguucuggccagggcaaucaggcaagagaaagaaauaaaggguauucacauaggaagagaggaagucaaauugucucuguuugcagaugacaugauuguauauuuagaaaaccccaucgucucagccccauaucuccuuaagcugauaagcaacuucagcaaagucuccggauacaaaaucaaugugcaaaaaucacaagcauuccuauacaccaauaacagacagagagucaaaucaugagugaacucccauucucaauugcuacaaagagaauaaaaaaccuaggaacacaacuuacacgggaugugaaggaccucuucaaggagaacuacaaaccacugcucaaggaaauaagagaggacacaaauggaaaaacauuccaugcucauggauagggagaaucaauaucguaaaaauggccauacugcccaaaguaauuuauagauucaaugcuaucuccaucaagcuacaacugacuuucuucacagaaucagaaaaaaacugcuuuaaauuucauauggaaccaaaaaagagccuguauagccaagacaauccuaaggaaaaggaacaaaguuggaggcaucauacuaccugacuucaaacuauacugcaaggcuacaguaaccaaaacagcaugguacugguaccaaaauggauauauagaccaauggaacagaacagaggccucagaaauaacgccacacaucuacaaccaucugaucuuugacaaaccugacaaaaacaagaaauagggaaaggauuccuauuuaguaaaugguguuaggaaacuggcuagccauaugcagaaaacugaaacuggaccccuuccuuacaccuuauacaaaaauuaacacaaaaauuaacucaagagauagauuaaagacuuaaacauaagaccuaaaaccauaaaaacccuagaauaaaaccuaggcaauaccauucaggacacaggcaugggcaaagaauucaugacuaaaacaccaaaaacaauggcaacaaaagccaaaauugacaaaugggauuuaauuaaacuaaagagcuucugcacagcaaaagaaacuaucaucagagugaacaggcaaccuauagaaugggagaacauuuuugcuaucuauccaucugacaaagggcuaauauccagaaucuauaaagaacuuaaacaaauuuacaagaaaaaaacaaaccaccccaucaaaaagcgggcaaaggauacgaacagacacuucucaaaagaagacauuuauguggccaacaaacaugaaaagaaaaaagcucaucaucacuggucauuagagaaaagcaaaucaaaaccacaaugagauaccaucucacgccaguuagaauggugauuaaaaagucaggaaacaacagaugccggagaggauguggagaaauaggaacacuguuauacuguuggugggaguguaaauuaguucaaccauuguagaagacaguguggcgauuccucaaggaucuagaaccagaaauaccauuuggcacagcaaucccauuacuagguauauacccaaaagauuauaaaucauucuucuauaaagacacaugcacacauauguuuacugcagcacuauucaaaauacaaagaccuggaaccaacccauaugcccaucaaugauagacaggauaaagaaaauguggcacauauacaccauggaauacuaugcagccauaaaaaaggaugaguucauguccuuuucagggacauggauuaagcuggaaaccaucauucucagcaaacuaacacaggaacagaaaaccaaacacugcauguucucacucaaaaguggaaguugaacaaugagaacacauguacacacggagaggaacaucacacaccagggucugucugcagguagggggucuaggggagggauagcauuagcagaaauaccuaauguagaugacgggcugauggguucagcaaaucaccauggcauguguauaccuauguaauaaaccggcauguucugcacauguaucccagaacuuaaaguauaauaauaaaauuaaaaauagaacuucuauaugauccagaaaucccacuacuggguauauauccaaaggaaaugagaucaguguguugaagagauaucucacucucauguucacugcugcauuauucacaauagcuaagauacugaaucaaccuguuuccaccaacagaugaacggauuuuuuaaaaaugugguuuauauacacaauggaauacuauucagccugucaucuggagcaacaugaaugaacccagaggaaguuauguuauaugaaauaggccaggcacaaaaggacgaauaccauaugaacucacuuacauguggaaucuaaaaacguugaagucacagaaguacagagaagaauggugguucccaugggauuagagaaggaaauguguuggacaaauguugguaaaggauauaaaauuucaguuagcucagaggaaugaguucaagaauucuacuguauaacaugaugacuauagcuaauaacaauguacuguauucuugaaaaucacuggccaggugcaguggcucacaccuguaaucccagcacuuuggggggccaaggcaggcggaucacaaagucaggaguucgagaccagccuggccaauauggugaaaccccaucuccacuaaaaauacagaaguuagcugggugugguggugggcgcuuguagucccagcuacuugggaggcuaaggcaggagaauugcuucaacccgggagacggagguugcagugagccaagaucaugccacugcacuccagccugggugacagagugagacucugucucaaaacaaacaaacaaacaacaaaaaaaaaacccaaaaccacuaagauuuuaaguguucuucucaccacaaaaagggguaauuaugugaggcaauaaauguuaauuagcucaauuuagccauuccacaacauauacauacuucaaaacaucauauuguucacaguaaguauacacaaguuuugucaacuuaaaaaaguaaaaaauaaaagcacagaaauacauuuuaaaacaaaaaccucauuuuucuuucagcuugaguaugaauuucaugucaacuauuuagaguaucucugcuuauuuuguauguguaaguauucucagaaauauguacuuccuuuuuaccuuuagauuugggaaucagcucuccacaacugaguauccguaccuccgcaaacgguuugcuagcugcaucuguuuucugguuuucaaucucucuuacaacuucuugaccagagauuacuuguccaaaaacaacaugaugccuaaagugucaaguaaaaaauuauuaaauaaaagcuuuuuauuucaagguuaauuuaaaacagguuguaaaauaaauaaaauaauauuuacccaucuaaaugaggaguugguuucguuguucuuuuggaaaucaucagauagaagaauaaaaacaaagucagagaaaaacaaaguuagcaucucuaaaaagaaaaagaaaauaacuguauuggaaacaaaguugaaaacaaagacaucaacugcuaucuuaauauaaucauauuaccucaaucuuaaguagaacagaaggcaaaaugcuuuccacauaauguauuuaucaaacuuguucuaauuauaaaagcaauaucuacuuacugcugaaaacuuuuauguaacuaaaauagacauuucaguguuauuucuaaccauucauguuucuugcacuugaguucuuacugaauagucauaauuguauaauguucuacauguagacauaucaaaauuuaugaaacaauuccaccaguguuugaguuuaacaauaaugcuuuucaaucuuaacauuuuaaacaguuaagcacgggcuauauucuuaugauccucagacauauacuguuggacuugaacagaaaugguucauaucguguuuacaaguuuuuuuuguuuuuauuuuuuugauuuggagacagggucucaugcuguuguccaggcugcagugcacuggcacaaccuugguucacugcauccugaacauucugggcucaagcuauccuccugccucagcaucccaaguagcugggacuauaggugcaugccagcaugccuggcuaauuuuuguauuuuuuguagagacaggucucacuauguugcccaggcuggucucaaaccuggguucaagcgauccucccacuuugaccuuucaaagugcugggauuacaaguaugagucauugccccgcugagaguuuacaaguuuuuuaauuagcugcaagagaucuggauuaggaguugggaaaaaaaauuaaaauaagcauuuuuuggcaaacgaaauuauuuuuaaaaaaucccacuccccaccaucaaccuuaaagcuauguagguaaaaagguugcuacuugaauacguacuaaaaacacugguaugaaaauuaaagauuagcauuuuauaagauuuuuuauuuuuaaaaaaccuuaucaaaaagcuauuagaaauucgaaaaaaggagcauaauuuaugcuaaucuuuggugaaagcauguacaauaccacugaaaaaauuauaacauauagcugaauuuuuagguuuaccuaauuauaaaauuaaugaccugcuauuguuuccucauugugacacuaugcucacuucaacucacuaaaaucaccuagaaauguaaaaaccuagguguacacuauguguauucauauaacauguuauagucacaaugcauauauaugauuugcauuuagauauaguugauccucacuucacugauaacuuuauuugcaagucugccugcucacuaaaacuuauuuguaaucccaaaauuaaaaaauuacagcuuguggugcuuucaugguaauuuacagauacacauaguguggcaaauaagugugcugggcaaggauguggaaaaauaaauaacuccuguacauugcuaacgggaauguagaauggugcaaccacuauggaaaacaguauggaaguuccucacaaagcuaaacagaguauuagcauauaacccaccaauucacuccuagguauauauucaaaagaacuaaaaaaagaaacucaaaugccaaugcucacugcagcaguauucacaauagccaaaaugugaaaacaagucaaauguccacuaacagaugaaucaaaaaaugugguauauacauauaguggaauauuacacagccauaaaaaauggacuucaugccaggugcaguggcucacgucuguaaucccagcaguuugggaggccaaggcggguggaucauggggucaggagaucgagaccauccuggcuaacacggugaaaccccgucucuacuaaaaauacaaaaauuagccaggcguggugacaggcgccuguagucccagcuacuggggaggcugaggcaggagaauggcgugaacccgggagguggagcuugcagugagccgagauucugccacugcacuccaggcugggcaacagagcaagauucugucucaaaaaaaaaaaaaaaaaaaaaauggaguucugauacauguuacaauauaaauaaaccuuggaaacauuuuuaagugaaacaagccagauacaaaaggacaaaaauuguggaauuccacuuaaauaaaauaugcggaacaggcaaauucauagagguuaccagggauugggggaaaggggaaaugguacagagucucugcaacaaugaaacaauucuggaaauaguggugaugguuguacaacacugugaauacacaugacucacuaggcccaguggcucacaccuauaaccccagcacuuugggaggcugaggcgguaggaucacuugagccuaggaguuugaggccgcagugagcuaugauugugccacugcacucuagcuugggcaacagagcaagacucugucucaaauaaauaaauaaauaaauagcuauaaacaagacugaauuguacacuuacaaaugguuaaaauggcaaaucuucuauauguuauaguacaaaaaaauuuuuuuuaagacugaagcucucuaaaaauugaaguuauuuccuuuaaaaaacagaacacagaagaaggguuaccuacgaaauaggaagauauaaggaguaacaaacauuuagagggaagauucugagaauauauauaugaaggauuauaugaacuuaacauaggaguuuugguuagugcaggaaagauuuuauuuaaaagaggaaaauaaauuauaauacucuguugagaauguggugaaauuagcauuuacauacuacuggugcuacaguaaacuauccuuuccuuuugaaaaucaacauaacaauauauaugaaaaggcuuaaaaauguguaaauaguucauuaaguaaacuucuuaaauauuaaaacugcaucaaaugauaggcacaacaauguucauuggagcaguuugaaaaacaggaagcaaaccaaaugucccaaaauaagauuaauaaugcacaguacuuucaagcaagagauuaacauguagccauuaaaaagcuaauauuuagugaugugcagagauuuauauuauagccaaaaguugacuauagaacgacacucuacaaacauuuuuaaugcacagaaagaugcucugggaaugggauuuuugugugugugucuuaucuguguuuucuuucuuuuuuucuuuuucuuuuuuuacaaugaagagguaauuauaaguuguuuuauuuguuuguuucugagauggagucuugcucuguagcccaggcuggaguguaguggcacgacccuggcucacugcaaccuccaccuuccugccucagccucccgaguggcugggauuacaugcgcccgcaagcacacccagcuaauuuuuguauuuuaguagagacuggguuucaccauguuggccaggcuggucucgaacaccuaaccucaagugauccacccgccaccucggcuucccaaaguguugggauuacaggcaugagccacugcacccagccauaaguuguuuuguuuaaaaagaaaaucagagauccacauuaugugcaauugguugaauaaacuaugguauacacaaacaauagaguacuaugcagcugcaaaaaagaauaagaaugaucucuauaaacuguuauggaguauuuuaaggauauacuguuaagugaagagugaaacaguauacaugguaugccaucuacgguguaagaaagggaaagugagaaaauguauacauguauuugcuuauguuuacaaacagaaauacaggaagauaaacuggaaauuagguugguuauuaacauguauagauggaacuggggugaaaaaaaaaaggaaaugggaauggaguggaaggguugggugggagagacacuucacaguauucuuuuuguuuugacuuuggaaauguuacuauuucauaaacuuaaaaaaaugcaaaaaaaaaauaucaaaacuagguaggaaggagaacaaaaugaaauauaaccagaaaggaauaaaccuaacacauuuugagugaaucacaaagccaaaccaaaaaagaacuaauuuaagucacuuuuaaacuugguguuuaacuaccuacacucagucuaaaaacgaaaauaaggauaaagaaauagugaacucuaguuaguuggucuuucuuuacagcaguaugggauggcaacuguucauucuaggaaucaauaaagaacagaaauguugaagauaaucaggcgccagauuucucacuguugaacaguuaacaaauacagaauagggaaaugacagaauaauccacaugguacugacagauuaaauuccucacagaacaagagauuucaaggcuaccgaacagaacaaaccuauacccauaagauaggauuuuaaaaacaggcauuacugacaacaggccuggucauaauuuuuuuuguaguuggaauuggaaauccuuagcauuuggagguuacaaauaaauuuuagugagaaggugaauucacaaagacagaaucuaugaauagugagaacugacugcauuuuauucuuuguaauuaaguaauuuacggagaaauacucuguaaacaucuaguuucucacugaaaucaccccucuaaauuuagcaucaauagaagauucuugccugggucagucauuacugugaugauuacaaaauggugacuuuucuaacuccaccauuccguuuaaauuuauuaguugacauucuaauaagggaacagcuucccuucucucucauuauuuaaucauuuauuuauaucaguguagacugcugguuccuauuugaccauaaacugauauuacuguuacuuauuuugaugcugaaauuauccuaauuuggcuagugggaaaccuuuaaccuggcuccuguguucucuugacaagucuccauuauuucaaaacauuagcagaacaauuuaacuuccccucuauaacaauuuucccucuucaacaauuuuggccaggugccauagcucacauguguaaucccagccuggaguccagccugggcaacacagggagaccccgucucuacaaaaaaauuaaaaaauuagccaggugugguggcacacaccuguagucccaucuacuugaaaggcugagguguagaggauugcuugagccagggaggucgaggcuguggugagccaugauugcaacacugcacucgccugggugacagagcaagaccuugucucaaaaacaacaacaaaaaaaucaauuauuuguuccccuuccuucaacaauuccgucccucauagauuccucuccuauuuauuaguaaucaauggcaggcacacagagaaaugacagaccaaaaacgggauuuuuuuuuuuuuuuuuuugagacagucuugcucugucacccaggcuggagugcaguggcgcaaucucagcucacuguaagcucccccucccggguucacgccauucuccugcuucagccucccaaguagcugggacuacaggcguccgacaccaugcccagcuaauuuuuuuguauuuuuuaguagagacgggguuucaccguguuagccaggauggucucgaucuccugaccucgugauccgcccgccucagccucccaaaguccugggauuacaggcaugagccaccgugcccggcccaaaaaugggauguuuuaaaucaucagauaauaaauacuuacaugaagaacugugaaccauuuguauccuucccucuguuggccauugacaagagaaauucuuuguuguguuuaacagcgaaacucucgucuauagagaaguaaaguuuucaguuacauuauagauauaaccuccaaaaaaauuucaucuucacuucuauucauaucugauguauuauuuagugccacacacaacuuacuuagauaauaaaguuagguuaugaaagaagagaaucaaauaugaaucaauuuccccucucaucuuuuuuuuugagauggagucucgcucuguugcccaggcuggagugcaguggcccaaucucggcucacuguuaagcuccaccuccuggguucacgccauucuccugccucagccuccugaguagcugggacuacaggcgcccaucaccacgcccagcuaauuuuuguauuuuuaguagagacggcauuucaccguguuagccaggauggucucaauuuccugacaucgugauccgcccgccucggccucccaaagugcugggauuacaggcaugagccaccgugcccagccuccccucucaucuuuuuaagauucaaauauuauuaauuuucuauuauuugcuuauaaaacccaaauauuaucucaauccccuuccuuuccauuuauauuuguccuucacaauuuuuggaaaagauaacaccacuuuauuuaaauaaaaaaaugaaacuaucuuuaaaaagcaagaaacagcugagcacaguaguguggcuguaguccuagcuacucagcagguugaagcaggaggaucacuggagcucaggagcuugaaccuaaagugcacuaugaucacacccaugaaaagccacugcauuccagcccgggcaacacagugagaucccaucucuuaaaaaaaagagugagacaguccagauuagauucuuuuacauuucaucuguuucauuucugagcacacagaguauuauuuagucuggacucauuaacuuaaccucugccauagcaucacuuaccgcaaaaggaggaauuuguuuuccaaucuuggguuagaauauuaagaacaaaucauguagaauuuuaaacaacauuucacuaaaugucaaaagugaaggaugaaaaauauuaaauuauuuccacauuaaauaugcuuauagaccauuuuccaaauggucuucacaucaacaaaaaaauuccagcaagaaaacuuaaauuuuuggaaaauauuauagucaaauuuuagaauaucaaagauuuuuuaaaaauguucauagaaaaaaugaccuaaaauuuggauguuguaagaaauauugcugaaucuccuuuaauaaaaguuaagauugaccuacggaaguuccuauucuaucauuaaaauucuaagaauuaaguacagaucauugaaacccuuucaaaucauguuguaaaaauguccuaagaagaaaaaauacccaucuguauaaaaagcaauuuuuuuuaccagaaaauuaaccuucagauuaguugaaggcagcuagacauuaguauacccuuuaaugaauaauguuauugauuccauagagaauaaaauagaauaaaagacaaaauauuuaaaacauaauauaaauguaaacauuuuuaccuucaaaaaauccuccauagauagauuccccuccucguccauuuccuaaaaaugaaaaacauacucuuauaacucucaguaagcuccucaaaggugauaccuaaacaaaauacuucuuguaaaguagauuuuugaauaauuuugaauuaacaauauucgaagauugcagcaaaucauaaaagauauuaaugucaauaacgacaaggucccaaauuacuuucuuuccccuaugcuaugauagcaagaaugugacgaagacuauuaaaauauauuuuaaaaaagaacuuucagauucuaauuaugauuaugcaggucuugcaacagguuaacauuuuuucaaaguuuuuuaaaacuauaguuuugauauuuuuacaauaaaaaaguaaaaauuuuuauuguaguaaggauuaccacuugugacaaaaucaaacagaaacacuugacagauuacugagaugaaugcaguguuguuuuguauccagaagccuauuucugaaauucaugugucaaaggcaaaauuauuuucuaugagcuuccuucuuuuuuuuuuuuuuuuugagacagagucuugcucugucauucaggccggagugcaguggcacaaucucagcucaccgcaacuuccaccuuucggguucaagccauucuccugccucagccucucaaguagcugggacuacagccacgugccaucaugcccagcaaauuuuucuauuuuuaguagaggcaggguuucaccauguuggccaggcuggucucgaacuacugaccucgugauccgcccaccucggccucccaaagugcugggauuacaggcgugagccaccgcacccagccuaugagcuuccuucuuuuacauauuucuaugaguacuucuaauugaccaaagauuaaauggagugagagugacaagaauauuggacuaaaacuucuagggacuugucuaacuuugagaucugugauauuuaacagaaaauaauacaugauuuuuccaagucucaccuucacugaagucaccaccuugaaccauaaaauccuugacaacucugugaaagagacaacucuuauaauguaaugguuucugaguugauuucccgguccccuuuucaccuauagagauaaaaaaauaggacauuuaauagaaaggaaaucaaaguaguaugaaagcaaaauaaauguaaaauaugccccucuugaacccugcagacuuaaaaucauauuuucauuccuuucaggaauuuuuuuuuaaaaauucauuuaaaaaaucacccacguuauuucuggagaauguagaaaucacucucaaauaauauaccuuuacaacuaauguuugguuuuagguuuuuuuuugagacagagucuagcucugucacccaggcuacagugcgguggcacgaucuuggcucacugcaaccugcgccuccuggguucaagugauucuccugccucagccuccugaguggcugggauuacaggcaccugucaccacacccggcuaauuuuuuuuuucguagagacugaauuucaccauguuggccaggcuggucucaaaauuccugaccucaagugauccacccaccucggccucccaaacugcugggauuacaggcaugggccaccacacuuggccucuauuuuuuuaauugagacaggaucucacucuugucgcccaggcuggagugcaguggagugaucuuggcucacugccaccuccgccuccugggcucaagcgaaucucccgccucauccuccagaguagcugggacuacaggcacacaccaccauacccagcugauuuuuuguuauuuauuuuuuugagacagaguuucacucuuguugcccaggcuggagagcaauggugcgaucuuggcucacugcaaccuccaucuaggguucaagugauucuccugucugagccucccgaguagcugggauuacaggcacccacuaccacgccuggcuaauuuuuauuuuuucaguagagaugagguuucacuauguuugccaggcuggucucaagcuccugacaucaggugaucugccugccuuggccuuccaaagugcugggguuacaggcgugagccaccacgccuggccgauuauuugcauuuuuaguagagaugggguuucaccauguuggacaggauugucuugaacuacugaccucaagugauccacccaccucggccccccaaagugcugggauuacaggugugagccaccaugcccagccacaccgugcccagccauaauauuucuuucuuuuuuuuuuuuuagauggagucucgcucuucuagcucaggcuggagugcaauggcacgaucucggcucaccgcaaccucugccucucggguucaagugauucuccuuccucagccucccaaauagcugggacuacaggcgugcgccaccacauuuggcuaauuuuuguauuuuuaguagagaugggguuucaccaucuuggccaggcucgucuggaacuccugaccucgugagccaccccccucggccucccagagugcugggauuacagacaugagccacugcgccuggcugcccagccauaauauuucuaagaauuacuuucacgcccuagucacugcuguguaaucuucauguuaagagaaaaguaauaugcauggagaaaucuaaaauagaguaaauaaaaaauuaaagcaagcuaugccaggugugguagcucacaccuguaucccagcugaggacgcuuauguguaaggauugaugagcccaggaguucuaguccaguuggacaacguugcaagauccugucucaaaaaaaaaaaaaaaaaaaaaaaaaaaaccaagcaagcaagcaagccauagucaacugagacuacuauuagggcaguugaaaaugugaacaaaccuguacaaagacaacgaaaguucucgcauguuuuggggcacacaucagaaaauaauucaaagacaacucuuccagcugaaaaagaagguaguugguuaaacuucuuuacuaauuuaaaauauuaaacacccauuuauaaaugucaacuaauauucuuaccagguugauuguuaauggcaaugucaaaaaaacaucgaggacguugaaccuuuauucccauggcuccaauacuuaaucugugaguaaaauacaguuucagacaagcagacuaaaauagcaaagaucuuucacaaauuucuggaaaaaaaauucugugaaacaauauuagaaauauaguuugaauuuauuuugauauuuauuucuaugagguaaaucacauggauuauuagugcuuucuuuuuagagauuagauugcauuuugugaagcaauuagaaaagacuugaaaguuaagccuuaaccauuauuauguaaucaacuuucuauuuaucaaccggaauacagauuaauagcucaaacagaaaauuguauuuacucuguaugauuagugaacucaauaagcagauuaccuucaaaugaagaaaagaccaaaaaaaaacaaggacaacugaucccugugcuccuagaaaacaaaaaugagaguucugauuaaaaugugagauuuuuaagaagcaaaaaucauguaagaagaaaaagaauaguauauaguuaauauacuauuuaacuauuguuaaauaguauauaguuaauauacuauuuaacuauuguuaaauaguauaugugguagauuuacauuuugaguaaaagcacauucaauuuuacauaugaggguacuugcugauucugagcaacagccuuuacugauaugcugguauagacacaaaaaauaccaaagagauacucuguguaacagcuuuauuuccauaacagaaagcuauuauuuaacagacauuauuuugauaaggcauuuuauuuuaaggacuuaaaaugcugaaucguaauacuugguggaagaugauacuuacccguagaagaaacaaaggcacuaaguguaaauaguauccaaaaugauggacucuaaaaaugacaguuucauaugcuauguacgcuauguuauauuucaauaaaaauuuacuuuauuaaaaauaauuaauauaucuaagacaaaacucuuuauucuucuaccuccauucccuugaauacucaguaaacauuaucauuguccaagccagcugcugaggcugaaaaccugggggucaucuucgguuccacuuucccucauaccucauuauccaaaccauuaggaagguaauuuggcucuagcuucaaaaacuaucccaaaaguucucauuaccuuuaccauuaucauuucuuaucuaggcuauuccaauagccuccuaacugguuucucuuauuuuacucuuaauucuguacugccucuucugcacaaaauagccagaguggaaugauucuuuuaaaacacaaaccuuaucauauccuuccccugccuaaaacugucuuacuauucaucugaaaaguuuuagcauggauuuuaaggcucuagaccagcacugcucaauaaaaacaugagccacccagguauaaaauuuuucaguagccacauuuugacaaacaaaaacaggcuaauuuugggccgggugcgguggcucacgccuguaaucccagcacuuuggggggcugaggcgggcggaucagggucaggaguucgagaccagccugaccaacauagugaaacccuaucucuauuaaaaaugcaaaaauuagccggcugugguggcgggugccuguaaucccagcuacucaggaggcugaggcaggagaauugcuugagcccgggagguagagguugcagugagccaagacugcaccacugcacuccagccugggggacagagcgagacucaaacaaucaaacaaaaaccaggcuaauuuuaauauauucuauuuaacucaguauguacagauugaauauccuuuauaggaaaugcuugggaccagaaguguuucagauuuuuuuuuugaauuuuggaauauuaucauacacgagauauccuggggaugggacacaguuuaaacacaaaauucauuuauauuucaaacauaccuuaugcauacagccugaauuguauguguaauuuuauacaacuuaaaaaauaauuuugugcaugaaacaaaguuuguauuaaguacuuaugugugaaauuuucaauugugaugcucagaaaguuuacauuuuggaccucagauuuucagauuagugauguucaacuuguacaaccaaacuauuaccacuucaaaauauacuaaacaaaaauguuacugaguuuuuuuuuuuuguacaagucuuuggaaauccaguguauauuuuauccuugaagcauaucucaauguagacuagccacauuucaagugcucaaaaagcacauguggcuuguggcuacuguaauuucaauuauacggcucuaaauauuuuagcuccuguucaccucuaggcauuuuccucaacuuucauuuccuaacaucuucuaauauuuuccucaacuuuauuucagcuacauugguauccugcuuguucccccugccacccaacagccuacucuuucaucagguccuuuacauuugcuguucucuccaccuggaaugcucucaaaccaucuucacaugguucaucccuuuguugcucaaguaucaccuucuuauagaggcccauuccuagucuacuguauucaagaaaggagcucucauccuccuaacacuuuacauccucuuauucugcuuuauuuuucuuccaagcauuuauugcuaauugauauucaauuuuuauauccaucuucucucacuagaauauaaguuccaugaugugauaaaccugaauuuucagucuuauucuuacugcucaaacagugcuuggcauaugacaagaaaucaguguuuauuaaaugaaugaauaaaugugagaggauaggcauaagugagaauguaaaauugcaguaacaacaacaaaaaaauggaaacacucaaaauaucuuacaauggggagaaacugaacaaauuacgguauaaaaugcuauuuaauacuauauggcaguuucauuguaacacaagccaagaaaccuacuguuuaguucaaaagaaacaaaaaaguaaauuguacauaaguauuucuuuuaacaccauaaaacaauacccuauuucuacaaagagagaucuugaaaauacuauauauaccaaacuccucacagaaucucugcaaaagggacugagucuaggaauggaagucauugggggccuucagcuuuacguauaagguuugaauuuuugcaauaagaauauguucauguauuaguuuuucaacuuaaaauucauaaaaguuuaaaauguaucugcacaguaaaacaaaauaggaaauaaaugaaaauauugagucuaucucuaaguaaaugaguuauaggugauuuuuauuuuaguuuuugcauuuccuagguuguauacagcagacuuaugaaagaaacucagguaagcauguaauuuaaaucuucaauuauauauuuuuuucuuuuuucuuauuuuuguuuuuguuuuucaaugacauuuuuaaagugucucacugucaugauuacuacaucaugauugagcauccuaaaucugaaaaccccaaaucugaaauuuucugagugccaaaaagacacccaaaggaaaugcucauuggagcauuuuggauuuucagaauuggaagguuuaacugguaaguauauugcaaacauuccaaaaucugaaaaagucagaaauccgcaauaauaugguccaaagcauuuuggguaagagguacucaacuagugcugcuguuuaacauguaaagagcuuaggaggcugggagcaguggcucacaccuguaaucccggcccuuuggggggcugaagcaggcagauugcuuaaguccagcuguucgagaccagccugggcaacauggcaaaacccugucuccacaaaaaauacaaaaauuagacaggcaugguggcacaugccuguagccccagcuacuggagacgcugagguggaaagaucacuugagccagggaggcggagguugcagugagccaagaucaagccacuguacuccagccugggugacagugagaccccguuucaaaaaaaaaaaaaaaauuuuuuuuuccucucacaaaauguguaccuccccacaaaauagaaacuaagaaaaguacuugcgaauauuuaccugaacccuggauaugaaacagcuuuuuagauucacuaaugaaguaaauaauggagauaaacagauuugaacuuaugaaaaaaauuauuucuauuugucuaugugaaauuaaaaagaaaaaaauuggggaaaauacauugucauaguugcugagaauauuaauuuucuuaagcagugcuuaggaaugggggcacuagggcaauucauugaguaggguuauccaacucacugcagaaccuuaagcaacccuugcccuauuaaauaucagucacugugacaaccaaaaccuuucacugucugucuaucaaauuaaagcucaaaggacaccuaaggguguaugagcagagaauucacaaaaagugaaauaacaaaaaaaaacauaaaaggcaccagcaguuuugauaagcaacuuggcauuacaggccaagaaucuugaauauauucauauucauuguaccuuuuaacauuuuacuaauucuauguacuggaauaucuguaaaggcaaccauuuaaaauaaaauaguccuuggguuuuuuuuuaaauaacaguaagcacaaacaacuuaaaugucuaacacaauaguuaaguaaauuaguuugugauggacugccuaagaaaauaagcuuuuuaaaauaacaugaaaaaauguguuaaaugccacaugaaaaaagauaauuguacaguaguaagaauuacuuaaaaaauacccccaugaaaugaaauacuaucuaugagaaaucauaaucuuacauauuaaaauuacaaacguaacauuuuuucaccaauuggauugacaaaaauaaaaaaugaccucauuuauuguugcugcugguaaagggauaaacugauagaauuacuugauugccaauuugacaacaaauauccauauuacaaaugcauuuaagacucucugacucaguaauuccacuucuaggaauuuacuuuauguacauccuuacacauucgcaaaauaagauaugugcaagguuauucaauguaccauaauuuguaguaguaaaaggcuguaaaccuaaauguccauaaaggaggaacagguuauagaaauauaaaccuguauuuauauaaauauaaauauuuaccuauauuuacauaaauauauuuaccuguauuuauauaaauauauuuaccuguauuuauauacauauaaauauuuaccuguauuuauauaaauauaaauauuuauaauacuuugauaaauguauauauaauuugauauauaauacaaaauaauuuaauaaauauaaaucagguauaccacuguauaccuguagaaaguacaaagcuauuagaaagaaugagaaaucuguucauuuacugcugucuccaagauagggagaacuauuuccuaaaaucuguaaauguuaacuuauuuuguuaaaugaaaaagaaaauaagccaggcgcgguggcucaugccuguaaucccaacauuuugggaggccgcuuuggguggaucacaaggucaggagaucgagaccauccuggcuaacacggugaaaccccgucuccccuaaaaauacaaaaaaauuagccgggugugguggcaggcgccuguagucccagcuacucaggaggcugaggcaggagaaaggugugaacccgggaggcagagcuugcagugggccaagaucgcgccacugcacuccagccugggcgacagagcaagacuaccucuccaaaaaaaagaaaaagaaaauaaaaggcuagaugcaguggcuuacacuuuagaaggcugagacagguggauugcuugaguccaggaguuugagaccagccugggcaacauggcaaaaccgucucuacagaaaauauaaaaauuagcugggcauagugaugcaugccuguagucccagcuaccugggaggcugaggcaggaggaucauuugggcccaggaugcggagguugcagugagcugagauugugccauggcacuccagauugggcgacagagugggacccuguaucaaaaaaaaaaaaaagguugcccaggcaugguggcucaugcuuauaaucccagcacuuaggaaggcugaggcagaaggauugaaacaccaggcugggaaacauagggagaacuuuguuucuauuucaaacaaacaaacaaacaaacaaacaaacaaacaaacaagcaagguacagaaguguguaggauauacugucuuuguauauuuuuaaaagaagagagagcugggcgugguggcucaugcuuguaaucccagcacuuugggaggucaaggcaaguggaucaccugagaucaggaguuugagagcagccuggccaacauggcgaaaccaugucuuuacuaaaaauauaaauaauuagcuggaugugguggcgcacgccuguagucccagcuacucgggagguugaggcacagaauugcuugaacucaggaugcggagguuguggugagccaaaauugcaccagugcacuccagccugggugacagagugagacucugucucaaaaaaaaaaaaaagaaaagaaaaggaaaaaagaaaaacgagagaaaaacgaaaguggggccaggcauggugacgugcaccugcaguccuagcuacucaggaggaucaggugggaggacucuuucagccgaggauuuugaggcugcagugagcuaugguagcaucacugcacuccagccucagaccaucuccaaaaacaaaauuaaauuaaauuuuacaaguauguauuugcuuaacaaaaaggcaucuagggagagagaaaauggguaacuggaaaagagggcuaagauuuuucacuuuauaaccucauauuuucaauuuuauaccacaugaauauauuaucuauuaaaaauuauuauaacauaucccacuccuagguauacacucaaaagaaaggaaaucauauaucaaggagauaucuucacuccuauguuuauugcagcacuauuuacaauauccaagauuuggaaguaacuuaaguaucuaucaacagauuaccagauaaagaauaugugggcugggugugguggcucccgccuguaaucucagcacuuugggaggcgaaggugggcagauuaccugaggucaggaguucaagaccacccuggccaacauggugaaauccugucucuacuaaaaacacaaaagugagcugagcguaauggcgcaugccuguagucccagcuacucucaggaggcugaggcaggagaaucgcuuaaacccgggaagcagagguugcagugagcugagauugcgccacaacacuccagcccaggcaacagaguaagacuccgucucagaaaaaaaaauggaccaggagagauauuagugcugguugcguggcuccaaaggcagacacuguugggggacugcugcauuaggugacuccuggagccuucaagucuucaauuuucuuuagguuucauggggagugaggcccuucaggcugcugaguguuacaagaaaguucuccgcuuuccugccucacugagcagucuaaaggaggugaggugagcuuucugcuggcauuacuucuggcaccaucugcuuuucccuaaggccaaaguuucccugggaucuagggguuuaggccacucaaaacacaauuuucggccgggugcgaaggcucacgccuguaaucccagcacuuugggaggcugaggcagggggaucacuugaggucaggaguuccagaccagccuggccaacaugaugaaaccccaucucuacuaaaaauacaaaaauucacagggcaugauggcgugugccuguaaucccagcuaccugggaggcugaggcaggaaaauuucuggaacccagagggcagacagagguugcagugagccaagaucgcgccacugcacuccagccugggcaagagugagacuccgucucaaaaaaacaaacaaaaaggccgggcgcaguggcucaggccuguaaucccagcacuuugggaggccgaggcggguggaucaucugaggucaggaguucaagaccagccugaccaacauggagaaaccccaucucuacuaaaaauacaaaauuagccgggcguaguggcacacgccuguaaucccagcuacucgggaaggcugaggcaggagaaucgcuugaacccgggaggcagagcuugcagugagccaagaucgcgccacugcacuccagccugggcaacaagagcgaaacucagucucaaaagcaaaaaacaaaacaaaacaaaaaacugugauacauauacacaacggaguacuauuuaaccauuaaaaagaauaagauccuguuauuuguaacaacauggauggaacuggaaggucauuauaguaaguaaaauaagccaggcacagaaggacaaacuucacauguucucacuuauuugugggagcuaaaaauuuaaacaauugaacucuuggagauaagagaguagagagacuguuacuagacacuugagaggguaauggggacuggaagugaggaugguuaaugggugcaaaaaaauaguuaagaaucaauaaaaccuaguguuugcuagcacaauggggugacuaacgauacucaaaaaaaauuuaauuguauauuuaaaaauaaagaguauaacuggauuguuuguaacaaaaaggauaaaugcuugagaagacggauacuucauucagucuaacgugaucauuaugcauugcaugccuguaucaaaauaucucacguaacccauaaauauaccuacuauguacccacaaaaauuaaaaauuaagaaaaggguaacuuuuaagacacugaaaaaacuuacuauaaaaaugaauaggccaggcgcaguggcucacgccuauaaucccagcacucugaggcggguggaccaccugaggucaagaguucgagaacagccuggccaacauggcaaacuccaucucuacuaaaaauacagaaaugagcugcaugagguggugggcaccuguaaucccaguuacucaggaggcugaggcaggagaaucgcuugaacccgggaggcggagguuguagugagcugagaucaugccacugcacuccagcuugggcaacagagugagacuccaucucaaaauaaaauaaaauaaaauaaaacugccaggcauggugucucacgccuguagucccagcacuuugggaggccaaggcaucacuugaggucaggaguucaagacuagccagcccaacauggugaaauuccgucuccacuaaaaaauacaaaaaaauuagcugagcguagugaugugcaccuguaaucccagcuacuugggaggcugggacaggagaaucucuuaaacccaggagguggagauugcagugagccgagauugugccacugcacuccagccugggugacagagacucugucucaaaaaaaaaaaaaaaaaaaaagaaaagaaagaguaaaacugaagaagaaaaauuaccagauuguucaugaaugacaaaauagucauaccaggugaaaaaagcaaguuaguaaacaauacagacuauaaaaucccaauuucacacguaucaguaagcacauuaaaaagacaggauuuacaccauaauguuagcaaucaucaugugugggccauggguuuaaggguaauuuuuaauguauuuguuuuccaauuuuucuucaauuucguaaucaggaaacaauuauuuuuaaaaaaguacuaauaaaaugcguuuuuuuuuuuuugccuaucaacagcaaagaucuuuuaaaagaauaacucucaacacauguacaaauggaaacaggaauuuauacuacuacuagugaucauauacaacuccuuugaaauuuaagaauaugagaaauucauaaguguuuauacuuugaaccaguaaaauucaacuguuggaaaucuauuaugaggaacuacucuaaauucagaaagccuucagguauaaaguuggcuacgcuggugcucuuuuuagcaacauauaaucaaaagcaaccuaucauaauaucacaaaaaagugaaauugucucugguucaacaauaauuaaagcaaugcuuaugaagauuaauaauuuggaaaaauaaucaagauauaaaacagugggccgggcgugguggcucacaccuguaaucgcagcacuuugggagcccgaggcaggcagaucacaaggucaggagaucgagaucauccuggcuaacauggugaaaccccgucucuacuaaaaauacaaaaaaaaaaaaaaauuagccgggcaugguggcgggcgccuguagucccaccuggaggcugaggcaggagaauggcgugaaccugggaggugaagcuugcagugagccgagaucacgccacugcacuccaaccugggugacagaaugagacuccgucucaaaaaaaaaaaaaaaaaaagauauaaagcagcauaugcaacauaaugaugauuguguaaacuacucccgaccuucaagcucaggcaaagacuuacaagaagacaaaaaaagagugaaaggaaauaaaucauuauugugugugucuguaagacuggagagggcuuuugccucacuacuucuuucuaguuuucuuuaauaaauguacugcuacuuugggaggccaaggcggguagaucaccugaggucaggaguucaugaccagccugaccaauguggugaaaccccaucucuacuaaaaauacaaaaaaauagccgggcaugguggugggugucuguaauuccaguuacuugggaggcugaggcaggagaaucacuugagcccaggaggcagagguugcagugagcugagauugugccauugcacuccacccuggacgacaagagcaagacucugucucaaaauaaauaaauaaauaaauaaaauaaauaauaaauguacugcuauuauaaagaaaaaauuccuaagauauauauauauauauacacacacagucuucuaacauuauaauguacauguguggaaauggcuauaagauguauucagagucuaucacucaaggauacacucuucauagaaauugauuaguuuuccugaaaugacaaaucacauaugccucaaaugcaagaaagaugaaaggcagcaaauuacuauuaaaauuacuacacaaaucccuugaauauguaaauguuuuaauauuagcagcuaaugaaaaacaauggugacaacaaaagauggcucacaugcugugucgcuaacauuacugaaaugcuacuaauuacuaaucauuauaaaaaguuacuaauuacuaaucagaaacaguauauccuauuuccucuauaauuaugauuuccucgauuauuaaauaauaccugaaaucacggugguucacacccguaaucccagcacuuugaggggcgaagggaggaggaucacuugagcccaggaguucaagaccagccuggucaacauaaugagaacgcaucucuauuagaaaaaagaaaucugagccaggcacgguggcucacgccuauaaucccagcacucugggaggccgaggcgugcggaucacaaggccaggagauugagaccauccuggcuaacauggugaaaccccgucuccccuaaaaauacaaaaaauuaguugggcgugguggugggcgccuguagucccagcuacucuggaggcugaggcaggagaauggcgugaacccgggaggcggagcuugcagugagcagaguucgcgccacugcacuccagccugggugacagagcgagacuccaucucaaaaaaaaaaaaaaaaaaagaaaaaagacaucugaaaccagaugcaguaagacaaacaucuggucaauuuuucauuuuuuuucaaguaaaaguaaagagaaaaaauaaugcuaggagauaccaaaaacaugauucaggggaaaauuaagcccuuacaauuuuaaauaaaauauccaugaccagccugggcaacagcaagaccccaucucuauuaaaaaaaaaaugacaauuagcugggugugaugacccaggccuguggucccagcuacuugggaggcugcggugggaggaucauuugagcccaggaaguugagguugcagcgagcagucaucaugccacuacacuccagccuggccaacagagugagacucuguucaaaaaaaaaaaaaaaaaaaaaaaaaucaugaauugccuaaaaauacuagaauauaaucaaaauuuucaguguaguaguaaucugugggugauuuguuugcugcaaauuuguuuaguaugaacuacagcuaaaauccagacaaauuuuucuuggaaaaaaaaaaaucacaauauguggcacugugccccauuucuacacagcaaucagcauagucugcucccaacagaugacauauauauguucuaguuugaccuaauucuagcuauugcuuauuagcuguuaaaauuuauugucuacuugaccucauguacuuaccucaccugcuugacuccuucagaaauuuaaguauaauauacugaaucuacuuuuuucaucauaaugaaaacacauuuuuaauaagauaagcaauaaagcuaauaagcucacugaaaaaaauuaaucauacaaaaugcacaaaauucuaaaacuuagcuauagcuuuuaauacuuuuauuauauucuuguuuuuccuaugcaggugauuaaaguuauuuuuaauauuuaucaacaauauagucacuuuuguauuucaauaauaagguaauacaauuuaaaaauaucacagugcuaucauuuauaaacuucugcaacaaacacauuucauaaaaaaaucaguaagagguaaccaguucauguguaaaaaaauuuauccuuguaguuucauacauaaacuauuuuccauauuaauccuaaaauaacaugacuaaaugaaaaacaggacaaaaauauaggcaacuaauuauuaaaauauauaguagcggacauggcauuuauaaguaggcauaugguaacuuuauuauauuuuaaaguuauuuggaaguuucacacauuaugaggaagucagcauagcaccgaguuucuaaucuagaaaaaauacaaaguaaauuauuucuauuuuuagagacagggucucgcuaugccgcucaggcuggagcacagugguaagaucacagcucaccgcagccuggaacgcaguggcucaagcaauccuccuaccucagccucccgaguagcugggacuaaaggcgugagccaccaccuccagcuaauuuuuaaaaauuuuuuuguggauauauugccuagucugaguaaauuauuuuuaacgauuaagaugccaagcaagucucugacccuuaggauucuccucacugauucccguguguccuuuuaagaugcaaauuagccagauaauuaguuagccagaguucacucucugggaacuucacgcugacucucuaaggucuguuuguuuguuuguuuuucugagagggagccucccucugucacccaggcuggagugcaguggcgugaccucuggcucacugcaagcuccgccucccggguucacgccauucuucugccucagccucccgaguagcugggacuacaggcacccgccaccacgcccggcuaauuuuuuguauuuuuuuaguagagaugggguuucaccguguuagcuaggauggucucgaucuccugaccuggugauccgccugccucggccucccaaagugcuggcguuacaggcuugagccacugcuccaggcccugacuuucuaagguuuaaaugauccucccuuguuaaauguuacucuuuuaucauaaacuccaacaauucgaaaccuuuguaucuucaacaccaaacacagugacguuaucaaauaaaaagaauguuaauugaggcaugaacagaacuagacucuauuauaauccagugccuauccucuuaaacauguacugcuugcuuccuuuuucuuuucuuuucuuuuuuuuuuuugguuguugucguuguugagacagaguuucgcucuuucuuguugcccaggcuggagugcaauggugcaaucucagcucaccacaacuucugccucccagguucaagagauucuccugccucagccucccgaguagcugggauuacuggaaugcgccagcacacccggcuaauuuuguauuuuuaguagagacgggguuucuccauguuggucagacuggucucaaacucccaaucgcaggugauccgccugccucagccucccaaaguguugggauuacaggcauggggccacugcacccggacugcuagcuucuuaaauggggauacugcuaacauauaucuguagucaguaaauucucccagaaccuaccaccaguaaucauccucucugccuccuccacaacugaaacagaacccauucccuagaucuacuaggaaguguuuuguuucccaaaaaaacaaccccccccaaaaaaaccccaaaaccagaauccacuucaguuuacaaccaagaaagaaaggauuauucuuaucugcuaaauuugaugaaacaggagacaauuuauauauaagauuuccaccucuuaagugaaaucauguaaguuaaauuaauuaaaacuauagcagaucuuuaauauuacuuucaaggaaaguaauuuaacauuccuaccagccucuuuagccuacucuuaauguaguucauauagaucaaaugagaaacgaaaaugcaccgcaucaaaaacauuugaguauauuuacaaaugccaaguugcuaaugaauaaaguagaaacaagcuaacauucugaggugucaagacagacaauuaugcuauuucauguagugucccuuccacugauguuucugauggacacaaaccacccugaugcaaaccacugcacugguagcaacaugauuagcagaguauagacacuucugaaauucuuaaauccucuagaaaacuuacagagauaacccauaauguugccuaauucaguguuaaauaaggauauuacgcacuuacuauauauacgaucugagagacauaaaaauauaauacaucuuugucacuaccaaacuacaaaagcaaauacuaacugggaacucacggcuaauacucuuaauguuguacuugcaauuaucuaagguuuuuuuuuuuuuuuuuuuuuuuuugagagggaguuucguucuugugcccaggcugaagugcaauggugcgaucuuggcucacugcaaccuccgccuccuggguucaagcgauucuccugccucagccuccgaguagcugggauuacaggcaugcgccaccaugcccggcuaaauuuguauuuuuaguagagacaggguuucuucauguuccucaggcuggucucaagcuccgaccucaggugauccacccaccucggccucccaaagugucgggauuacaggcgugagccacugcacuccgccugaucuaaguucuuauaauaauaaauuuaccaaaaccaaaaacaaaaaagaaaaaagauuuacccccaguuuucaaagauauauacauauauacacacaguucuaaccccauuauucaauccaguaauuccuacguaaaaaaauaagaacauuuggaguuucaaggaacucuaagagauaaccugauccaaucuucugauuuuauagaucaagaacaagaggacaaaagagaugaaaugaguggcucaagcucacaaauggaaaaaagcaaaaguucugauuuaguacuuucuacaauuucacgguaaaaacuaguuuacucacaaauauuccacauaauggcuuaauauuacuuuucaccauauaaccaugauucaaugguuuaauuauaagcuaaaauguauacaauaauuaacaagagcuuaguauauacacacacacacacgaauaugcuucguucauuuuuaaaacgaguuaaggaaucauucauauuuuuauuuuuauuuuuaauuuuuugagauggaguuucgcucguuucccaggcuggagugcaauggcgugaucucggaucacugcaaccuccaccucccggguucaagcgauucuccugccucagccucccgaguaguugggauuacaggcaugcaccaccaaugcccagcuaauuuuuguauucuaaguagaaacggagagacgggguuucuccauguuggucaggcuggucuggaacucccgaccucaggugauccacccgccucggccucccaaagugcugggauuucaggugugagccaccacccccggccaucauucauguuuuuaaaauaaucauuuuaauauaaaagauugguguuuauaaguguuauauaaucaaauuucaguaagcgugugaucauuuuaagccauuauucuaaaacaaaguucaaaaguuuucuugucugcugcuagaaguacaaacucccaauaacagcaguuuucucugaauacugucuguaguaaauuucaggaugcaaguuuuucccuacagaaauaaaaauaccgaguucuuauggugaccauuuaugcauuaaaccagggaaaaucaccgacacuuaagcaacaugaaaauugaaguuuaguccuaacauuaaaagcaaaaaggucugggcacgguggcucacgccuguaauacuagcacuuugggaggccaaggugggcagaucaugaggucaggaguuugggaccagccuaaccaacauggugaaaccccaucucuauaaaaaauacaaaaaucagcugggugugguggcacaugccuguaaucccagcuacucaggaagcugaggcagaagaauugcuugaacccgggaggcggagguugcagugagccgagaucacgccacugcacuccaguaugggcaagacagcgagacucugucucaaaaaaaaaagcaaaagucaggcugggcacagugcacaguggcucacgccuguaaucccagcacuuugggaggcggaggcggauggauuacuugaggucaggaauuugagaccagcguagccaacauggugaaaccccuucucuacuaaaaauauaaaaauuacccggugugguggcaggcaccuguacucccagcuacuagggaggcugaggcgugagaaucccuugagcucaggagguggagguugcagugagcugagaucaugccacugcacuccagccugggcgacagagcaagacucugucugaaaaaaauaaauaaauaaaagcaaaaagcaugcaaugccacaaugcaacagaaagacuugcaacaaacucuucaggucacuugcauuaauuaucuauguauuccuucaugacaucuuaguacacugggauucuaaaaauagacaacauguuauaauuauguuuaaauacucuauuuauaaacuaauaggaaggaaaaaagccuaacuaaaggggcaacuacuauuuaaagaauuaaccccagauaguguccuaacagaaguacuuuauuaugaauggcuuccacuuucccuuuguauaaagaagaggaugcugccucacagaaaaucuaauuuaaggcaaaauaucaaaaauauguagaagucaccaauacugcaagaccacaauaauaagcaccacaguaaaucgacuauaugguuaaaaauaaauguaaugaacacucuucacccauaaaggaaccacugaguuaaugaaagccaacuucacacacaauuuuaacaaagcugaguauuuaauuuucaagcccacaguugauggaagguggagaucaaaaugucauuuugcagguaggugaagaaacugaagcucagaaagauaauugggccagaaaguccaaauuuuucuaaccuaagaaguuuacauacuuauacacuccugacagcaggagcacuccugacaacugacugccuagaaaagccuuaaaaaggaaaccaacaauucaaaugcgcagaauccuacuacaagacccuauaggaucucagagcaucaauaauucugaaucauaaagaaauagucaaacaauguacaaugaacucuuguuuaagacacagaaccauguaauuuguuacagaaauaauucugucccaacucguuaacauaaaaaaaaggggagugcuaaaacggguaaauuuucaggauauauuaaaaacaggagagaagcagccauucuaaauguaucuuuucuggauuuuauagcacgauuucaaaauuuauaaaauguucacccccccacccgucauuguuacaaaguagcaauuaccggccauccuguuaccaaaugggaauacacaaagacaaaaacgugugugugaccgacacacacacacacucacucuuuuuuccugguuuuaacuacugaaaguuaauaucaggccccccuaauuucuaaaacaucuaauuguucuuuggacaacuauguuaguaccaaacuauaaaagcaaauacuuuuguauuuguguucacuacugcaaaauguugguuacacacagaaagggcuaucguggaaagaaauuaaaaucaaugcacaaaauggugcuuuuauagcauuuccaaaacgauugugcauacuccuugccagcacaucuagacuuugcuccuuaagacuaaacaugagcuggccgugcgcgguggcucucgccuguaaucccagcacuuugggaggccgaggugggcggaucacgaggucaggagaucgaccauccuggcuaacacggugaaaacccgucucuacuaaaaacacaaaaaauuagccgggcaugguggcacgugccuguagucccagcuacuugggaggcugaggcagaagaaucacuugaacccaggaggcggagguugcagugagccaagaucgcgccacugcauuccagccuaggcgacagagcgagacuccgucucaaaaaaaaagacuaaccaagaaccaaauuagcauacuuccccuucaggcauacugagccccgaaaucaucaucuuccuccuaaagaguaauuaucuccuccuaaaaggccugcgcagcucacagcuccuccgaaacacgggggaacuucgcgagagcucaagacccuggacuugaguuuuagaaaaaugcuuaacaaaguggccucugccacuuaacugcacgacagccacugugcugugagaggaaaaggucgaaagaggaggaaagcuagucuucaauuuuaaucccugugauucaggcucuucgcccgucacucuccaacccuagccugacaggacgucaggcugucucccccuuccccaccagucccgccaccuaccccgcaacagugcugagucuuaggauuuugaagcuuuaaaaaucaacccggcucccuagaguucaggccgcagucgcugccgccauguuacagcuugugcggcaaaaugcgucagugagggaggugugcgccugaguggggagggcgggggcuggcagaggaaggaccguccccaggccccggggcucgacugcaagccuucuccuucugcaacagcggcaaaggcacugcugcgguccucagggacuuccucugggcccaagcagccccgauaccucgagggaaagacgguaaacccaacccggucagccgcgccggcuccgccccucuucccaggcccuucccgcuuucguacgcagggacugcugaaaugacgccgccagaacaacuugagccucauaccacuuaccugcaccgguagaguuuuccucuucucuggguccgguccuuugaagcgcuucaaaucuaccgccgccagaaaaggcgcuaaagcccgcuaaccgccucccucccccacaacucaguccuggcauggagagacagcgucgcaccggaagcgcgucaggaguggguugucagcaucggccagcguucaccugcuugcgucaccacgcccuccuaggacuucuaggauuuuggugccuuuuaaauuccuaguuuauagguggccuaaugcuuuguggaugcguugacugggaacgcuuguaaccguuaaaaugccauauccuuugugaaguaaagugccucauuuaauaaacauuuauugaucuuacgcuagguuaucagaaaggaaggccuaccuucauggagcuuccaguuaa

SEQ ID NO: 13216 - RNA, 719 nt, Homo sapiens
ucaauaggucuuuuauugcaucauuuaaauaucacaaguaggucuuaagugucaucuggcaucuucuuucuguagccagguaacucuuagaucuuauucaucagccugcugaacaguuccuuuuucagagacauagauaccauccaaaaauuuccugauauccuuguuuuuaacuguuguggcuugcugaaucaaagccgcugaauuugaaacaagcucaaugucauuuccuucaaggauuaauucaucuuucugggcuugagauacugaacaagcaacaccuggucucauccgaacccugcggauguauuuuucacccaaaaaauuucggauuucaacaagagacccauucuccuggauaacaacguugauggggaagugagcauacacagaccucaucuuguaacggaagcccaguguaacacccuugaucauguucuguacaugacuacaaauaguccgaacgguagccaguuccuuucuguuaccccaccauuugucaacccggagccucuuuuuuuucuuuccaagaaggcugaguucuacauugaugugauugaagucccuccgcaggguuccucuggggcccuucacgauaacugugcgucccuucagaguaaugucgacauuuucuggaaugucgacagucugauugcugagaauagucuucauucucgcaguagacgcagcaaagaaagccuaauuucuuuauguaugau

SEQ ID NO: 13217 - RNA, 2258 nt, Homo sapiens
uuuuuuuuguuuaaauuagaaaaggaauauauuuauuugauaggauauccacaaaauuguacauguaagcacccucuucaugugauaaagaauauaucugacccauacugcagcaggaaacagggguuagggcccuaagagcuagugccaagaguccacugaaaaaacuccccauucaccagagagggaguguuuucuugaacuccaucaucucuguuuuagcucccagccaggucuuuaaaccuuagaauccuucgugccacuagcaguucaugcucuuuacccucgccucuacugacucuuucaagacccauguccacugccccauccucacucacccaggccaccucugggguccuaagcacaucucucuggggugcugcugcccugccacccucaggggcaugguuaagguuggcagggagaacauaagauuauauuaccaaaagcaaaagcagggguacauuaguaaaugacagugcuuagaccuaagccucacaaccucacagaacacgugcuuccucccucaaaugauacguaauccccuagagaucaaaggaaaccccuucaguauuuuaacagguauggaugauuccgcaugccagggacaagggauacacgugggugguguuuacuuccauuauauacccugcacagaguaggaaguuaguggaugaaagccagaaccagaucucuauccugacuccaucagaucucucccggcucuuccugccuuugaauggugccaucauucugcuucuguccauucugggcauuuguucuuuuuccaaaagagaggauaaaaaaaaauggauggcagagagaaagaguguguguguauaaagagagaaggggaaaaaccccaguaaaaaaaaaaaauacaaaauuccagaaauuagcuuuacagauuaaaauauuauauaacaauagaaaauagucgaaaauucuaccugcuugcacagguaauaugauacacaacuucagagaauggagucagcaggagauuguggcagaggccacagcuuuagacuaagucuuucuuuucuuuuuuuuuuuuuaauuauacuuuaaguucuaggguacaugugcacaacgugcagguuuguuacauauguauacaugugccauguuggugugcugcacccauuaacuugucauuuacauuagguauuucuccuaaugcuaucgcucccccagcucuccacccacugacagggcccagugugugauguucccugcucuguguccaaguguucucauuguuuaauucccaccuaugagugcgaacaugcgguauuugguuuucuguccuugugauaguuugcucagaaugaugguuuccagcuucauccaugucccuacaaaggacaugaacucaucuuuuuuauggcugcauaguacuccaugauguauaugugccacauuuucuuaauccagucuaucauugauggacauuuggguugguuccaaaucuuugcuauugugaauagugccacaauaaacauaugugugcaugugucuuuauaguagcaugauuuauaauccuuuggguauauacccaguaaugggaugguugguucaaaugguauuucuaguucuagauccuugaggagucaccacacugucuuccacaaugguugaacuaauuuacauucccaccaacaguguaaaaguguuccuauuucuccacauccucuccagcaucuguuguuuccugacuuuuuaaugaucaccauuguugcaaaagauaugaacagacacuuuucaaaagaagacauuuaugcagccagcagacacaugaaaaaaugcuuaucaucacuggucaucagggaaaugcaaaucaaaaccacagugagauaccauuucacaccaguuagacuaagucuuucaauggacugcugaauggacuggaucuacugcuugagcugugagcuucuuugacagugacaggacagacgaugacagaucuggagaccccacaggcccacccgagggccuguuuggagcauacaaacacguagaacacauucuugucuucacacagcagcugcaggugcagaaugaucuccagcagcuuggcaucugcagcccccacaaugaacccagaaaugccccuacugaggguuuugguggccucuuuggcuucuuucuaaagcugccuguaguuacauggcuacugcacgagguccaguaguuucuuggugagguggacaucugcgagaggguaggccuuuggauuuacaucagcaucagccaug

SEQ ID NO: 13218 - RNA, 3469 nt, Homo sapiens
cauccaaugaaaacaauaauuuauuuaaauaaucucuucauauuguaaaaucaacauuaagagcauguuguuuucauaauaaauaaccccaaaauaccuuucauuucaacaacaaagacuuuaggauacgauaaaacaaauccaaaucaguagcuuaauuuaacugaaauguuuuuaaaggaaaaaauaaaaaggagggguugcugaggucacugcuaaacugcaguuuucacaacuggggguuuacaaaaaagucugaaaagaugaguauuuuuauacaaauaaaucagugggaaaaucugcacagacaccuuuauuuacaaacucuguguccaaguccaggcuaauaauccugaauagguuuuaaaaaagauaauuuaaacacauuuuugcaguguucacauauuaaaaaaucauuuuuucaacgucaaaaugaggucauccgcaaaggcaccuaaacuuuuaaaaaaauaacaaauaaaaaaacuccacuggugauggaugaggagagagcugagggagcgcuccugggggagcgcgguggggguaagauaagggaugggggcuccgagggcugggaacugcaggaaggaaagaagcggcggggccgcccgggucaaggggccacgugggggagggcgggcaggcgggaccgggaggucaauaacugcagcguccgagcugagcccaggggagcgggcgaggagaaagaagccucagagcgcccgggaagccucgcgcgccugggaggcuuccaucucccgggacccagcucucagcccggggcgaggaaggcgccagacaggcucacccggaggggagggaaggcaaguccgaggcggggcucgaaacagccgagacccggggcucaggucagaaaugcggccuuuuagggaggccuuugccaagcugcuguccgguucccccgagagaggggcccguuugguggccccgggagugagcagggccugagacgggccacugcaggucgcagccugcaggagagguggguggcggcagcgggccgggaggagggaaccccggcucgggguaagcaaugaggauaaguggucucugcucucagucucuggcgaguucucccugggguuagaaaaucguccccgcgcucaccggggcgcccccgccgccgugaugguggugguggugaugcggcugcggggucugaguggggugcagcagcggcgccguggccugcaggugugaggcggaucccgaggucuggugguaccagggguaguugcccagaaaagccgaggccgcgcugcucgggcuggagcccgagcugccggcgccgcugccgccacugcccggaccaccgccgcccgccauccgcugcggcacaccaaagucccaggaggccggcgcugagacuggcggcgaagcacaagguggagaagcgcuggccccagggugcugcuccgaggggaucucaccacuuuuccacaucuucuugaacuuggaccggcgguucuggaaccagauuuugaccuuugaggaaaaagaccugagcauuaguggaggaaccuagucuuggggcaguagggguucgaagaggagaaaaaagaaggcagagaaaaaccgcuggcuagcggugggcagcgagcgcccuggggagauaagaggaucacgggcggcggccuucgaggcucugccgguuccugcucccuggggagguaauugccaaaaggccaggacugcugguguacgugcacugugaugauggugacagcgggagggugaggagggccaguuauuucacccgcuuaaucaguagcgagagguacgggauuucuguccacccggucccuuuccuucccucccacggcggccccuuggggguuuccagcuuugggccuagaagcuuacuuagggccgcucgaggcgcaggccuggaaauccuuaaaaguacuuaaaaugaacuuuaaaaagcauuguccuaaacccgccugcuucccagccaucucaggcccgcgcucuccucgccccugcagggcgcgagccccaccugagucugggugaggcccagagaggccgccagcucggcucgcuccggcaaggccaaguauugagucuuuuggaaacgccgcugaagagccgccagcuggaaacuggaguagauggugcgggguuuccggacuuucuuuggcuucccguucacuauccgaauuucaggcucaagguccuccuucucugcaacgauaaagaaucguaagaacagcgcaacccagggguccuggaguucccgcccuccuagagggcccggcgggggggacuuggcuugagcaaagaggugggugcacugaacuguggcgccacgggcaggcgcaacuucgcagcgugcgaucggagccgccaccgaccccgggagcuguacccuccagggaagggggagacaagugcacacccaagagaaagaagcugguggcaaggagaugcccuuaugaggcaggcagagcacgcccacuuggcucuugaggccaccagguccuaccaaaggagagagggacguaaccggcgaccugcggcagauuggaggcuggggaggguaaagggcacaagcgggcggugagcaggcagcgugaaaauccagagcuuucgaaggccccccgccccaaacacguuuacccauccaucccauuaacuagaccgacucggcacucuugacuucagcguuaugcauaccaggcucguuguuggcuggggacgaacugguuccauagggagcguaggagguguaggcggcgguguagcccaggucauagcugcucuuggcggaguaagggacguuguugaggccgcuggcuugguacugguaggaacccaugugcgcguagggcgagcccccgccgccgccgccgcccgccgggugcugcugguugguguaguagcugcugucgguggcgguggacaccggaagggugggcgacuccuggggcuuguggaggcugcugcugcugcugcuguugccacccgggccggcgccgccgccgcucgggggcugcuggugcuggugguacgugcuggaggcggcgaucugggucgagugcauaucagccacuagacugucaaagacuccagucauccuggcccgagacgggaaagagcagagguggcgggcgugcgggggaagccaggcgccuccucugucucucccgguccccuccagcagccaauguaauuacggggguggugguggggaaacaagaaaggaggcaaccgucuaggcgccuccuccuccgggggaggcgaucaccgugcgcugcucgggacagcugccucuggucgcauccucuuucggccucugggcccgcucggcuccuugcccagcgcgagcgcgggcucuggcggggggcgggcaguggagggggcagggguggcugggccgggucggggcucugggaggcgggagcaggugagcggccccgagcggcuuuacgauugucugcca

SEQ ID NO: 13219 - RNA, 9689 nt, Homo sapiens
agacacuuuggguaguauugugcuagauaauaucaacccuuucuuucagugucaguuaagauaucacuuccucccagaggucuuccugaccacccuuccccaccccacaucugaacuagguggucucauagaauccugugugucccccuaucagaacacgaaucaaacuguguuugaaaugggucugccuugcugauuugggggugcugccauugccucuaagugugucaaccuuuugcaaacauucagggcuccaaagucaguagucaucacaaucccuucuguaaaccaguuggccaaaggagguaagucuguaugugaaggaagaaaugcuguuugucauuaaauuuaagaugucuuaauacaaaaauuagcugggcaugguggcggaugccuguaaucccagcuacucaggaggcugaggcaggaaaaucgcuuggacccaggaagugaagguugcagugagccaagacugcaccauugcacuccagccugggcaacaagaacgaaacucagucucaaaaaaaaaaaaaaaacccaaaaaaccaaaaaaaucccccaugaauuguaaagugcaucccuaguucaguaaugugaaaauaacaauuuuaagacauggguuugguguggugguucaagccuauaaucugagcacuuugggaggccaaggugggaggauccuuugagcccaggaguuugagaccagccugggcaacauagggagauccugccucuacaaaaaaauaaugaaaauagcaaccaaacauagugaugugaaccuauggucccaacuacuugggaggcucaguugggaggauuacuugagccugggaguucgaggcugcagugauugugccacugcacuccaaccugggugacagaguauuccagagaugguacaguaugugugucuuugaauugauaacauguggguguuaaaaucucaaucaucugucuuuugaguaaagucucaauugucugucgaaagacgauuuuguagaaaaggauaaaacauaaaguaaaguauauuuacauuuaagauuauaaauaccucugccaaaagagaguauuuguggcuucuuguaauccuuugcagauauugucacuaaucucuccuucauuccuccaaauuauguguguacuugguauucuuauuuccucauccccaucuuaucccucaaguaaguaaagcccuggauaccugaguuaguuaguuauccaagacuuugcagugagugagucagagaggaaugaaauuucuguucuccuuacccccagguagcauugccuagagccaugcugggaagaucacucuguaagacaaaccaggaaaccuaauuaacaggacaggucugguccugacuauacauuauuuucaucuucauauggaugacugaugagggguggcuaugacagagcuaucuguauugucugaucugggaaacuguuucuuugaaaagcucauaaauugaccuauuaagacuauuaucuguguuccagaacuaaauaaaagccacagcuggagacuccaguaauauguaaacaugaaucuauauaaauuugaauguaaaauugcccagaaauuucuugauggacaaauuuuuauguauguuuugcuuaucuauaacugaucucauagcuucccuugcuuacuggguaucauuauauaauaauuaguguguuuauauguguugaaguaucugcuaacuagaaugauuugggauuuauccagcuugauccaaaaacaaauuuggccagagcuuugauaaucccugccuucuagggauaucaauauauaaauaguucauauuaauauuuaggaagacaacagacaaauggcuguuaagaaugccaagacuuccagauagacuagugaugccagaaauaacgaguggaaucucaggagugcagaacauuuagaaaauuauaggucuagaagauguguuauuuuccugauaguagaaaaacauguugccguagaaacaauauuaaagugaccauuagagucccgagccuucccacaaacacuuguguagccuacguugaagcuacccucuuauccugauaguccuaaccugauuucuggcugcuaggacucagggacugggaggaggaaggaggagaaagaaggcguuugccuugcaccuucuuuucuucaugucuuuuucuuccuggaccccccuccaggcagcagugcucacgagcugcuuuaucuagacacuacccaggcuugcuccuuuuccccaaggcccccaagcaucucagugacuucccuccuuuuugcccaaaugaaacucuuauucccucuuggcaacggaaagcaaucagacuuaauugauuggcaccaauuuguguuuaacugauuauucccuauauucaucuauucucuaggucugaauuuuaaaaaaauauuuuccaaacuuuguccaauggguggacuauaggcagggaaacaguagugaaaaauauuuaguguguguagaaggaggaugauauuuaaacacauacucauaaacacaacaaaguauaugaguuaugguuuucagaugucaagcaacagaaacaaaugcuaauucaaauauaaaaggcaugaacuugaugguuguggggugacucacagaaucaaaaggaaaguugaacaauuaggacagacgggaaucgugaaguuugaguggaagaggaagauguguucuaagcagaacugaugagugauaucuuaccaaaucaacuccaacagucauuuuaucacuuggcuaaacauucagauaccugaauagucucgcuugggucagagaccuucugcuuagcugggacugggcaaggcaccuugauugauggucccaaccaaggggagaaggugguucacuaggguaaaacuaggguuccauuccuagaagaguggauagacacugguuggauggcucacucucugcuaagugcuguaggugccaaucuccuugaccagcugugccugggaugguguccgugaguucagucuccuacucucuacuuuucacagcuucuacccuuuuagaacccacagcugauccaaaucaguucauacaacagcucuuacaaaacagcaacaccgauaaagugccugguuagcucguccugcccccaguccccacuguacaggucccuggaaagucugacugcuuugugggagcuaagggcaauggacuggguugguauccagguugcacuuuuuauuuugguccucugggcaguguuccaguuaaaaugagaaaaacaggauuaauucuagugacguuucauccccucauagaaguauggaguccuuccuuugugacuaccauggaucuggccucuuagaauguggaaaagcccuugcuuugcccaagguagccuuucuagcagguggaucucagaauuacuguauuaaaaaaagucuaauuaaugaccaacggaaggaacagugacacagauuaauauuuaaccuguuggaaagaguaacuguguguuugggguuuaguaacagaucugcagcacagguuaacucagucucugccucaucagcacuccuuaggucgcucuguucccuagaccacagucuuuccuugacuucauuccccaccccuauuccucuaugaggaacucaggaggaaacauggaagccaagccucaaacugagacucgcuagccaaaggcagagcugaguuuaaguuuaauauuuacucagccaggaaauacucuaauuaagccuugcucuuuaaaucuuaaagcuccacccuggaaggacagaaaugagcucucccaaaggguuucauccuggggaugaggaauccuuuuuccccuacauccaaauauuucugagaugggguuaggcaggucuucuuuccaaguucaaaaggcauaacuaagauuguggguugaauuuccaugggauacccagauggcuuccagaaaaagagcuggcuguguagaucccuaauuccagacagccagaaaggauucacugaauaucuggagcaaaaggagauuuucaaugcagggaggcaguuuaguauaaauauaggagccgaagucagauguccugggucaaauccuggucccgccacuauuuucugugugaccuuugagugugacucauaucucuaagccuuaguuuccucauggggaaguugcaguaacaguaucuaccucauuggacucuggagagaauuaaacaaaauaguccauguaaagugcuuaguacauaauaagugcuuaaagaauaucugcuauaaguuauuugaccauucauucaaaaaaaaugacuugugccuaaaauguaccaaauaauguguaagauaaugguacauauagagauauaaugguauguauaaaacuccuuuuuucugaagaagcucacaguuuaguggggaagcuaacauagaaguuauucuucuauguuguaauaauugcgacagaaaagguauauaaaaguacuauuaacgugcuuauuagaggagagagaguuccuucuaugaagaauuucaggaaggcuucauggugacauuuaagcugugucuuuaagaaaguuuuagaauuuuucaugcccagaaaagaggaucaacuauuccagaaaggaggaacauccuaagcagaagcacagcaaugagaaaaaucucaguguguuugggaagcaacaaaaaauuuggcuggaguaccagggugcaagguggguuugguaggcaguggaguuggaaagucaagguuaaggaugucaugggccauguuaagauguuuagacuuuauuuugcaugaucaguguuccauuaaggaagauaauuuuacuguggccauuaugggaguauuuacaucauggguauuggcaagcacuacaaaccuggccuuuuuauuccacagaguugguuguuaaacauuuaccagcauaccacugcaugugcacacaugcguguaaaugugcacggacacacacagacguacacacacacacacacugccccaggauagauuucuucaauuuuuaaaauacagguggugucaccuuuaccguaugucucagcacaacauaucaaggaaaacgcugucaugcauugaaauauuguaguaugugcaucauucacaauuagaguuucuuaccaagauauuuaucugucucccuuuugcaguaaauaaugacauuacuagacauacaguacuuagauuucuccccaaucucccuuuaaggaauuccuuauugugaggggccucacccaaauaagaaaccuguaccuacuuucuuagguguaguguuuuuucccuauuuuaagaccacaguuaagagcacuuccggcacagaaccagaagucuugccaauuucccaaguccuugaaacaguaaucacucaguagccaaggauaaauuuacauuggaugacucuuuuggccuuucucacuaacagaaauauauuuauuaauucaguggcgucacuguaauauuauuuccuugcuuaguacaauuaggccaaguguaagcuuaaaauagaaucaaauauugaauacauacuguuuuaaggcugauguaauaucuuucuuuuugcaagcuccgauugaacaugcauauuuaacagaccagccauacgguguuggugggggugggggcagccaaugcuuuagacuuuuaaucuacuuaaugggagaaagguuagacauaauuaaauaucuuuaagcuugaaucuuucagugcaauaaguaaaugaauuaaaucuauccaggggauaaaauagaaacauuugucaagguagcaauuuggaaagcguaagucuccuucuagucaaacuuaaaaugucuuggcaucuuggccaaaugccugaaagauauguaucagccuuagcauauucuuaauaauagcacucauaaaaagagagcaugaaaagaugaauucccucuucuuugagccccaggauuuuccuuuuuauguuuuuggucuccauauuauccuaugaacuugcuggaagaauguuggaggucccaaaagcagccacaccuugaguggcaaaggugaggcauucaaacucgggcacccugaagaauuuucuacaccugauagauagcuaaaaugcaguauggaggacaggcaaacauugcuuugagaagacuauauuuuccuauaagaagaaagugcuugguuccugaaaugacuagguuuccacuugggcaguagagcagaauuccaggaaggugcucgcaagcaugacauccugcugccucagauacuaucuagagccacugucccgagauccugguuccagcucaauguagaauucucaguguugguggaagcugacaucagucacuccucucugcuacuuugccugagaagacugugguccaaacagcugccuuugcuaauguagccuugcauccuggcccuacacuguucugcccugccuguugacuaggaaauaaugcaucuacuugcuagccaauaaaacaaacuagguacacaggauuccuugcggauaauucccuaagauaguacuaugucugcagagagaucugcacugcuaugagcagugaucagaaggcuagaggaagggagggagugauagggaagaagagagggggcucaguaaccagggccccacauaaaggcaaaucacauggugucaugugaaaguagcaagaauuuccauuagcugcucugaugccucgccucuaauaucccagagguccccuguaaccuaaaauuuuaaucuuggccauuucuuugcuucucagaauuaggaaauggaggacagauggugaccaagagaucuuuccccaccuccacugcuugcucaagcucuuggucucucucuccuucucccucucccacacauguacaaaugcacauacacaugacagaccuacacuugugugugugugugugugcguguguguauauauacacacacgcacacacauauauauauauauuuuuagacuaagucucgcucuguugccuaggcuggagugcaguggcgugaucuuggcucaccacaaccucugccuccuggguucaagugauucuccugccucagucuccugaguagcugggacuacaggcauguaccaccaugcccaacuaauuuuuguauuuuuaguagagaugggguuucacuauguuggccaggcuggucucgaacuccugaccucaugaucugccuaccucguccucccaaagugcugggauuacaggcaugagccaccgcucccagcuuguguauguauuuguauaaguccugauauuagaguuuguuucugauuauguuuugcauuuuaacagauauuuuucuggaucucugcuuuaagaacacuguauuguccuuucuaaugaugaccuaugucugugaucuuucaucuccauguuuauuuugagccacuguuucuugaugcuaaguuuuuaacauuuuacauuuucaauucuaucagugugcucuacauaacagagcuuguuugggccaaauacccauaaagagaguguuugcuuaacaauacaguagauucuguguuucccuauugacucaccucaagcccuggugcauggaauaucuuggccucacgagcuaccugguaaccaucaaaaucaccuuauuugacuggggguaugaggagugggggaagaagaauaugguauguaagcugugaugaccaagccaaggccuucccugggcucaaacuauauaagagacaauugucccagaggaaaugcaaggguaugcauuuaccaugagguccagaggauggagaggcaaguuccugagugaugcaggggaggggcagacagaacugcaguuugaaggugguuacccaacaccaggggucuccaggugguuccccagguggaagccaaaggauggcuguuccuuucaccagcuggggagccgaauggcacuacuuucugcccauuccuggaucaagcgcucccuauggccaguccccaugauggcauugucuuugaaucccuggacauccuauuucuggaaugucugcccaguuuccuauggccuugagcauuuucuucccuguguuguagagagguaacucaacccagucaucuauuguacuuuuccagcauugucugugaaguaacagagaugaaacuaagaaauguguguggcugacauggugccagagggucuccacagccaugcaugccuuuguccagacuagugggcauugcuaggccugagauacucgugaagguccuuguauuaguccauucuuaugcugcuguaaggacauaaccugagacuggguaauuuauaaaggaaagaguuuuaauugacucgaaguuccacacagcuggggaggccucaggaaacuuacaaucaugguugaagaggaagcaaacauguccuucuucacaaggcggcaggagagagaagaaugugagccaagugaagggggaagccccuuauaaaaccaucagaccggccaggcgcgguggcucaugccuguaaucccagcacuuugggaggccaaggcggguggaucacgaggucaggagaucgagacaacccuggcuaacacagugaaaccccaucucuacuaaaaaaaaauacagaaaauuagcugggcgugguggcgggugcuuguauucccagcuacucgggaggcugaggcaggagaaugccaugaaugcaggagguggagcuugcagugagccgagaucacgccacugcacuccagccugggcaacagagugagccuccgucucaaaaaaaaauaaauaaaaccaucagaucucgugagaacuuacucauuaucaugagaauagcaugggggaaacugucaccaugauucaauuaccucccaccaggucccucccaccacauguggggauuaugggaacuacaagaugagauuuaaauggggacacagccaaaccaugucaguccucauggaugggauccccaagaaacaagccagggaucugagcugcugagaauucagacacagggaugagcccccucauccuuguuuuaacaagcccugaguuuguuaaaagucuaugagaagcugcucauuuccaacugcaacuuucacauauccacucauccuuaaaaaaagaguagaugaaacucaaacucaaagagcugggcucuuucaugccaaaaguuccccaaaccugugaaacccuuccaugcagcuuucuccacuggcaggacuuugcacuuggaggugaugacccugagcuugcaucauuugugauuucuauuuaaaggcaaaccccagacagagaaauauuugccauaaauuguuacagcaacaugacauauggcuuuucugccacuaaggucacacugccaucggccucucacuuccuccucaauugcuuguucauuccacaagguuuccucaauuucagcaauucuuguggugcagaucugccugcccagccauuuaucaccaguaauaacaaggagaguugugauguuuuacaucucuacacaaugaucugagucuuggaaggcuucccaaacccccuugccccucugccuggccaggcagggccucuuuuccuuucuuagugugacauaucagcaguuuagaugcagggcucucccgcuggguaggagcuuguaggucacagcgacauccaacagauucauuaacauagcaaucgcaggagagaaaagaagcccaggcgauucuggugaaugcugagccuuguucuaaauucucauauagaaucuc

SEQ ID NO: 13220 - RNA, 14090 nt, Homo sapiens
aguuagaacaaacauuuuauuauuaaaauaaacuuuuguauaaaagcauuacagaucaaaagcuguauuuacacuuaucgauucaagguccaauuaugcaucaaacauugaauggcacagcaaugguuuacauaugcaaguaaauuggacauacaaacacuuagauuccaccucuaccaaauaccuugauuaaugcaaagaggagggggaauacugacacaggaaaccugcccagaaacuagacuggcagagaugucagguuaacaaacugcuaaaaguuacaucuccaaaaaggcacuuaucauuguuauaaaagugcuuaaaaucuaaacuugaaccuugugccugguuuauaaauuuacaagaaacugcaaagaaccacagacuaguuuuuaauaucaaguuuccauacaaaauuguccaagaauuuauuugcaauaccuuacaugugaacugaaauaaacuuugcaaacuacaauuauacuaaaguuuuauacugaaaauucaaaucagcuuacucauaaucuccagauagcucuuccaucauuauuuuaauuaaguauuacauugcccaccaaccuuugaauuaugauuguguaagcuggacgcaccacuuacccuucgggcagaagaaauuaggagaaauuaagucucaacugugacaacaacuuguaacauaagcgcaauacaugggauugagagacaucaaucugcaauaauuaccuaauuuuuccacaugguuuuaagacuuuugugccuugauucuauuaaaaauuucaacuaguaugaaugcuaaaucauacucguuuuuguguaaacaaguuagaaggcucuucucugaaauucaauagaucuaguuaguuaauacuauuauuguguuuccaagugcuuagguuuuaugagggcuauuucaacaccaaguaaauaaaauaugcuuucauaaaacuguaauuuaaaagaaauucagaaacuaagcgguuggagaggagcauuggaaauagagggggaugcugugagauggggguugggagcagagaagaaacugcaggagggcaaaguguaacuagcaauauaccuucugugaugcuccagaaacacaugucugcuaagauuaacuugauuggaguuucuuaugaaacaggcugaucaucaagauuuuuaacucagguuucagugaaaaaauuggaaacuuuuacaagaaagauuugagaaguagaaggcaggcagcaaauuuuccagauauuaugcuugcauuucaaauuccuguuucaggcugugaaaaacaaaaggaaaugugucaggacauaguuuucaaccaaagaauucucuuuugaaagccuaauucauuuuuaaaaccauuuuuauugaguuauaacaucacuauggucaagugugcgcaucuucaaguauauuaccugacuuuuucauacacacccacccacccggguuaccaccaccuaagugaagacagaaaauguucccaucccuuccagugugccccguuccagucagucuccaccccgccagagauaaccacucuucugacaucuaucaucuucucauuaagacauaaaugaauauaaaauucagauguggaagggaaaaaaaaacacccacuaccuuuucaaguaggcaugcacauucccaaagccaugauauuuggcuaaauacacaaggaccccagucgcacaccguccaucucgcugccggcagaaacugcaguugcagauuccucgacaaggcgggcaaugccaguucugaaggaggauugucaaacggcacaauuaaguuaaaccuuaccucccccaccaacuuaucuacauuacauuuaaccccuucuuuaugguuaaaaauuuauaugauuaauaggcauuagucaugccuaauguuuccuaaugccuaaugcuuccuuccaggaguggaaguuacaagcagcuaccagggauaaauggagcagcaacuucccagggacaguucagacccgaguaucguagaagcggcucaugccuaugcagcaccaucccucugaauucauuuguguucugaauuaagagcacccugggccgggcgugguggcucacaccuguaaucccagcacuucaggaggccgaggcggguggaucacgaggucaagagaucuuguaccaccacaccauccuggccaauguggugaaaccccgucucuacuaaaaauacaaaaauuagcuaggugugguggcgcgugccuguagucccagcuacuugggaggcugaggcaggagaaucgcuugaacccaggaggaggagguugcagugagcugagaucgcgccacugcacugcagccuggcgacagaaugagacuccaucuuaaaaaaaaagaagagcaccccauaacagaaagggcuccaccccuucaccaaugccuuuuucuggccucaucacaguuuguggcugaccuucaagcccacaggaccaaccccuggcaggcaccuaccggauccagcagagcaucccugaccucuucaccauaacgguuucgaaggcaggggccacagaacuggccucgaacgccccagcagucuggguuucugcaguuuguuuugguaucaauagucuucugacggcauugaugacaaguagagcccuacaaauaagccauuaagaaaaaaaacaaaaaaaaccacuguuuuucaacagaggaaauggcauauuuacagaaugucccucuucguaguauaggcuuacauuuugucuaugaaucucuacauacacauguauaugccaggguaugaaaaauaacucaaccaggugcaguggcucacaccuguaaccccagcauuccgggagacugaggagaguggaucgcuugagccaaggaguucaagaccagccugggcaauauggcaaaaccccaucuccacuaaaaauauaaaaauuagccuggugugguaaaaccgcuuucccuuuaagaaaaggucuuauuaaaaaauaaccuacccaaauccacuuuuaucuuugguguaccaccacacuccagcaccuagcuauguauacacacauaauagauaugcaguaaauauauguugaaugaauugauuucuaaauuaggagaaaagauuuaccaugacuacagacuuacuaagcagauaauuccacugugaaagagggcuaaaucccagggauacuguaaaacuuuuccuuccuugugugaaaaaaacauauagguacagauuucacaugcuaggcccuuuagaaccugggcaacgcuuagggacagaagcucucuuccucucacagauguuuacauucucagguguaauuuagaggcucucaccagugaacgguuauauaucuucucucgagaauugcugcagacguucuccaacuccuccucuguaauuucuuccacugggcgaauuauaugcggaagggucacggaugaucuggagcgacggcuucugggcaggucaucuuccugcauuacaaggaauacaaaacacagaacuucaaaacugaaaaacugaaagagauucaaaacugaaaaaacagauucaaauaugaaacacagagauucaaaacuggcucuccccagcuuugaaucucagauacuugacuuguaauuucuucacacaaacuucaaccuggaaaucucuccuagagcuuaugguaggggaacaggccauacgcuuacuguagccuaacuggacauuuuggaaacgaugccuacaauuaagaagagaugaagaaaacccaauucucgccugcuaauaaaauuaccaaguaagcuuaugugacguuuacaguucugaaugguuagaggaaaacauuuacuauggaucgccugguguuaaggaugugcguguaccugugcuguguaugaugccaggccuaccgaagaugagaaucagaagagcaaguaccaaugcggagaacucacauucauguagccauccacggucuuccucuuucucaccaacauguacuuauccucuuccuccuccuccuccauggguagagcgucaagggacccgaggauccgggaccuugaccugguaagaggacgagcucuccguucaggguuucuccuggaagcaacacccgggaauguacgccuucgcggucuccuugauugcuaaacaaagcacguauaagggaauccauuuauuccauaauaaagagaaguaguacuuuggggaauucauagcuucuccuuaaggauguuuuaaguaaagagagcucuauuuuuucuuuuucuuuguccuuugcauaaugcauggcaaaaugagccuaaaaccuauauggccaucuuaauuuugcuuuuguaauaccaagcccaguuucuuucaacuugagagaugagcuauuuauucuuuuacuuaaugaagauguaagaaaugaucuucuguucuaaaaaaaaaaauuuucucugaugucucuugacccuguagaaacacauucaguuucuacacugcaaaauagagggauaucuguauggcuucccucuuuccaucuuuccuuuccucagggaaagccaggaaaaagaaaucuuuucuaucacagcagacacaccaaaucucccuaaguuguaccaccuuaauuccucagaaugcaauuguguaugauaccaagcuacaacuugauaagaaauugugauuuucuucuuuuauuuucauucuccaauuuuaaaaacaucuauugcacaucuaccauguaggaggaaugugcucacacuggagaacagaaaaaaguuuucaaucuucauuaccugcccaugaggggcuuagucuagcugggaaggaaagaaagaaccaaucaaaaggaguuuagugccacaggagcacagcaaggagagaccaaacugcccaggauucaaggaggaucauccagagaucugucaggggguuuccucuagguccccuucguuugucuagaaggccacacaaauaaagaaauuagauuuuuaaauacaacacagaucgaccuuaggugugcccaaaacacuacuguauauaaacaagaacugguacuuacugagucggagccugggaggggaugucuuccacggaacgagccagggaagcuuucuaauucagacaugaguuuugcaagcuaaaaagggaggaaauuaaacugauaucauuggcuuagaauaacugucgaaaaugagcaacuaacuucuggaaaauacucaaguacaucucaugguuuuauauuugauaguaagcugacacauucagaguuucugauuuccccuauacacuuaaccaggccuuuaacagauuuaaaaaaaguaguucagggaaagaaacacauuuugaggcacacauugaagacuucacagguaaacaaaaauaacuuuuuauucauguaacagaaaaaaauaacuuuugcgugauggaacagauuuaaguaaugagucgcuuagagaggaaaaauuaauucuaacacaaagucagauaccuaccauugcuuuguuuugcuuuauauuuaaagcccuuuucuccaaaaaauucauuccacuuucaucuucugaaucggaguuggaaucagucacagaauucucugagggcuggcgggacucugcuuuuuuguugguugcuccccugguacuccgcgcuggaaacuucaucgccacccugagagguccagagugccugcacuggcugcggguccuacagccuucccgaacugacugcagccucuaaucacaacaauugagucauuaggacuugaucagcagacaagcugcaucaguauaacuacaaagucccuuuucaaugagacacuuguaugaaaugaauuuuaacugaacauugauaccucuggguaacaaaaucaggaaccacaaagaguacaucaacagagugcaguuuaauuccauguagcccaucuggaccacacuguuauaagcuauuuucauagucccuaggccugugguucugagccuuuuuuuaaaauguuaaaauuccuaccaccugcuuuucauuucuuuagaaacagaucuuuauguauuuuaaaagaauucugacaagaacaaauguguucuccuggcugggugcaguggcucacaucuguaaucccagcacuuugggaggcugaggcgggugaaucacuugagccuaggaguucgagaccagccugggcaacauggugaaaccccgucucugcaaaaaaaaauacaaaaauuagcugggcaugguggcgcaugccuguggucccagcuacuuggaaggcugagguggguggauggcuugagcccagggggcagaggcucagugagccguguucgugccacuguaugccagggcuggguuacagagccagacccugucuugaaaaaaaaaaaaagggaaaaaaauguguuccccuauaaauauggcuucaauguuuauggcaauauuaaauuauauuaacagaucucaauucucuacuuuaaaaaauauauaauauaauauacauaagauuuaucauuuuaaccauuucuaaguauacaagucaauggcauuaaauacaugcacauuguugugcagccaucaccaccauccaucuccagaauguuuucaucuucuccaacuaaaacuccauccauacccauuaaacaguaauuccucauucccucuuucccuccgccccuggcaaccaucauccuauuuucugucuauacauuugacuucucuagguacuucucuaaucuacuuuuagaaguucaaaaugaaaauauuuccagauuccaaaaguaauauagguuuucaucauuaaaaauuuauccaaauuagccauaggguaauguaaaucaaaaucacaaugcaaggcugggugcgguagcucaugccuauaaucccagcacuuuggaaggccggggcaggcggaucaccugacgucaggaguuugacaccagucuggccaacauggugaaaucccguuucuacuaaaaauacaaaaauuagccaggcacaguggcacacgccuguaaucccagcuacuugggaggcugaggcaagagaaucgcuugaacccaggaagcggagguugcagugagcagagaucacugagaccacaccacugcacuccagccugggcuacagagcaagacuccgucuccgaaaaauaaaaauaaaaaaaaacacaaaacauagugagacaccacuucauaguagagcuaaaaagcaaaagaaggcuggguaugguggcucacaucuguaaucccagcucuuugggaggcugagaugggcagaucaccugaggucaggaguucgagaccagucuggccaagauggcaaaaccccgucucuacuaaaaauauaaaaaauuagccaggugugguggcacaugccuguagucccagcuacucagaugcugagacacaagaaucgcuugaacccaggaggcggagguuguggugagccaaaauuaugccacuguacgccagccugggugacagagugagacucugucucaaaaaaaaaaaaaaaaagcaaaaggaaaauaaaaaaaaguauuagcaaaaauuuggagaaacuguaacccucacacacugcugguaggaauguaaacugguguagccacuuugucuauuucucaaaagguuaaacaguuacuacaugacccacaauucuauuccuauguauauaccuaagaguauacacaaaaacuacacaaaaacuuguacaugaauguucacaguagcauuauucauaauagccaaaaaagugcaaacaacccacuuauccaucaacugaugaauggguaaaucaaauguggcugauucacacaacagaauauucugcaauaaaaugaagaacuaacacaugccacaacauaaauaaaccuugacaucauuauccuaagugaaagaagccagucacaaaagaccacauaucaugauucaauuuuuaugaaauauccacaacgggcuaaucuaugacgacagaaagcagacugaugguugccaggagcuggggguguugggaaagaauagggagugacuguuaauggguacagagucauuuuuuggggucauaaaguuauuccaaaauugacuaugguaaugguugcagguuaaaaaaaaagagagagagaagaaaaaaaucacccauaaaucccagaauuucacccauaaagacucaguuuuaacauuaaaauauuuaucaaggccagcaagguggcucuuggcuguaaucccagcacuuuuggaggccgagacgggaggauugcuugggccuaggaguucgagaccagccugagcaacaaagugagcccacaucucuauaaaaaauuuuuaaaaguucccaggcauggugguacacgccuguagucucagcuacuggguaggcugagggagaaucgcuuaagcccaggagguggaggcugcagugagccaugaucacaccagugcacuccagccugguugacagugcaagacccugucucaaaagucuuacaugcccacaaacagcuuuuuguacuuuuaguguccauggauugagagaguacaaaacaacaaaaaccuuucaugaguuccuaacaauuauaaugaauuggcauuuuauuaaucaugacaguaucuucaaagaacugaaacacugcccagaaauuauucaggcuauugacaauguuugugucgcauccagaucugcagacuggacccccugcaacaaacuccaguaugcacugauuuggaccaaaacacuccuuggccaggcacugccacuucuaucaauguuacucaaaccaugaaccucaggcaguggauccaugucagaccagugaguugaagagcaugcacuugauuaucagugaaugcacugcuuccuuugucaagaaagucuuuggaacaggaaaaugugugcagaauuaagcaguaugcucagaagagugggaccgaggcacagcacaacaguggcagcggcaguuaaaggaagguagcgugcauaggaaaagccaaccaaggagcaaaaguagcagcaggaagggcccucaaugucauuaucugcaauggagcuccugcacguaaguuaucacagguuuucaagaugcagccacagaucuacuaugagaccaacauuuaucaaaggucugcucuaugacaggcacuaggcugggcacuugaacuuaaaugcaaauguagauaauauuuagaacuagugugcuuccugauuaggcuggauuuuuguggaaacgaaaaucuggagauuggccaauuuuaucuuaccaguuuccaaauuuucagagccuacaaaauguucaugauuuguaaguccgacuacauuaguaaacacugcuuuaagacaugaagaaaacacuaaaaauuuuuaaaaggucaacaaagucugcuggcaugacuaaaaucaaaaucacaagaaaaaaauuucuaaaaauaugucaugccucuaaauguaucuuacuucuugaaacuggugaaauucucgaacucaccauuccaucuuguaucucacucucugagaaaccgcaaaaugauucaucgucagagucggcaugaaaaauaccggccaguucguuagugacaucuggccuugguuucuguaaaaauccacaauggucuaauacaucuugcaccucacuuucugaaaagccgcagaaagauucauuaucagaguccucauaaaaaacauuugccaguucuucacugauaucugaccugaauuuagguuucuguaaaauaaauaaauaaaugcgguugugcauuuuuuuucuuuuucaagaaccaauuuuccauaaaccgugcagagagcaaaucacauuuacaagugcacuacaagagaacagcuuuuguuacaaagaaaaaugguucagagguuuacaaaugauuucugaguuguuauggcaaaucaucaugcauguuagguuaggcgacauuucaaaaggauagaauaaguagcuaaucuaccuccaacaauuacuaccuagaaccacagcaaaaagugaaaugaaauuauagugcauacuguauuuucauaacggcuguauagaaauguaggcaaaaagcaagcaguuuuaaucacgcacaaagcaucuggggcauuuugagcacugcagacucaauucuguuuauucucaggcagcacuuaccguguuugcaaaauuaucagaagcaaagcugucacaacugucaucagaggaugacgagguuuccauggaaaucaacuucacauaucugaauuucuuuaaguucuucuuuacucugagaucuuucugcugcaaauggaaauagcaauccuauuaagcgugaugcuuacuuuauuuaacuaaagacaucauuuuuuuuuaguuuaguagguucaaacagcacagaguagauauguccauuuaucauacccuacauagaaaaggaaguuuguuaacugcuacaaaaaauuuuuucuuucuuuuuuuuguaagaagcaggaucucgcucugucuuccaggcuaaagugcagugcugagaucauagcuuacuacaaccuggaacuccugagcucaagcaagccuccugccucagccuccugaguagacaggacuacaugcaugugccaccaugcccagcuaacuuauuuuauuucuuuuuagagauggggucuugcuauguugcccagguuggucucaaacuccugggcucaagugauccucccaccggagccucccaaagggcuuggauuacaggcauuagcuacuguaucuggacccaaaaaucuuuaaaaccaggucaaauucuuuuuuuuuuuuuuuuugagacggagucucgcugugucgcccaggcuggagugcaguggcgcgaucucggcucacugcaagcuccgccucauggauucacgccauucuccugccucagccuccagaguagcugggauuacaggcgcccgccaccacgcccgguuaauuuuuuguauuuuuaguagagacgggguuucaccguguuagccagaauggucucaaucuccugaccucgugaucugccugccucggccucccaaagugcugggauuacaggcgugagccaccgcgcccggccaaaaccaggucaaauucuaagaagggaucccuuugcaggaaaauuguaaagacauuuaucaauuuauucaaacaucuguagagcuaccucucaacccaccuuuaugagccccuaaucuuuagcucuuagcauuauacugagccccacaggagauuuuaaugcuaaacuccuaaaauccaaccuguuuuuuuaaaaaaauuaaacuguacuucuaaaaggaaauuucaaaaguacaaaaggggagaaagauuuuucucccucagccaaaaucaagcuaaugagguauuuuuauguaagcuuugggcuauguacugugaugcuaauuucacaaacuacaaaaacugggcaggaccucuacuucaagauggcaggcuuccaagcaggccccuuuccaaucaagagggcuaucgugauuuccacagaaguccuuacaaagcaaauacaucaaacgcuucaacaaaugguacaaggagccaaguuaaagaucaaauagcacuccaaaugcaggugggauaccggauuccauuuuagcacucuauuacuugaggcugucauucaguucuuguugcugucccuuugcuauacaagacuuaaguuuuuaaaaguccuuuuauaaagugcaaauuacuuacauagaaaugcuucauucauucauaaauacugaacagccuggcacugcucucagaaaauguaauuggcaucuaucuuguauaaaaaaaggauagugguuugucauuucuuaauauuuaacgagauuuccuaaguguugcauuagguccuguguuuuuauuccuuaaauggggccauggaauagcagaagugauuccuuacacugaaaacuuugaaagggcaagcucugguauagauucuacaaaauaugcuaagauguaagaugucaggugaccagaacauucuugcccuccuucuuggccuaacauuacgcauuucagucucuugcagauaaaguuauuuucaugaugauggcacucccaacaucccuauaccccuaaguaaacuccguucaaucaucuuaggaaguuuuugucuuuugcccucuuaacaaggcaggacaacguguaaaagguagagcuacuaaauauaaagguuagguguauguguagggggguggcucacaccuguaaucucagcgcuuugggaagccaaggugggaggaucacuugagcccacgaguucgagaccagcguggggaauauggugaaaccccgucucuacuaaaaacacaaaaaucagccggauguggcggugcguacauguaaucccaguuacuugggaggcugaggugggaagacugcuugagcccgguaggcugcagugagccgugacugugccacugcacuccagccugggacacaaugaauguugggagcugaaaaggaucucagaucccauuuuccagaugaggauauucaaggccccaggaagguguaauagacugcaagaucacaggggcaggaaggagaacucaagucugccaucuucuuaagcagcaguguucaucgcauuacugcaggaauuaccacccuuuacucaucaaucuaccugcaagcagucagaggccccagacagccucaaaggcggcauucuauuggaagcuguccgagaaauacaggcugagcuuuaacaagucagcacaagccaagaguuauuuaccaggcaaacguaucuuuggaggaaaagccacaaaaaagcagcaaggcaaauagucaagacggagaugaacuucuuuggcagguaaguaauaacuaauaccauuuauaguaggcguuuuucgugccaggcacuauguuaaguacacuuucacgucagguuuaauucuuugcaacaaaggugcuaucguuauucucacuuagccaaugaggaaacugaggcucaggaaagcgaaauggauuacucaagucccaugguggcucagauuugaacucaggcaugucagguuccaagaccagcuacacaugguuuucuucauccggaaagccaaugcccagcuccaccggggcggcgacucagcucugaaaccacgccccaucgcacccacccccgcgagggucccuaaccccugauauuuauuuuaaacaugucauugucuuccguuucacccaacccccacucuucuacccucuccaggagcccgacccuacguucuggcuuccguuagagcaaaaaguaacguuccacucagagcaacguccugcagcuaagaguaaggcugggggguggggggugggggguuggggguugggguggaggaaguaggaaacgagcaaauggucggcgaacgcuuugacccaccaagcccuuuaaaugcacuuaaccaccgcccgggacuacggucgcuucacacugcgugcgcagcccaaguucuaggagaccgguucgcaagaccuuaaaccucagacgcgcuggcccucagcgguuagaagcggacgcgucucuugccgggcggggugcgcgcccaagggccacccacugagcgcggguauagacgcggcgagccacgcacuggcuccgaguugugugcgggaaagggcugggccgcugcgggacaaccucccagggggcaggcaggcuggcucugccuggcaggcaaaaucgggaccggccagcgcucccggccgcuguccggccuuuggcggacgcacgugccuagggcuuuccagcgcugcuagccauccugcaaacgacucaagucuccacgccgcccgcacuucgggugcgcacgccacgcaggaacguccccauggcccucaguuaucccaggugcacaaaaucaggggcuugcccaagcgggcaacgccuaggcaggccaccaguuaaggcagcgcuaggcugcggaguuggagagggucggcccgcgcccgccugcguccagcacccaccgcgcccgccccucggguucgcccgcccagcccucaccggcacgcggcgagcguccaugcugguggcgggugcccagaucggcgcuuggagcggggagagcggagcagccgcgcggucagcggucccacagcaggaggagcagcagcagcgcggcuggcaggcugggcgcgccgacccgggcccggaggggcggggcucgggcug

SEQ ID NO: 13221 - RNA, 12968 nt, Homo sapiens
aggggagaggcgaggggaggagaaagcggcgcgaggggggagccgggccgggguucagccgcuccucaccugggccgccgcugccgccgccaccgcaccguuuccgugcuguugcugcugcugcagauacucgccguggccgccgccgccgccaccgccgccgccgcuauccacguccaaggcagccauuuccucuuguuucacgggcuuuucgggagcugcaggcacagcgcggggggguggggguggggaggaaggcggguggcggagagggagggggcccgcgggccgaagcgaaauuacucccaaagcccggacccaggccccuuccccucccccacccgccccccggcggcggcggcggcggcggcucccuccuccccuccugcugcugcccccgcccgccgcugccuguaacccuccuccuccuccucuuucccuccuccuccuccuccccgcgcugccccugcccccucuccucuccuccccuuucccuucgcgccgcucgcucucacucgcgcucgcuccucucgcaccgucagucacucacacacgcccgcccgcgcccgcacacagggggaugcgcucccggcggaccgggccgcccgccccggggccuggcggggagacggcguugcuggggcuucggggguggacgguggcuggcggggaggggagggaggcgcaggggagugcagcuuucugccucucacagacacucggucgcacacacggggccgagaccggcggcagcggccccgggcuggcuguggucggcggcagcggcggcggcggcagcagcaaggguugcucucucggcuuuacguaccggucauaguguguuuagggcaccucaggcggggcuccccgccgccuuacacauggugaggagcgaaggcggcggcggcgggagaggaugcgggaagcggcggcggacacggccggagcgguccggggauuuuuuuuuccuauuuugauugacugugcgggaaacacaaaagguggagccuccagcccaaaaggggggaagagggugacagcccgcccggaacucccgccccucuucuuggcucucauucgccgccgugcucuuugucggcugugcucauugguccaggcgccuguccgucggucugccaggcggcgcgcuuccuguuugcccccggguggaaggggagagacaaugagcggccguggcagcguagguuuucgagagcggcuacggcucgccgguuaccccgcugugcccgccucccucgccggcugccgcugccaggcccgaggcgcaggccuccuccaccuugcaggcgcucggagcaggccuagccaagcuguaggggagcugagcuggggaggaaauucguccccggugacuccugcuccacuggacgcuuccuccaucccggcagcagucuuggccggaucuccccagggccucgcgcucuuggagccgccgcuucccugcgcugccaggaggccaccgcugcucagccccggggcugcugcugcggccgcugccgcuacugagcaaaccagacccgccccacgagcccggggggagggagcugguauuaggggagacacccccuccgaggcuggaggaggauuuuucucucucacauccagcuuccugauucagucacagccaucucgcucccagcccccuuagccccaguuuuccaaccggucucccacuuucacguacccugaaggcaggcauuuaaagcaaaaaagaaaucucaagucaccucacauacggaaggagaguuuuaauuuuggccaguggcaccaaaacgggcacuuaaaaguauauuucauuuuacuugugguauguguauguauucaguggggcagaauucuguguuuuaaaaaaucggucacauaaccauuuugcugcacaaacguauuauucccggccucuuuauccucuugguaccaagucagauaucuccugaaauaagcccaucaaccacugccaacguuuuuuaaagucgugaaccggugaacuaccuuuuuucccccauuggaacauuuuuguuguauuuuaaaaucuuguuucucuuacuggauuagguuaacacuccuuccuucuuuggcauccuugguaucuugcugucauccugggggaaaaugcucagguuuuaaguguguguuuugccaacuaagagacaucucucccuguuaccuucaaguauaguugccaagaaagaaguuaaauucaagagguggaaacacuguccacaauaccuguuuuuuagaaaucuggcucaagauucaguuuucccauuacugugauuauuauauuuugugugauaugugaugugcugguggaugagguugugaaguccaagcacuuuaaccagauuuuguguguccuaacuuaauagguaauccauuugugagauacugaguuuacaucccaguuccaaagcacuuaaccgccuaugcugacaggaucagaaacauuguaugguuacuuugcucuuaauuguacaaagaucaaauuuccagggaauuaaccuaaaaaccacaaacaugcggaaacgagacucaaaauucugaguccaagaauaggguucaucucuucuaauaguccuuguagucucauauuuaaguggaaaagucacuuucaaaguugagucguauaaccuauguacuauuuuacaacaaaaacuuuuaaggaaauaaaagucacaaaauaaccugauuugggguggggaaaauggaaaaagagaugggugccuugaagagcgggacaggugaaaauaaguggacugggagggaggaagggaagucacuauuaucacucuguuccuacccggaucucuuggguggaagguagcucuuucccuagaaaggauauuucaggcauuuucaguuuuguuuuguuuuuuuuuucaggaguggggauauguucuacgcuaucgccauacccuuuuugcaaaguguuaguccagccaccuugagagcaaaguacuuggccacaggaguuaaauucguuucuucauugauaccaauuggcaaaugauaugagacaugaauugucuuuuuucuuucuuuuuugggggguggggacggcacguccgcagaccauuuugacaagcaaaaaaaacacuucugaaaaagaaaaaaauagccuagcugagcgugguggcucacaccuguaaucccagcacuuugggaggccaaggcaggcagaucacuugaggucagaaguucgagaccagccugauugccauggugaaaccccaucucuacuugaaauacaaaaauuagccaggcuugguggcgcacacguguaaucccagcuacucaggagacugagacgggagaaucacuugaaccugggagguggagguugcagugagccgagauggcaccacugcgcuccagcaagacugagacugucccaaaaaaaaaaaccuaccugaacuaacuauacugcuuuugaugcgaugcuuuuaagagauacauauggagguagggugacagagguugguuaauugguacaaacauacaguuagauagaaggaauaaguucuaguguucaauagcacaguagggugacuauaguaaauagcaauauauuuuauauuccaaaauaacuggaagggaagauuugaaauguucccaacacaagaaaugacaaauguucaaggugacaggggagagggggcggaaaaaaaauguccaaagugauagauacccuaaacacucugauuugaucauuacaacacuguaugcauguaucaaaauaccacauguaccccauaaauauguacaaauauguauccguuuuuuaaauuuuuuaacaaaagaugcauauaccaaaagcaucacucacuacuuuagucagauucagagaacccucuuagaccacacuugaguuauugucauggaauagcuuuuuaaaauggcuggaaaugaagauagucucuugaaagaacaccuuuuccuaccuauuucaguauuguagucaaaucuugaaauacaaauuuuuuuuuucaauggcauggucucggcucacugcaaccuccgccucccggcuucaagugauucuccugccucagccuccccaguagcugggaucacguagcgcccgccagcaugccuggcuaaguuuuguauuuuuaguaaagacaggguuucaccauguuggccaggcuggucuugaacugccgaccuugugauccgcccgccucugccuccuaaagugcugggauuacaggcaugagcccggccgaaauacaauuuaauuaaaauacuuauuuucuuauuagaaagcugccucucaauggcaccuacugcuacauuuacauaguaacccaaaauugcaguugcuuagcagggagagaaucacagugcuggauauuauuuauacuuuuucuuccaaaacgauuugaggaaguacugugcuggccauuguuuacaucauauuaggagaucuggaugucacuuucuuuucccauauccucgauuuccucacuuuuuaaaaugucauguguuuuuguaaguuuucuuaaauccuuuggaaaugugaugacggugaaaaaucccugaaggcuucuauacaccuguuggcauggaauauuuugcaacccguuucuucccuacaaacagaagagacaacuaaauacgguuugaucuacaucugcaagagccuagccauucaguauuaaaaagugauggcccugguugacgguaccacaccugaagaccuaugcccuuuccuucacacucccuacuucugcauuucuucccuccugaacgucuaucaaguggaccauaugaaauugccaguauucaacuguuuuuuaucuuaaaaggugacaauucuauaucauucaaccuaaauuaaugucucaagaacauaaccuuuguuucuauuauugugaccuuacuuuuaaccauccuagagcucuuuaaccuguucacacuggauuucaaggaucuuaaguuguucuacuacauaaucacuaucacacuucagaaacauuuuaguuuacauuaaauacacuuaacccccucauauuucaucucuuccuuucucaaaaauaguaauaaauaaccucaagccauuaaagugugauguccuuaaaugaggagcaacaaccuucagcauggaguguauucauacuuuaugauucaauuagauaauagaauuuguuuauuuucuuuggucauauaaaccagacauaaacaacaacuaaucucaaaagagucaaugauacccaaagccuaguuagagaagguaagagaaaggggaaaaaaaaaaugaugugguuaggagaagguuggauagaacuguagaaaauauugaaggcagcuuuuaccugcuuuaaggaacagaauuuuucgaguucccccuaaaauggcugagugcugcaccaugucaucacuccauuccaaccaaacagcuggaauaaaaaaugcaauuauacacacacauauauauguauaaucuauacacacauaaguauauauguauaauauaugcauuaauauauaaacagaacaauccauaauuaauuaaaagagaugaccaucauggauaaaucucaauacugugugaaaaaagccugguuauagaagaauaaauguuaugcuacuacuguauuuauauaaaguuuuuaaauguaccaaauuauauucuauacuauauauggauauauacauauguaguaacacuguaauugcaaaggaauggugugcuaaauuuaaaacggugauuacccuugguaugaagaggagaauggcauuugaaugaguuucccaugggcuuuguuuacauuugcaaauuuaacuuaagcuaggcugaguguauuauuauuguauucucuauauuguucuccuugccugaaauacuaugagcauuauuuuaaacuagaaaaaaaaaaaaguaacugauaggagaaguacugcaguaaguaugcccagguaacugaucaaagggcuggaggcaaaagagaaugauucaaauauacuaaguuucccagcuuuuaguaacuggaaagaugaacugaaguaaaggaucuuaaaagggcaugaguaaguggugggccauuaugaguuuguucuuagaugugcugagcuggaggugcuagcaggacuuccaugagauggauagccaacagacuguugucaaauugaguuuagagccacagagagaagcaagggcaggcuuggguuuggggacucuuaccaucuucacaggccuuuguccauuugucuucaaacauagcuauguuugaagauaaacauuccuuccuaucuuuaaaaauccuccaugugacugugguugucccuagcuacuaucuuuuuucuuuccucccuuuccuuguccaaagucucaguaacuugcugucuuccuacugccuuccuaauauaauucuacacccaauuucagcauuugacacuguaaauauuuccuucuuaacacucuccccucccuugaacauuaucagcuuucugguuuucucucaaauauauauuucucuguaucuuuacagugcagucccauaaaaagcuaccuguggugauggaaauauucuuugugugcacugccuauuaccauagccacuaaccacaugugaccauuaggaacuuggaaauguggcuaguaugacugaagaacugaagguuuuuuuauuuuaauuaaaguuaaaugugaauggccacauguggcuaguggcuaucagacagugcugcuuuaggguuucuuuuguuuuugguuccccgagcuuuucuucagaagcuggaaacacagcauucugcaaugucagcccucaucuccaaacucacucccaaaucucuaucuccugucaccugaguucuuguucuauauccuuuuuuuuuuuuuuaaagacaaaauuucacucuugucgcccaggguggagugcacuggcaugaucucagcucacugcaaccuccaccuccuggguucaagcgauucuccugccucagccuccggaguagcugggaccacaggugcacgccaccaugcccagcuaauuuuuuuugcauuuuuaguagagacgggguuucgucauguugccuaggcuggucucaaacuccugacugcaaaugauccacccgccucggccucccaaagugcugggauuacaggugugagccgcugcacccggccauguucuauauguuuaagcacugugaauuccucuugaaugucucacuuucaccucaaacucagaauguucaaaacuaaacucauaacuuucucuacacaaccagcuccuccuccccucugaugcuucugucugugacagugaggccaucauucucucagaagcccauacgggaaauuaccuuugacacaucuccucccuucccucucccauaggcagccacuuaccagaugcugccugccaaguuuuccugcagacacucucagcuaccuguucauugaaaucacauuuauugaacccugcucuacaagaugcugcauggucccuauccucaaggaguggauauccaguuaagaaacaaaauauagggcugggcacgguggcucacaccgguaaucccagcaccuugggaggccaaggcggguggauugggaggccgaggcagauggaucacgaggucaagagauggagaccguauuggcuaacacagugaaaccccgucucuacuaaaaauacaaaaaaauuagcugggcaugguggcgggcaccuguagucccagcuacucaggaggcugaggcaggagaauggcaugaaccugggaggcggagccuacagugagccgagaucgugucacugcacuccagccugggcgacagagagagacucaaaaaaaaaaaaaagaaaauauaggccaggcacagugaugcaugccucccagcacuuugggaggcaaaggcaggaggaacacuugagcccaggaguucaaggcuagccuaggcaacauacugagaccucaacucuacaaaauuuuuuuuuuaauuagccagacaugggggugcaugccugcaguccuagcuacuugggaggcugcgaugggaggauuccuugagcucaggaggucaaggcugcagugagccaugauugcaccacugcccuccauccugggccacagagcaaguagcaaaauguaaacauacacaaauucaaauaauagagaagagaaauaacaaagccuacaauacaucagaugcuuugccaaaggacugccuuccgaauucagaaaucacuggggggucagucagcuccuucuggaagggaucaaagcaugcuuugcccuggcccacuucugcugcccuagacaggccuccagacuuuccugcuccuuucuguucuauaucuaccaucaaauuaaucuuccuuaaccuggcucaaaaaaccugagugauucaaaugaucuaaugcauaucaggucaucucucccaacuccucacuguccuguagucacucuaaccacaaaguuuacuggcccucugccaccaggauuuuccuucuccccuccccaugcuucaguucaagucuuaaccucuuuccauaaagccacugcuggccaggcgugguggcucacaccuauaaucucaacacuuuggaauucaagaccggccuuagcaucguggcaaaaccccaucucuacaaaaaaaugcaaaaauuagcugggcauaguggugugcaccuguagucccagcuacucuggagguuaaggcaggaggaucaacugagcccagggaggucaaggcugcagugagcuuugauugugccacugcaccccagccuuggugacagagaccgugucucaaaaauaaaaauuuaaaaagccacugcuuccagcuauuggucauucccucaucucuaacuuuccauuaaccuuagaguauaccccuuaauauuacucuuaauucaugauuuaguauugucaccaugauuuaaaugauaagcacuuugugcacaagcauuaucuuacucuuucuaugguucuuaagcagugauuuccaaggaaggagagguaucauuugaaaacaaaacagcucuuugucccauagggauguuuuuaaaagcuauaacacuuaacuuacuggaauuucaaauauuaaaggaaaaugugagacuuuuauguuuuaucaaaagaggcauguuguauaaugaaagaguuaggagacaauuuuucaguguugagcaaauagaagauaauuaauagauaucuguugaacaauacauugauuucaacaagccaugaauuuggauucuuuuaggauuaaacauucagacuucuuauuuuaauggagaaacuguuaguaauaugaccugcugauuauaaaggggccaaaaaacugguacucaccagcugaaccaacuauuaaaaacguaaggauauguuugaauguuuuuguuaugaaccauuugauauauaaaaugugcgcaauguauacauaaauuauaaaacaauaauagauggugaagucaccuaauuuaagagauuucuggaacugauuaacaccuauaauuuuuuuuuuuuuuuugagacggaguuucacucuuguugcccaggcuagagugcaaugguacaaucuuggcucaccacaaccucugccucccggguucaagcgauucuccugccucagccucccgaguagcugggauuacaggcaugcgccaccacacccgacuaauuuuguauuuuuaguagagacaggguuucuccauguugguuaggcugguuucaaacucccgaccucaggugaucugcccaccucagccucccaaagugcugggauuacaggugugagccaccgcaccuggccaacacccauaauuuaaagguucuguuaccuuuaacagcaaaugacuuuauuuuugcucuaauuacauauauuucacugaguuauuuucuuagucuaguauauuaaaacuguggcauuucuuggccaggcgcgguggcucacgccuguaaucucagcacuuuggaaggcugaggugggugaaucaccugaugucagggguucaagaccagccuuaccaacguggugaaacccugucucuacggaaaauacaaaagugagccaggugugguggugugcgccuguaaucucagcuacucgggaggcugaggcaggagaauugcucaaaccugggagguggagguugcagugagccaagaucaccccauugcauuccagccugggcaacaagagugaaacuccgucucaaaaaaaaagcauuucuuuaaauucuauagucaauauuccugucuuacucauugcauuggaauuauuuuguuucuggcaugcuugcuaacucaugaguuuguacuuuuuuacucuauuuugaauauucugauuucacauuacugagauaaucuuucuuucuuucuuucuuuuuuuugagacaaggucucacugugucucccaggcuagagugcaguggugccaucuuggcucacugcaaccuccaccuccuaaucucaagcgauccuccuucuucagccccccaaguagcugggacuacaagcaugagccaccauauccggcuaauuuuuguauuuuuuguagagaugggguuucaccacaucguugcucaggcuggucucgaacuucugagcucaagcaauccaccugccuccaccucccaaaguguuaggauuacagacguaagccaccgagcccagccuaccaugagauaaucuuucuacuucauauuuccuccacacugaauugaauaagccacuuaucugcuuaugucccuagucuacucaagucauuucauuccuucuuuguauugacugacccucccucuaguuuuguauaacaagcuuacugcauguuacuucuuccaaaucacugacauauaaaaaugaacaaaguugguccuaauauugaucccuggagcguuguaacccauccauuccaaacuauuccacacuuugauaucaaagucauuguuuacuuaaguaguucaucccuauacuacuuaucuaacuucuagauuaguuguuugucugguauucuuuucaugguauuuuauccuaaaauacaaguaauugguucauggcuucccucagcugauauuuguuauuagacccagaaguuauuucauaucacugaggcagauaagaugugaauccaugcugacucuuuuuaaauuaaaucauaacuuucugauauuuccauuugcugauuuccuacaaaauuuaccaaugucaucuucucuacagaauuuaauacuucugaaucucaugcucaagagaaaaagggauauuuagggaaugaacaauaauuuaaugaggguuuuacuuauuaaaacugacauagaccuagucaaagauaaaguauuucaagucacuuuucuccuuauugaugaauuuaaacaucuauuaagaaucaagaagcaggcuaagcaugguggcucguguuuauaaucucggcacuuugagaggcugaaauggguggaucauuugagucuaggaauucaugaccagccuggacaacauagggagaugcugucucuacaaaaaauaaaaaauuagcugggugugguugcacccgugguggcaugcaccugugauccuagcuacucucgaugcugagguaggaggauugcuugaguccaggagguuaagacugcagcaagccgugaucgaaccacugcacuccagccuggucaacagagcaagaccuugucucaaaaaacaaaccaaaaaaaaaaaaaucaagaagaaacuauucgcauuacaauagugaaaauguaucagaguagucaaaauucacagaacuguauaccuaaauagggugaauuuuacuauauguaaauuauaccuuauuuuauaaauagaaaaaaguaaauagaaucuucauuuuauguuuguuuuguuuuuuuuugagacagugucucacuuugucacccaggcuggagugaaguggcgccaucuuggcucacugcaaccucugccuccaggguucaaguguuucuccugccucagccuccagaguagcugggauuacaggcacccgcuaccacgcccggcuaauuuuuguauuuuuaguagagaugggguuuugccacguuggccaggcuggucuagaacuccugaccucagguaauccagccaccuuggccucccaaagugcugggauuacaggugugagccaccacgccuagccagaagcuucauuuaaaaaaaaaaaaaaaaaaaacuaguaaauacggaaagugaaacucugugagaauagcacaggggaugguucaggcuccuauaccugggggguuuaacauagacuaauuuaauuguggaaacuuuuuugaagaggagauggaaguauaugaaaaaaggcuuagaaaugaauauuuugaaagaaagaaauccauggauaaacaguggaauggcaagaaaugcacauguuaggccuaggccgggcgcaguggcugacaccuguaaucccagcacuuugggaggccaaggugggcggaucaccugaggucaggaguuccagaccagccuggccaacaugaugaaacccugucucuacuaaaaauacaaaaauuagucaggugugguggugcaugccuguaaucccagcuacuugggaggcugaggcagaagaaucgcuuaaacccaggaggcggagauugcagugagccaagaugacaccacugcacuccagccuggaugacagagcgacacucugucucaaaaaaaaaagaaagaaagaaaagaaaugcacacuuuuaaaaguguguuuaauguaugcuaaaaguaaaugcauaaaaaggccaaaugaauaaacccacagaguuccucacaaacacauauauuucugcaaauauaacagcaagauuauagaaagaaaaaugguauauauaaacacacacacacacauauauauaucuguuuuguacacuugaaagcaggaaccaucaaaaaacuuugcaccuaguaggacuuuaauaaauuauuugacuaaagugauauuuaacuucuuuaggccuauuauc

SEQ ID NO: 13222 - RNA, 4400 nt, Homo sapiens
uuuacauaauucaaggaucuaaaaagaccagaaguucagucagagccauuuuucugagauauuucugcaucccucugaagaagauaauuuguccaaacuuaacaaaaacagguguuaaaauugaguacguucugagaauacucagacuuuuuuuaagacuuuuuuuagucucaaacccuacaugaaauacaaucccuuaaaucuuccaaucuuagagcuagaagaaaagucgagcacccucacuuuacccagaggcaauuuugugccccagaugacaaagcucuuagaucuacucauuugcuuauggcuccaccaguacuucuaggucaggcccucuuucaccugaaggauuagccauacuucuggaaccauuuuccagguuccuugaaauaaauaucuucgcuuugcuggggacccuaguuuccuguuaaguagugaaugacccuucuuuccucccgccagccacaguccuauuucacagaggaagagaaugaccagcaagucaacuucuacuacagagaagcagcaacugauaaaaggccaaaucuuacaaggugccaacgugaagaaaaaggcccacuauccugcagccaacucauaucaaaaguuaaucuguuuaguccucucugccggggugaaucuacaguuuuucuuuuugucucccucuugccccaucaccaggugguugucguuguccuucccggcuaguugccaauaaaguuguuacaaagugaccuugagugucuuccuuggugcacccgaaaccccgccuucuucauccgggugcugcggcgcgaauaagagccggaccgcgcuugcgcauugagucccacuccuucgaccucugccgcagcccgugccgccgccgccuccugggaagguaaguggagggcacagggagcccggccuggccagggcggagcggcgcccaguagggacccauucauugugccggcgccucacugggcacggggcccaagcugacggcgugcacgggagccugcggggccugggugggaagaacaggccccuggagggcacuugaccuuaagccucuuuuccuccgcagagaggaagcgggagaggagcccacgucgccugucacccaauaucuccagccgcgcagucccgaagaguguaagauguucgccugcgccaagcucgccugcacccccucucuggugcguagcccaggcagggucggggggauugaggggugggcguuuuggccuagagcguccacguuguugaauggggcaaccuucgggcggggcacaccgcccucucgggaacggcuuucuccuuaccuauuaacccauugccguuuucuuccuaaucuuagggcaucucagcccucuccuugccacuagggcgaggcagagcagccgaggccuagcugucaggccucacucgguguaggucaaacucucuggucccuagaccaggaguggcccuuucccccaccuucucucagccucucuguuggauuggggucgacgcgaagguuggaguacugcagaggauguagggggccguugaggccuaguucaccucagcagcgcuuuccagugccugucuguaggucaaacucguugcugcagagggagggacuuugccuuuccgugugggggcggaggaagguggugggggaacgagcccaaagucuuucuuccugccucuggaguauuauuuucauaacaauuuugcaggcuuaaagugaggucuagaucuggaggauuugucuuagagaaucagguuuugguucggaaggguuuuucugugaccuuaauuuaguggacacucaagggcagagaaguuggacuggaauauguccuuauggucagauauuucacagauuauucuuaaacugauguagaauugcuuaaguuccuuuuuuagaaauuuuuuuuuaugauuaauggucauauagaaauagcuuugaaauggucagggcuauuaacugcugggcuauuuugaaugauaaauguuuauugugacgcuccuaauauacuuguugguccacuuaaaauugccaaagaacgugugguauuuauugcuuuuuucugacuugacuuacggcacuacaauaauggaaaugucaaaagcaguucuuacucucuuuguaacuguuauuagaaauuuuauucaagguagcaagcguuacaauuucauuagcaugaaacuuuauuaaaauugcuuauguauuaaaaaugaccaaacagcaaagagucaauucagaaguuucugauucauuuuuacugcuugcuuuuuuagaauucaugguaccagaaaagucauugaagucuuaccuguauucuuucuuaauauugaaaucuuuauuuuuuuuucauuaauagauccgagcuggauccagaguugcauacagaccaauuucugcaucaguguuaucucgaccagaggcuaguaggacuggagagguaauaguagcaauaauugaaauuagguaacacuaccaaauaaggguaggguuuugauuagagugaaggaaaaaaacuuuauuaauaagaguuugagggcaagucuuucccacccuuuuauccaaaaaacuagaugagccaaauagccaaaaauagccaaaaaacuagaugagacgaauagagaaauuucucuauccaaaacuuggccaaguauuuauauucaagucuauugauuuaaguugccuauauuuaaaauuauaauagcuacaguuauugaaaaauguacucuauuggacuggaugcgguggcucacaccuguguuccuagcacugugggaggccaaggagggaggauugcuugaccccaggaguucaagaucagccugggccacauaguaagauccuguuucuacaaaacauuuaaaaauuagcccagccugguggucaccuguaguguuagcuacucaggaggcugagguggggagcuggcuugagcccaggaguucaaggcuauagugagcuaugaucacaccacacuguacugcacuccagccugggugacagaccaggugagaccuugucucuuuuaagaaaaaacaaaacaaaaaacccuacuuuauuuaaaagcauauuuauauauguuguuucuuaauuuucaacacccuuuuaagauguagauauuguuaucccuguuacacaagagugagauuauucuaagcucuugauuugucucuuuacacucagcuacaaaauaaaaaaguaguuaucauuuugacaauaugguauuuaauuaaaauagcuaccugugguuacugauacgaccuuuaccuuuauuuucuguuuuccagggcucuacgguauuuaauggggcccagaauggugugucucagcuaauccaaagggaguuucagaccagugcaaucagcagagacauugauacugcugccaaauuuauuggugcaggugcugcaacaguaggaguggcugguucuggugcugguauuggaacagucuuuggcagccuuaucauugguuaugccagguaaucauuucuaucccuaaauaaguuaagagcaugcuugcaguaguuggaaacuuagcuacugaaauaauagcuacuuugcauuaagugcuuacucugugucuugcauuauauuuaaagggcuuuguaugcauuaucucacuuaauucucauaacaccauuugggguguuaugagaauaacaucuaugaaggacuagagacacagaggccacauuacuugcccaggucauagcuaguaaaugucagaaaaugaauuuuaacuaagucugacuucagagucugcauuccuaauuguuaagcuauuuugggaauaaaauuauuagagcacauuccuuaaaaggaucaauuuauuuuauuuaagaccuaaacugucagaucuuaaaagguauagaucauauuuucagauggauaagaaugucagaacccaucaaaaugaaugaaaacuaaccauuuauauugacagacagcucccuaccuuuacaccauauuaucaggauugaaggagaauaguguaagagagaucuaggcaaauacucuuccagcagacuuuucaguuuacaaaaauccccacacuaguaaucugauucuuuaacauuuaccaaacauguugaaauuaauauuucaaaguaacagucauauguggucucuuuuagaaacccuucgcugaagcagcagcuguucucauaugcuauccugggauuugccuugucugaagcuaugggucucuuuuguuugaugguugcuuucuugauuuuguuugccauguaacaaauuacugcuugacauguuggcauucauauuaauuacggauguaauucuguguaucuuacugugacuccgaaaacuguaguauuggugucaugggaauguacguuauuuccaaagucauuucauuaaagaugaaaacuuuaauuucuucu

SEQ ID NO: 13223 - RNA, 82814 nt, Homo sapiens
cgggcugacuuuucuccacuggcuugguugggaacuggcuucuucggagcuguguagucuuaauuugcuuugcugcuggcuggcugacagcugaugggggacuccucaggacggacucccuuccagaugcacccaucuccauccuucucaacuccccaaccuuuguccuccccacucuucgcucgcgcggcggucugagaccaccaggaccaguuucagggguuuccuucuccagcgagacuuggcagaacaggcuuuaaaagcaaaggaggcagcggaagaguaagaaauaacuauauucuaagagucauaauaaauggcaguacauaacugcgacacgacaccgagcagccuaagcuggcugcggaggccacaaacacaagauccuaaccucccggccgacccgccccaacaacuacccgcccaggguacggucacgugacgggggagcggcgcgcgccgaccgcggcgccaauuggcgagcggcuggagcgcgggguuucaugggaaggaguuggcccggcuugucucucugucaguggcggcugcugccugcucuggaggcaggcugggcgguggcggccgagacuggcggggguggacgcccgggccgggcugcgcccgcuucuugcagguagaacgcucaaggcgagggcaguugggagggcucugcagcggggaggcaugcugagcugugccccugggaaauaagcugcggguuccccgcuugccucuccuuggugcccccgccuccugccaaguggccuagagcucugcggcggcugcuagucaggcugcgcggugguccgcgcagacccaggcucgccgccuuguucccuggauuucccagcacacuggcagugguggcgcuggagucuugaaacccuuguuuccccucuagggcugguaguuucuccagcucgguucuaggagauuccggguggugacuggcuugagccccagcucuuuggcccacuugugucgagcuuaucucgacacagguggggcaaagaggucagaaggucccaaacuagcauuuccuacgcucagcuguccgcuuugagcguucucuccgcuucucuuucugaguugugcggaggcuccaagaguuagaaagaccagaagggacugaaaacugucagugucaugcugccgggcucuagcgugugggcguggaguacgugcuacuuagagaagagacucuccaaccauuguccuuauuucagggauggugggcugugggguggaggggaagggcgaaggugcauuguaucagaggcgugguaggaggagaaaaacaaaucuaaauuccgucaguucauaguuuacggauugagaaagaguugaaauuggucaacucagcuuugcugauggugcuuucacaguacuaagcaagacccgugaaucacugaguuuuccguguucugcuuuucccaguuggccuccgguguguguugcucggugucuacuguuuccuccuuucuuuauggccugggugucagcauugacaaaauugacucuauucaacagcgguuuggugggugugaguaagcuugguuucaggaauauguucaaacuggcagggaaugcucauuucuuuuccucagcagcccccagaagaccaaguugacuuuuaacacauuuucuuaaacaggaguggugcguuuaaauuagaauuuuaagguugucuguuaucuauugagaucagcucaguaaugauguuaguaaacuuauauaguguuuauauguuauauaaacaagaaaauacaagaaaaggagaaguuauauggcuauuaaaaauauaugacuucacauagaaacauuuauaaucaaauaguaauuuuuuggugguauuuaguucagaugaaaauugacuuaccaugaaagcaagcacuaaucauuauauauuaagagugcuuaauauauaauagagguguacuuuucauuaaaauucuuuuugaggagcaauaaauguggcuugggcuauuucagaauugucuuuucaguuaggacauuugaaaguuagaauucuagaauaaaucaccuuuacucuucaauuguauaguauaauauguuauggagguacuguugauggugauuaaauagcuuauacuuaacuuuggaauuugauaaacauagaacuuccuuugcuguuuccuucaaagaccuacaagguuauuuaauggcagagucuacagaauuuuuugcucuauuucuuauacuagagaaaaugagagcaaucuauuuuuguaaaaauacaaacuaauauaauuuuccaauuuuagaauuaugaaauaggugcuuucuuuauaagaaguuagaaauguguuucauauaaauacauguguuuucugguaauaauaauggcuacaauuaagcaguuacuacuaugugucggacacugugccaaaugauacauaauuucauuuaauuuauacaacaauucuaugaaguguagauauuuuuaccauuuugcaaaugcaauaacugaggcgugcagaguuuaaguaaucugcucaagauugcauagcuaguaugugguugagccauauuuugaauccagaucuauuuuauugcauuauuuuaaugugucuuggagugaggugaaaauuuaagaaaaacauuucccaagauuuaaaauucugacacccaaaccugaguguaaauagccauuaguagaaaacauucaaauaagguggucauuauuguucauugaaaagcacauuuaggucgggugggguugcucacgccuguaaucucagcacuuugggaggccaaggcagguggaucacuugaggucaggaguucaagaccagccugggcaacauggggaaaccccgucucuacuaaaaacacaaaaauuagucgggagugguggcauacaccuguaaucccagcuacaugggaggcugaggcaggagaaucacuugaacccaggaggcggugguugcagugaguugagauugugccacugcacuccagccugggcaacagacugagugagacucagucucaacaaaaagaaaaacacacuuagaugcacccugcucuuaaggucaugacagguccuguugugguaucagaucagaguggaaagaaacacucuguacauguucaugggagaguucuuggagaaaagucacuugagguugaaccgucuguccaauccagggcaagcaaauugauuuaugccucagaaggaaaugcaaagguuauucgguucccauguauuuuccauguauuugaaagaaaggagagauggauuagaaaauagcuacaacuacagcaguaaaaacaguuuguauugagcaaucacuaugugccaagcacuguuguaaacagguuagaauacauuaggucauuuaagucuuucaacauuuaaggggguccuuaacuaucccucuuuuacagaugaggaaauugaguagcagauagguuaaguaacugauuuguccaagauuuuacaguaagugaugggccacaggacuuggaguuaauauguuuggguggaaaggagagcaccagugguugaauacagaagagguaugaaauuaaagcuauggagaaauauuugauuuaauuauuuaauuuuguuguguuuucacaucuguuagaaaguaccaccuauuacauaugcauuacaguaaaacaguuccuuuaauaucagaauuugauagaaaaauugcugaaacugugcugguugacuguucuuugauuaugaaccugaaagcauggauauggcauuuaaugacuaucacucuaauauuguuuuagaguacaaauuuaaaagcauaaucccuugcuucaggggucuuagaggcuaagauguagauuguuucauuaauaccaaaacaauucuuuaagcaaauaauugucaaaauugguauagugauauuaugcauauauuucauauuguacuuacuuuaaaauugacaugcaguaaacaaauaaaggcugugcuugcagacuucuaguaccaguucugucccuagcuggagcuacaugauuuuggcaaaucauuuaacuucucuuuaaugcagauuuaaacacucaaauguaaucaaauaaaggaauuggguuacacaauacauuguacuaauacuauuucuugugcuuauuacucacuuuucauuucaguagauuuguuuaccaacaauuugauaaugucagaggugguuucauauauuuuacauauaaauauucaaaucuaaucuauacaaagcagacuuuauuucugauuuuguguuauucauaauaacugggugcuuaaaaaaucaaaacuaaaauauuauguuuggcucugcugcuuacugccuuuuuuuuucuuuucuucuuuuuuuuuuuuuuuugugagacggagucucgcucugugacccaggcuggagugcaguggcgcgaucuuggcucacugcaaccuccgccuccuggguucaagcaauucucugccucagccucccgaguagcugggauuauaggcaccugccaccacgccuggcuaauuuuuauaguuuuuuaguagagacgggguuucaccaucuuggccaggcuggucuugaacucuugaccuugugauccacccgccucggccucccaaaguguugggauuacaggcgugagccaccgcacccggccugcuuacugucuuugggauguuacuuagcacacuacuucacuucucuugccuuagauuucucauuuguaaaauggagggauaguaguaucuaaaugcuaaaauuaauauaaaguauuugggccgggcguggugccucaugccuauaauccccagcacuuugagagaccaaggugggcagaucacuugaggccaggaguucgagaccaaccuggcaaacgaggugaaauuccugucucuaccaaaaaaaaaaaaaaauuagccgggugugguggcccaugccuauagucccagcuacaccuuuggagacugagaugggagaauugcuuuaacgcuggagauggagguuguauugagccaagaucgcaccacugcacuccagccugggugucagugagacccugucucaaaaaaaaauuauauuuauacacacacacacacacacacacacacacacagagcauuuguuuuagggccgcuagaaaugaaguacuuacuaaguguuuaacugauauuguuggugccauuaauuucaaauauuaaaaauucugaucacagucuuagggugugaugguuagaaacuugacauugaaggauauaauucuacuucaaaccaaaauauguagguugguuguguacagaacacugcuagacaccauacacuaguuccagaauaguggaaugauguauauuuugagaauaacaagugauucauaugaaucuacccccuucacccaccuuuuugguaguuauuuuuagcaucucaagaggguuuuuagauuuacuuacugucauaauucagauagaaauuuauaguuuaaucauuaaaguuccuggauuuucuacaaccacauuuuagaaauuugaguacuaagcaaauacuaaaugauuaauaauauuuagauugcaacuuaaauaagacuugaaacauucauuauaguuauaaaccuuagaguuuuucaggacagauuauagguguuucuguccuuaaaaauuacuuugugaguaaaaguauuuuacaguuaggcacuuuguuacuuuucugagaaacuccaagauagcuaugccuuaugcuaauuacaauauaugaauaauuuugcagagugagugugcuuacuugauacugguauuauuuuguguuuacguuuaugguuaaaaaauaugagaagugugacauagguaaccuuuuuggggguggaaaagaaguaguuuuauacauuggcaaguaucuaacuguaaccugguuaaaauaugucaguuugaaauuauacuuuuaccauuucaacuuaaaagaauaaaaauuuguguaaucauuguccaguaaguugauuuagaauauaauauuguugagucuauuauaaaacauucgagagucauagaaaagcaacugaaagaagugguuauggagcuagcugaauugaaggucaacuagcuucagggacuuguauacaaugucagggagaaauguuuauuugggcauugaacagaaguguuuaguaauagaggcuagaaaucugaagauaaagggacucuaggccauauuucuucugagcuauugggcaaaucacuaaaccucuuuucacuuaguuuucuuaucugugagaugguaauacuauagacuauccugugagaaagugguuguauuauuaacuaauuaagagaaaagaaaauuaaggcuuagaaucauuaagugauuugcuaaaggucacagauaaccuuguaauccuuauuuucuuauucauaacucagcuggcuuucucuuauuacuuguaaggugauauucuaaacauuguaaaacacuucuauuccagauaacuaguuuaguugggagacagcuggauaguagaaauuauuuaaguguauaguaugaaaguaguaugguaaaacuuuguuaccagaacaacauagagaaccuauuuuaaaggauagaaaauugcaaagugguaagaauauacauuucuaaacugcauugucauuuaaaaagcuuuucaaacuuuuucacuuuuagaucuguucugguuuugaagaauggauuuuuaaaaggugggcuugguggugugcgauggcucacgccuauaaucccagcaguuuaggaggccaaggcgggcagaucacuugaggccaggaguucaagaccagccuggccaacauagcaaaaccccgucucuaccaagaauacaaaaauuagccaggcauaguggugcgcaccuguagucccagcuacucaggaggcugagccacaagaaucgcuuaacccgggaggcagaaguugcagugaguugagaucucgccacugcacuccagccugggcaacacagagagucuccaucucaaaaaaaaaaaaaaaaaaaaaaaaaaagguagacucuaucccaauaacugucugaaaucaaauuccauauauguggcauccaaauaaauuaauauuucauaacauuuuuuaggcaguauugcaacaucuauaguggguaugcuguguguuuaacuuaacauuuuaaauacuugcuuuauuucuagcugugaauuccuuuggacaauugaugauauuuaucauugugcccaguuucuacaaauaaaagauggguggauuauuuucucgauggaggguaagguacuuuucuuuacagcuaguucuugagucuaauauaaaagugucacauaaagcuauuugugaaagucuccuuugauuauagccuugaauaguaguuugcuauuuuccuuaacuuuuuucuucucuuuugaauuacuuuucuauuuuuuuauuuuaauacuuccauuuguucuguagguguccaaugccucuguuuaacagaauuauuucacuuggauguaugaauuauuuuuauuucuguauuucuguauuugugugcaaauggcuaucuuguuuucuuauacuuccuaaguuucaagcuuauuugaaagguaguugaaaguaaguauucuaggccgggugugguggcucacaucuauaaucccagcacuuugggaggcugaggcgggcagaucaugaguucaggaguucaagaccagccuggccaacauggugaaaccccgucucuacuaaaaauacaaaaauuagcugggcguaguguugcgcgccuguaaucccagcuacucgggaggcugagacaggagaauggcuugaacccaggagguggagguugcagugagccaagcuugugccccugcacuccagccugggugacggagcaagacucagucucacaaaaaaaaaaaaaaaaaaaaaaauucuauacaagacuuguuuuuuacagacuguaucuuuuuacuugaagcuuaucauaaauauugacuaaagucacacugccugugcuuuuagaaauuauagguuaaacaaaauuagaaaugcaguuugauuuuauuggauaagcuuuuagaggaaguaucucaaaguuacagcucgaaaauaugaauuguauaaauuauauaaccccgucucuacuaaaaauacaaaaauuagcugggcaugguggugggcgccugcaaucccagcuacgcgggaggcugaggcaggaucgcuuccauccaggaggugaagguugcagugagccgagauugugccacugcacuccagccugggcgacagagcuagacucugucucaagaaaaagaaaaaaaaauuauauaaaugcucuuuucaaaaguaagaggagauaagguagucuaggauaaacuacuuauuuuuuuuuacuccuuauuaccauaauaauagagucuaacuauacuugguacacaauuuagguuuugggguauugcuggaacagccuuguuuuggaucagcauuauauugacccuguuaugaccuuauaauaaucugcccaaggaucaaauuuaucucuucuuguuuugucuuucauaauagguugaaccauaugaaauugccaguauucaacugcuuggacuuagcaaaaugucaguuucauaugguuaacccuaauguuaacaacucuuauggaaacuacaaugaacugauauucauuacccucuuggauuguugaguauguaauugguaaauauuuuuucaaguguuuuaugagugauuuuggcugguuuucauucuagauguauaaaaaauaucauuggcaaacaagcuuugcuauaaugaaguauucuuagauguccuuuuaaaaucugaucugcaaaaaguacuuuaggaauuuagaaagaagauaaccuguugauuuugaccuccagagucuuaagugaacuuuuagcaauagcaaaucagaccauuuuuagucuguaauuuuuuucaauguguuaauucuuuugaguaaucauuccuaagaauuuuuuuuggaggaaaacguguguuuuuuaaauuuuuuaauuuaauuuaauuuuuuuuuugagauggagucuugcucugucacccaggcuggagugcaguggugcgaucucggcucacugcaaccucuggcucccggguucaaucaauucucgugccucagccuccugaguagcugggauugcaagcgcaugccaccacgcccagcuaauuuuuggauuuuuaguagaccaguuggcgaagcuggucucaaacuccugacccuaagugauccgcccaccuuggccucccaaagugcaggcgugagccaccgugcguggccaaaauuuguuucuuucuagaacgguguguucuauugagguuaagaaugguaaaaauugagcuaucagaauuaaaagucuuucuaggauuaaaacaguuaaguagggaaaugcuuauuucuuuaaucuuacguaguucuauuugcaauuauaauuuuuauuuaaauaaaucuuaguuauaaacaagaaugcauauuugacaagauuugagaaaauuuaauuuugaaauaaauguucuuuaaugauuauaucaaaauguaaagguuugugauaaguuuuaaugcugucucuuguuucuguuuguauaacagacaaaaccuucaacuguagaaguucuagaaaguauagauaagguauguucuuuggcugugagguauuuuaauucauuuuagguauuaaguaaauauuauuguaguauauauuauuuuggagaccaaaucugguaugggaauuuagaaaugauauagagugagucugagaacuuuaauauuaugugaucucaaaaaauccaaagucuauccgugacuuaagaagucuguuucaaguaauagagccaguuagaaugaaauuagaucuguagugugguguaaaucaguguuacagguaggacaaaauagaugagauacuguacaauaguuuuuaucagucuacaaaauuuucacagcuuuuuauauacuauuaucaaaaaugauuauuuucugggaauauugagagugauaaauagauggguuacuguuuuaauuuuuauuaauuauuuuucuuauugccagauuuuuuaaaugccuuuuauaggaggaauuauuacuuauuugacucaacaaauauuauugccgauaccaauuucauucccugaaucuuugccaauuugauaguuuaaaaauaguaacuaacuuugcauuguaaaaaugauguuagaauaagcauuauacauuuuuaacuucauuuuuaguuuucuuuuucauauuauguuuuguuuuaaacuguuagaauauuaugcuuuacugaacuuuaaauaagaguuuuuucuuaaauaucuuuccugcuaaaauuuuuuaacauuuuaauuucuuuaugaaguuugaaauuuacuaacauggaauaauuuucucuuaacaggaaauucaagcauuggaagaauuuagggaaaaaaaucagagauuacaaaaauuauggguuggaagauuaauucuguauuccucaguucucuaucuguuuacaugcuuaauuguauauuugugguaucuuccugaugaauuuacagcaagacuugccaugacacucccauuuuuugcuuuuccauugauguaaguaaauuauucuuuuuguugaucuuuuccuuuucugacuagagagucuuaauguauaucuaauauguauauucggucucuuuauuauuaaaugguaauaucugauugaguuugaauuucuuucacaauuugaaaagauuuuuuuaguagaacaauuguucuaaaccuucauuuguaauccaauauaccugaggaauauuaccuaguaauaugaguaauaauugcucuauauggcaauguuuuaugauuuucuaguagaugaccaugcuccccgaagggcacugggcauggaguaguggguaauggcaaguggggcaggguuuguaaaaacgaaagaauaacugcucaaauuauucugaauauauucaccucaacucucuucccuucguuuuacugcuauauggucacugcuauaaagcaauugacccuuauuuuagaaauauuuuauaauauagcacuguauaggaggcguaucaugacugagaauuuugagagacaauuuaauaaaaaguuuguuuauucagucaacaagcauuuauggguaccaguuguuuagacauuggauuauaaugguguaugguacauaaaaauacaaaauucucugacuguauaucuuagacugcaaacauuaaguaaugaguaugaugaauguuauaaacagaaguguaaaaugcuaugggagcauuuaauaggggcauugccucagucugaauacuacuauaaaaaaauguguuuguuuagucuuuagugcagggcauauuuucaauuugaaacuccugaagcuuguaaaauuauaaguucguauguagcuacaagagcugaaauugagugcuuucauaauauugcaaaauaauuaucucugcuacuuucuuuauuuucauuuuuugaaaucuuuuggaaugcuuuuaucccagaaguaguggauuuuauaauugugagccccuuuuccuuguuucccuuaucuuuuuucauaagaggagaggaaagaaaauuacaaaauaaguaugagauguuuaguaaauuuaagcacuuuuaaauacucaaaaaugcacuuuacauauauuuccauauaaagauugauuuuuugaucauaaaagacuuguaucuaguuguaacagaaugucugauagggaacucuacuguguuaauucuaauggcuauccaaaaacuaugaucuagguuugcuauuaugauucauaacaguuuuuuggggggcaaauaaauuauauacuaauuguucuuuagaagcaggaaaacuucauuucuuuaaaaauguaauuucuucaauucagucuuucugauauuuuggguaugaagcuuucuuauccuuacuguguccuucugauuuuucugcaucaccugcaucuaguauaucuuggcuuguuuagcuucagagccauuuuucacuucaucucauugauauuuguaaccucguucucagcuguuguagcuucuauuucagugagcuuuucacuuuuugaagcacagaccgguuauccaacaaagaauagcauuguccuucugaucaaugacaaucaaaaaacaugaaauaaaacaaugugaaaguggauguugugguaaaaagaaagaagacuuaacacaggacauuuucuuauguauguaaugugaguuuuugccuuuuguguguaaugugagcuuaucccuggacuuuuuucuuugggaaacagugucuuagucuguuuaguguugcuauaaaggaauaccugaggcuggguaguuuauaaagaaaugagguuuauuuggcucaugguucugcagacuguacaagaaguauggcaccagcaucugcaucuggugagggccucaggcugcuucauucuuggcagaaggugacagggagccagcauaugcagagaucacuuggugagagagaaagcaagagauaggggaggugccaguuucuuuuuaacagccagcucucucaggaacuaauagagggcaaacucucgccaugccccagggaggacauucaucuguucaugagauccgcccccaugacccaaacaacucccauuaggccccaccuccaacacugggggacaaauuucaacaugagguuuagagggucaaauauccaaauuauagcaaacaguuuugagggcuggacucggauuuacuuaaagacuuagaggcaaaaggggcaauaaaguauguuguuuugcucaacacuguguacauugauuauauaguuuagaaaucuaccugguaucuguaaaaagugacugcugucuacacauucccaguuucccaaaugcuuuuacuggaaaggucauggaucaggacugaacauauauuguauaacuauuccaaaauuauucuuuaugguagaauaucaauacucuaauauccuuugaaauuuuauuauauuuucacuucagaauguaauauggaggaguuuaauauaauuccacauacuguuuuuuggccuuucagauucaauaguauauuuaccucccuugaucuuuucaacuauuacugaaacuuaaaucauaauauaaaugccaaauuuauuuuguaggagucauuaaggcuacacaccguagugagggaagguuuggguuacguaaaguuacaauuuuguauuucugcauuaugcuagcaaacaugcauuaccuugggaguugguucauuuucuaagucagcaaccauuaaguuuuauuucuauguuaacuaaugcuuuaacuaaugcuuaguuaacuauguuaacuaaguaaaagucuuguagacuuuuacuuucggauaccuuauuuuuacgaauuauaacuuucuagacauuucauucucuguaauuuuagagacugaucaucaucauaagauauugaggaguuagccauaauuuuuuuauuuguuuuugccucucaaaaugggguuguuggggaagaaauuuaagcaagggaauugaggaaaguggucauauuccuauuucucuucuuguaucuccacuuaaauugaaaaccauuuaaggauagggauuuguucuuauacaauuuucaugccuccucucucuccccacaaguagcacauguuagguauuuccucaauccagcuagguugacaaacauaauuuguaaccuuuugaagaaaguuaaauguuuauuucaugauacacuaguaagaauacaagugucuuucagccaggcgugguggcucacgccuguaaucccagcacuuugggaggcccaggcgggcggaucacgagaucaggagaucgggaccauccuggcuaacacgguaaaaccccaucucuacuaaaaauacaaaaaaaauuagcccagcacgguggugggcuccuguagucccagcuacuugggagacugaggcaggagaauggcgugaacccgggaggcagagcuuacagugagccgaggucacgccacugcacuccagccugggcgacagacucaaaaauaaccucaaaaggaauuuuuagauauggcuuuuauauauaauaaagaagacauuuggaaggaaaaaugguuuugaguuguaugccccaaaaaacaaaagcaagaaauacuugauucuuauuuuuuacaccaaaauaaaucauuguuacuauuuugccuaaacaugaagguaauuauugcugaagucuuuggugguuaaauaagcugacaaagaagucaacauaguuauaaauauuaagaccuguauauaaauucaucuuuagcuuuuuuuuuuuuuuuuuuuuuuuggagacagagucuuacucuguugcccaggcuggaguguaauggugcacucuugccucacugcauccucugccucccaggcucaagcaauucuugugccucagcuuccugaguaguggggauuauacgcauucaccaccaucccuaucuaauuuuuguuuuuuguuuuuuuuuuaguagagauggggugucagcauguugaccaggcuggucucaaacucuuggccucaagugaucugcccaucucagccucacaaaguguugguauuacaggcaugagccaccacgcccagcucaucguuagauuuauauauugcuaaaucucaucuaaaaacauuuugauaaauuggauagggcuuaugauaugguuguuugaaaaagaacacuuaaguuuggcagaaagggugaaagagguaacaaaauaauguugcauauaugaagguuggugaaaaaccaccagguuuauagaauguuaauucuuuacccaaaguaaggaagguuuaguuauauugauugaauugagauauucugcuauauuucaacuuuuagcauuuuuaguuugaguacaguaaaacacugaauauugagcuuuuaaaauguuuacgcuguccucugugugauucuauuauauugaaguuccaaguauuuccugcuaggacacauauuuuuuuaguuccagucauuagauauuacugaacaaaaauucaugcuguaguaauauuccaaguagcauuaauuucauucagaaaagaacaacaaaugcuuugaugaaugugagucaaagaaauuuuuuauuucucaacugauuguauauaggaauguagugauuuuuuuuuuuuuaauuauacuuuaaguuuuaggguacaugugcacaaugugcagguuuguuacauauguuuacacgugccauguuggugugcugcacccauuaacucgucauuuaacauuagguauaucuccuaaugcuaucccucccugcuccccccaccccacaacaggcccuggugugugauguuucccuuccuguguccauguguucucauuguucaauucccaccuaugagugagaacaugcgguguuugguuuuuuguccuugcgauaguuugcuaagaaugaugguuuccaguuucauccauguccauacaaaggacaugaacucaucauuuuuuauggcugcauaguauuccgugguguauaugugccacauuuucuuaguccagucuaucauuguuggacaaauggguugguuccaagucuuugcuauugugaauagugccacaauaaacauacgugugcuugugucuuuauagcagcaugauuuacaauccuuuggguauauacccaguaaugggauggcugggucaaaugguauuucuagugauuuucuauacuaauuuuauauucaacuacaauaauagucuuauuguuuguaauaauuuuuuugguugauucuuugagagcuuccaaguaugcaaucauauaaucuguaaauagcaauaauuuuaccaccuccuuuuguuuuuuucguuuguuuuuuuuuuuucuuguuugauauuuuuuauuuuuuuucucuuggcuaauuauguuagcuaauaccuucaggacaauguuaaguuguagagaaaauaguggacauacuugauguguuuuuuugggaauucuucuaauguuucaccauugggcauuauucugacuuuuggauugagacagauauauuugaucauguuaaggaauuuucuaccuguucuuacuguauuuaguuuuuuuuaaucaagaaagguuguugaauguuguuaaauacaguucauuaucuauggagauaccauaugauuuuucaucuucucuugauacaaagggauuauauuaaauauugaaucauucuugaauuccaggaaaaauuucugcuuucaguuuugugaucauuuuauaaaaacauccaaaaacuuuucuuuauuuucauucuuuauuuguugaaacaauaacacuguacauguuuuugaaacuaugacauuuucugaccacugcuuuaguuuuaugccaugggucuugauacauagugauuuauuuugguuauuuucaagauaugauguuuuuuuggagggaguuauaaucuaucaguuauuuauggauggcaaauauauauuuauauuuuuauuuauugucuuaguuaaaauuucuaguuuuauuguauugcucucagagaauguuaaauauuucugauuuaaguuuauugaguuuuuuugguggaauguuauuuggccaauuuuuuaaguguuucaugaacauuugaagauguauucucuuuuuucaguuauacagaguugaauauuagcaaugagaacuaccuuaugcuauauagaucuucuacauccuaauaacaguguauuucugcuuuuccccguauuucuucuaguuuugcuuuacaaauguugaugcuuugcucuuuacauggguauuucuguuauaucuucguuagaaacacauccuuuaagaagaauuuuuaauuuugaaaaaauuauagauuaacaguaaguugcagaaaaaaauguacaggcagguugcagguacccucaccuagcucaccccaaugguaacaucuauaugguaguuuuuccuucauccauaguuuugcccucugcaguuucaguuaacuguggucaauugcagucugaaaauauuaguuuuucgagagagacuacauucauauaacuuuuauugcaguauaguuauacuuguucuauuuuauuauuaguuauuuuuguuaaucucuuacuaugccuaauuuauaaauuaaaucccuauaccuacaugguauguauuuauaggaaaaaacuuaguauauguuggauuugguacuguccaugguuucaggcauccacugggggucauggaacauauaucacugagauuaagggagaacuacuguaguaaauuucuaguuagccuggaaaacgggaagauaugccuuuauaccaacacgaccuauaaauaacugacccaaagugaauguaccacaaaguaaaagguuuuaauuaauuauaaaaaccaaaagcaaaaaaaguuguuucaaaacagaccaacgucuuucauaucaacaaauauuaagccaggaaauugacauugcuucaauccacggagccuauucagaguucaucaguuuuauaugaauuccuuugaguggguuuuauauuucugugcaauuuuaucgccuguagcuuuguguaaccaccgcacaauucagauccagaacuguuccaucaccacaaggcuccuuuuugcuacuccuuuauagccauacacaucuuccuccacuuuccgcauuccuaaccccugccauccauuaaucuguuuucugucuccacaaauuuguuauuucaagaauguuauaagauggacucacauaguauguaacauuuugaaauuggcguuuuucacucaguauauucuugagauccauccaaguuguucagugugucaauaauuccuuucuuucucugagcaguauuccaugguauuaauguaucauaguuuaacuauucaccagcugaagagcauuugcauuguuuccaguucuugcuauuacaaauaaggcugcaaugaauauuuuguacaaguuuuuguaugaacauaagucauuucucugggguguaugcccaagagugcaaaugcuggaguauaugguaaguacauguuaguuuuauaagaaauugcuaaacuuuuuuucagaguagcuauaccauuuuacauuuccacuagguaggugugagugaucuaguuucucuucauccuugccagcauuugguguuaaucacucuuuucuauuuugacuguucugauagguauguagcaauaucucauugugguuuuaauuuuuuguuucccuaauggcugaggauguuucaugugguuauuugccauuaauauguaucuuuauuagcaaaauguuuauucaugacuuuuguccaauuuucuaauuggauuauuaguuuuuuuaacuguugaauuuugagaguucuucauauauuauagauaaaaguucuggccgggugcagugguucacgccuguaaucccagcacuuugggagacugaggcgggcagaucaugaagucaggaguucaagaccagccugaccaacaugugaaaccucgucucugaaaaauacaaaaauuagcgaggcauggugacgcgugccuguaaucccagcuacuagggaggccgaggcaggagaaucacaugaacccaggaggcggagguuucagugagucaagaucgcgccccacugcacucuagccugggcaacagagcuagacuccgucucaaaaaaaaaaaaaguucuuuguuggauauauaugguuuacagcuuuuuuucccccuaaucuuuagauugucuugucuuuucaucucccaacagggucuuuugcagagcaaaaguuuuuaauuuugaugagguucaaguuaucaguuuuucccuuuauuaauuguguuuuucaugucaauucugagaccacuuuaccuugcuacagguugugaagauuuucucuuacuuuuuuuuucuauaccuuaaauuuuuuuuuuuuaacauuuaauuucauaauccauuuugaguuaaucaagguucaggucaaggugguuuaauuuuuguuuuuuguuuuugccuguggaugugcucagucaacguuuuuuggaaaggaaucacauuuuuuuuuuuaacuuuauaaugugacuuucuuuuaguuuaaagguuuuuuaaaaaaaguuuaaccauugggguuuuaugaucacaacccuuguuuuguuugcauuugccugcuauaccuuugucuaugguuuuauuuucaaccuuaaaagauacuuaguuuuagaugcauccauuuacauuauagaguuggguuuugucugguguuacagugugaaggucuuuuucuuuuaccuuagugaguuuagcccacuuaauauuuguugauaugaaagaaguuggucugucuugaaacaauuuuuuuugcuuuugguuuuuauaauuaaaaccuuuuacuuugugguacauuuacuuugggucaguuauuuauaggucguguugguauaaaggcauaucuuccuguguuccaggcuaacuagaauuuuccuuaugauucaggauuuugugugugaauuuguuuagcuguuauuuuuucccagccaguggggcuaggcaauuguauuucuuucacaauacaaaacuuccccccaacccccuugccauaggaacagaauacucuuuguaaauagugcacuucugaauaauuucuuuuuaauuccugccuucucucuuuuuuuauuggaaccaaacugaggagugucugccuguagcugugcaucuuguucucauuguuacaaacauggguuuuaaguuuuacacuuggaaaaguuuaccuuauuaccucuuugugaaauaugcaguuuucuuguuuugcuuccacuuuuuggagccccuguguaauaaucuccauugcuuuugagagugccuccacauauucugaugguugaguuuuaguuauaucucuguuuuaccagagaaguaguuugcaguuuuauuuuuauucuccuuguuguuuggauuauuuuuaugaagagaagggggaaguggaucuuaugccacuauucucuaacuagagguuaguaauaauauccuuaauaucgucaauaucuucacaaaauauguugcuauauuuuaauacauuauuuuuaauuauugggagagcaaaaccuuuguugggauaacuaaaacagaguccugaaguacuuuaguucuuuuucuaaauuuuauuuaaaaauauaaaagggcuaggcaugaugguuuaugccuguaaucccagugcuuugggaggcagaggcaggagaaucacuugaggccaggaguucaagaccagucugggcaacauggugagauccugucucuacaaaaauaacaaaaaauaccaaagaauuucauuuaauuuagcccuaaagaaaaauaaauucuguuuuaccuuuugaagucuugaagacuugacauauggaaaugucuguuguuugauagcuuauguuaucuaggaggaauucugauaaaaaccagaggaauuuauuguccacagagaggauuuagugaguuuuauuuugaagagaguauauuucaauuuuuguaguauuuacacugacaauuauauaugcuuuuuaaaaaguaucuacucauuuaagaaaauuuauacauuuccuacagaauucuagccacuaucucugcaauuccaucuuuuuuuccccguuuucuuucucuguaugcuuuuuaaaaguccuccuuccagccugcuacuauuucaguggguuugcacuggagaagugauacgagacuuuuuuauuauugcggaauccuugaggguuaugggcauuaugcuuaaccuauauucucuuaucucccuucccuugguaaggacaaagccugguguuuuuuguacuuuuagguaauuguccaaaugccaaauaggaaucuggugcuaguuauuugguguuuucaugucacaaaaauaaaucaucacaauauuaaaaaaaaguguauuaucuauuccuguguaacagauugccccaaaacuuaguagcuuaaaacaacagauguuuauuaugucucagcuuuugaggggcaggaauguuaagagcugcuuagcuggguaguucuaucucaggaucuuuuguucuuagguaaauugcaguuaagcuguugguaggggccacagucaucucaaggcuuaacuaaauccauacaaucacuguagauaaagucauugcagaucuuuacucccucugcuguuauccaaucuccagcucacugcucgguaggcauuugcaauuccccugacuuucuucauucuguucuuguguuccuuuugcuuuuuucuugaggucuuuuucuuuucauauaggcuguuuuuuggcaagccuauguuuaguuuccuuuuucuuuguauaauccaggaauuuacaugccaaagcuaauugucuugccaccaccaaaaugcauucugaauucaaaucccaauaagauaucuggugugauccuacucacuuuggcugauuuuucccuaaucuacuccuaaauucacacagguggcuguuagcaggcaucaguucuuugcugaguguuuaccacagaccuuucuuccucacugcauggaccuuuucauagacuucuuugacuguucucauaucaugacagcugucuucucacagagcuuguaauccaggagagagaaagacaagugaaagaggaggcccaaaauggaagcugcaguccuuuauaacuuaaucuugaagugauacacuaucacuucugccaugcuguugguggcacagaccaacacuggugagagaggacuacacaauggugugaauaccaagagacagggaucacuggugacuacuugcagguuaacuccccaaaauagcaaaugcuguauuucagagugaagaacuaauuuucauacuuauauucugaauuuauuuccaguacaaucaaauuuuuuuuuacaagagauacaauguauguuuuaagaugaugaauaauguuuauauacuucuuucuuucuuuuuuuuuuuuuuuuugggacagucuuucucugccgccuaggcuggagugcaguggcaugaucuuggcucacugcaaccucugccuccuggguucaagugauucuccugccucagccucccaaguagcugggacuacaggcgugugccaucacgccuggcuaguuuuuguauguucaguagagaugggguuucaccauguuggccaggcuggucucaaacuccugaccucaggagauccaccugccuuggccucccaaagugcugggauuacaggcgugagccaccgugcccagccuuauguacuuauuucugccagguucuauggagaagagguauuuugcuauguuuacauugaauuuaggagaugacccugacaaguuugugaugaggauuauucauuuaguuucuuuuaauucuuucaauucauuugaugucuuacuaaugcaaggccuaaagaauuauccuuauaaaaucuuugggaggagauauuuagcuaauuuuacucaucaaguauuuauuugaagguaagguuuuuguuuauuuuuccuucagguagcuuaaucucuuagaguagagacugucccucuauuguuaaauaauagggaaggaguggcaacuuacauuuguauaaugcucuuacauuuguaaaagcauuuuuccuuaaugugugggaauagacaaauuaaguuuuuggaauugaugcuuacuuaguaagggauucuaauauucucaaucuuuugcggggugcauagauuccuuucaggcugaugaaagcaauggucuuuccagagaaaugcacuuaugcacacaaagguaauuuuguaauuuaaggggaucaucagaaggucuguggacuuuagguugagaacuccuccuuugaaagcacagguucugauguucucuggcagaaauaaacgcuuuuuaguuuucuguauauaaagggaaacaauguaccuaacucuaauuggaaauauauguuuucauuuuacauggcuucuaauucgcuuuuucuaaugauguuuuuuguuucugaauuuugcuucccuuuuagcaucuggagcauaagaacaguaauuauuuucuucuuuuccaagagaacagaaagaaauaguaaguuuaauuccaauuuuuaauaaauauuuuuuaaaauaccuauuuuagaaugugcugguaagacagguuguaaaauaugauauuggaaugauaauguguuaaguauugaagaguuguuuauuauaaagcaugagaaagguuauaaaugaucaagaugguucuguuuuuaauuuguguuauuuccaucuuguucauuuagauuuuuuuuuacacaaaacaaacuuuuuuuuuuuuuuugagacagagucaggggcauaggaagagccugucgcccaggcaggagugcaguggcacgaucucggcucacugcaaccuccgccucccaggucaagugauucuugugccucagccuccagaguagcugggauuauaggugcgugccaccacuuccagcuaauuuuuuguauuuuuauagagacaggguuucaccauguuucccaggcuggucucgaacuccugagcucaggcaauccgccugccucugccucccaaagugcuaggauuacaggcgugagcaauggugcccgaccaaaacaaacauuuuuaaauaaagagaauuuauauuuguuaaauuaaucuuuauggaaaacuugguuuguuacagagucuuguuucauuuuuaccucaacccauuuuuuucaccccguauauuauuuugaaguauaucccaaauguaucucuccauuuucauaccuggaaaagaauucuuaauaucauaaaauauuaaauauaaaaauauuaacuuuucaguuaucucauaaguaucauuugcuuuuaaaaaaauuuuauuuguuugacuaaggauccaaauaaaguuuguacaaauauuaauauaugacuaucaaauugcccuccucacucacaaccucucuucucuucugcucacauuagauccuauaaucuaccccaacgacuauuuccuugcugacacucuugacccuuuugcuccuccuucucuuccuacuuaucugucaaagccuacccucuuuaaauacaauuauaugccuaaucaaugacuggcaaaacaguauucugauuaaauacauuuacagguuuaaucucauugaagcagcuaaacuuauuagaggaaaaucauacaacaugcucaccugaccagacuuauuuuaaaucuaugauugcagauaucaaguauguacuuaaaacugccuuaugguccuauuauaguuccccaguaaauucaccuuuuucucugucagcgugauguuuguuacuguauuucuccucaaaucacuaauaccugccuccuaccaaaaaccaacaaucaaaucuaaccaaacuaaaaccaaccaaccaaccaaauaaaucaaaagucacaaacaaaccuuacaaaaucuaccuggucacucuuaaccuauagucuuacuuuauacagaaaauagauguaaacagaugagagcuaccuacaccaccaagugaaauuguccuucaguaucugugagggauuggucccaauacccuccgagaauaaaagugguauagaauuuggauguaaccuacacauccuccugcauacuuuaaaucauuuguagauuacuuguaaucucuaaugcaauguaauacuauauaaauaguugcuauauuuuauuaauuuuaaauuuguauuuuuuauuguuguuauuuuuaauuuuuucugaauauuuuugauccaugguugauuuaauuccaugagugcugaacuaauccauauggagggcugaauguauguaaaguuagcucuaccuguacucaguagggucucaaccuucauuauauuuuguaagacuggccuugaucucaucuauggcuaaccgccauuuaugcucuggauucuaaauacucuggccaucucuagagcuuugcucuuauaguuaucuccuguaguuaucaucucuuuugcaucauuuuauguuuuauuauuccuauuggcauauaauucugccucaguaugacuauguggggaaaaaaccucuccuaacccuacauuuccuuuaagcuaccaccaauuucucuuucuuguucaaaacaaaaauuuuuuaaaaaauuauuuguaguuguuaucucuucuuuuccuccaccuauuccuucucaacauaauuuguuuagguuuuguuuccaccauuuuuuacugcaguggcucauuucaaggucacucauuaucuaugucuugucaaagccaguaaucagcucucuuuucucauacagcuugaucucuuaauagcauuugaauuaauucaguuauucacucuuuuucugaaaacuuuuuaagcuucuuugacaacacuucacuggugauuucuuuuuaguuuuauuugcuuuaccucuucuacuagaauucugccuuuggcuuucuuuuuuuuuugauaacuuguuugggucugugcugucugauagaaccuucucugaugagaauaaucuguaucuacuguucaauaugguaucugcuagccauuugugacuguugagcacuugaaaugaggcuaguguaaaugaagaacuggauuuuaaauagcuuaaauuuaaauagccccauguggcuccuggcuauuauuaauacauuagacaguacaucucuaggugauuuuauucacuuccacagauucagauauugccuauuuguuaaugauucccaaaucuaagucuuuaguccagucucuucccuucagcuguagacuuguauaccuaacuguguaauugacauuuccacuuaggaguuuaguaggcaucucauaaguaacauggccaaaagagaauuaauauugcuccuccccuuuauucccacucccucaugucugcucuucccuuugucuucuccaucucaguaaauguuuacccuauaugacuaauaguuaaaacuugcauuaguuaggguucuccagagaaacagaaccaauaggaaauauuauaaggaauuggcucaugcaauuauggagacugagaagucccaggaucugcaguuagcaagcuggagacccaggagggcuaaugguuuaguuccaaucuaagucugaaggccugagaaccaagagagccaguaaguguaaguucuagucugaaagcuagcagguucaagacccagaaagagcugauguuucaguuugagucugaaggcaggaaaagauagauguccuagcuccagggagucgggcaugguguguucucacucacuggagggagaagcaaacuuuuuguucuauucaggccuucagcugauuggcugagggccacuucauuagggagagcaaucugcuuuacucaguguacugauugaaaugcuaaucuuaccccaaaacaaccucacagacacccagaauaauguuugaccaauuaucuggauaccuugugugaccuaaucaaguugacauauacgauuaaccaucacaagaccaaaagccugggagcuauuuugauucuucuuucauauucauucacauuaccagcaagucauauaaucuuuaccuccaaaauuaucuugaaucugaccaguucucacuuucuuuacuacuacaguucuaauucauuaucaucucuugcuugcacaauugcuucuucacuagucuguuuuuaagguauaaaucagaucuugugugucuuuugcuuaaaauugucuaauagcuucccauugcaaccagaaugaaaucugaauucauauccugacuuucuagcuuguuccuauuucuucaaccucaucuuucacucuccuuuguucacuucugcuccagccacacuggccaucuuuuuguacuacaaacaaguucccugaaccuuacaguuucuuucuuucuuucuuuuuuuuugagauggagucucacuccguugaccaggcugcagugcaguggcacgaucucaggucacugcaacauccaucuacuggauuaaagcaauucucuugccucauucucccaaguagcugggauuacaggcacccgccaccaugcccagcuaauuuuuuuguauuuuuaauagagacaggguuucaccauuuuguccaagcuggucucaaacuccuggccucaagugauccaccugccucagccucccaaagugcugggauuacaggcaugggccacugcgcccagcuggaccuuacaguuucuuaauuuauaaaaugggaacagaaagaaugaguaagaccuaguauuugauagcacaauagggugacuauagucaauaauaacuguacauuuuaaaauaaagaguauaauuggauuguuuacaauucaauggaugaaugcucaaggggaaggauaccgcauucuucaugaugugcuuauuucacauuguaugccuaugucaaaacaucucaugcaccccauaaauauauacggccacuauguacccacaaaaaaauaaaaugaaaacaggaauauuuguuuugguaggacuguuaaaaguaguaaauguuacuauauaugaaagcauauaaaaauugcgaaguguuauacaaaugugagcugauggcacugauucuucuuuuccaauucuuauucuuuuauuuuucuugcuuaaauggguuaggacugaguacaguauucacuugaagugggaauagcagguauccuugucuaguuccugauuuuaauggaaaaaacuuuuaauauuuuaccauuaaguaugauguuugcuguaguuuuaaaaaauguuaaugcuuuuuaucagauuaaggaaauuuaagcuucugauacuguuuuuggugauauuuaguaauauagcagaugguggaagaauaggaagaaguugaaagcaaauaugcuuucugacuccaaggaauagcaagauaguaaaaaaaaaaaaaaaaauaagaaaccuuuuucaagaguccuuuggaacacuucuuuaaggaaaucaaauguaugaauauuuuuaacuuauguaauaaauaggcagaucuggacgugguuaugaaagggauuuuuuuuuugcuuuaaaauauauuucagagguucuuuuuguuuuuaauuguacuaauucauuuuaauagguauuaccuguauguuuaaaaucgacuuuguaaaagauugucuugcagucacauaguauuuuuuuaagccugaagcuauugguccuguccuuguuuuuuauucucgauuauuuuuacuuguuuuguuuuacaaguuggaccuuguauaaauuaaagcaggaauugauggcugcagccuggaagccaaguccugcccacugcuuuguacagcucaugauuggcuuuuauauuuuuaaauuauugcaauaguaaaaugaauaauauuuugacauguaaaauuuauaugaaauucaaauuucaguuuuuauuggaacacagucaugcugucuuuagcugcguucauccuacaauagcagaauugaguagcugugacagacuguauguggugcucucaucacuucaggcacuuguaggacuaaucauuucaucauuucacacuguuguacgaccgaugcaguuauaacuuuacagcauuuuuuaagugccauguguauuuuuguacugugacaauuuuauuuuauuuuuauuacccgugcauacccaucauguaaaaaccaggaaagaaaaguggacuuugaauguugcacuuuuaguacauaauggaauguggacuauuuuauuaucaaaaugcaaagcauuguauuuuuuaugcaaugacguuauagcugugcuaaaagaguacaauauguauuugacauuaccauacuaacuacuuaucaucauauucccaacucacagaaagcaauggucauaaaaauuagaaaauuuaaaauggaauauauuauugcagaauugcuccauaaaacuaaaagggaaaauggggcuucagucaaagaaaguuucugaguggcuuguuugugaagaaaggaaagccauuuaccaauuaugaguuaauuaaauuguguuugauugcugcagcagaagaaauguauucagggaaaauacacuuaagacuaguaacguuucagcaagaacaguugccugaagaauugagaaaaauucagaaaaacaaacaugaguagucaauuaaagaacaaggcaaaugauuucaagugaucuuccuuggcuguuguugaguugacagauguuaucaauacugcucaauuguaguuugaguuguccacgcugagcuugaagugacugaagaauuagucucuauaaaaagucuuugcagaacaacuuuaggugagaauauuuucagugaaguuuagaaaacagcaauuuacuacaaccugaaguggaaucugcuaagauguacuguaacuacugcugguaaaaauauguaacagaaaaagacuuaguuguacaaauuguacaaaacuuuugaaacuguaagguguuuacagucuaugguuauucauuguauuauucaacaacagguacuucacagaacauacuugaauuugucauuuuguagggccaaagggaacuucauugcucucauggacuuaaccauugucaguuaugugaauuucaaucaugaauagaagcuaucuugacuugccucacagcaguuugauggcuuagcaauggcaaaguuuuauugucauauuuugagcucaaaaccuagauugaaauacuucaaaugagaaggaccaucuucagucacuguguuugaauacugacuggcuuuggaaauuagcuuuugcuacagccuugauaaugguucuuaauuaauccaaccuaagauugcaaggcaaaacaauguauauaugcaaaaccuauaauguggugaagucauuuagaaaacaacauuguaaugacaaguaauuuuuuuuaaaagugcuauaaaaauggaaacaagaagcaggauugccauucccacacaaauuuguagcagaugcauuauccgaggugaaauuauaguuccaguagaauuuuucagaccucaaggcaagugcaaaggaaauuucuguguuucuaaauccauuucacuguauaauugaagagcuucagucuuugauuggaggugauuaacuuccaauguaauaauacucuaaaaggcaaaugccaagagaagaaucuaauagaauuuuauaaaugccuuucaaacuagugaauaugcucaauuaaaauccuaugccuguggauugauaucaguauuuggcaguaacuaccucugugaaaagacauuaaaaaaucaaauauguaaaaucucauuacagaucagcauuaauggauuaucauuugcaaucaguuuugaugauagagaacacuuagcuuugaaccucaauuaagugaaauguuauccaccccugaaaguauuacauucuuuucccugguagacuuauauuacaaaaaauugaacucaauuauuauauagguugaacaucccaaaucugaaaauucaaaaucugaaaucccccuaaauccaaaauuuuuugaaugccaacaugauacucaaaggaaaugguccuuggagcauuuuggauuuuggauuuuuggauuugagaugcucagcugggguguauucugcagauauuccaaaauuaaaaaaaaaauugaaaucugaaacacuucuagcaccaagcauuucagauaagagauacucaaccuguauuugaauuuagucuauaaaguuuguggaaauuuuguauuucuuuuguauuucuuaggcugggcucaguggcucaugccuguaaucuagcacuuugggaggccaaggcagguggauaaccugaggucaggaguucaagaccauccuggccaacauggagaaacccuguccguacuaaaaauacaaaaauuagcuugguguggugguacacgccuguaauuccagcuugggagacugagguauaagaauugcuugaacucuggaggcagaggcugcagugagccgagaucaugccacugcacuccagccugggugacagagcaauacccugucucaaaaaacaaaaaaauacagacuugauuuugcuuuuuggcccauaaagcccaaaauacuuacuuuuuccuuuacagaauaaguuugcuaacccuuggauuaaaguacagauguuuggcuuggucuuaucuaacaaaaaauuacuauucucuuugaagauguuagcagauuuccucugcuuuuaguaacaaguuagcuaucacauuaaagacugcuuaaucuauuuugaaaaaaguuuuauaguaaaaucaucuuuuuauauguuuguguuuccuugaauuuuuacauaaaugauguacuuugaguuggguauucagguauuuguuaccuagaauuucagugaagaaguaauaauuuuauuuauaaauuuaauuaaguauuaagaacaguuauuuacauuucauuugauaauauucaagccauaaguucugcuuuccuuagggaauaguguuucaaucuguauuaguuaaauauuucuagagaaaaacuagaaacuuaaauaauuuguaaaucaaacauugacauucauaaaagauauccucugaggugauucuuucuguuccaccaugccaaccuauauaagcgggcaaaucuuagaaauguuuaauuuuggaaaguuauuaguauuuuuuuccaugucccuucucagaugcaauaagguagauuuucuagguuuuuuaaaaagucgugcuuaauaucuucaggcuugacuaaguaaaauauguauuuauuuccuuauaaacaaagagaacauuuuuauuaccaguguauaaaaagagauuugauacuaauuuuguaaauuaaugugggugagguguugaaaggaaaaagaaauaguagaaaguaauguuucugaacacauuaaaaaguauuuguauauauuucaauuuagaaaggugcuuuauacuauguaaagucaauuuuucaccucaauggccuauaauauauaauacaggcaaaaauaugaacuauaugugggugaagauggagauaauuuuugucucuacacaucaguuaaauuuugaaaaauccuaaaauaagaaaguuuucuuguguuugcuaccgugugucauuuggcgugauuuuuucuuauaucuaaauaucuuaaucuuugauuuaaaucuugcuuucuagaugaagcauuggaugauuuaaaaucccagaggaaaaaaauaguaaguuaacuuuuauuuaaaauuaauuuauauuaaacuaauaagaacugaauaauuaauguuuauguguuggaaguuaauaacucuccaaggaagaaauaugcuuuuagauagcauuuuaaugaugaagugaaauugugaauauuuuugcuaguuaauaaugauugacaggaaaaaguaguuuagaaggacuuuugagauucugagaaucuguaucaguuggaagcugagaaguaaguaaaugagucauauuggaggccuaaaugaggcagagaggguaaaaauguggguaccagauuguuuauuagagcuaaauaaaaaaggacaaaauaucuccacgugucaguucucagguuuucuugacaccaagaaagagagggaaucaagaagaucgguuguaagagagcaauucaacaugaaaauacugaagaagagaugggagagagagagagauaauuguuuucuucagaguuuuccacuuucuaucaguaacucugaucacauggauaucuauuguggggcuaguugaugcaucccuucagauguguuggaaagaggaccaagaguaagacagaaggcgcucuagauauugauacauaguagucuguaauaagugaauugaaguugguguuugacauagagcuacuaauuuuuuaaugauuauuuuugaagugugaaaaugauaacugcugauaguauuauguuguauagaaauguauuuaauaaaauuuaaucagguacaaaugaucaauucaauauauuuuagucuaguauguaacaaguaauaauuaagaaaccaauauugugaagguuaagacuaauguuaaaaauuauucugugaauugaugauaauagauacugguuuuaagggcuuuaaguaccugaaaaguaagagaacuuuaauuuugaaaggauuccuuagcuuuguuugcuccuuauuggguguccugugagguauuuaucaaaacugcauuggcaauuuuggugguccuaaauugccaaacacagaaauaucuuauuauuauguuucugcuauucugcacauuauggaacagccagaaauucaaagugaggaaauacugauggugucagugauuuagaaguugugauaugauugguuugacuugcugaugagauaaaaagaagagcugguacuggugaucagagacaaguccugcuuauaccaaaauggagaaauauuaguuaaaguagaaaagaugaagaggaagacaaaggaaagcagaaaagaaaaaaguccuaagugaugagaagcagcccaaugucacuggcaucauauggccagaaaacaggaucuugaagaacauaugauuugggaaaaucucucaauagaguaacagagcugacuuggaaaauugugugaaaggauaagucaagcuauuuacuacuuuuuaaauagccuuuaaaggaaucgcaacauaaaagauguuucauuuuaagucugacaacaguugaaaaaguugaguucaauagcucugcaaguuuaaaugguucauuaggcaucaauauuaauaauucaauauggcauuucucuugcaguuugacuaaagaaaaauguuggcucuaauucacuuuauuaauuaaacacaauuugcauuuacuugauuauuguugguuauaauacuguuugcuacucgaacuaguuugugaucuugacuguucaagccuuuaacagagcugcuuuguuugaguaguuuuacacuuugguuuuuuuuuuuucuuuuuuugagauggaauuuugcucuuguugcccaggcaggagugcaguggugcaaucucgggucacugcgaccucugccucccagguucaagugauucuccugccucagccucccaaguagcugguauuacaggcaugcaccaccacaccuggcuaauuuuguauuuuuaguagaggcggggcuucacuauguuggccaugcuggucacuacuugauauuuuauuaaaagugguuuccuuggggaugcaucccuuuaaucugaauagauuuguaauguaauuugaaauuuguaaaauuguaauuuguaaugacagauaugaauuaucaauugauuaaaaaguaaauuaggaaagagcaucuuaacaauauuuuaagagcuuaauguaaguauuauuauuauaaaguuaggaaguaaucuuuaguuaucuaaaaaauucccaagucuagaucugugugcauuuuaccauucacguauuuuguggcccuuuaacaaaacuugaguuuuuaauaaucacugaguaaucugugcaagcagauaaucccucugcauccaugagcauuccuucaaaacaguucaaaaaucaagcucuaucaaaauacaugagucaagauuaccucuuuaaauggcuucaugaaaauuuugugcuuuuucagaauauuaguccuaugugguaauuuccagcauuccuugggaaaucuguguuuuucugaaucuugagaaaaaucacuugagaaauugggaacaugaggaaaaguguuauaguucccugagaauuaaagcuuaacaaucaacuacagauguuacuaguucaaaggaauucacuaaugucagcugaaggcaagagcaagaaauucugacaugcugaguuacagguuaauguugacguuucugggaacaguacagaaucauagagaagugguacaaucuaaucaguuuugugggcauuuauggcacucucuuauuaauggugagucauucuugcaaauaaaaauguuuauauaccuacuauaauuuauauaaauguauaaaguauauuuuguacaaauccugugcgugauauuccaugaaauaaguuuuggaagcaaaagaagucuuuaaauuggcaauuuuagcuuuuauucucuauagaguucuuaaccuuauagcggcuuaaaauguuacauuuuuguauuacccaguaauguuuucuggcuuuucccaguguuugaauauucaccuuaggcuacacaauaacagaagaaaugcaaagaagaaagaugugacuauuauuguggaauacucuuauaugaaagaaaaugauauaacaucugaauuaguaaaagcaucaucaauuucaacagcaaaccucaaaucagggauaccagacaguauuuucagcaugauaaaaggaugaguuuauaugguauaacaugcucccuaauacucugaauugcaaaguuaaugcaaaaugaaagaaaugaaagaaaguuuucuuacaucuggaauauuuuucaugaguaaauauugguuagggaaauuaaugcuuugugcguuuuaaaauucuguuucaagaaugauaauuuuaguauuaaauauuuguagaauugucuuucaaaacuuaaaaaguuuuuuucacauuuauuuugugcuagugugcccuuuuaauguuuucuaugauguaauggcuguauccaguagaaauaauuuuuacauguuauagaaauauaacucaucacaauguugacucuuaauagaaucauguauuuauuauucuaucuuuuaaaauaaaaaagccccuaaaaccuuuaguacaaccguauuacagaaaaaugauucauucuuuaacacuaacgauagcugaugagcucaaaaauaaaaaauugcaaaaaaauguuauaauguuuuaaaguuuacgaauuuguuuugggcugcauucaaagcuaucuugggccacauguggcugguggcuaaggguuggacaagcuugaaugagagaauucucaagaauucuaguuucuuguuccugaaucuugagguuaauauguugaguuuuuggaaauaguuuguuucaggcccauucugaguaauugagaugucucugaaaauuauguuaauauuuuaggcacuguuguggacucuuucuccuacauuauauuuuuuuaaauugcacaguagugcuaugaagaaaguauuaaaauaucuaugcagaggagaaacugaggcugacaaagugcuaacaaucuucuaagaauagaaaugugcguugaacccagaucuuuucucacuuugaaguuucaaauucauguucuuugcacugaacaguguauuuaaaacauauuauuacuuaaauguuguauggauguguguuaauuaagcuauuauaugaaaauauuuuguuagaaguaaaugcaaaaaaugggaaauagauuuguaucuuuuaguacuuaaaaacugauuuuauuuaagauaaauaaaaacauagauacacuugaauacuugcugaauaaucuaccaggaaugcaaucauucgauaaaguagcauuuugguuuggaguuuuguguguuguuuuaaagaucacaguuuaaucuuuuuaaaccuaguaguaguuuuagucuagaguuaucuguccaaaucaguaugacuguuuacauuuacauuauuuaaaaugaaauaaaacuacagcugggcgcaguggcucacaccuguaaucccagcacuuugggaggcugagguauguggaucacuugaggccaagaguucgagaccagccuggccaacauggcgaaaccucgucucuacuaaaaauacaaaaacuagccgggugugguggcgcgcaucuguaauccuagcuacuugggagccugaggcagagaaucgcuugaaccugggagguggaggcugcagugagccgaaaccacucacuccagccugggugacagagugagacuccaucuaaaacaaaacaaaaugaaacaaaacaaaaguacaaauucaguuccccaguugcacaagcaacauuuuaagugcucauuuaucacauagggcuuaguggcuacuauuacgcugacauagaccauuuucaucauuacauaaaguuuuacugcacaacacugcuaaaaaaucaaaagucuaauguguagagaucagggauuugcuucuuugauauuccauguagauuauguugauuuggggauguauuuuauuaugcccucuuucuaccucuguuccuaguuuuuuuuuuucuaacucuaaagugauacuauaaacaucuccuuuacaucagaaaagucaacuuguuuauuuugagaauuuauaauaauuuugaaauaggaaaauauuuuaguuucauuaaaccaaggcaaggcuaauaaaucauucaucuaaguaccuaccucuuaaaugucgaauugaguguuuaaugaggaaucuguuaacugcuauuguggcagcauauuuuuaacucaguaaaugugcuuuggguugcauuuuaaaauaaauguccuuuggaaugaauaugacauuuaaugaaucuuagugguuaucaguggucacugagaaagaaaagguucuuuuccaauuuuugcaaaagcacuuuauccuacauauuagguaauuugucauuacuaugacugucuuguacuaaaguucaacuuuuucugauguugaacuagccguaacugcuagugauacuuuacuagugauuauauuuuaaguuaaacccauguauuaaguuauaaagugacuugagugcaugguaaauaaaacguuacaauaaugaagugauuuaauuauagucccuagugugaacauagaacucaguaaaauuuuugcuuaaauucugugcucaguuuuuuccucuaaaguuguuugagucuaaguaaaaaagaggugaggguuaucuuuuaaagucauuugagcaaauuccauggcuguucucccaguuagugaguuuucacugcauuugcagcaagcuaauugcuucugcuaauaaauaaucuaaaaucgaugcugacagcaguuaauuggcacagagauuuuauuuuguaaagcucuuggcuaacgaccuucuuuaaauuaauagcauuaagugcuaugaggaaauaaaucugaggaauugccugucauuugcuugucaugucuaauaacuuccaauaaugauggcugauagauuuuugcacauuccauuauugaaguuggugcauguaauuauucuccucauuauauguaaacaauuagcaauauuugguauuuccuugcaguaaaacuguuaaguacaaguaacauauuagagguuagaagccauuuuaaaaucuggauuuuaauuauucgaauguaggaagucuuucauucuauuuggauauauuaaggauauuuaaaccuuuuugaauaggacuuauacaaauaaguaguguguguuuugaagugugacaauuuauggaaauuuuuguucguagcuugaagaagucauggaaaaagaaacuuacaagacggcuaaauuaauucuugaaagguuugauccggacucaaagaaagcaaagguaagacugugauaucacuacuauuuuauuauaaauuacacauuguaauaggucacuguaauaacauuauuauaauugacaggagugugagccgccaucugcuggagcagcuguaacugcaagaccuggacaagguaaauaacuuaguagaaacugcugcugcuguuggaaagauccauaauuacccaagugaguucaaaaguguguuggaggugugcaaaaacuuauguagaaugcuucuguguaaauuuauauuugguaauuugggauaugacuuaggguggauggcaauaauuuuauuucauuuugauuuuaugggaauauguuaaguuaggaugucaaauauguauugagauuaaauauaucauugguuuuaaucuuuuaaaauuuaaauaauuucaucaauauuuuguaaauauuucccacuuucaaauaauagucucuuggaauaucuguuauuaugaaaauccuuacauuuuuauguuuuauuuuugaaaaauguuaugauuucugugaaauuuuguuuuuucuaaaauaacacuuuagaauaaaauaauuuagaaauaagaaaaaugaaaauugaauuaucgcuguguaauguuaacuauuuuugagcuuguauuaccauauuauuaaugaagucauuacuauuacaucauuaaauguuauauaaaauuuuaaccgucauuauauuaagugguuacauaaaauauuccccagacuggcaugggaaaagauauucugaguuugcaaugacuuuugucuuuguucuuuucuuuuuuuuuaauuaauuaauuuauuuauuauauuuuaaguuuuaggguacauguacacaaugugcaaguuaguuacauauguauauaugugccauguuggugcacugcacccacuaacuugucaucuagcauuagguauaucucccaaugcuaucccucccccgccaccaccccacaacaguccccagagugugauguuccucuuccuguauccauguguucucauuguucaauucccaucuaugagugagaauaugcaguguuugguuuuuuguucuugugauaguuuacugagaaugaugauuuccaauuucauccaugucccuacaaaggacaugaacucaucauuuuuuauggcugcauaguauuccaugguguauaugugccacauuuucuuaauccagucaaucauuguugggcauuuggguugguuccaagucuuugcuauugugaauaaugccgcaauaaacauacaucugcaugugucuuuauagcagcaugauuuauaguccuuuggguauauacccaguaaugggauggcugggucaaaugguauuucuaguucuagaucccugaggaaucgccacacugacuuccacaaggguugaacuaguuuacagucccaccaacaguguaaaaguguuccuauuucuccacauccucuccagcaccuguuguuuccugacuuuuuaaugauugccauucuaacuggugugagaugguaucucauugugguuuugauuugcauuucucugauggccagugaugaugagcauuuuuucauguguuuuuuggcugcauaaaugucuucuuuugagaagugucuguucauguccuucgcccacuuuuugaugggguuguuuguuuuuuucuuguaaauuuguuugaguucauuguagauucuggauauuagcccuuugucagauggguagauugcaaaaauuuucucccauucuguagauugcguguucagucugaugguaguuucuucugcugugcagaagcucuuuaguuuaauuagaucccauuugucuauuguggcuuuuguugccauugcuuuuaguguuuuagacaugaaguccuugcccaugccuguguccugaaugguauugccuagguuuucuucuagguuuuuuaugguuuuaggucuaacauuuaagucuuuaauacaucuugaauuaauuuuuguauaagguguaaggaagggaugcaguuucagcuuucugcauauggcuagccaguuuucccagcaccauuuauuaaacagggaaucuuuuccccauuucuuguuuuugucagguuugucaaagaucagaugguuguagaugugugguguuauuucugaggccucuguucuguuccauuggucuauauaucuguugugguacgaguaccaugcuguuuugguuacuguagccuuguaguauaguuugaagucaggaagugugaugccuccagcuuuguucuuuuugcuuaggauugucuuggcaaugcaggcucuuuuuugguuccauaugaacuuuaaaauaguuuuuuccaauucugcgaagaaagucacugguagcuugauggggauggcauugaaucuauaaauuaccuuaggcaguauguccauuuucacgauauugauucuuccuauccaugagcauggaauguucuucuauuuguuuguguccucuuuuauuucguugaguagugguuuguaguucuccuugaagaggucauucacaucucuuguaaguuggauuccuagguauuuuauucucuuugaagcaauugugaaugggaguucacucaugauuugguucucuguuugucuguuaaugguguauaagaaugcuugugauuuuugcacauugauuuuguauccugagacuuugcugaaauugcuuaucagcuuagggagauuuugggcugagaugaugggguuuucuaaauacacaagcaugucaucugcaaaaagggacaauuugacuuccucuuuuccuaauugaauacccuuuauuucuuuuuccugccugauugccuuggccagaacuuccaacccuauguugaauaggaguggugagagagggcaucccugccuugugccaguuuucaaagggaaugcuuccaguuuuugcccauucaauaugauauuugcuguagguuugucauaaauagcucuuauuauuuugagacacgucccaucaauaccuaguuuauugagaguuuuuagcaugaagggcuguugaauuuugucgaaggccuuuucugcaucuauugagauaaucaugugguuuuugucuuugguucuguuugugugauggauuacauuuauugauuugcauauguugaaccagccuugcaucccagggaugaagccaacuugaucaucaugcauaagcuuuuugaugugcugcuggauucaguucaccaguauuuuauucaggauuuucgcaucgauguucaucagggauauuggucuaaacuucuuuuuguugugucucugccaggcuuugguaucaggcugaugcuggccucauaaaaugaguuagggaggauucccuccuuuuguauuguuuggaauaguuucagaaggaauggugccagcuucucuuuguaccucugguagaauucagcugugaauucauuugguccuguaauuuuuuugguugguaggcuauuauugccucaauuucagagccuguuauuagucuauucagggauucaguuucuuccugguuuagucuugggaggguguauguguccaggaauuuauccauuucuucuagauuuucuaguuuauuugcauagaggugucuauaguauucucuuaugguaguuuguauuucugugggaucaguggugauauccccuuuaucauuuuuuauugugucuauuugauucuucucucuuuucuucuuuacuagucuugcuaguggucuaucuauuuugcuggucuuuucaaaaaccagcuccuggagucauugauuuuuugaaggguuuuuuugugucucuaucuccuucaguucugcucugaucuuaguuauuucuagccuucugcuagcuuuugaauguguuugcucuugcuucucuaguucuuuuaauuguguuguuagcgugucgauuuuagaucuucccugcuuucucuugugggcauuuagugcuauaaauuucccucuacacgcugcuuuaaaugugucccagagauucugauauguugugucuuuguucuuauugauuucaaagaacaucuuuauuucugccuucauuuuguuauuuaccuaguagucauucaggagcagguuguucaguuuccauguaguugugugguuuugagugagauucuuaauccugaguucuaauuugauugcacccuggucugagagacaguuuguugugauuucuguucuuuuacauuugcugaggagugcuuuauuuccaacuaugugaucaauuuuggaguaagugcgaugugaugcugagaagaauguauauucuguugauuugggguggagaguucuguagaucccuauuaaggcagcuuggugcagagcugaguucaagucguggauauccuuguuaaccuucugucucguugaucugucuaauauugacagugggguguuaaagucucccauuauugugugggaguguaagucucuuuguagguugcuaaggacuuaccuuaugaaucugggugcuccuguguugggugcauauauauuuaggauaguuagcucuucuuguugaauugacuccuuuaccauuauguaauggccuucuuugucucuuuugaucuuuguugguuuaaagucuguuuucucacagacuagaauuguaaccccugcuuuuuuuuuuguuuuccauuugcuugguagaucuuccuccaucccuuuauuuugagccuauaugugucucugcacaugagauggguuuccugaauacagcacacugaugggucuugacucuauccaguuugccagucugugucuuuuaauuggggcauuuagcccauuuacauuuaagguuaauauuguuauaugugaauuugauccugucguuaugauguuagcugguuauuuugcuuguuaguugacgcaguuucuuccaaacaucaauagucuuuacaauuuggcauguuuuugcaguggcugguaccguuaguuccuuuccauguuuagugcuuccuucaggagcucuuguaaggcaggccugguggugacaaagucucucagcauuugcuugucuguaaaggauauuauuucuccuucacuuaugaagcuuaguuuggcuggauaugaaauucuggguugaaaauucuuuuaagaauguugaauauugacccccgcucucuucugucucguaguuucugcugagagaucugcuguuagucuguugggcuucccuuuguggguaacucgacuuuucucucuggcugcacuuaacauuuuuuccugcauuucaaccuuggugaaucugacaauuacgugucuugggguugcucuugucaaggaguaucuuugugguauucucuguauuuccuggauuugaauguucaccuaccuugcuagguugggaaaguucuccuggauaauauccugaagaguguuuuccagcuugguuccauccuccccaucacuuucagguacaccaaugaaacguagauuuggucuuuucacauagucccauauuucuuggaugcuuuguucauuucuuuuuacucuuuucucucuaaacuucuugcuucauuucauucauuugaucuucaaucacugauacccuuucuucuguuugaugaaaucggcuacugaagcuugugcaugcaucacguaguucucgugcuaugguuuucagcuccaucaggucauuuaaggucuucucuaugcuguuuauucuaguuagccauuugucuaaucuuuuuucaagguuuauagcuuccuugcgauggguucgaacauccuccuuuagcuuggagaaguuuguuauuacugaccuucugaagccuucuucucucaacuugucaaaguuguucuccauccagcuuuguuccuuuucuggcaaggagcugcaauccuucggaagagaagaggugcucugguuuuuagaauuuucagcuuuucugcucugguuucuccccaucuuugugguuuuaucuaccuuugguauuugaugauggugaccuauagaugggguuuugguguagauguccuuuuuguugauguugauacuauuccuuucuguuuguuaguuuuccuucuaacagucaggacccucagcugcaggucgguugcaguuugcuggagguccacuccagacccuguuugccuggguaucaccagaggaggcugcagagcagcaaauauugcugccugauccuuccuguggacgcuucgucccagaggggcacccggcuguauaaggugucggucgaccccuacuggcaggugucucccaguuaggcuacacaguggucagggacccacuugaggaggcagucugucuguucucagagcucaaacuccaugcugggagaaccagugcucucuucagagcugucagacagggacauuuuaagucugcagaaguuucugcugccuuuuguucagcuaugcccugcccccagagguggagucuacagaggcaggcaggccugguugagcugagguggacuccacccaguucgagcuuccuggccccuuugcuuaccuacucaagccucagcaauggcagacgccccucccccaccccaggcugcugccuugcaguuggaucucggacugcugugccagcagugagcaaggcuccgugggcauaggaucugccaaaccagacacgggauauaauccccuggugugugguuugcucagacuguuggaaaagcacaguauuagggcgggaguguaccgauuuuccagguagugucugugacggcuucccuuggcuuggaaagggaaaucuccugacuccuugcacuucccaggugaggcaaugccccgcccugcuucagcucaucgucugugggcugcacccacuggccaaccagucccagugagaugaaccagguaccucaguuggaaauccagaaaucaccugucuucuguguugaucgugcugggagcugcagacuagagcuguuccuauucgggcaucuuggaaugaucugcaauaguauccauguggaauaauuaaugauggaggagagaguagggagaauugauuuggaacuguccaugaguaggcaagaggggaugugaucuaguauacaaguggagaagucggcuuuugacaagugugugauagcucaucuuuagcaaugaggaaagucugagaacaugggaagacauagguagguggcuggguucuuuuuuugagauguuuucuuuuuuugagaugaagucucacuguaucacccaggcuggagugcaguggcgugaucucggcuugcugcaaccucugccuccaagguucaagugauucuccugccucagccuccugaguagcugggauuacaggugcccgccaugacacccggcuaauuuuuguaguuuuaguagauacgggguuucaccaugucagccaggcuggucucaaacucuugaccucaagugaucugcccaccucagccucccaaaguuuugggauuauaggugugagcuacugcgcccagccaauuuucugauuguaucucuauuuucuuagugaggaugagguugggggagauaauguuggaggcuugaagaaaagguauggaauaaugccaggggacucuaaaggcuacuuaaaaugaauagucauaaauuuaaugcaggauucugugugcuuuuccaguuacagucacccguguaggugccagcauggaguaggcaaaugguugguuuuaagcaggguugggguuuugccucauguguuagauaauuugauaagggggccaggagcugaaguuguuuguaggcgagccauuaucacaauggauuauggaauuuaagacgauuaugagggaaauaaagacaugagugguagugauggacagucaaaagguguugguaguauuaauacaggaauccacaaacugcaaccugcaaauguaggccaagaccuguguuuuaugguucuucagcuuagaauguuuucacauuuucaaagcauuuuaaaaaauaaagaguaagaauaugcaacaggagcuuauguggucugcaaagccuaaaauguuuauuauguggcucuuuccaaaaauguucacugaccuauuaauaauuaauggguuauagaucuugcaguuggaggagguaagcugagagguuagugguuggagaacaggaugcuuaaaccugagaagugaucaguuauuucugguugcaaaguuauaggaauagguuaucaccauaggaguaaaugauugaaauagggagaaugaucagauuuuuggaggaugcccuaaaaaugaaaucuuuuuuuuuuuuuuuuuugaauacauggucucacugucacccaggcuggagugcaguggugucaucauggcuuacugcgaccucaacauccugggcuccagccauccucccaccucagccuccugaguagcugggacuacgaguauguaccaccgugcccagcuaauuuuuuaacuuuuuguagagaugggguuucacuauguugcccaggcuggucuugaacuccugggcucaagcgauccaucagccucggccucccaaagugcuagaauuacaggccuuaaucaccacgcccagccuaaaaaauccuuaacugacccuccuauuguuuucuaggaggacaccaccuauacauuuucuuuugccuuuuguacucagcccugcaccuuuacuaaugaaauguaacaaaagaaaagucaauuguaucuugccacagcuaaauucaaaaucaguuauuuuugcagagacauuuaaugguuuuagcaaauagaguacaacuucuuauuucaguagguuuuagaguuuacucacuuguguuccauagcauguauugaaaauuaaaguagaaauuauagaucuuuuuuugaucuuuauaccaaauggagcaauacuuuauauuuugcuguuuuuugggcauguguuugauucagagaacgugaaaaaugccuuauaaaauaauaaauucaccuuaauaaauuugccuuguaagaaauuuggauguucuuuacauaaguaucaaauucauacuguuacaauuguuuaguauauaacaaaccauccugaaauuuagugauuuaacacagcauucuuuuuuugcucaugaaauuugcuuggcuaggguuugguggagacagcuuaucugugucucacaucaguuagagcuacuuuacugagcuagaggaucuacuaucaaggugguuuacacagcuggcaaguuggugcuggcuguuguuuccucuccacauggacuucucucgggucaguugagcuuacucuucccugguggcagguuccaagaccagggagcauaggagacaaaaaguccuggauucuggcacaacuuuguucucuuugucagaguacaauuucaaggggaggguacacagacacccucugcucccguuuguugaaaggagaaucaaaggauuuuggagucuuauuuuaaaacugccacauguacuuuaauauagauaacaaaggcauuucuaucccaauccaguuuucauuguuuaucucaaaugccaucaucacuguaaacccuuucuucagcccaucuagaugacuaaguugucaguccucaccucuugugaaguccucacuucacucuauaguacuuuguuggcucccauuauauggcauuuagcuuguauuagaauauuuagugaguuuguuuuucuuaucuuaaaguuagcuugcuaccucuauaugcaacucugaauccccuucaaugugcuuaugcuggugcuuuacucuuagugguugcuuaauaaaugaguugaagaaaauaaaaguaaacauuuauuuuggcauugcuguauuuuguuuaaauguuauaaaauaguaauuuaccaaauaggaccuuggugaacugcaggguucauguuguuuaauguugagauugcuagaaguuaggccagaucaaaaauaaauuauuaaggugauaaaggaaaguaaauguuaagacaaagaacuauaaagcaaaauguauuuuuaauuugaaaagcagaacaaaagaacaaacucaacuaaaggcuggcaagugauauauauuauuauuaauagaaaacuuucugcuuaaagauagcuuuucuguauggacuucugaaguuaagcugagauucuaaaugcagcaggcugauuagcaaucuuaauucuaucugcaaucuuuaucugccuugcauguaacauauuuacagaauggacaagaagauggggacguuuuugagaggccauuuuccuguuuaucacucuaaauaaguuggguagcaggcaguuggaaauuuaacauugaaaugcaagaggaaaauagauugauuucauagguguuuauuaagcucauacucuguaccaguuaccuuucccacaucaugugucuacagagauguaguuccugcuuauuagcuuuugauuaaaagggguauacacauguaauaaacgguaugguaaggaccaaaaugaagauaggcacaaauuacaaugcauuauaacuuuuaauaauaauuugcugugagaauaggauugaaaaaguacucuucagguaaaggauuuacuccgugugcaagcacuggaagagagaaacaacuuggcaccucgaggcacuacaaauauugccauaucccugaaaaaggaaaguaggggucauaugaaggagggaucaaauuaugaagggcuuuuucugcaucauuauguaguauaguucuggaguucaggacuuuaucuuauacacaacauauaaagucaauggaggcuuugaauuuuacaucaaguuagcauuuuaugaagaauacuuuuuuuuuuuuuuuuuuaguaacauggagguuauguuggauuggagagaauaugacugagccauagagaacaauuaggaauaucaucuaauauaguuaaaagauaaaggccuguacuagauaagguuacagcaauagcguuggggaaaaagaagagauuugagagauaauucaggaguagauugauacaggcaauuagauuuggaaagcggggcagggguugggggugggaggaagaaucaagaugugaccuacguuuuuguuuggacaacugcuuagguguuaguauguuaagccagauaaagaacauaauuggaauacugguuucuguagaagauaaugaauuuacuuuugguucuguugaaugggaguuauagcaagaugcugagguucauagguaguugauuauuucauauggagcucaggagaaagguugagguuauagauauacagauuagaaauaauugggaggcauaggugauuauuauuggaauaugagauugagugaaauugcccagagagagaaaauagaguaagagcaccuaagacagaacuacagggaacauugacauuuaagaguagaugaagaaagaagagcccaggaaaaagaaugaaugaucagagucaaaaguagagcuagauugguaguaaguagaagacugaaaugaggccuuugaauuugacagguugcauaacacagagaauaugggcauuuuugucauaaaaaccagaauuugaauccuggcuccaucucuuauuuuacugugagaauuuuagcaaguuacuuggccacugaacuuugguuucuucuuuugaaaacuggggauaggaguuaccccaaaggauugauauaaauaguagaugaaauuaguaaauucauauauagugccuagcaugguuccuagcagaaaauagggauuugauaaagaguagcuauguuaaugcaacauuaguagugguauuauaauguuguuggugaccaaagcagugauacuuucagugguggguaauacugugguagcuaaaaaggagcacaaaaaccagauugaguuggguuaagaagugaaaugcagagaaguuuuuuuuuuuguuuuucaaaaagcuuugccucuauaggaaggaagagguuauaaagucauuuuuuagcaauaaaaagacauugaccuauugagaguacaauuugaauagcgaaauaggguagaaggugaauuuggagcagcuuaguaugaguggaugugaacagaagauacagugaccauggacuucagaaaguuuugaaaguagaaggaagagaugucuuuauuauuuugauuauuuaaaggaauuacauucaaauaaguuaaaaaauacagaacugaaaacaauagaaauuuaccugaaaauauaucccugugcccuaacuauaguacuauaguauaaaauuauacuauaguauaauuuuuuucacaauuacaaaaagcaaaauucacccuaagaguuuccacauuugcauaugugaauaggcuuaaagauucccccacccccauuacuaaaauccaauuucugaaauuuucucuuaugagucuuagaacuggacaugggaguucagaaagccuuugaccagugcuagggaaaauaugaauauugccuuuguaguuuugccaacacucauauuaaggaaauuuggaaccuagugggguuuuaguucacguaaggagcaagaaaaaacaaucccaucaaaaagugggcuaagaacaugaauagacaauucucaaaagaaaauauacaaaugggcaacaaacaugaaaaaaugcucaacaucacuaaugaucagggaaaugcaaaucaaaaccaaaaugcaauaccaccuuacuccugcaagaauggccauaauaaaaaaauuaaaaaaauagaagauguugguguggguguggugaacagggaacacuucuacacugcuggugggaauguaaacuaguacaaccacuguggaaaacaguauggagauuuccuuaaaaaauaaaaguagaacuaccauuugauccagcaaucccacuaugggguuucuacccagaggaaaauaagucauuauacgaaaaagauacuugcacauacauguuuauagcagcacaauucgcaaucacaaaaauguggaaccaacccaaaugucauuaaccaaugaguggauaaagaaacugagauauauauauauauauauauauauaugaaugauggaauacuacucagccauaaaaaggaaugaauuaacagcauucacagugaccuggaugagauuggagacuauuacucuaagugaaguaacucaggaauggaaaaccaaacaucguauguucucacucauaaguggcagcuaagcugugagggugcaaaggcauaagaaugacacaauggacuuuggggacucaggggaaagggcgggaaggggaugggaauaaaagacuacaaauaggugcaguguauacuguuugggugaugggugcaccaagaucuuaaaaucaccacuaaagaacuuacucauguaaccgaacaccaccuguuccucaguaaccuauggaaauaauaaaggaacugguacuauuaacuagaugaaaauccaggccuccuaauuauuguaugguguucuuccuaccacagcuugauaauagaacaaagacaaaaccuucuagcagcauaaaaagaguauuuaaaaaaucugauaaauuaagggacgaguauuuguauuauaaaacauucaucccaauauuauuuaauggcaagcuagaauuauacauuuaaguuuuuauauaaguugugaauuuauacauguaaaugacuucacaaauaacuaagggaacauuuaauguguaaauuaguaucuauauauuuuaaauaauugccuuagaaauucuagauugcuuaguuuuugauuuauaauaaucguuggaaccuuuagauaugcacuauuucugcuaauaguuauugccuguuaaguacuucgcaugugcuuuggcugaguucuuugucuugauuuugucauuuaaucuuuacaacaagcauaagagguaaguauucgcauuaugagaaagcugaacugagugaugucaucaacuuggaaaagguagcauacacaucuaguaaacaggguggagcuaaaauuaugaccauuuggucccagagucuuugcuuugcacagcuaugcuguuuuaucauuaauuuaagcuucuguuuaauauaguaguuuuaaaaauauaucauuuggauucuauuugcuucauuuuuaauugauauauaauuguacauauuuuugggguuacauacuugcauacaauuuaugaugauuaaaucaagguaauugggauaucugucaccucaaacauuuaucuuuuauuuauguugagaacauuccaauucuucucuucuagcuauuuugaaugacacauuauuguuaauuguagucacccuacuguacugucaaacacuagcucuuauuccuccuauguauguuuuuguacccacuaaccaaccuuuauucauaacccuuaauaaguaaccucuuugaaaagaacuuggugaugggucuguuugcuucauuuugaauuuaaaccuaauauaggcaugucaucauccucagugaguaugauuuuuguugggucauugaucauugaugaggguguuaaaacauacuacgguugagaauuaaccuuauggcaugcuccuuaugauuuuuugccagauucauguggaaugcuugguggcucuuuugggggcuuuguaucuuacguuuaaggcaggaaauguugaacauaucuaauaugacuauuuuguugaguacuggaaacuuuuuagaguaauuaauacaaaacuuuaugaaucacaaguaguuaaaaguagauaaaucugagguauuuuaaauugagacuaccagaacauuuuauaauaguuugacaaauacagauuugguaccuuguuauuuugaacuauugaagauauuguaacccuugauacuugcuuuuccuuugaaaaugaugaaacuacauuuucucccuuuuguaacucugcuauaacauuuucccccuuuuccuaaauuuagauuuagaauuauuaagguacaucucuuuuauggaaugcuugacaugguguccuuuguuagcuagucuccuuucagugguguacuagugauaguaaaagcauuucagguaauuuucacuggguaaaugcacauuuagaggaaguagucucaagucuucgugaagaggaaggauaauagcugcuuuuauauagucuaauaaaugcuaaacuuucauuuaucuggaagaaaaaugccacuuuuugaguuaugcuuuaccugaaaguuggcugaaaaaugauuuacaguauuugaugccuuauuuuuaaaugaguaguuuaaauuaucaaauccuaauaugauuuuauugauuucaguaccuuuugcagcauuuaauggcuuuccuaauaugcaaccaccuauuaaggugcuccuugugaguaaaaaauaaaguuagcagcuaauuugcagacguuaggauaugauuuguucagguaacagcugaaauuuucuauauaaauugcauggaaaguagcaaaauauaaagaugguuccauuuauauaaugauacugugcuuauaauuuauuauugccauggcuugguuaaagacuaaauugugaaccaauggaaaauuaguugaucccaguaauuuuagcuaaaaucauuugaaaauacuuaguuguguacaaaaacugucaucugaaauaaguauucauuaaaugugagcuaucaguuugcagacauuaucauauuuaauucucauaacaauuaguuaauauuauccuaauuuuacagauaaaauaacagguuuaucaaaguuaaguaaccuaucugaagucauguagccagagccaggauuccaaccaaaucuuucuaacugcagggcccugguucuuagcuaguagacuagauugggaugaacuaagaucugaugcuagagcuguacuuucaauugcaaugaacuuucauguaauucuuuaacugucaaauaaaguccaaguguuuugcuucuggacauauguauuuuuacuauuuaugccaauuaaaaauuacuuacuuaguuucagcucacuaauucaggauuugugauaauuuaaugugauagguagaauugaaaaaguauaaaggcuucuuuaugugaaaucuuaccacugacauucaaguaaaauauuggugggaauagagaauaauagaauucaauuuuauguuacugaguacaagucaugaaacuuuuuuuguaaagagccagauaguaaauauaguuaaauggcccugagagccauauggucucuguugcaacuacucuacucuucuaaagcagccauagacaaucuguaaacaaaagaacuggccuguguucuaauaaaacuacaaaagcaggcggcagccugaauuuggcaugcuugcugaccccuguuacagagaaucuuguaauuucuguaacuauaagcuaagauguauuaaugaugaaauguuguuuauauggaguagaucuguugaauguuuuggccaaaacaaauuugccaaaaggauagcaauaccauaaaggagaauggaaaugguaccuaauaguaaaaauacuuuuucagcauuucuaugacuacuuagauuaauuacuuugauaauuccagaauauacuuauucacuuaucgcuuaguuuuuaguuuuuuaaaucuugaaaaacaaaucugcaauuuggaguuuugacuaauucugauaaacuuucuuuccuuuauuaugaugaggaagauuacuuuaaaaagacauggcacauaauugggugauuucauuuuacuggauuuguuuugaaaagugguaucaguagcuacacuuagaucauggcuuguuguguaaacauguacaguugaacuguaaguucagaaauagaguacuuuguuuucaaugucacauauuauagauuuauuauuauaaguaauuuugacacuacaaugccuuuuggggcguaaaauuuuaauaaauauaaauuguuugugauacuggcuaauaugguauauuggaaauuaagucuaguauguacuuacucuucucagagauucgucagcgaacugcagcucaaagaaaccuuucuccaacaccagcaagcccuaaccagggcccuccuccacaaguuccaguaucuccuggaccaccaaaggacaguucugccccugguggacccccagaaaggacuguuacuccagcccuaucaucaaauguguuaccaagacaucuuggauccccugcuacuucagugccuggaauggguaaacagagcacuuaauguuauuuacaguuuauauuguuuucucugguuaccaauaaaacgggccauuuucaggugguauggaaauggcauuucauuuggaaauagcagagcaguuaucugauuaagcaggaguuccauauucaauuagccauaacucuuuacagcuggcaccuugugauacugaaaccuauuucuugagcucauuuaacuguuauggcuucuuuguuuaaauagcaauaaaacuuuguauuauucuguagccaacaguacagcauaucuuuuuauauucaacuuuagaaugccuccagauuuauauaaaacagggauagaagaaaacacuuuuggaauguauugauguuuuuugcucaacuccauacauauauuuuuaaacaugacaacauauuucaggaauaauacuccuguauuguauacuuuuguuaaugugggcuaguagauuuuuuuuuuuuaaggcauagaaccuuaguauuuucugauagauauuuuauaaagcucuauuaaaugaacauauucucuuuauuucauagauuaucucuuuucacugugguggaucucuaggggaagaucccauucugaaguguaauagacuauaguacccuccaguuucuuuuggagugugacuggggcauggaaguccacugcuuuagcacagaucacauuguuuuauguagauuuccaugucauauuguugcauauguuaguaaauuauuuauuuuguuuuagauuauucuaauguagauuacuuuguuauuucaugacuaauuacuaauauauaauuaauaaugauuuugaggcuaggcaguagcugauaucagguaaucagaguauuuguguaguaaaaucaauaaaaaauggaaaugucacuuaguacaguagauguuuuuccuguuuuccuucaaaaaugcagcauaagauuuuagaagacuaaaaaaacucuucauuuauuaacaaauuaagaauacugacuauaaaugaaauguauacaaaucuuaaaacuuuuaaaauaguuacauaaaacaauacuuuuaaauuugacauauaaugacaauacuuaaggcagccauauauuuuaugaaauugagaaaaguuaaauugauugaaaauuacuaauguuucuguuguuaucugguugauuugagauacccaugauuuguaaauuaaaauuccugguuguuuaaugaaagaacuuuuuugggugcgaauguauggauuauauacauuuguauaucuaacuuauuuuaagcaaaaaguuuagcaacauauaaaguaauaaaaauuguauugcacauguaagaauagggcuauagaaggaauaauagccuagauuuuaugaucauguaaauauaacauguuuuacugaaguuuuuaauuaguuucugugugaaagacuguguuuaaauuguacauugucaaaaaugugaaugaguuaaauaauuuauuauaaagaagauuaauacuuaguuuuuucuuuaugccauauuuguggaagagaaucaauuuaauguguauuaccacagagcucccauauguuugaaaauuaauaaccagcagguacuugauaauuugccaagcuguguaaaaaugaccaguauuccuacaaugauugcuuuugauguuuguguuaauuaccauugucuauaacagcaugcauauaaaggugcaugugcaagagguuuaagauauuuuuaugaaaucuauuauuucauguauccagauucuuuuguggauauguucacuuuaaauauguagaaguaaaauacucuugcaaguuaaguuggcuuaaaugcuuuccaaaucuaauuuggcuugcuuauucaaguugaaaauuugauaaugagggaugaccaugucuggauucaaguuuauuuuuugaugauaauaauugaauguuguuagcacaaguaaaccaguaacuuagcugauggaaucuuuuuuuuuuuuuuuuuuuucuuuugagacacagucuuguucuguugcccaggcuggagugcagugucauggaucuuggcucacugcaaccucugccuuacggguucaagcaauucuccugccucagccugccgaguagcugggauuacaggugggcaccaccaggccuggcuaauuuuuguauuuuuaguaggaguuucgccguauuggccaggccguucucagacuccugaccucaggugaucugcccacuuuggucucccaaagugccgggauuacaggugugagccacugugcccugccagugauggaaacuuaaaaguguauuugagagccgggcacgguggcucacgccuguaaucccggcacuuugggaggcggagaugggcagaucaccugaggucaggaguucaagaccagccugacuaacgcggugaaaccucgucucuacuaaaaauacaaaaauuagccgggccugguggcaggugccuguauucccagcuacuugggaggcugaggcaggagaauugcuggaaccugggagguggagguuacagugaacugagauaucgccacugugucucaaaaaaaaaacaaaguguacuugauuucuaauacuaagaacuuggucuagaaccuaacuuuuauuuacuaauagcuauaauuuugacaucaguugcccuuuuauagaugguaauagccuuuaaguuugugauuauuuacaaaucaaauuuccuuuuuauuccuuuaaauuauaagaauuuaguauaauguaguauugcuauccuaaagccaucuugaauacuugaaagauuuugucauagccauuuugaaacccuuguaucccuauauugcagggcaucuuccaacaggguuccauuuuguuucagagucuucuaugaagucuccauguaaaccuccauugcugcccaccuuaucauguucauucugucuuguuuuacaaaggcaaacaucacauuuuauuuuauucugucacugucuucucagugccuucuguguugucucaauucagaguaucuccugcaaauaguucucuuucaguuuucagagguuauaggguuacaauucauaauguuugaauguguaacucuuuauuuuuguuauuauuuuuauauaaaauaaaaauuauuaacuaaauuuuauguguuauuccuccacucccaacucaccauuaguaucuuaugauauugucuaauuuauuacaugaacacaguauauuucucuucacuuauuuaugucauuaauuucuuucagcaauguuuuguaguguuugguguauagauuuugcacauuuuuugguuaaauuuacaucuaauuucauauuuuaaugcuauuguaaaugguauuguuuuauuaacuauuuccaacugguuauugcuaguauauagaaauacaauugauuuuuguauauugcucuuguauccuauaaccuugauaaacuaauuuauuggcucuaguuaguauaacuuuuuuguagauuacauaguauuuucuacauagccacauugucugaauaaagaaaauucuacuucucccuuuccaaucugguuuucuucuauuuauuuuucuuaccuuauuauaugagcuauaaccuucaguacaaugguaauagaagugcuaggaguggacauccuugccuuuuuguuggucuuaggggaaaagcaauuauucuuucacaguuuugcaugauguuagcucuaggguuuuuuguuuuaauaaauacuccuuaucagcuugaagugcccaccuauucuuaguuagcugaagguuuucuuuuaaaucaguaauagauuguguauuuuuucaaaugcuguuucuacaucuauugagauguuuauauugggcuuuguuucuuuguuuuaaugccuguucauauagugaguuacauugauuuuuaaauguuaaacuaacuugcuuucuuggaauaaaucucacuugaucaugaugaauuaucuuauaugcauauuguuggcuucgauuugcuaauauuuuguuaaaaauguuuauaucaauacucauuaggaauauugggucugugguuuuuuuguuuauuuuuuccuugucauaucuuugucugguuuuguuaucagaguuaucagaguuaugucgguuucauuucauaacguuaugaguaaguauucccuauucaauucucuggacaauuuguguagaauugguauuauuucuuccuuaauuuaaauguuuccuuaauuuuaaagauaugaccaguugaagcaucugggccugguuauuuuuuuuuuuuucuucugagagaaaaagguguuuuuuuuuuuuaacuaaaaauucaguuucuuuaagaaaaacugugaccaauaucacacaugaucauaggggcaaaaauuccuaacaaaauuuuaacauaauuauuuuuaucuucuugagugaacuucgguaguuugguagucuuucaaggaauucguccauuuuaucuaaccuauagaauuuauuggcauuaaguugcuuguaauagucccuaauuauucuuuuaauguuuuuacaauccguaguuauggcauuuuucuccuuucugauauuaauaguuuguaucuucuuuuuuuuuuuuccugauuagucuggcuagagguuaacaauuauauugaucuuuucaaagaaccagcuuuucuuuauuauuuuuguauuuucuguuguauuaauuuccucucugaucuuuauuauuucuuuuauucuguacuuuggguuucauuugcucuucuuuuuuaguuucuuaauguggaagcugaaauuauggauuuuaguccuaucuucuuuuguaauauagguguuuaauauuauaaauuuuuucuuuuaaguauugcuuuagcugcauauuauaaauuuugauuuuuuuuccauuuucauucaguucaaaauacuuucuaauuuucauuuuuucuuugaauccuggguuauucaaauguauguuauuuagucaccaaauauuuggagauuuuucagauguuuaucugcugcugauuucuaauuuaauuauuuuguuagaaaacauacauuguguuacgugaaucuucuuauguguauugauacuuguuuuaugucugagaaugccauguauugguaaauguuuuauauuuacuugaaagaacauguauaugucaugggcgauugguuccaggaucccccaguggauacuggaauccacggaugcucaaaucucuuaaaagaaauggcauaguauuugcauauaaucuauacauauccuuccauauacuuuaaaucaucucuagauuacauauaaugcauaauagagugcagucaguuaucuuuuaaggugauuuaaauaauaaaaagucuuauauauuuacccacaugauaacuguuuuagauucuuuauuccuuuguguagaucuugcuuuccaucugcuaucacuuuccuucugccugaaggacuucuuuuuaacauuucuuguauuguucuucuagugaugaauucuuucaguuuuguauaucuguaaaagucuucauuuaaaaaagauguucauacuggauauaacauuuuugacaguuuuuucuuucagaacuuuaaacauacuguuucaucguuuucugguuugcgucuuuucugaugagaagucugcugucauucuuaucuuuuucucuguacauaauguauuuuuuuuuuguuuuuuuuuuuuaagauuucucucucucuucuuuuucuuuuucuuuuuuuuuuuuuuuuugagauggaaucucgcuguguugcccagucuggagugcaguggcacaaucucagcucacugcaaccuccaccucccagguucaagcaauucuccugccucagccucucaaguagcugggacuacaggcgcgugccaccacgcccagccaauuuuuguauuuuuaguagagacaggguuucaccauguuggccaggauggucucuaucucuugaccuugugaucugcccaccucggccuccuaaagugcugggauuacaggcaugagccacugcacccggucaagauuuuucucuugauuauugguuuuaagcaauuuguucaugcacugucuuggagcaaaauaauguuucuuguauuugggauuuguugauauuuuugaaucuguggguuuauagauuuaaucaaauuuggaaaauaugcauuauuuaaauaguuuugucuuuuucuucauuuuucuccucuucuugauggaccccaauuauauauaaauauaaauauaaauauaaauauaaauauaaauauauuaggcugcuugagacuguucuguggucuugcucugucacccaggcuggagugcagugguacgaucauggcucacugcagccuccaccucguggguucaagcaguccuucuaccucugccuccugaguagcugggacuacaggugcaugucacuacacccagcuaauuuuuguauuuuuuuuuguagagauggggcuuccucauauugcccaggcuggucuugaacaccugagcucaagugaucugucuaccucgaccucucaaagugcugggauuacaggcaugagcuacugcgccugguugucauuuuguaugguuucuauugcuaugucuuaaaguucaccaguuuuuuugugugcagugucuaaacuguuguacacauaaucuguggauuuuuuuuauacuagacauuguaguuuuuaucuguagaaguucaauuugguuuuaaguuuuacauuuuuuuaugucuacuuagcauacugaaucuuuagauucucaaacauaugaaauauagucauagucauaagaauuguuuuaauauuguguacuaauucagucauuuucauaauuucugggucaauuuugauugauuuuucuuaucagugauauuuuccugcuuauuggcaugucuaguaauuuuuaaucuguugccagagauugugaauuuuaccuuauucaauacuggguuuuaaaaauuccuauacaguacucuucugaauacuuuaccuaauggccuguguguuaggagguucucccacucugauuggaaaugggcaauauucuuggcccuguaugaaugcuguuucuuuucaccuuuuugaguaguuuuuuuccuccauccucagauaguuuucucacaugcaugcaccagucaguacucugcugaauucuccaguagacccucugcaaaucuuuguuguucuuucucugugccuucucuccugcuugguacccuuucuugugaacucaauaugccuuggccuucucagaauucuggcuuugucuccucaacugugagagucugcuacauuucaucuggguuuacuuucuuuucacugccgaguggaaacucucuauaggcaauaagcuggggcaguuguagggcauguuuuguuuuuagucuucucagggaacaauaaccuacauugcuugauauccagugucuuuaaaacuguuacuucauauguuuugcacaguauuuuaauuguuuuaggugggacguuaaaucugacuccuguugcucuauuauggccugaaguggaaguccccugauuuacuaucacguaggcuuuuaagaguuggagcauuuuaaaaacaucaguuuguacagaacuaagcauaauuuuauuugcuaguaguuauguaggaaucuacuacagaaucuacuagcaaagguaguucuaauauagcacauauuuaaauauauuuuguaguacaguauuuuuaaugaaaauuugaauguucuucagagauuuauaagaauuaguauuuugcuauuuuguuaaaaccuuuuaaaauuucuaacaaguauagguaguucuugguaauggaauuaaauuuuauguguauuucauguauauaaauuuuguauguauuuauuuauuuaauaggucuucauccuccagguccaccuuuagcaagaccuauucucccccgagaacgaggugcuuuggauagaauuguugaauauuugguuggugaugguccacaaaacagguaauauuuacuaaggugguagauaaaugaaaaugaaaacaggauguguguguguguguacacacuagauguuuuaguuuuguggcaccuauuuucugacuuuagagcauaguggaguauuuuauagcccugcaaaagaguacauauucaauuauuugacaguagaaguuuugacaacauagucuggauuaaauccauuuugaaaaaauauuaacucugcuauaacuuuuagagaaacuggauuauuucauugaaacuuuuaaacuuaaaaagcaaaaacauaguucaacucugauagguucuaagaaguggagcuuuauagguaucaguacuggacuuggugauaguaguacuuuuaauguuaagagcaauuugcauguauuuauuucucaaaaugcuuuuccaauuauucuuaaaauaacucuaggaagaucguaugauauguacagagcaauugucaaaguauagauuuuuaaaaaauucaucggauaauagauguuugacagcgcuccuaauuaauauuauuuaaaaaaaggaaugagaauuuaguguuuauguaauaaaucguauguuauucaaaauagaaugacauuugauauagcgaaguauucauugaguauauccacagagaacugagaaaguauauaaauagauguuuaguguaacugggaaagguauaagaaucauguauaguaauuaaucuuuggguuguacuaaacaaaauuaaauauguuuguuugccgcaagacaucucagguuuuaauaauauucauugugaaucucuaagaggguuccaacuuuuccagccuuaucugaccacagauuuggaggcuuucauccccagcacuauacucugggaaacaccaaaauuuaaguguucaguugucaaauauguuucugcuaauuuaauaaagauauauucauuuaacuguuaguuuauuuuaaauuugauguauaaauuauauuuuuaaaugcuugaaauuugggcuuugguuaauuuuggcuuuuauuuaaugaauauuguuuguuguuuacuaagucucauauaauuuguuauggcauauuuagcuguguuaaaauauaaauuagccaugauggcuaaauuagucucugucaugagcuuuguuugcauuuguaacuggucuguucauuuuuccuuacgguguagguaugcacuuauaugucagcaguguuuuucucauaauggcauggcuuugaaggaagaauuugaauacauugguaagaauuauugggcaaugagauuuaaauauuuuaugcuuaaauauuuuauucuaugccauuuucuaugcagugucauuuuauuuuauauacucucuuuguauacauugguuaggcauauuauccuuauuuuaguacauagagcaaagcagggaagacaauucagguuucuuccuauauaauguacagccccuaggccaguuguucucaaaccccacugugcaucacaaucacccaaagagcuuaaaauaauuaugauacccaggacccauuuacaaagagucuccuuuaauggacugaguaugagguccaggcaucaguauauuuuuuaaagcucugcagaugauucucauguguagccacuauuaaaaacuacugugguaaauugaaaaugcuucugaaauauuauguacuacauuuucauggguaaaugugcaagcuucuggauuuuaaaauaccuaaugauucugguuacuagaaauguaaucucacuaauucauuuaaaucauuaauauuauucugcugucaaccugcuguguaacuuauuacauaguuagccugcuauguaaccuguuaugccuuuucugccuuuaauuuuaaaaauuaaaauucuaauaauuaggaaguaugcuuuaguucuguuuagagcaucuaccauauuauuauuuaaauaacauacacaguaacuuuuaaaagguucuuuugaauaucugcaaaagugaucuugugaguuaacuaauuaguucuugaacuuugcuugguuugugguuuugcuuauuuuuaaaaaauucucugcagcuuuucgaugugccuacuguuuuuucuugaacccugcaagaaaaaccagaccucaggcuccaagacuuccugaguuuaguuuugagaagaggcaggugguggaagguucaaguucaguuggucccuugccaucaggaagugugcuuucaucagacaaccaguuuaaugaagguaugaauauguuaaacaguuuugccccuuaauaacauguguuauuuaacaguaauaaaagcauaaugcuuuuagauaaagauggauuaauuuaucagauuuugcugcaugcauaugucaacuacggcucuguuaccauagccuccugugugauaggugugauguguuucacuuuuaacaugcagguuguauugugauaagcaacaucuaacaucagcuaguuaaauacuguuuauggagugaccuuuucuaaaaacuguugggagauuugauuaguaauauuuucauggguuaaguuuuucaauuuaucugagugaaacagauuauuggaauuaugaaacaacuguucaaaggauaaaauacaagauuugugauuaauauugauaaaauagguuuguaucuaccacacaaauugguagaaauuaccagaaagcaggaaacuuuggaauuauaaaguuauccuugcauuuuuuuggauuacuguaucaauaggacugguauuucauuaaaacaaacaauuuucuaaagguucagaagauuaacauugccuuugauguaaaaaucaaccuuauuuuagagaaauaauuuaucagaauuuauuggguuuuagaauucaucuuacaauucuguuuuaggaauucuugaggaaguuucaugaaaaaauggaaaagaugagguggaagauuagacuauugccagcucuuucuugcuacaguauuaauacuuggucaggagcucuuuguuaauuagcucugaauuaugaagauugccacaauuaugaaacaggccauaauguuuuguugcuaugugugauauggaaaaaaaugcauauuagaaguuuaguucacauaauuuauuuaccagucaggauuaauuauuuuaauuucuaggaauuaucguuuacauguauuugauauuuucuucauaaaaacauugaguacuguaaaaauugcuuuaauugagaauauuauaugaagcagugaauuuucagauaucagaaauuuaguaugggauuugaguaucgauauuuuuuuuuaacuuugaagagugaaccuaaaauguguguguugaauugggcuuggcuuuuggcuuacuaacaaauaucaaagugaauuugaauacagauagcuaugacagaggccuguauucuuccaacacugaaucaaugcauucaucuucuccaagucugcagcaucaccuucaaacaaaaugucaauuuuuuucuuuugcuuaagucgugcucugagcugcaugcugucacaugcaaaccaucugccuugccauugcagccuuuuggaacugaaaauuaaaggauuucauacugaagaugccuagaggaaaaauugaagucuuuuccaugacuagcccugcuuauagaagcuaaagugaauaucuguaagcuaauaguugggacaaaaaaaaaagacaggaagaaacagucaacacagugaaaaucuugauaaugagucccauacuuucugucuucugcuaaggucaagauagauaguuagcaaacaacacccagcuauaccuauccuucucaucuaaucuaggaggagcaauaccccagacgucucauuuucugucugaaauuccuggaaagaagucuuacuggcucaaacccaaccccaauaagguaauguuauuacaugaagacaaaacuggaggcaggguuugauaacuccauaaugcuaaaaacugaagcaacaauuccauuugguuaagauaguuucuagaauaauaacuuucauacuucucuuuggauucaucaaaguggcuaugagcaucuuuuucuuuggcuuuccagaagauugaaacuuuucucaagacaucuaacucaacacugugacacacaguuaucaauuccaagcuggcuuccuuuaguaaacaacuagaaguauaucugaugaacagaugaagcugcauuuguuuugaaccccgguggcuuaugaguauauugaacuauuaaugaagaccacaucaucucaaucaucuacucuuugcuaacagacaguguuuuagauuucugauuuuuaaaugauguagauacuugaggucugaaaaaaaaacuuuucugcuuuaauucuuauauuauuaaaaguauugcaguggcuccuucuuagcagcagaaaguguagagaugaaguuauugaaguuacagauggaaccaaaagauaacuuucuuccauccaaacuuuucuuuaaacaaauaucaguaaccauuuuuaugaacaaucaagaauuaauagaagaaauauuuuuuuuucaaucugugauguaaggauuuugaaguuaaguuuugccuggauucugauuuuggaagauuucgcauuuaggauggggcacaaagcuguuaaaauuucuggaccgcucuuuagaaaaacauacagaaucuuggaaaguuuucaucaaaggaggagaccuagaagaaauuucucucauuaauuucucaccugaauaccuggaauauuuuuuucuggaauuuuacauccagaugcuuugguaauagauuauuagagaaauacaagaaauuauggauauagauugucuuuuugcuugagggcauacuaaauacggcaagaaaugaacugcuuuuagguuccucaguuucuuuuaugguuaaauagauaguaccguaauacuugaaucucugcuaaguuacauuaaggugguuuaucaguuuuaccuuuuuuuaaaaaagcauucuuuuuaugguaugugauaaucauuagaguacuagguuucuacauuguugauauucuaaugcagugauuuuuuggcuagcauguuuacaaaauguuacuguuaauauuguguuuuuauugcccaguuguguuugucuaggucucaugcaguuauuuuaguagaauauaguuuuuguccaauuggaaauaacuuccuaauaauaaaacucauggcaucuaaucaauacuaucaaaaauagcaagugaaauuuauauaagguaaaauuuaacuugauaauaugauuuuaguccuucucuuucuuuuaugcaaaauacuguuaccauuagguugcgcugaacaagggaaaauucuuaguauuuuuguuaugcuccaggaaauuaaacuauuugauaauguaaauuuuguuguauuccauguauuuaccagauccauuaaauaaucuuuuuauaccuuuguuuauauuuacuuaugugcagccuucucaagauauguaguauguuuuugcauguuuguuuuagacacagagaucuuuuggccgucucacucccuuuucuaaaacacuuucacuuaauaguuuaguuuuagaucauugcuuaauaauuaaacucuuggccaggcacgguggcucacgccuguaaucccagcacuuugggaggccaaggcgggcggaucacaaggucaguucgagaccagccuggccgauauugugagaccucgucucuacugaaaaauacaaaaaugauccaggugugguggcgugcaccuguagucccagcuacaugggaggcugaggcaggagaaucaccugaauccgggaggcggagguugcagugagcugagauugugccacugcacuccagcgugggugacagagugagacucugucucaaaaaaaaaaaaaaaaaacccuuaacuugucuaauugauuugcucagaaaugguaaauaauuaaaugguauucuguauguugaugaauacuagcuauuaugagugguuauaauuuaauugaauuuuauuuacugaguuauuggguugaguuggggugaaauuuauaccuuuguuucuuaaauaugaguuagccauuuuccuuaaggcaggaaaaucucguaaaaagugccuuguuuaaaacuugugaguuaaagacauauugucaauuuuaauuuaacacaguuccuuuggguaaguuuguagcuuacauagauagaggguacugauguguuagcaaggcaaaaauauaugaaguuguuuugcuagacuauuauuuaauuuucuuaagaaauuauuuuuucaagaacuagaguaaaaaccuaaacaugauauucuuuacauguuuuugcauguguguaguuuauagguggggcagugauauucauuauauaauuacacuguuuuaugaguuucaguuuucuagcugaguugagacuuugcccaaacaacuggaagccaauuguuacuauuugguaaaacaaaauaauaauaauaucucaagaauauugagguugggguggggugauggcaggaguggggaaagaaauugcauggaucauuuuuuguuuuauggcauugugguauauuguuuucuugacauuauagaugccagagucgauuuuaaaauuuuucuuacagauggaauuaggucauucagguaauuguuucaugucuuagucuuaaacugggccauaaagggaagaguaggguuguuuaauuagugugaacacaaagccugguuucucuuauaguauuuuaugcccaaauauuaacaucuugcgaaauauauuuuauuccaccaagcuguuuuaaacuacaacuucauggaagaaauuugcuguuuuuguuagaaugggcaaaugaugugcuuccauaaaaaugaaaaaaguauguuuguaacacauuaaauaaucuuauaaagcucugugauuauuaaauuuauauguaauucucuguuaaucauuuacacuuaauuauuuagaucuuguuugaugacuucuuacaaaauggcauuggcauccaaacaucaauaccuaucuuauuuagacuaccugaugucuacauuguagaugucaugucacauaccaauuuuuuguaguguuacugccauuaaaaaauugcuuuucugcaaauuaacccaggggaagaaacuuaaucauuaauaggcucuuugauuauuuucaauuuccacccauuucaccaauuuuguagucuuccacauauucucugaaauacaguagugacuggaagacuucguguaucuuguuuucugauuaugauagcacaugguauuucuaugaauucuuguauugcagacauuuaaaaauuucaguauuguaguucuccuccuuguauuaaccauuucuuuguggccccagaauuuguacauuaaaucggcuuugacuaguaaagucuauuuuugaaaauaguaacaucacaaaacuuuaauaugacaagccuugaauuuugauaccucuccuguuucaguacaguauugaggcagucugucagacagaauaugacaaacuaugugggccuguuuucacuuaaacauguuuauuggugaguuacauccuggauucuuagcuuuuuguuuuuucauuucuuguggcuuuauugguuuguuucagaaggcuuacuaaacuauaagaaauugugaaguucuugccaaguaaauacugcucuauggccagagaguuguggaaaaccaugacgcuuaacauucugucuuggauacauucugugaggguagaauuacaaaugauuggugacuccugaaguuuuccacggauaacuuguuugcccuuguagcagaaaugauuuguacaugccuguaguuucauuugcccuuucugcuuuuccuuucugcucuggaacauugaaauaacaaaauucaagugacuuacuguuuucuaacuuggauuuuuauaaaauuccauguguguagcaaugccauuuuaagugccauguuaagauacagauaggauuuuuaaaaaugagauuuggcacaaauuaauuuauggacauuccuuacuauuuuuugugagcauaggaaguuuucauauaguaaaacuauagaauuugggccuuuauucuacauaucaaaagguggaaggugguuauaacuaauuauauaagccagaguccaagguaucucuuuaaagaaauaauucuuuuuaaauauuuuuaaagucuuggcauagaguaugugagcuauagauaaacuuguaugguaaaaccauggauuucuaagacuuccauauuaacacaugugcauauaacacauaauuucuuugcaaaacaauuuuauuuauuuagcaaaacugaccuuuauuauacaaggaacuuaauuagaacuuuuuacuaaggcuggccuucccuccagaguuuuugaaucaguaacauuuguaguauaucguaagaaaucaucuaugagaguggaaaaauaugcuuuuuuucucaacugauaugguuuggccauauuucuacuagcaaaaauacuaauugcuguuuuuuacauaaacaaagaaauaccuuaaagcuagauuuuuaucuuuaauguagaaauuggguggcccaaagguugucugcuccagucauucccuccuccauccuguucuuuaaaccuuaaagaauuaaaggcaguuuauucaauacaauuguuauauuauuuuuaagggauuugaauucaauaauacuuagagaguuuaaaaggaguaaauuuucauguagggacuaguacccuuaacuucugcuauggagaugggauuaaaagacccuucucuuucucucccuaacaugcuagguauguaguacauucugacccagagguuaaauacagaggacuugucuugcagagggaugaggagagacuagucaugccuuuggaaaagauagaaaccugacuucccaguuuuuggauaauagagauguauaucaguguaggaacgcaccauccacccacacccacacacacccacccacccacccacaaaguacacauuuacauauuacucacaggguugccuggacacaagggaaacaguuucuucaggaaauguaaucuggacauuaauacauuugcauuguuugcuggacuauuguauuauagcacauaauucuguugggacuaugauuuuuggacuucaacuuucagaugugucuuuaguaacuuauuuuguaugaaaauaugggacauuagaaaaaguauauuuauggguuuuuuuccucugaauuacuuuuuuuuucuucuaucauacuaacuguaaagagaguuauguacuuauuguaaaagauuuuaaggauaauguuagacaauuguaugguuucuuuguguguguguguguguguguguguguguguguguguguguguuuaucuuuuuugcuugccuuauuuagcaguuuuaacguucagguauuccuaaaguuuugaaucuuuaucuuuucagaaucuuuagaacacgauguucuugaugauaauacagagcagacagaugacaaaauaccagcuacagaacagacaaaccaagugauugaaaaagcaucugacucagaggaaccagaggagaaacaagagacugagaaugaggaagccucagugauugaaaccaacuccacaguuccuggagcugauucuauuccugauccugaacuaaguggagaaucuuugacggcagaguaguaaaugcuuccacgugccuucaacuggauauuuauagucuuacugaugucaguuauugcuuuuucgguggcacuuacuuuuuuugccccucuaaggguaugcuuguguaucauuugaauucagauugccuagcuauuugaacaucucaaaguuauauauacuggguauuaaaauuaaaagcaaguuauaucagugaaguaagauccuuuugaauguacaaagacccacacuauugagacagcuuuuagauacuuuuuuguccauucuaaaaguaagcaaacaugauugccuucuuguuuucuguauguauaacccguaaauauccauuuugacauaggaagaacuuugguuaagaguaaguucucuaauuguguuuguuuuaaggaaugaaacuugguuaagauuuugacuacuucauuauuaaaaauugauagaauuuuagcuccugagauauuuacaacugggagaaaugucuauuuagguguuuacauuaagcgguaugaaaguuguuaccacauaggcacugguacgaauucucaauaagaaugcaguggaacaguuaaguagaacuguaacuacguuggcacugguacgaauucucagugagaaugcaaugaaacagucaacugcaguguuucuuuuugaugucuuuuauuuuacaacugggccaaaggcacauuauguauauaauuaguuuauauuuacacacuagcauauaggaaauauuucugcacuugacccuauuugaauucugagcauuauuuauaaguauaaaaugaugauauauaagugaauuuugugcucuuguuuguauuuuauuaaggaaaaugaaaauaaucuggcaucaguuucauuuugcuaaauaucuagucuucuucaaacaguaucuuggugggugacuuggcuaccugaaaaaucuuaggaggaauagcucacaauacaauaaaucuguagauucugcuuagagcaaauuaugguacuuuuauucagacuuguuuccuuucuaguuaacagaaauagugacauuuagagguuuuaaucagaaguuagguuuuucugauucaggaacaucguaggccagccauuuguaauuuuuaacuuugagaaacaaauuuugugagaauagguaguggguugcugguaguuaauuggauuuaauauuuguauuaaggauuaacuggaaaaaaugugucucagugcuaauucuuggaccuuuaauacagugugcuuaucuguuacggccuccuuuuaucucucuucuccaauauuaaaaaaaauggaaaucaaauuauuaugcugaagggaaaaauauaccuguauaagaaugguguguuuggcuaauguuucuaaguugcacacaguuuauuaacaacugaacaaaacauuuuuaucauuuaaaaaucuauuuuuaugauuuaauaucucauaugugacaguuuuuuuuuuuuuuuuuuuuuggaacucaaucuguuaacagucugggacauccgguauaguaaccagaguuuuugagccugccguauugggcuuaaauuucaggucuguagucuugggcaagucaccuauaaacucacugagauuauuuuuucaucuguaaaaugggaagaguuauguuuauuuuugaaggguauuaggauaauuaaaaauaauguaaugugccuagcacacuaccugaaaacgauggcauuuguucuuauuaaugucuuuaaaauaugcaaggaccauaaguuuuuccucuugcagaugaggaaaguaaaaaauaauacgaacauguaauucagcuucucagauucaagccaauguuuuuugcaucaacuuuucuauauuguauguauguauauaaauacauagauuaaggaaauaggaaacugaaacucuguggaauauaaacuuuuuaaaaauaauuucaucagguuuuuuguauguuacugacccauauggauuuuaguaacaucuugcuuagucauguuguuauaaaacauucaaauucugauauacauugcuugaaaaugagugaguaccucagagaaauuugauagacucaaacagauaguaugagaaauaucuuugaaagaaauauggaggaagguuaaaaggggauuaguaaaauuaaugcgauagguaacauguuuguaaccauauaguauccuuuuagauacaaaagcuuauuuucauuauuauuauaauaaacaguuaaugguugaaacuuaguaaaauguccuauuucugauuauuaagacuaguauaaaugagaaaauccaagcuauuaaguaccauuagcuacagugaucuuagcuuccuugcuuacaauuguucagugggucaucuaaauucuucuauguccugagcaugaucuacaaacauggucuagcuucugucucuccgucuucccgccaucauugugcuguagccauauggaacuccuuucaguucucugaccaugcccuuuccugccucagauuucagcuuaaauuuugccuccucagagagaugccuucccaaacuccccaucugaagcuggccucugccuuuuacucccuaucaugucacucucugcucaccauccuuaucacaauguguauuugauuuguuugcuaguuuacugucuucacaacauaauguccguuugugcaagggucuuauuuuucuuauucaugucuguaucucaagggucuagcacaaugcuugaugcauauugugugaauaaauacuuuguugccaaauccagugaaaacucucaguucuuguuucacugcuuggcaguauugacauugaauauucucugagauacuuuuuuucuuuuggcuuuucauauaucacacuauuauucucuuauuucucuggccucuugcucucaacguccuguaaguguugguguuccuuaaguucuaccuagugucaucauuucuucauucugcauauucuuucccuaggguuucuucccaacaccaaaggacuuaccaucugucucucugaaucucagaucuccagcuuugaucuguuuccuuuacuuuagagcuauauauuugccugccuacuggccugucucucacaauccauauauucaagaaugaacacuauacuuugcuucaaaccuucagaacauucaaaccguuuauguuucucaucuaaucaaauagaguuacucucuaagccagaagcuguaaacucaucucuuuucccuuuauucaagcugucaauuuuugucuccuaaacaucuucuaguuauauucucauuucucuguucacauugcauuaauaaugaugauaaacauuugcauucuuauucugugccaggcaacaugcuaacugcuguauauauauuauuauauuuguacuuuggcaagaauccugugaagauuuuuaucuuuggacuacuagaagagaaagcugaguuguagagagaguauguauuuaaguccguuugggcugcuauaacagaauaccacagacuggguaacgugaugaacaaaaauuuauuuggcucacaguucuggaaccugggaaauccaaaggcaugaugcuagcaucuggugagggccuuugugcuuugucaucccaugccagaaggcagaaggguaagagagggcaagagugagcaagagauggaaguugcaaccucaagcucuuuuauaaugagcauuaauccauucaugagggcuucacccucaugaccuaaacaucuccauuaggcuccaccuuccaaugcaacaguuagcauaaguuuucaacacaugcuuuuuguagcauucaaaccauagcaggaagcaacuuugcuuaaaauuguauaccugguaaguggaaaaagagggauuugaauauaggcaaaugacuucagaggauuuacucuuaauuucuguuguacugccuucuaaucuuggccuccaucauuucagauuaccaaagcugucucuuaacugguuucuuugucuccaaccuugugcacuugcuaucuauucugugugcugcagccugaguuuuuaaaaaacagaaaaugaggggccagguguggugguggcucacgccuguaaucccagcaaguugggaggcugaggcgggcagaucaucuggggucaggaguucgagaccagccugaccaacguggagaaacacuaucucuacuaaaaauacaaaauuagccaggcgugguggugcaugccuguaauccuagcuacucaggagccugaggcaggagaauugcuugaacacgggaggcagagguugcagugagcagagauugcgccauuguacuccagccugggcaacaagagugaaacuccaucucaaaaaaaaaaaagaaagaaagaaaaugaaucugccacgccauugcuuagacccuuuaaugacucuugaguguucuugggaugagguccaaauuuacuaauaaggccugcaaagcccuguguaauuuugcuccuaguuauggcuggcaucugcaccacaacuacagccacugccaccucccccugccacacacacauuuuaaaaguaacaauaguaguguuuucuguguuuugcauaugcagucuuuucucaucucccagccuucuugagcuuuuccucugccugagauacgcucccacucacauagacauugggggcacuaaauaaaaauagcuguuuaauugaauuggaaucguuccacuuggaacccaaguuuggaaauuuugcuacuucuuguuaagcuaggccuuuuauucuugaaguugcuauuucucauacaaacucauuuuaugcauuagacacacagucacuauuguuauggagaacauaguuguaucagaagagguauagcuuuggguguggaugugcgugugucaggggaaagauauucugauuauaugaugauuuucauaaaauauaguaugcugaguuuccgaaaauccuaaaugacuuagaaauggugcuauaugugguuuguuugaccccugcaaaucucauguugaaauuugauccccauugcuggagguguuuugagcauggagcggaucccucaugaaugucuuggcguuguccuugcaguaaugaguucuugcucuauuuuuccuccccuggaagcugauuguuuaaaagagccugguauccucccucccuuucuucuuugcuuccucucucuugcugugugaucucugcacacaccagcuccccuuugcuuucugccaugaguggucugaggcucucaccagaagccaagcagaggcuggcaccaugcuucuaguacagccugcagaacuguaagccaaauaaacuucuucuuuguuuuuuuuuuuuguuuguuuuguuuuuuuuucaguaaauuacccagccucagguauuccuuaacaacacaaaugggcuaagacacagggucauagggauagcaggcaccugagccaagccagaacuuagaucucaacuguuaaugcaggaugauuuguauugaaccaugaauuuuacacugccucucaauguuggugucagcauuuaagguuauuuaaaaaauacaaccugaagguuacauaaaguuucauuuaaaaaauaagaccuuauaagucuacuuuuauuuccaguggacagcaacuacuuaaucgucuuaaaacuuucuucuuacaauauuacuuuacaauauuaccuguuggauuuauuaucuguguacaaaucaguuaguugaagggccaaagaauaaaggcauuuugugaauuaugaauagcuauuuugaaauggucauggagacuagcuacucuagaaaauugggagaauauacuguauuaaguuacuaucugguauaacuucaauuaauugugaaaauuguagcagagaucuagauauaguuuaugaacuucuaaagagacauuaaagggaauucaaguacuuguguaaagaugaaccaagguagagaugauugugaauuggugaucugcuguauguuacaguuauguaauuugacuuguuucaaaauuauuaaaguuuuaaguguaugcauucuacuggucaauaaguaaauauauucaggcucugaauguagacagauaaauauauaaauauagaaaguacauuuguuagaauacaaacaagaauaaaaauugaguacagaaugaaaaccuuauuaaauuuuaucacuccauauauuauuugucucauccuaauuucuuuccuccucagaaacuaaucuacauuuucuacuuuaaugcuauuuuaaaugacuaaaaauuacuaaauuuauuggguaguagguaucuugccccaauugcccuuuaucaguuugccuguguaugaaacuuggauuccacuuaauuuuccauucuugguccuccagagcuucuaucauaccugguuuaauucauacuauuaauggacuuuaggagaaggaaacaccauccaguuauauaguucuauauuauuugaugcuuuuuaaaaccuagauuuucugcuuuaugcauuuucucuauuuuuuuuaaguauuucuaccuuccuuuuuguuuggcagcagaauuaauggaaguuggaaguacucuggaaagauuaaaaaauguucucaaaagucucccucguaaauuagacuuuuaaguuuucaguccaggauucugugagaacaggccagauuuucagcugccaaagacuuuuaccagaucccuggcacuugauuuaggacaacugggaaaaaucauuuauuuucaugaaaauaaauauuuugaagggugaagaaagugggaaauuaaauguacauuguuugaauaccuucucucggucaggcacuaugugcuaaguacuuucacacaguucucacaacaaccgugugaggagauagaauccuaucaaacagauuaaauucauuccccaagacuaguuuaugggcauugaaaauggaaucugaaccuaggaucuuuaaguccaugcucuuuuuacuaccuaugaauccucuccuuugguagauguaaaaaauagauuaaugcucuuuuugguuccucauauuuuucugauaauuguuacuucuucagggcagucuuaaccuaagacuuaccagacacucuauucaacacccuuccuugaaauuccuucuaauguuaucucccauaucaaacuaugaacuucuugaaggcaggaccauaucuguuguugcucaucauuuuauucccaguguucaacacauggaagacaauaucuguugaauagguaguaugcacaaacagaccacacagaaugggaaauauacuuagugcagauuuuuguaguguggggaauuuugcaaaucuuaaauuguuugaacuauugaguagggaaagggccagauaacuuguucuucacaauuuaggcaaacuccaauugguuccucugucuuuuuuugauccauuguccacauugcucuuggagcuuucuaaaacacacaucuuuaaaaauauucugcgacucacuuguauauugcaauuccguaggcaacuugcaaggaagcccuucagaaucaaaaaucaccuuuucagccuauuucccaguacucuccuuuauacuccggccauagauaaguauuucauacaucugagagaugccaugcacucucauaugaucuauucuuuuuaaacucucacuucuucaagacccagcauuaucuguaaucuuuugagugacaucauccucaacuuuucuaagcaguuacuugcuuuuuuguugauugcacuuuauauacuuuauguaacuuguagucuccugaccucuuguuauuuguucugucuaccucccucauuugaccuaacacugaagauaggccauguuccuuaauuuuuacuuucucacuuuugcuguccucaaacagaauaacaggaaauaaaaacaaaaccugugccuguuacagguauguugaguggauucauauaacugauagaucugacuuucucagcaucaaugguuggugugcugcuucucuugaaacucuuacaaauccaggaauuggagcuagaaagugagaaggacuagcucaagacauaagaauagggaaacugagcacauugagggugggggggauucauguguuuuguacucucaaugccugacauaggaaaagcucucaucaugaaugaauugaacuggagaugaccucacaacacagguguucagggggauuacaguacaggagcucaucccucauucacaugaauccaugauuuggauaagguuucuaacuuguacauaaaauauuuuguguucguuuaaugaguucccauuguugaagaucccaauaccccucacucccugcucccauaaauaucuguagaaugagguauuuaaaaauauuuuuuguuuuuauguugauuuuuauucauuauccgauuucugacucauuuaguguuauaacuggcauuaaguuagaaauggucuggauaaaguugcugcuuuuuugacaucugugucuaguggagccuggacacacucacauguacauacauacaacaugcaaaauaauguaagaguauuuucucuuucaguauauagaccauaggaauucagaccuuaaagucagauacaugcaucuaaaaguauuaaaaggggcugggugcgguggcucacacccauaauccuaguacuuugggaaacugaggcgggcacauuaccugaggucaggaguuccagacuaggcuggccaacauggugaaaccccgucucuacuaaaaauacaaaaauuaggguggggaacccuauaaucccagcuacuccagaggcugagaggagaacugcuugaacccuggaggcagagguugcagugagccgagauugcaacacugcacuccagcccaggcgacagagugagacucugucucaaaaaaauaaaauaggccgggcgugguggcucaugccuguaauccuagcacuuugggaggccgaggcaggcggauugccugagcucaggaguucgagaccagccuggacaacauggugaaacccugacuuuacuaaaauacaaaaaauuagccagguguggcuguguacgccuguagucccagcuacucgggaggcugaggcagaagaauugcuugaauuccagaggcagagguugcacugagccaagaucgugccgccgcacuccggccugggugacagagcgagacuccaucucaaaaaugaauaaauaaauagcauuaaaaggaaauguguuacuguacauggcaaguguaauugaaacuugcucuaguugugguauaauuuaugaauuaaagcuaaccaaguuauucauugucuuuuuuuuucuuucugagauggaguuuggcucuuguugcccaggcuggaaugcaauggugugaucucggcucacugcaaccuccgccuccuggguucaagcgauucuccugccucagccucccgaguagcugggacuacaggugcaugccaccaugcccagcuaauuuuuguguuuuuaguagagacggggcuuuaccauguuggucaggcuugucuugaacugcugaccucaggugauccucccaccucggccucccaaaguguugggauuauaggugugagccaccacaaccagccucauugucuuuuuuuuuuuuuuuaauuuaaguucuaggguacgugugcacaaugugcagguuuguuacauguguauacaugugccaugcuggugugcuguaccaguuaacucgucauuugcauuagguauaucuccuaaugcuaucccucccccuucccccaccccaugacaggccucagugugugauguuccccacccugcguccaaaaugaaacuggcuacuugugucuuacugucuuuagcaagaauucuaaaggcuuugcauagcugccaugaguuggcucuuguuaaauuacagugguuugcuuuuuaaaaauaucuuuuuuagcagcaacaaaaaagaaaauauauguggaacggacuuguauucucaauuaagaauauccacauagccaaauaauacaugaauuuucagaaugggaugcugugaauugugugaaauaaaguacagacugaaagaaaauugauaugcuugagacaug

SEQ ID NO: 13224 - RNA, 3419 nt, Homo sapiens
uuuguggccuccgcagccagcuuaggcugcucggugucgugucgcaguuauguacugccauuuauuaugacucuuagaauauaguuauuucuuacucuuccgcugccuccuuugcuuuuaaagccuguucugccaagucucgcuggagaaggaaaccccugaaacugguccugguggucucagaccgccgcgcgagcgaagaguggggaggacaaagguuggggaguugagaaggauggagaugggugcaucuggaagggaguccguccugaggagucccccaucagcugucagccagccagcagcaaagcaaauuaagacuacacagcuccgaagaagccaguucccaaccaagccaguggagaaaagucagcccgguccccaggagugcuugaggcucugucacucuuggacgucaaaaagggucauuugaugacuggacgcuuaccucaccggugugagguaagcuucaaacgccguaucauguugcuuuaaaaccugcggguaacagcauaagcugaguuuucuaucuuagaacucuuaaccccaagaacacucuucacaggcccugauagguggacccacaaaaaaaccacucaggcuauauuugacucggauuugaaacgcugccgaaacgguauuaaguguccuccucaacuggaaaagacaaauaacaaaugaugccugaaugagaaaaagacuagacgugcacacaguaaugugugagcagggaaacuucagcgaagguuuuuaucaugcuuuaccccuuuuacaugcuuuaccccaugugcaaacauuuuucauggguuuuuuucuauuuuuuauuuauuuuuauucuauuuuuuuauuuauacacaaaaaaguuucaaugauuuuuuaaagaguaauaguuuuaauauguuacauuuaaacuuugacgaugcaaacagguugucaagagaagcaacugagcauuguuugguugguaagaaaauuuauuauacuagaagcuaccgcauaauucacugugcaauuugcuugcccuaauugccuaaauauuuaguuacaguucuguacacuugcaaggaugaggggaagggaacugaaguuuagcgugucacuguggaucaggcacuuuccaaauguagaagaaaaugaacagaaacauuucaccuguuuugauguggaaauuuaaccguuuuguuuuucaaccuuugcuguugcaaaguauuaaaguccugugcaguuuugcaaauauaucucaccgcagaaagaucuccuuuccuaagaagacugggaagaacggcuuuccacuugccaguaauguguccucugguuucaauugagccaucagugucuguacuccagccugggcuaccaagcgauaccccaccucugaaaaaaggguagcaaggggacagagaagagcugucuggauacacgagauuccaaaaaccuaauccugagauaaaauucccuagggaauugcucuaccgagaguagagauuugaccuggaaagagaagggagagaaguauuuaaucauuaacucuuuuaauccucccaacaaccuuuuuaguaucauuuuucaaaugaggaaacugaaauguagaaagauuauguacacuguugaagguaacacuaagccacugccuccuucauaucaagaauaguuguucaucgagcaaauaaagugagggaaagacauuacaagcagagaaaucaacauacacacuauuguggcuggacuucaggcuacagggugguuccaaauauuuauugacaaggcccuguguuacgugcugaggauacagagauaaauaaaccagcuguccuaaagccgcugacacuagugagagaaaccuuaaaaaaaauacaaugcagacuaaauaagugcugugauagaggcuaauguucacgguauuggaaaaugauaagaaaacagcagccggagagaaugugagaaagccagugaaggugcugcuuuagcagaguccaaaugucaagaguuauccccuacuaacccugaaauuguucugggauagggucuaaagaaugaaauccaaagaacaacagagaagaacaccagagaauacuuggagagaggaaacaaauugcucuaaccaauggaguuuuaaauggucuaguuuaaaauagguugaauuuaccuagguguuaugagaacuuaagaacuuacauaaguggcauucauugguauggucaaagagguuagguaaggcuucuuugaggaagucacaccagaauggagauccaaaagaugagaaacugaaaaagggagagugggaaacagagggaauaucauguguaaagccuuuuugucagaagggaacacugcaagccugagggacugaaaggaggcuauuguggcuagagccuagguugcagggagaaagugcaccaguuugaagcuggagaccagauuaagcagagucuuauuggccauauuaagaacuguaaucuuaagagaaaaagggagggggagggcauuugacaugauuggaucuguguuuugaaaagaucauuccagcugcagugugggaacacaagcagagccagcacuggacuaauuaaaucuaugagugguguuaguguugguaggcaugcaaguggcuugggguaggaacaaggagauggacagaagugggggaaauggaacaauaggaaguaaaguggaaggucuuggugauggauucaaauaucauggggugggauggggacugagggagagggaggagucagauaacucagaauuucuagcagacccaguggguggauaguaaugccaucauugagauauggaggacacuggaagagagccagguuugggggaagaggguaauuucaauuugaacacguuaaguuuaagauauuuuugugacuucaagggaagauguaaacauuggaaucuuuaggucugcagcacugggcuggagaaaaaaauauauauuaccauuugcaauuuuuuguuuucugcaggguacuuauuuuuucaaaauacauaugucuuuauuguaaauaagauguuuuguuuuuaaacauauuuagacgcacuugaacccaggagccagaggguugcagugagcugagaugucaccauugcacuccaaccugggcaacaagagcaaaacucagucucaaaaaauaaauaaaaauauauugagaacagaauuuuaaacuagagcaguuucccagacuucucugagagucaccagugucccuuaucaaaaacucaaauucucaggcccauccccuagagauucugauuucacuugucugguauagggggccuggaaauguggauuuuuugacaaaugccacuggagauucuucuuauugcugaguuucucugggaagugguaugccagugccagaggcuaccugcauaagagucaccacagugcuuauugaaauauagauucu

SEQ ID NO: 13225 - RNA, 5523 nt, Homo sapiens
gucacagcccgaaccagcuggggacgccgccccgccgcgggucgcugcucugccucugcugccucuccuccucgagcaugcuguagaggucgucggcagcgcugccuucagggcucucgucuuucucgggaaacagaucugggaacgugaaggucuguccaugggccuaagggggagaacaaaggcuccagccagagcugcaaagacuccucagcagaggggucugugggggagccucaugcuuucuggcagccccuuucugccggcgccggauucaacugcucagagguaccucccugggccuccuggggcagcgucccugccuggaauguaagcacccccacggccaccggcccccggcugucacgcugcagcagaggccacagcuccaggacagggccgcuuuccccaccauugucucuuuagggccuggugucugcccccgcccugggugcacccauuuacuagcacggggccaccugguugguggggggcagaaacaaggcauggaaaaacaugacacaaaucacgucugguaccaugcugaaccuguccauccaaaaugccucaggcucuacucacauuaaagcucccccuccucccagcccagagccuggcaauuaaagugaacaucacguacgaagaaacaugcacgugcggcaguugauaaaucaggaccggcucugccaauuaacuggucuuacaucuucugcugagaguucagaauauguccgugucagccaagccccagcccaggccacagcauguggcucggguucacgagaaggaggggauacugcuccuuggggaccuaagcaaauacaagaagccaucuuaacuugcuaaugauuacuaagugcuccaaagcuaagaggcagaaagagcagaccagaggagagggaagagaagagggaggaggagugaggauggcacccgaaucuggaacccuuuagugaguaaaaucagucagguacacuuggcucuugcagacccuuuguguguaaauaaaucuggaugugggcaggcagccaaguaugaucugaaacaggcccagaucccacccugcgagggagguguaugcacccugaucccuggcgcagagcgcaggggcuggcggggagaguggcacugcgugcgccguagccggccugcaggaggauugccuuacacagcucugaacuuugcgucuuuuaaaauaccaaggggcagucguuuacacgugaggcugacugcccagaaugggagauucaccuugacuauauggaggugauucugcuaguuuuccgaggcaaggggaacccaaaaugacaguuuaaagcacaaacauggccauuugucacagcuucgggaagaaauggggaaaggugcugagagaaaauccguuucuuacaggagacaaacaccguuuggggaugccaagcaugguuucccaggggcuuccccuuucuagaagaguucaccuuguaccuaaaaaaaaaaagcccuugauccuuccaaaaaggagagagacagcugaucgggguaaagaacaggaauggagaaaaaugucccaaugacaaguaaacaaggcagcccugccuucaggaaucccagggcgcccugggggcugccgccugccuggaccuggaggccggagccccgagcacggagcucggcccagcuggcggcagcgguuuguucuggaguugccucucaugucgugcgcccuucauuccugcgcgcccuucauucccgcgcugcucagcauccacacaagccucggggcagcgggcagucaauggucuuuuuguugugugggucacugaggcgcugcuuucagcucccaggacuuugggccaaggagaugcuuaucagguugucggagaaagaaaugugggacucccgccacgugggacagggccuuuccacagcggccaacuccaaauaacguggauaauuuuaccuuuccaaugcucccucccugggcuuugcaauuagcagugauucuaagcccuggcgcagggcccagggggacacgcugagcaaggucucagcagacacgagacaggaaagggccuugagaguccccucugcgggcagacagggaccaacggccacggcccauuucuaggcugugcaaagaugugcuggaguucaggaaggggggugaggacccguuacaaauuuucauucuggaacaggaggauccaugcccaacugggacccuucaggcucccaguugcccugcccugucucuggcugccuggacuucacagagggagaacaacacgcgggcagcagcugcagacaccggaucccggagcugcuggguucaguuuucaugggagguggggcccagaggaagaacgcaagggcucggaugacuugaaugccacuuguaaccguagcugccucugaagugcccguggcggugccggcacacgggauguccacccacaugccaugacaaagacagaugggcccgacugacacugagcacacagaggccuuuaugaggccaacggcugcucuccccaccuggauuggcugauuucaugcacagcaaauaucaggccaaauuauuccgggggccccuguuuagaacaacaaaugugacuguuuuucagaaaagcugccaugcuaacuuggccuuuuucacaaacugccuccuuagccccacaacaggccggcuggcccaggaggcgguuuccaccaucgugugacugccaucuaguggcagggcccgccggcucggccuccagggaccauuuacaccggaagacaaccccauccccacccaguaaggccagccccaggggcagaguggggaggcccaggaggcggccggggcaggcuguggacaucuuggcccagagagaaagugccucuggguuugccugggacucaaaaugaagagcccaaagaaaggcuuugaaacugugggucucacuccugacaagucuggguuucagaaacugaaggcccaggcaacguggggugaggguucuuccuccccagagccccccaggauacguaagaaagcaccugcucagaagcagccugcugagcccuaacaaguacgugggaccugcuacccugcaaugcaggacaugggccucagccaacagcccggccagccagaccugccuuggcaccaaagaccuuugcccucaggggccucacacucugccuccgaggcugaaacccagccaaggacaggcucuccagaggccggggccucccaugcucugacacccuggugugcguuggaguugaaacccacuaggccugugauggcugccuuugcccacagagaauucaaacuucaaaaucacaaaacggccggacgcugagacgugccccaugugccccagugcucacgugcucccagcgccaccacuaacacccccaaggccgugacggagcaugaccuuauguggagccugccucugcgcugaggcccugagauccggccucacgggggcucccugggccccagcgcagcgucuccggcacaaacauccccaaggacacaguugcgaggagccccucggaggccccgcuggggcuggccagcucacacgcaccagcugcacguaggcgaccuuguaguccggcuucuugauccucacguuucugugaucucuucucuuguuagagccugccggaagggagugaaaaaaaaaucagaacuuuaaaaaaaucagaacuuuaaaaaauuacauccucagaggucaaugccacuaaaacgaaccucugcucucuuaaaaauguaaauauguuuuuaaaaacucaaaaaggcgauuucucagggaaaugggcacuguaaucaaacgagccagcacagcaggcucccaggcuccucccuucucccaacagaggccagcagguucucaacaaaggagcggacguggcaccagccagggcacacgacaggggcuuauggaacagacagcgcuuugcuccccagccucagccacugcagucccaccucgggggcugacggcaggagucagggcucagaauggaccccgggccagcccaguugaauuccaaucccugcucuggcacguaagcaccgugugacccugacaagucacccugugccucaguuucccaugagccacgucagaccaagacccccaugcaguagcugaggcuguggcucggcgaggugggcauguggcacagaugggcacgacaccaacaggagaaccucccaugggcacucaccaugcugcacccguguccgcacagcagccacgggcacguuauagaugcccucgagguaauuccugagguccacccuugucauucuggaggcgaaggagaaagaaaacggcaucuuaaccaggcuaaaagccaaaaauacugucccagaugcacaagcacccgaggcugagaggccgacagaccaagacccacagggggcagggaggagggcuggguacaucagcggcacuagugaggccaggcagccccagcaacaccagugcugcuggcugcaagacucccuacucugggcacaccagcaugggguggcaguggcacagaccccacagagugggagcacugcccaaccaaccccuggccugcuccacagccccacauggcucccugcuccgggcaagugccugugagaggaggugacagucucugcacgcuccuggcuggcaggugccccaccucgucugccccggggcccaguggccgcaucaggguuaggccugcucugcggcugaugggacugaugcgguucuaggaaguaccuucuggaaaggccugccuggcauucggugcguuaacugcaaguucccucuacugcagaaccucacggucacugucaacucagcuucugggccccugcaggcugcacaggccugaccuucgcccccaggggagcucacgcugcugccccgccuggcucgcaucaacccugagcuggggaccugugaacuuaaacacugcagagcagcaccccaguuuugcucguagggacugugcauuucucugaaggucaagcaggcucuucugagcgguucuguacaucacggccugcucccaacccagccucucagggcgccucuccuaaaaagaagcugcaagaacucaacagaagacgcgagcacagagguccaaauuuuaaggcuuccagugaagccguccccggguggagggcggcgugcagccugccugccgggcuccacaccuacaggcacuccaucaauacuugccgggcagggccgccugaggugccuucccagcaggaagaggcuagcacgugagcagaguuguuuuaacucaggacccaggccccccugagggcacucucccaacccagcgggaaaacuuccgggcucacuccacggggauccccccgagggugcuccccaaccccagccggaauccucccggacucacuccauggggauccggaacugcacgguguccucgggcugggccacaccgggccgcaccagcugaaugaagaaguugguucggaacacccgaaguugugggccacccagccgguacaggggguac

SEQ ID NO: 13226 - RNA, 5523 nt, Homo sapiens
guacccccuguaccggcuggguggcccacaacuucggguguuccgaaccaacuucuucauucagcuggugcggcccgguguggcccagcccgaggacaccgugcaguuccggauccccauggagugaguccgggaggauuccggcugggguuggggagcacccucggggggauccccguggagugagcccggaaguuuucccgcuggguugggagagugcccucaggggggccuggguccugaguuaaaacaacucugcucacgugcuagccucuuccugcugggaaggcaccucaggcggcccugcccggcaaguauugauggagugccuguagguguggagcccggcaggcaggcugcacgccgcccuccacccggggacggcuucacuggaagccuuaaaauuuggaccucugugcucgcgucuucuguugaguucuugcagcuucuuuuuaggagaggcgcccugagaggcuggguugggagcaggccgugauguacagaaccgcucagaagagccugcuugaccuucagagaaaugcacagucccuacgagcaaaacuggggugcugcucugcaguguuuaaguucacagguccccagcucaggguugaugcgagccaggcggggcagcagcgugagcuccccugggggcgaaggucaggccugugcagccugcaggggcccagaagcugaguugacagugaccgugagguucugcaguagagggaacuugcaguuaacgcaccgaaugccaggcaggccuuuccagaagguacuuccuagaaccgcaucagucccaucagccgcagagcaggccuaacccugaugcggccacugggccccggggcagacgagguggggcaccugccagccaggagcgugcagagacugucaccuccucucacaggcacuugcccggagcagggagccauguggggcuguggagcaggccagggguugguugggcagugcucccacucuguggggucugugccacugccaccccaugcuggugugcccagaguagggagucuugcagccagcagcacugguguugcuggggcugccuggccucacuagugccgcugauguacccagcccuccucccugcccccugugggucuuggucugucggccucucagccucgggugcuugugcaucugggacaguauuuuuggcuuuuagccugguuaagaugccguuuucuuucuccuucgccuccagaaugacaaggguggaccucaggaauuaccucgagggcaucuauaacgugcccguggcugcugugcggacacgggugcagcauggugagugcccaugggagguucuccuguuggugucgugcccaucugugccacaugcccaccucgccgagccacagccucagcuacugcaugggggucuuggucugacguggcucaugggaaacugaggcacagggugacuugucagggucacacggugcuuacgugccagagcagggauuggaauucaacugggcuggcccgggguccauucugagcccugacuccugccgucagcccccgaggugggacugcaguggcugaggcuggggagcaaagcgcugucuguuccauaagccccugucgugugcccuggcuggugccacguccgcuccuuuguugagaaccugcuggccucuguugggagaagggaggagccugggagccugcugugcuggcucguuugauuacagugcccauuucccugagaaaucgccuuuuugaguuuuuaaaaacauauuuacauuuuuaagagagcagagguucguuuuaguggcauugaccucugaggauguaauuuuuuaaaguucugauuuuuuuaaaguucugauuuuuuuuucacucccuuccggcaggcucuaacaagagaagagaucacagaaacgugaggaucaagaagccggacuacaaggucgccuacgugcagcuggugcgugugagcuggccagccccagcggggccuccgaggggcuccucgcaacuguguccuuggggauguuugugccggagacgcugcgcuggggcccagggagcccccgugaggccggaucucagggccucagcgcagaggcaggcuccacauaaggucaugcuccgucacggccuuggggguguuagugguggcgcugggagcacgugagcacuggggcacauggggcacgucucagcguccggccguuuugugauuuugaaguuugaauucucugugggcaaaggcagccaucacaggccuaguggguuucaacuccaacgcacaccagggugucagagcaugggaggccccggccucuggagagccuguccuuggcuggguuucagccucggaggcagagugugaggccccugagggcaaaggucuuuggugccaaggcaggucuggcuggccgggcuguuggcugaggcccauguccugcauugcaggguagcaggucccacguacuuguuagggcucagcaggcugcuucugagcaggugcuuucuuacguauccuggggggcucuggggaggaagaacccucaccccacguugccugggccuucaguuucugaaacccagacuugucaggagugagacccacaguuucaaagccuuucuuugggcucuucauuuugagucccaggcaaacccagaggcacuuucucucugggccaagauguccacagccugccccggccgccuccugggccuccccacucugccccuggggcuggccuuacuggguggggaugggguugucuuccgguguaaauggucccuggaggccgagccggcgggcccugccacuagauggcagucacacgaugguggaaaccgccuccugggccagccggccuguuguggggcuaaggaggcaguuugugaaaaaggccaaguuagcauggcagcuuuucugaaaaacagucacauuuguuguucuaaacaggggcccccggaauaauuuggccugauauuugcugugcaugaaaucagccaauccagguggggagagcagccguuggccucauaaaggccucugugugcucagugucagucgggcccaucugucuuugucauggcauguggguggacaucccgugugccggcaccgccacgggcacuucagaggcagcuacgguuacaaguggcauucaagucauccgagcccuugcguucuuccucugggccccaccucccaugaaaacugaacccagcagcuccgggauccggugucugcagcugcugcccgcguguuguucucccucugugaaguccaggcagccagagacagggcagggcaacugggagccugaagggucccaguugggcauggauccuccuguuccagaaugaaaauuuguaacggguccucaccccccuuccugaacuccagcacaucuuugcacagccuagaaaugggccguggccguuggucccugucugcccgcagaggggacucucaaggcccuuuccugucucgugucugcugagaccuugcucagcgugucccccugggcccugcgccagggcuuagaaucacugcuaauugcaaagcccagggagggagcauuggaaagguaaaauuauccacguuauuuggaguuggccgcuguggaaaggcccugucccacguggcgggagucccacauuucuuucuccgacaaccugauaagcaucuccuuggcccaaaguccugggagcugaaagcagcgccucagugacccacacaacaaaaagaccauugacugcccgcugccccgaggcuuguguggaugcugagcagcgcgggaaugaagggcgcgcaggaaugaagggcgcacgacaugagaggcaacuccagaacaaaccgcugccgccagcugggccgagcuccgugcucggggcuccggccuccagguccaggcaggcggcagcccccagggcgcccugggauuccugaaggcagggcugccuuguuuacuugucauugggacauuuuucuccauuccuguucuuuaccccgaucagcugucucucuccuuuuuggaaggaucaagggcuuuuuuuuuuuagguacaaggugaacucuucuagaaaggggaagccccugggaaaccaugcuuggcauccccaaacgguguuugucuccuguaagaaacggauuuucucucagcaccuuuccccauuucuucccgaagcugugacaaauggccauguuugugcuuuaaacugucauuuuggguuccccuugccucggaaaacuagcagaaucaccuccauauagucaaggugaaucucccauucugggcagucagccucacguguaaacgacugccccuugguauuuuaaaagacgcaaaguucagagcuguguaaggcaauccuccugcaggccggcuacggcgcacgcagugccacucuccccgccagccccugcgcucugcgccagggaucagggugcauacaccucccucgcagggugggaucugggccuguuucagaucauacuuggcugccugcccacauccagauuuauuuacacacaaagggucugcaagagccaaguguaccugacugauuuuacucacuaaaggguuccagauucgggugccauccucacuccuccucccucuucucuucccucuccucuggucugcucuuucugccucuuagcuuuggagcacuuaguaaucauuagcaaguuaagauggcuucuuguauuugcuuagguccccaaggagcaguauccccuccuucucgugaacccgagccacaugcuguggccugggcuggggcuuggcugacacggacauauucugaacucucagcagaagauguaagaccaguuaauuggcagagccgguccugauuuaucaacugccgcacgugcauguuucuucguacgugauguucacuuuaauugccaggcucugggcugggaggagggggagcuuuaaugugaguagagccugaggcauuuuggauggacagguucagcaugguaccagacgugauuugugucauguuuuuccaugccuuguuucugccccccaccaaccagguggccccgugcuaguaaaugggugcacccagggcgggggcagacaccaggcccuaaagagacaaugguggggaaagcggcccuguccuggagcuguggccucugcugcagcgugacagccgggggccgguggccgugggggugcuuacauuccaggcagggacgcugccccaggaggcccagggagguaccucugagcaguugaauccggcgccggcagaaaggggcugccagaaagcaugaggcucccccacagaccccucugcugaggagucuuugcagcucuggcuggagccuuuguucucccccuuaggcccauggacagaccuucacguucccagaucuguuucccgagaaagacgagagcccugaaggcagcgcugccgacgaccucuacagcaugcucgaggaggagaggcagcagaggcagagcagcgacccgcggcggggcggcguccccagcugguucgggcugugac

SEQ ID NO: 13227 - RNA, 15569 nt, Homo sapiens
cagucagcuuuuacgagagcugccagacagugucuguucacguucuccagauaccaggggcgcccugacaaaguuaaggucaaguuagugucuuaucuugggugacucaaaaucaccgcaucgcguccuggcgcugugcggaaagcucuuucucgcggagcggcuggcugcgccccgaaggccuggugcgcucccugcguuucggguggggccgcgcaggcaaggacaaggccacagagucggggucuucacgguagguucucgagcgggacgcgcggguccggaggcugcgguuuucccuggguuuggggaauggggguaggaacuaggagggagcuggggccaaagagccaagcgggcugggacuggaaugaaagcgcucuggguuguggagugggucggggggcaaggguccgcgcuaaggagccgaaaggggccggccgcccccuuccccuaugcaccggcgcgccacugcagauggcucacccucccccgccaaaucgcugcucccgccggagcugccgucgccaugucguugaacuugaaugguucguccuccccuuuucccucuucggcggucagcaggcuccauacugggggcgccgggcugccugcaccccaccccgugccgccaguagagagaaggugcgagaauuuugcgaauccccagacacauaaagacccggguugaaguccucgcagcugcccuggguccugagcuaccgcagggccagugugcagcguccagggagccauuuuaggagagagauccaggggcgucgaccacgagcccgaaagggagaggcuugggccugggauggagauggggaggcagauaagugugcugggggucuggguugaggagaagaaugucagcuggaaucugggcgggggugccagcugcggggagggagcacacaagaugggcaguucuaguugggggaggcucgaugcccuccagucgccacagaccuauuugcgcaguguugggggagggaagaagacaugggaaggggcggaggaaggagagaggaagggagaaagggagggaggagaaaaagaggaaggggggguacaucagccagaaaauagauauuagcucagaccacccgccuuuucucugucuguccgcacggugggcagagcgcacagcaccggcacugcagcagcccgggccagggagggaaccagcaucacagccagcgccgccugcccuggguauaggacugaggcccaggccccagcgcugggauugccugggcggaggaaucuuggggaaaggggcagccuccugcccucgguucugggauuuggguuugggaagagacgguuuaccuuugaaaagcgucugcucacucggaggugggaucccaggccuugccuggacccaugggcuaggagagggucgcggcaggcugggaggagagugaggccuugggggaguggauggggugccccacgaagagucugccucagagccaggugacacagaggggcuccaggagggagucaggcuccgcugagagcccuuagagagacaaccuaucuugggggaggggcugaagugaccaugcagacccaaggguaccagaagagccucggggaaacgcggcguggauucgcaggccuuggcggggcuccgaagcagugaagggucuagguauaaggcggacacccaggcuaggccugaaagcagaggggugaggaggacgaaggugcgaguguguggggguugucucuuguggggagccagcgggaagccaagcacccuaagaguaggacuccagauccuuuuguucaccagacuccccagauucuagggaggcuggggaccacgggcugagcccccuccuggcuucagugcugaaggagaaggcagagaggcaacggggagagagacagagacagugacacacagcuuagaggaaaggaggggagaggaugagaggacagagagagagaggagaagggagacaggaaagcaagaggaaggaagaaggaaagcggaaaagaagaggaaggagagaagugaagacaggagagagaagggagaagacugaagagaaacgaggcaaggagaaagagagacaagaacagagagggaaaccagagagaagggaagagagccgggugggcacgaaggccccggccugggugagugccuagguggugaauggccuggguuuuuccgaggccagcacucgcacccuuggggucagaaccggaaagagccaagucacuccacucugaacgcgcugggcagaaaaauauguaaaucagggcucccugcgcccuggagaguggcgaaauuacucccgcccggugaacaagaagcaacaagcucccaggcgggugagcugcagaggguggcagagucgcgggggagggagcggcugcaguaaggggggugggguucggaaccucacacccucacaccuaguuccuagcuucuagggagccuggagccggggcuucccccccucugcucgcugcuucucucccuucccccuuccucccccucuucccccuccuuccuccuccccgccggccucgguccgcguacuuaaagcggcgcgggagggcggacgcgggcgggcggcccguucgggcgguggcagaugcgcccagcggugacagcggccagcggcgcgcaggugaccggccugaggcgcagccuggucagggagcgcccggggagagcuggcggcagagggcagccgauccgcccccagcgcgcgcgucucggcgccaggagccgucccggggcguguuggcgagcguugauauagauauaaggacauuucucuucauggcgucacgugacauaauuaccaccagaaucaaucaagaugaauugcacgucagcgcccgguggggauuuuugcuuaguugauccuggcccaagccucuugugcaaucgauggcucagguuggcugcgcggggagcggccagaggcucgcuggcgcgcacgccgcggagucaugaacgacuuugacgagugcggccagagcgcagccagcauguaccugccgggcugcgccuacuauguggccccgucugacuucgcuagcaagccuucguuccuuucccaaccgucguccugccagaugacuuuccccuacucuuccaaccuggcuccgcacguccagcccgugcgcgaaguggccuuccgcgacuacggccuggagcgcgccaaguggccguaccgcggcggcggcggcggcggcagcgcggggggcggcagcagcgggggcggccccggcgggggcggcggcggcgcggggggcuacgcucccuacuacgcggcggcggcggcggcggcugcggcggccgcggcggccgaggaggcggccaugcaacgcgagcuucucccgcccgcgggccgccggccggacgugcucuucaaggcgccugagccggugugcgcugcgccggggccgccgcacggccccgcgggcgccgccuccaacuucuacagcgcggugggccgcaauggcaucuugccacagggcuucgaccaguucuacgaggcagcgcccgggcccccguucgccgggccgcagcccccgccgccacccgcgccgccacagcccgagggcgcagccgacaagggcgaccccaggaccggggcugguggcggcgggggcagucccugcaccaaggcgaccccuggcucggagcccaagggggcagcagaaggcagcgguggcgacggcgagggccccccgggagaggcgggggccgagaagagcagcagcgcagguaggcaccggguacugggcaagcggugggcccgggggccgcgggggagggggggggggcggaggccucccucugcuugcgccuuuuuaugugcuacuuuauaagcauucgaagagguuuauacauccuauaagauuuccugggccguuguaaaguguguuuaugguaggaaaccaauuuaggugggcuuaagguagacuucgaggaggacauuaauagcugucgagagccuuuucccaguuuugggcaggggguugcuagauaccauggagggagggagggagggagauuucaagccagugugagugcauacaccggagccuccugcuuuuaagggagagaggcgggggguggggaaguggggggaguuugauccuugcacuggacuuuauccaagccgcuagcugacgcgcgccgcuggagucaagcagaugccccggcgggccugcucuugucucuguucccucagguuccaguuuagagccugccuugcccucugcuuccccaccuccgugccaggcucuguguguguguguguguguguguguguguguguguguguccgggcgugaacacauguccacgcccgcacucucuccugugcccgcccauauaucaucccccacgacgcaggcagggccuuucggccgcggcagagaacguccccaacggggccagggccuggcccucgcucaguggcccgggcgggcgggcgggugggggcugucaggcagcggccucucucacccccuggucucuuugccuugcaguugccccccagcggucccggaaaaagcgcugucccuauaccaaguaccagauccgcgaacuggaacgcgaguuuuucuuuaacguguacauaaacaaagagaaaagacuucaacucucucggaugcucaaccucacugaccggcaagucaaaaucugguuccagaaucgcaggaugaaagaaaagaaacugaacagagaccgucugcaguauuucacuggaaaccccuuauuuugagagcuccaggaagcgcccucaccccagccccacucacccacccuccuucccaccagccugcucuccgcaggcccacuguccuuggguuuaaugacgucucuucucuguggaacuucacgauuccuucccacggucaacucgggaccucccagcgaccacugcagccugcggacgaggccgggacuuggccgagcggauccuaauaaggggaaaaugguaaaugcaaacgucccguuacaauuuuaccgccagugugcugucguucccccucccccucuccgaguccucguggggacacggcggggucuguaggaaguugggccggguuggggguugcuagaaggcgcugguguuuugcucugaguuuuaagagaucccuuccuuccucuucggugaaugcagguuauuuaaacuuugggaaauguacuuuuagucugucauaucaaggcaugagucacugucuuuuuuugugugaauaaaugguuucuaguaaaauggagguuacagcuucaauacacuguaugaauucuccucuuugagguuuagugccuccuuaggauauuuuaguggccagaacccaugcaacugaaaaucgaaugaaauacuuuuuagucccacuaaaauaguagucguacccucccaccaccucuagguuacacugguuuuaaaaaucauguuagugaugaauuucugaauugacgaugugaccaagcaaugcuggcgcugccuucuccaggcaguaaggcuggggcagcaggaaccuaagaagaaaacucccacccccaccacuagucuagugaacuugggauuucugaaaagacagcaaccauuuuuaaaaacugguuagaaaauccaaaugaucucuuacaagcuaacaaggagucacagucccuuaaaaaagaagaaaccaaaauuagaaacuuccauugaagggagaaguuuucgaaaaggaagucaucaguagguggagagggcuugcuggugucauaaguggaccuggaguagggaagguaaacccuccccgcccccacugaaauagggccaggagcugcagacccucucacggcauuuaucgcuucaaguuaaagaauguggugagggcucuacugcacuuuauguugcagggccaggccaggcuguuuacaaaaccuugaacugucuagacaacaccauaaaagccaaaguucuaaacagcuuaauuggguuauauuauacaccuucuggugggcccaaaagagauuuccgcaaugugcaauaaacuggagaagugagaaaagcucucucucugaaaagagugaagugaaucuuaugagucuuaaccucuccuaagcccaaagacaaaauauaaaucuauaaaugcacaguaccccaugcaucuuccaaggagucaugcacuucaaaaugcaauuaaaaaaauugcuaagccuuauuugggaaggaaaaaauaagugcauaaauguaugccuuugaacuuccaaaaugucaaggucaucaccuuuaaccuuucugaauaauuaggcgccuuaaguucuucuugauuuucagcugccacccacucucacacauacaugcucacacauauagagagccacacacacauuuaugaccacacaaaaucauaccaggagcucaccauaaaucuaagaaaauuccuaauuucaggaucaauaaccuuaauuucccugcaaacguuuguguaaugcaauagcagucaacuucuuuuuaaaaauacugauuagauuaaaaugccuucuagcugcuuucacuacagcuaggaaaggcugagaauucuggcggggggucuuaaauagugguccccuuugcuuuaaugaagaacuacaguuuuaaaaucaagccuuugaaagaggaaguucugugcagccuuacaccuucauuaaauuugaaagcaauuugccacccugugaaauaaauuauugcacuuucuacaauaaggaacaaaaggaaauauaguuauaaugcuuuuaaaagcauccuuuggugaaagaugcaauggaaacaaagccuacaaucgaaaaauuucguuaagaaggggauuccuuugguauucuagacaucgguuaaaaugucagugcccuaauagugugaucguuccaugagcuuaaaacuguuuuuuuucuuucuguuuccaucuauuuuuuaaaacugcaucuaaacguagcaagcuugugugcccaccacccaaggcaagccgaacccgagauaccauuuuccguuugcaggggccuggagauccacacgagggcgcgcucacguuccagaagccgcguuugaccaagaggccgcgguaccuugucuguccaacacuggauucuaauaggcgaccucaaccccuuagaaacaggcggcagcuaagguguuugcuaguuuauuuguucuaagcagccaugaggugugagaaguuguauagagacagaaaacggagcaacuagauucacgaaacagccuaaucuuugucucuuuaaagacaaagcuguugcaaaagaauaccuugguauaaccagaugguguggagcagaguuuuaaaagauaaauguaugcauuuugaaagauaccauagccacugcugguuaauuaaauuagggaaaaucaguuuucuugguuucaguguggagagccuugucuaggguuggacacccccuacuuaacaucccccucccccccgcaaaaaaaaaaaaaaaaaaaaaaaccuucaucgguuuuacccccucucagaccuccugggaugauuaaaaggcuuuuguuuauaacagaucagggagcgggccacuuagccaaaugucucucagaaaaaaauaagacgcaugggggacugggagaaucguucugggagcccgcggccgugccuggagugcgcggcuaccaguggcgaccgaguggcgccggcaggacugugaguuggugugcccaggccgggcugggcugaugcggacacgggaggcagcaggcacucgggggaaacguuuauacuucaaggcguuguaaaacggggaauguauuugaagcaaacgggcuuugcguuugacagaaaacuggccacccuuccaagcugcacgccggucuugagcagaguugaauuguggcucucagaagcagugcauucguugcgugcccuccuuccuccagcaaagccccugaccuuggggagggccuguguccccguucggaguucacaagagaggagacagggcuccccgacauuggccucucuaagggaggaugacugcccccuuucccuccccgaaguucauugugaagagccugcaacccccagaauuagcgcuggccuuguuggcccuccaagcccuggaccaaaggcccuggggccugccgcuugccccucucccggagcuggccucagcuuugguggggaggccggggcuccagugagccccccggcgaggcuccaacgaguggcguggguguuccccgcaggcaaccuuggcuccacuagucugaccgccgguccaccuugucuauagugacgcuaccuuucccgaggcugaacgggguccucggucuaugugaagugagagcugcccucccuaaaugucguuguccucucaaggcggccccagcggcugcacaucuggcugugcgggggccccuuggacuuggcuggcagccgccugcgaaacaccgcuucucagcggucugcaguuccuuuccucccugcgcccaagaugggccugacaagggcccgggaucagaccagaaccucugggggcugaagaccucuccccacccccaucuuacaaaguguguggggcuugcggagaguggccuuggauccuaaggcgccaaggucucagacucugaaguggaagggaaaugcgcgaaguaggagucuuuugugucugugcagaaggagguucuccggccgccggcccuuguugcacgucuggauagaccccuuauugcauuggugguagacuccccauuugcccccuagauuuccuuucaccuuggcuuggaggugcacagugcaacccggaggagcgcccggggaagacagcuuuuaaucgacuccauccgcucuguccccaaagagugacacagcccagagguggcucagaacccuaauccggggugacccuaagagcccacagguccacucaggcccagggcuucaacuuuucuuccaggagacaagagugcagaugcaagccacuuuuugauuacaaaugcuaauuucuuguucaagcuguucuuuuaauuuuucccuggaaagaacuguggcagggagaagggcgucuugguacaaauauggguauucaucuccuuuauggugcaauauugauuuauuauuaaugguaacugcuccaacugaucuaaagaugauggaaaacaucagcuacauuaaauacucauaagcaaaauaaaggcuggccuguagagcacggccuuuuuauuccauuugucucaccucagccuuagagucuuaggcacacuuuccauccuuuggggcucggaucauucuuuuguauuauuucuaucuugcucaauuuuuuaaugauaaaauaucucaaaauauugacagucucuugucucaaggagcgggucugaaagcagaaauuuuaaagauaaaaaauagaauuuugugagaacagauucaaaauuaugucugauauacacauuuuugucugugaguaaaaaccuauuuaacucuaaccaauaagggagugacuuugagcucaaagccacugaaagcugaaauggaaagguccccaaauucugaagacacauccugccuauucuggcucacugcagaccuacccgcccgcaaggaauugcuuguuuuuagccuguauguuuucuucauguauaaauaaagauuaugaaagggcauuugaugggcauaaaauucccgauuagauuaaacagucuugccuuucuuaggguagggaaaauugggcaaacaaguucccagcagcucuucuggccaagaggcaaaagggcgacacucgauacugcuggagcgccaagcuagugucagggcgccugcggcaagcgagugcagcgggcacuucauucagcuuugggcacgcuuagcccuggcuugaaacaagaucucuacuaugugagaaagcaaauuucagggcgcuggucaguggcuguuagcuuugaacaguaccuuagcaaccuagagucaaaaguuauguuuugucuuguuuuguuuuuccggccauccucaacccccacccccaagcucgaaaacagccaccccuguggaaagguaauguuuaaaccccaggcuaugcugggaugcugcagccaaagcaguuagaggcgccaggcuuuuaaccugacaaugauguuguauuugaacagcugcguaaagguuuaaaaggucugucucauugccaccgcggaguuuuuuaaaagagguuauuguuugggcgagagcaccgagagggaacaggcgaaagggucccaaggccgaaaauaauguucaacgcuuguuucaaccaggccaggggagauuccuuuuugggaagagggacaaaggguuuuuugggaaagguuuuuguaaaggagcgggcgggcuacuaggucccccagaaugcugaggcgcuuuaaugaaccucaggccccaaagaaauguucuauugagguggaaacccaauuuacccacaaguucagucucugggccugaaauccaaggccagcccaugccccagcgaguacggggaaaagagaacacagaugcccucccggacugagaacugguucauggucagaguuucugggaccgcuuuaguuucuuggcuggcaggaagggaaccuggcaggccgaaggacggcuccaagcccuggccggccccucacucagggcaagucuuuggaaaucaagguuaaagcuccccgcugcugccccgaggcccgggcuuccgcagggcggcucacccgccugcagcaagagagggagggaggaaguuguugaaguuucucauaaaacucugaguuuccauggugguaguggugguaguggugguaguggugguaguggugguucuuuaaugagccggaccacaaccccagaccauauccucuucauagaaguuucccucaccaaaggaaacagagaacuaagauucccaccuccuuccccucccuuacccaagcaaagccuugucaaauaauuucagaaauuguccaaaacuguaaaacucaacuucugacaaaaguauagcuuuuaauauuugacaauuuguauuaaaacaaaaaugaccuucuugguuagcagcgaagggaaaaaaaucaauaguauaauuuucaauaauucauaaagcgaacgccauuaugguaaauuuaacuauuaaucuuauccuuuacaaagucucgauugauuuguuaauaaaguaucuucccguguguggcaacagcgggcauaacucuuuaaaaaccuucagaagcaagaaaauuaccaaguagcccaagaauguagaugagaauuuuauugaucgcccugauucuucuuaauauguauuaauaaauuccacaaccuuuuguaccuugcacuugucagaaaccagugcuuuuacaaaauccauaaaaggaaaacauuuuucuuugcagaagaaccaaaaugacaccuuugcauuucucucuguccuucuuggcccagucaguuuucuaaaacuucuggauucugagggucagaguuuccccuuuucuuaaauuauuuuuuccuuucuuccuuccuguuugcccuccauuaucaggguguggggagagaaaccucuguuuaguucuccuacagggagcccgagggacgcuuucgcggauagugaacugcuggcaaagaauugucucugggcugaaagcucccagagguccggccccgcagaggucagggugugguuccucugagagccgaagccucguguagcccuccggggcgcauaggaacccggagccaggcaggaggaccgagcgggaggacaacgcagggaccaacccauccauggggauccgggcccggccagcugcuuggccucccggcccucgcggcccuuuuugccuccgcccuccuagagacaccuuggccgcuucuuagccccaagggaucuuuccuuuggaccccuggggugggaugucucagggcccgcggaauccgacucaccuucccgcugggcugcccgggacuaaauuaaccagccugcgcccccacccgcuuguccuggacccggcccucuuaagcgcguucugccugguuguguguggggggaaugcuucugugcgcuggcgccagggcacucuggcuucccuccccguccgugcguguccacuuggaggccccuagagcugagacuuuccuuccgccgguugggcccaggggccgaagcgggggacgcgaguggggcgggcuggccgagcgagcccuggagaggcggacaggagggcggcggagagcgcugggccgguugucuccagcgcgcacuaucgcgggcgcguaguagaugucgcuguuguccgugcuuacccggccggccggccaggcucuggagcacgugacccgagaggaggcugcggcucaaggccauuuucaaaucucauuggcuugguugucauguggucggcagaggcauccacaauuacacggggaauguuuuccuagagaugucagccuacaaaggacacaaucucucuucuucaaauucuuccccaaaauguccuuucccaacagcucuccugcugcuaauacuuuuuuaguagauuccuugaucagugccugcaggagugacaguuuuuauuccagcagcgccagcauguacaugccaccaccuagcgcagacauggggaccuauggaaugcaaaccuguggacugcucccgucucuggccaaaagagaagugaaccaccaaaauauggguaugaaugugcauccuuauauaccucaaguagacaguuggacagauccgaacagaucuugucgaauagagcaaccuguuacacagcaaguccccacuugcuccuucaccaccaacauuaaggaagaauccaauugcugcauguauucugauaagcgcaacaaacucauuucggccgaggucccuucguaccagaggcuggucccugagucuugucccguugagaacccugagguucccgucccuggauauuuuagacugagucagaccuacgccaccgggaaaacccaagaguacaauaauagccccgaaggcagcuccacugucaugcuccagcucaacccucguggcgcggccaagccgcagcucuccgcugcccagcugcagauggaaaagaagaugaacgagcccgugagcggccaggagcccaccaaagucucccagguggagagccccgaggccaaaggcggccuucccgaagagaggagcugccuggcugaggucuccguguccagucccgaagugcaggagaaggaaagcaaaggucgguaugagcagaguugccaccccagcggggcgcgcagcccgggaacccggcagagagggagugccggggugcccagcgccgagccggagcccgacuuggcaggugcugcuccgccugguuuuagaggggugaucucagcccugagauaguccccgcuucuccccugcugcccuggcccucuccgccaguccuggccccacgcugauggcgcccgggcagaggaaaagcuugccgguuuuauuuuuccugagcuagaccugaacacaacaaaagagcgcaaaggagaccugcggcucauaaacacgaccacagagccucuuuucuccugcucagauuugcaguuccaguuuugccuugagcccaaugaucauguuaaggugauccagggcaccguguucguguucaaguguaugcaccccgcauccugcgagcuuggggguggugaggggaaagagauggcugggcugguuggugcuugaguugggaaacagggcuuacugccuuugcugggcuagguaaccuuggcuuuguuuaggaaaagugcugcagucuuugcaauccgucggcaaagagggcaaaggcggagggggagaguggaacccgcauugcccucccugcaaggccagccuuagggcugggcuaaggcaaagagccagggaucuggcuuuuugagaaggaacccuccuccucucccccagugcuuagaggugggccacaguagggggcucccuuucugggggaaugcuuuagugugggggcaagaagacaugaaaauuaaggaaauucuggggaaugcaacaauacccaggcaaggugggggaaggugucucgcuuccccauuuaucuuuugaaagagaaugggcaccuauaaaccugacugucaggauuccugacugccuaggagagguggggaagaaguggcagauuuggggaccugaggcagcagugggguugguaggcuuguccaggucguggcguauuccccuccgucccuguuaggagcugaacccuuagaauguugcuggggagaucuggaaaguuuacuauucuacuaauguuuuguacaagugagaaaguugaaagagagagcgagaacccaaaugcagacuguccugccaucaugucauuuaaguaauguggcaucaauguaagauucccuuccaaggcccacuucaugugaguaauguuuaauacuagcauuuuccaaagcggccuggcugccagcagggucacggccaaggguacauuugaacagucugaagaaaaaaacaaaaacgaaaaccaaaaccaaaaccaaaacaaaaacaaaaacaaaaacaaacaaacaaaaaaccucuugauuuuuuucuucuucucccuuuaauuuuguuagaggaaaucaagucugauacaccaaccagcaauuggcucacugcaaagaguggcagaaagaagaggugcccuuacacuaagcaccaaacgcuggaauuagaaaaagaguucuuguucaauauguaccucacccgcgagcgccgccuagagaucaguaagagcguuaaccucaccgacaggcaggucaagauuugguuucaaaaccgccgaaugaaacucaagaagaugagccgagagaaccggauccgagaacugaccgccaaccucacguuuucuuaggucugaggccggucugaggccggucagaggccaggauuggagagggggcaccgcguuccagggcccagugcuggaggacugggaaagcggaaacaaaaccuucaccgcucuuuguuuguuguuuuguuguauuuuguuuuccugcuagaaugugacuuuggggucauuauguucgugcugcaagugaucuguaaucccuaugaguauauauauauauauauauauauauauauaaaaacuuagcacguguaauuuauuauuuuuucaucguaaugcaggguaacuauuauugcgcauuuucauuugggucuuaacuuauuggaacuguagagcauccauccauccauccauccagcaaugugacuuuuucaugucuuuccuaacacaaaaggucuaugugugugguuaguccaugaacucauggcauuuugaauacauccaguacuuuaaaaaugacauauauauuuaaaaaaaaaagauuaagaaaacccacaaguuggagggagggggacuuaaaaagcacauuacaauguaucuuuucacaaaugaauuuagcaguuguccuuggugagaugggauauuggcgauuuaugccuuguagccuuucccuuguggugcaucugugguuugguagaaguacaacagcaaccuguccuuucugugcauguucuggucgcauguauaaugcaauaaacucuggaaaugaguuca

SEQ ID NO: 13228 - RNA, 1800 nt, Homo sapiens
caucuuggugauuucuggcuggcgagcaaucaucaggggcuagguugaagcuagucuugcccaccuggaaguugccggccuccauuacaggagcaaggacaaacagcaguguagcacugcagcggauccaauucugcccccuuucccucagcccuacccccaucccaagcgcaagacagccagaccccagagaagccgaggaugggugaguuuucccaucccacuucgccuugaucuccuuguggacggguuuuaugcucagucauuaccuuuuaguggcccacaugaaauuuuguuaaaggaagaaaugaaaagauuuuccccagucagucuuuccucuauuuaauuacaaaaugcuggugggaacugcugcaucugggaugcaagaaaaugcagaaagggugacugaaaauuuugcaaaugaacaugacuucccaugaagucuaauguuccauucgcugccaugguccaggggacucccaccagcuuccaccggcuucaacaggaucuccacuagagagcccagacuuaucuaguccugucggggaaaagggagaagaggccuugcaggagaaagcuaacagaaaauucguuaccugagguccugccugcaguuucaaauagcuuccagcaguuuuacaaaacacauccuuuccauuucuuccuuuuaaauguuucccuaagaacgauccauuuaggugcuauaaguccucagccagggagucucugggacacuggcauucaaaauuuuaaacuuccgccccaaaaccaggaacauuccaagacagaacucuuuuagggggccauuuccugggggugggggagagggcuuggaaucaaugcuagauugaaaacguuguaauagcuuugccccagacuuaacaccgguugggcaggaggaggguaauuuuuauuuagccguuucuccgaucauguggggaauaccauuagcuguugauagcgggccauguauccgaggaaagccugagcuacaaggcaaaggcaucccaucuggaacaaaaucagaaagcuauuggcaaagguaaucaaucaggccauaaauagccauuuacccgcuuccuuuucggggcuggaggugggccgggagcccuccaagggugagcugggcaacuuguagagcaaggaauaugcccuccgcugccggcgccccggccgcuuuugucugggcucccagccgggcuuccgaggcuuuguaccauggauuugggagugacaaugggcauuucccucagauucaaggcugcucaaccucaccucuguagggggaaaaaaaucagaagggagugucccaaggaccuagccauucggccgaauuuuuuagacauuuugggagucuccuccgaggccuuuaagugcgaaccgcgcgaagcggcccugcccggggagacucgcugaggcagggcugaggcggcgggcgggagcaagcugcucuagcauuuggguucugcccuguggcguguucucuuccagggccuuuccagcaucaucggagaagacgaagcacccuggccgccacuguccgugcugcgccaacucgcccggccgcccgcccuuccgagggcaggcagaagccccucuguguccuccaccgccgcgccccggcucgccccucgggccgcggcgugugcccagccucacgucgggguguguguggccgcgcgggcgugugugaguguggcagggggagggggcccuccgaucugcuccauccguccguuuuauuagggacacauuaaucuauaaucaaauacaccucauaaaauuuuuauugaaaggcau

SEQ ID NO: 13229 - RNA, 2514 nt, Homo sapiens
cccgacugcgggaccgagggcugcaagaagaagcgaacaaauaguccccagcgccuccucuggaugcggucgcgucugugguccuggcagccgcugggcgggccaggccaggucgggccgggccgagccgggcacauggaccugggccugcgggcucuaauugcggcgcuuauguugaugauuuuuuuuuuaaucacagcagcccccaguuuagcggacugauuuacucccgguauugguaaauaugaucacgugggccgcgcgaccaaugguggaggcugcagccugcgaacuagucgguggcucgggcgccggcggggagcugcucggcggcggacaguguaauguugggugggagugcgggacgccucaaaaugucuuccaguggcacccucagcaacuacuacguggacucgcuuauaggccaugagggcgacgagguguucgcggcgcgcuucgggccgccggggccaggcgcgcagggccggccugcagguguggcugauggcccggccgccaccgccgccgaguucgccucguguaguuuugcccccagaucggccguguucucugccucgugguccgcggugcccucccagcccccggcagcggcggcgaugagcggccucuaccacccguacguucccccgccgccccuggccgccucugccuccgagcccggccgcuacgugcgcuccuggauggagccgcugcccggcuucccgggcggugcgggcgguggcgguggugguggaggcggcgguccgggccgcggucccagcccuggccccagcggcccagccaacgggcgccacuacgggauuaagccugaaacccgagcggccccggcccccgccacggccgccuccaccaccuccuccuccuccacuuccuuauccuccuccuccaaacggacugagugcuccguggcccgggagucccaggggagcagcggccccgaguucucgugcaacucguuccugcaggagaaggcggcagcggcgacggggggaaccgggccuggggcagggaucggggccgcgacugggacgggcggcucgucggagcccucagcuugcagcgaccacccgaucccaggcuguucgcugaaggaggaggagaagcagcauucgcagccgcagcagcagcaacuugacccaaguaagugcaaaagaaauugcccccugauuuauugcugaaaccuguaaggcucgaaugugcaaaacugauaguuuuacuaaccuauaaaaacgucuagacgccuacccaagccuaggcgaacaacaugcauccauaaaaagagcuucccauaaccaccuacccugggcgcucaguuaguacgguaaacagagcgcgagcauuaaggcuuuuuaugauaauuccccacaaguugugaaaagcgaccauccuuggugaaauuaauuuaacgaccucucuuccccacccuguggucucucccugccuccccuccucuccucucuccccgucuccaaaccucccucuuuguagacaaccccgccgcgaacuggauccacgcucgcuccacccggaaaaagcgcugucccuacaccaaauaccagacgcuugagcuggagaaagaauuccucuucaacauguaccucacccgggaccggcgcuacgagguggccaggauucucaaccuaacagagagacaggucaaaaucugguuucagaaccguaggaugaaaaugaaaaagaugagcaaggagaaaugccccaaaggagacugacccggcgcggugcuggcgggagcgcucaagggcagcggauuuguuguuguugcuguuuuccuuuguggguguuuggugcuugauuuccagaaacucuccagcgacuuggacuucuucuucuuuuuuuuuuucuuuuuagauagaagugacugugugguuggucucugagguauuugggggacucuguauuugcucguuuacguguuggaaaaaccaaguggcuuugggguuucgcccuaucccacucccucucuuuccugcuccauugguuccuuaagaaaugcuauauuuugugagugcaagcuggcuuggggagcccucucuuguguaaaugucccccauguuucugaaaagugcuguaguuuaguccccucacccccagcacugcccaaacaggggccaagugcgccccaauuccaagaaugaaggcagagcgacaacagugcggacaccccggcugcuagcccacggugaagcccggcgggguugcccaccaguugcgaaagcccccuuuccucagggagcacgcgggaccucgguggagaucuccagugaggcuuagaggagcccagggccucgggcggguugggguuuguccucagugcauuggacgcgcugcucucuccccugaaggcugggcucgcgugggcggccgcgggugguggcccucccgguuccugcccgaggaccaguuguaaauguuacugcuuccuacuaauaaaugcugaccugaucaaauggagcccagacgcuggcccuaaac

SEQ ID NO: 13230 - RNA, 13518 nt, Homo sapiens
ucgcgccugccccgcagccaaguuagccaaagcagcccagggccgccgcccagcgcccccgagccccgaggagagccgucgcgaccgggggcugccugggcaagggcggggcgagagggcagaacgccugcucucggacagguauugggcgagguggggggagaaaggcaggacuggacgcuugggugagggcccguggaugcagcggggcgagccgcuucugcucuggaucguggggggggcuagucccucgagggcggagugugggcgucgcggcauggaaaagguuaaaugggagcgugacgcgcggccgguggagacugcucuucgcccaccuccaggacagauaaaguuauuccucuuccccucuucugaguccucugcgcuuucgguuugcuuggcgcugauguuaucccucuucuaaaccuagagcagauguuugguuuuuuccuuucuucccccuuuccuaggacucauggaacuacaucuuaugcugugagugcugugugccuagggcgggacaaaauuuucacuuuuugacuaggcuuccuuuuaacgugacuuugcagcuuucuucuaucccucgcaauuuguggcggcgugaugagggccaguguuguagugccagauuuugauaaaguuucugccuuguggggugguuuagcagauuuuccccuccggcuggguuguuggaauaaagaauccagaguggugguggaacacuccuuaugcuccuuucugggagacuggcacaggcaccggugcggcgcuugcuuucacugaggagcuugucuggagggcgcaagggcuuaccggggacgggugagaucucagagguuuagauggacuuguaccucgaagcaauuagagcuucugcuccaucagauaagugcugcaucgucucuugugagugaaaucugagggcucacaauguuaaugggcucacgucuuucccuugauaauaugguuuuguuuacugaguguagagagacgggaaauaaaagugcaauugccacaggaaaugaagaguagaaagguuacaaagaccagcuuuacauugacaaacuuuccaacuuccuuuaguauuucuuuuaauguucccuuuugaggggacuguaggaaaauuacaaauuagauaaauagagguuauuuacacacaguaguuaugaaagagggugguuuccuaaaacccugugugaauaaagacucuaaagagucuacucagagcuuauaucaagugcccuugaaaaguuaaucuauuacagccucuaaguuaugguaaccgagguuuuaucauuguuuuacugauugacuugucauaaaagagcgauugagcuguuguugccuaaauuuccacucugaggaagucuuuagaauaggcgccaucacagcccagggagccaguuccuuccaggguuguggacuugugaauaaacaaagcccuaccaaaauguggacuacugauggacccgaaguugcugcaggaugggggagggauguccccagguugaggggagccaguagaggguggaugccuaggaaucagcacaaaguuaaagaggucugugguuccugcacugcuggaguucuugaguuugauuggaaauggaauaccugugcugaaaauagcccuucaaucuugauuuugcuauuucaguugugcuauagccagucagauaagguccuaaauaauuuuuauuuauuuauuuauuuaauuuuuuuuuuuaagugcaguggcgcgaucucggcucacugcaagcucagccuccccgauucacgccauucuucugccucggccucccgaguagcugguacuacaggcgcccaccacuaugcccggcuaauuuuuuguauuuuuaguagagacgggguuucaccguguuagccaggaugguuucgaucuccugaccucgugauccgcccgccucggccucccaaagugcugggauuacaggcgugagccaccgcgcccggcccuaaauaauuuuuaagaagagaaaaauaaaaguucuucccuaacaccccaguuaggaaauguuagagcucuucagagcuagcucagccuuaaaauguagacacguuucuucacugcucuccugugccauuuaugcaaaaguaacagcaaauaagaugcugcugaguucacaaugcccccuccuccaccucuggcuagauuuuaauagccaguuuuuaucugcaagaugucccagcucucacaguguucccucaaaugauacuuauccuaucacaacuccaaagccuagaggccccaugggucaagaaggaaggaugacuuuguaaaccucuuuggggaagacauccagccggcugcaacccaggguuuagggcagaagagucagccugacuguccggcaagucugaccaaaaccccucaaauuaagggccuuuucucuaagguuucagaaaaaucaggcugccuagguguccuggcagcuuucauggcaacaaagacuaaguuuuuccuccugggcauuuggggcaaaggcuggguccuucaugauauaauuaggccuugacuuuaaugcacccaugagcuauccacacuagcuccaucaaguaaaauuuuggagauuuagccuuucugagggaagaaagugcccuaaaaaagaaugaaguuuuuaaaaauacuguuuuguuuuguuuuguuuucacaacugugggugagagcgagggagagguguucaauauuuguucagacccaauagcauuucuuugauaaucgcauacagaaaacuacauucuggcugggcacgguugcucacaccuguaaucccagcacauugggaggcugagauggguggaucacgaggucaggagaucaagaccagcccggcuaacacggugaaaccccaucucuacuaaaaaaaauaaaaauaaaaauaaauuaguggcacacgccuguagucccagcuacuugggaggcugaggcagaagaaucgcuugaacccaggagguggagguugcagugagccaagaucaugccacugcacuccagccugggugacagagcgagacuccgucucaaacaaaaagaaagcuacauucuguucacccuucucuccacucccuuaaucuccaaauccuuggcauaucccacaccuuggggcucagaguuagcaucuccauucuuggacugguucuugacuugcucagguuggaagucaugacucuggucaucucauacucaaauucaacagauguuugccaaggauuuacuauguaaugacauuuuguuaggagaaaguuaggcuagggaaaagacagucuuaaaccaaaggagcuagagauuuauuucugacacagguuuuagcuauacuauaaaucuacucuagaggaaucuuaauguauaauuaucuaaggagaaauuggaagauauuauuggggaaauauagaaagaugugaauauagcauauuuugaguaacauuaaaguuugucucuuagauguucaccaaguaugggagaaaugucuuacuaauuuuauuacuugucaagccaugaauuccccagggucacuugcucugcuggguccuggugcugaguucuccacgggaggugacagcagaggggcccaauugccagcuuguguuugauguaggaaugcuuugaaaucucucccauccugcucaccacagcagccacccccuacccacucccuaucccuuucaugacuaccuuucucucccuuucuaauaacuagccucuuuucugcagacagaagugauaaaggguggcagucugguuuucuguguguuuauuuuauuuuauuuuauuuuugagauggagucucgguuugucacccaggccggaaugcaguggcacgauauuggcucacugcaaccuccacuucccggguucaagcgauucucaugccucggccucccaaguagcugggacuacaggcacaugccaccacacccagcuaauuuuuauauucuuaguagagacaggguuuugccauguuggccaggcuggucucgaacuccugaccucaagugauccaccuaccucacccucccaaaaugcagggauugcuucuguguguuuuaaguuguuuucaagaagcuccggguaagcccucuagacaagucccacuguguuaccgcuuggaggcacuugagcacauugcaacgcuuggcuuccuaaccccaagucacagaaaaucuuguuuguugggguaaaaaagggugggugucuuuuuuuucuuaauccacauuaagagaaagugaagauuaagaugcaguucucuguagcaucccucagucauccuaggauggagguagggaugcaaaggaguccuaaggacaagaauucuaaaccuguuggaaaucugacaauaugacauucccugaggaaaaccauuuaaagugcugugccuuucccugagaauuuugugaaugaaaggcuuacuggucaagccagugauugacacauggaggcauucaaaaguguuuguuggacguaagcagaguggacagaauggugugucuuuaccgugacuaauauuggcugaaggauaucuuuagauuguugccucccaaaaccacaucagguggguagaaaucaccauagaaucuuguuuaaaaguucagguuucuugagucacccccagagauuuuuaccuaauagucugacucaggaauuuuuuuuuaauuuuugauuuuuucauagacacgaggucuugccauguuggccaggcuggucuugaacucuugggcucaagugauucacccaccucagccucccaaagugauaggauugcagguaugagccacugugccuggccuaggaauccuuuuuuuuuuuuuuaacaagacuuuugggugauccuaaagcaagauuguuugggaccacacuuugaauaauucugcuguaggaguuggggugggagggggccgugugggaagaaaggagauguuccuaugggagggaccaugagugaugagaggucauggcuagcuggcacaugaguauaccuaaaaaguguccagagguuuguuggguugcagagaggucaaugucaagguaaaacuuaagucuacuucggcugaaguucuagagcauauccuuaagaaguggucaguuggaaguuucccaaguuuugcugaccaauuggugcuuugcagagacugggcucacuucugcuucuugccacuuccuuaccuuggcuuugaugaugccaguggggugggaagagaaagagauuugucucucccagucucuucagagaaaauuuagagugguucugaggcaaugggaagaaggaaggagugagaaugggcaucugaagagagaggacucagccuuuuuuuucuuccaucucucaaauuggaauaugccuuugagccccagggauccagagggggccaaaugucccuuagccuaagcaguaacucuuucucuggcuaaaggcugacuuuucacagccuaagaugucaaagcuagaaaacaccuuccagauaagcuaaaucaaaccccuaauuuuagagaggaagucacuuuacucagagguuaaaaggcaaagccauccugcaaaaaauggaaccaccuugggucucgugacuuuccacaguccauugccuuuucacagucugcaaagaggaagaaauauaguagcuacuccuuggcauuguggcaggccuccaucccaagcaagcacagcaguguucaagaaggcacacucauuuccgggaggccacacagucagugguucugacugagaggccugcugcucugccagacuucuguagccucaucuugaguccuccuagaagagaggguagagacagaccugugaccccagcaccaagcaacagugaagaauccccucauuaucguugagguugaucagcaucagggcccugggggaauaaaacaagagguaucccaagauuaauuuugcuggauagagcaaguacaaauaaggacacauaugaacacacacaggcacacccaggucacuuguacuaaacauuuuuuuguuguuguuccuuuaucauuuuagucagggugaguaauggcauuguuuuguuuuguaacuuuuaaguucagggauacaugugcagguuuguuaaauagauaaacguguaucaugaggguuuguuguacagauuauuucaucacccagguauuaagccuaguacccauuaguuauuuuuccugaucuucucccuccccgcacccucugcucuguuccuuuuuuuuuuuuuuuuaauuuuuuuaugagacagaaucuugcucuguugcccaggcuggagggcaguggugugaucuuggcucacugcaacccccacccccuggguucaagugauucuccugccucagcuucuguguagcugggacuacagacuugugccaccaugcccagcugauuuuuguauuuuuaguagagaugggguuuuaccauguuggccaggcuggucucgaacuccugaccucaggugacccaccugccucagccucccaaagugcugggguuauaggugagagccacugugcccgacuucuuuuauuuuuucaaaagaguaauaaauuuaaauaugcuugcuucaagauucaaaggguacaaagggguauacagugaaaagucuuccucccacucuuguucccagcuaccuaguuccccuucacauaagcaaccaacuuguguaucuuuacagagacacuuuuuacuagcauaauuuauauauauguguguguguguguguacuccacagguuuuuacacaaaugguagcaugcuaggcagacuuuuucgcaccaugcuuuucccccuauuguaucuuucagaccauuccauauauauccacacauaacuuccuggauuuguuguuguuguuugagacagggucugacugugucgcugaggcuggagugcaguggugcaaucauggcucccugcagccucaaccuucucggggcucaggugauccucccaccucacccuucugaguagcugagauuacaggcaugcacaagcacauccagcuaauuuuuguauuuuuuguagagauaagguuucaucucuacaaaaccaggcuggucucaaacuccugggcuugagugaucugccagccuuggcuucccgaagugcugggauuacagaugugagccacggcgucuggcccugguuuacuuuuauaacuucauacuguucuacuguauacaccugccacaauucauuuagccauucccuguuggugggcauauagcuuguuuucaaccuuuugcuauuacaaacacauggucaagcuuuuaccuauuagaaaaauuuguagaagugaaaugauuuagucaaaagauaugugcacugugaguuuuaauacauuucuccacagaaauaaauuaauuuauaccucuaucagcaauauaugagaguuccugucuccucacaccuuugccaagucaaugggauguugaaguuuuuauguuggccaaucugauaagugaaaaauaauaccuuuuauuuacucuuauaacaucucccaaaauaucucucuuccuuaucuugagccuuucauaauucuguauuacaaaugauaauacuaacacagaaaagauaaccaacuugcuguaaucacacccgguguaaauggccaaagucagauguucagcacucuucucuauacuacaccauuccacacagggcucaaggagguucaaaagagaguagguggcuucaagcauucccugaaagacacaugauauuuuaaaaaaaaaaaaaagcauugaagcuuucugacaucugcuaaaagaccucuuuagugguuugauaccaagaacacauuacugcaugaauccuccagcaaguaccgcucuugaaggagagggcucugaauagcaauuugaucugaccuaguccuaaacauuagcuuggauucaauaucuaggaagcaguaggauguuguuguuuuuaauuucucuaagacauuucucacuggacacccaggaucuaaguauucaucagcauggugugagugcggguguguuuuuccuagguuuuagcuuuauauagaacacucacuuggaccuggugaagauaccaauaucuaacacgcauucccauacaacucuaaugauaagccuaugagguagauaucuuuauugacucuuucacugaugaaacugaaguccagaaagauuaaguggguugcuuagggccacacaguguaucaguagcaaagcagaaaauacaguguagacugcaaccgaacucauuagauuccuugcaaagccuucucuucucccuccucuauucauuuuagugaaugacgugacucagucccucaaaucuagagauuaacauccacaacuccucuuuuacucauccaauugaucacuaaguccugugaauucuaccucuaaaugucuuuucucuucacucuuguuacauuaguuccucucucugcuguguuguugcgguugccuccuauuuuguucuucuugccucgugucucuccuuucuccaaucagacacagcaucccugaguuagcuucaaaauacauaacuucacaucccagcuuaaaaccugcaguggcuccccagucucuagagaguagguccagacuccuucacgugaacccugugcaaccucucuuuucagccaggauaaccacacuccaaaguacucuccuuguuccaagcccagacuuugcuuuuuccucccucuuugcuuuugcaugaguuguccucucuaccugguauggcuucccuucuuggccugaaaaacgcuuauguuucaggaacccgaauucaccuccucugaaacuauuuuuuuugacauuauaguacuacuaguggcuccuuuuuuauuagaggaacauuuugaccacaccucuguuauagcaccugucauauuguuuuaagauuauuucucuuccccacuagauugaagagcauacaccaucagugacuugucuuuguaucccagagcccagcacaguguguauaggagcuguucacuagaaauuggugaaaggcaaggaggaggaacagacugaaccaaggacagcaggaccaguaguuucauugcucagugaguucaggacacugugugaggcuuaaugcuucagcuuauaucuaucugaagcaagaugguagaacauuuuuccaaagcaaguuaauuuuccacccaagaggaugaagggagagaaggcugaaggaagagggggcaaagcugaggcuuucuuuccuucagggacuauuuucuguggccugaggcaacacauuuacuaacuucagaaacaucucagcugaagucccgcagcaaaaaaggguaaaaggggaacuaggcuggaaccuuguuaggauuuacaaagagaacagcaugaccacuccagaaggguuauaaaaaugcuucaccacuaacuccaccaaacccuccugcuguaaacagcucuaaugcuagugacuacccucagacacuuacugucuaucccuuuaggguguucuuaaaauacaccggaaagaacggagguaaaaauacuggaguguuuccuccacacuggaaagaggugagucauaucauugugauugguguuuuaaguauauuuuuauuguuauuuuaaauggcauucaaguuuagcuucaaguucaacagcagucuuagccuacuuccucccacacaaauacuccugccaguaaauaggcacucuuaaauaaaacagugccugcaagaaccuucugacccauugaaauuagucuugcccugucuucagagguguauucgucccucucuggguguagagcgguauuuaagggugacacucgggcacgcaggagguguggcagggggcggggaaugcaaggucacuguggcucaggggcgggugugggugcaggcgcguugggaggacccugggcgcccugggaaguccgagggcaggcggcagggcuggcgggcagcagugcuggcuuccgacgugagguggugacggcgggcccugcgcccaggcccugugcugccgaccgcuguccuggcugcgcagcuccccagcaggcgccgggcucaggucgcgccuucaguuagcgcucagccugcgcuacugcgucuccuccgcuugcgauuucuggucggaucccagcuggcccagacuugcucugaaguaggaggaaccgcugucgagcgaaaagugcacaccgggugauugaugaacucuuaauagaacuaaccucuccugcccccaacccuagacacacacagagaaaaccuccaccccagccccuucuccaguccuccucgcgggcgagaggggacgcggccgccagccgguagggugauuaacucaccgucugucuuugcaaaaguguuccagguggaucaggagcgccagcccaccccgcccgcagccuggccgcucgcugaggcgcggagagcgcggaacgagcgcgcgcaucacguggcggcgcggacguuugugccgcgcgcccgccagaccgcccaggaggcggcggcuauuguuccccgcaggggcccggggcgcccugaaacgggguccacgucagcccgcucccgagcguguccucaggucuaaggacggguggggcuuccuuuguguguucucuggaaggggcugggauggcgucguugcugccccaagggguaaccgagggggauugagggaagaugguaccagcucccuagagcucagcucaccagaccuacucuuccgcucgacccuugcagaggagguggggacggauaugguauuuguagggcagcgcugugaacaauggagccaucaaaaaggccuucucccagccuccucaccaaccacggacauuccuggcccaacaagaccuccuggccagguuuugagcccugcuucccagguaaaaacacugccuguaccagagcucuccaugaauuuugguuuaaauuaggauuuaaauucuucuggcccuuacuaauguuaaaacccagcuuuuaugauuucuccagguaguauucuuuccuuaaaauaauccagacuagcuauaggaaccaaucaggacauuuugcccaagaucuaggacagaaagacucaugcaguaacuccugccuuacagaucuggggacccuucaccugccucuacuacugcaaaugauuggauauucgucugacuuggcucuucccuaauguguggaacuaauuuuguucacucuguuucaugcuggaccuggccugaaaaugggcccuuauauugucuuugcacuuuccaacuugccaagguaggugugaaaccugagggaaguuuuuaggaauaggcuuuaggccagguacuuaaauccauuuguucccaaccuuggacuccaaagauaagggcauuuguagcuggaguagaaaagaagggaacaaugagaacuaagauuucauccucugugaugauucuuaucauucaccguccuuccucuccagcaucaccagugcagaaagugcagaggacuuauguacccaaucuuuuuuuuuuuuuuuuuuuuuuuuugagauagaguuucacucuugaugcccaggcuggagugcaauggugugaucucagcucacugcaaccuugccucccagguacaaacgauucuccugucucagccucccaauauacccaaucuuucuccuuucuauccaggccuucugcaagagagaucuaagaaccagcccucaaagaugguaagggcuuggcuagugacagcccagucucagcucccugugcccaaagugucggaacagggccacucaacccaagcccuacauauauacucugggaaguugcagugccucgaagugaucaggccauaguccugugaagacuggggucauccaugucccuuccugccuacucacaaacuucuguucuuccuauucuuuucuuucaguuucugaaagaaggaccaaaguaaugccaagaacucccagaugaagaggaccuuccuuagaccuauaacagauucacuacuugacuucagagggaaguuucagcuaauucucaggaaaaggucaaaacaggccugugacugucccuugaauacugaagguauaaacaagcuucuggcuccuccaggucaagcagaggaacacuuuuauuagaaugaaggguuacuucuuuguuauucaaacacacacccacacacauccucuguagucucccuaaugaaaaaccucaacagauggagagccugagcucccaaguccgcaggcugagaagaugcacuucacucaagggccagugggcugguacagacuagggaagagaaaagggacaaaggcugcuaguauagguaaucacuaucuuuuaauacuccuaacacauagaaauucgaaaaaucuuguucagcaauguuagcagccugugagccucggaaacuaauuuggcugaugugucucugauagggagcuuggggcugcaccaaggggaaacauucuccuccuguauucucuccucucucucguuugaaagccuguacaaagaaaugguacaaauggaugguuaacuuaaugauuccaucagaggcagauuuuucucugucaggucccuggauaagguggaggucugaaagccaggagacagaauauguacuuaaucgcccuuucugaccugcuuaccagugaccaggacuacucuccaggccuuucuucugccacuuccccauucuuccuggcuaguucaguugggucucagcacuucaacuccuggcuggauccugaguuuuucuugguugcagggaaagcucucacugucugcaucuccuuccccacccccaccucccguuuugcagcuggccauucuggcugccucacagcuauccugccuuaauucauauuugauugccuggacagaaccaccuagaauguccagacgacugccaccccucagccaugggccugagauccugcccugaccccuuucuucagaccccaggaggacccacaaucucccugauccccaccuuccccaaaguagucucuaggaaaaaagcagagcuggcuaaggccugagacagagccauuucuuccccuugggcaaacgagguagacccucccagagaccaaugccggagaggcccggauccgagcucccuuuauauggccucccccaucacggaucccgugggaaaaccugacacacaauggcgcggcugcuccgggcacccucaacccagcgcccugcggcaaggccuggagcagccugguggucuuggugcgcucccuuugcccuccccgcaacccucugcgagcacucgucccaggagagagacccuggcuaggguggagguugccucccgcaaagggcgcuguugcuggggccuccccucccccauucucuuguuuuucugcuucugagacucgggagggaggcggcaggcgccuccgcagccgauagagcagcuauugugaccuucccuugcagagcgggaacccagccgaguguguaccgccggcgguggcgggggaggaggcgacugugugugcaaaccucagucggagaggggguggcgcugggaaauaaagguuugcaaccucaggcag

SEQ ID NO: 13231 - RNA, 1152 nt, Homo sapiens
ccucugcaagggucgagcggaagaguaggucuggugagcugagcucuagggagcugguaccaucuucccucaaucccccucgguuaccccuuggggcagcaacgacgccaucccagccccuuccagagaacacacaaaggaagccccacccguccuuagaccugaggacacgcucgggagcgggcugacguggaccccguuucagggcgccccgggccccugcggggaacaauagccgccgccuccugggcggucuggcgggcgcgcggcacaaacguccgcgccgccacgugaugcgcgcgcucguuccgcgcucuccgcgccucagcgagcggccaggcugcgggcggggugggcuggcgcuccugauccaccuggaacacuuuugcaaagacagacggugaguuaaucacccuaccggcuggcggccgcguccccucucgcccgcgaggaggacuggagaaggggcugggguggagguuuucucugugugugucuaggguugggggcaggagagguuaguucuauuaagaguucaucaaucacccggugugcacuuuucgcucgacagcgguuccuccuacuucagagcaagucugggccagcugggauccgaccagaaaucgcaagcggaggagacgcaguagcgcaggcugagcgcuaacugaaggcgcgaccugagcccggcgccugcuggggagcugcgcagccaggacagcggucggcagcacagggccugggcgcagggcccgccgucaccaccucacgucggaagccagcacugcugcccgccagcccugccgccugcccucggacuucccagggcgcccaggguccucccaacgcgccugcacccacacccgccccugagccacagugaccuugcauuccccgcccccugccacaccuccugcgugcccgagugucacccuuaaauaccgcucuacacccagagagggacgaauacaccucugaagacagggcaagacuaauuucaaugggucagaagguucuugcaggcacuguuuuauuuaagagugccuauuuacuggcaggaguauuugugugggaggaaguaggcuaagacugcuguugaacuugaagcuaaacuugaaugccauuuaaaauaacaauaaaaauauacuuaaaaca

SEQ ID NO: 13232 - RNA, 828 nt, Homo sapiens
uuuuuuuuuuuuuuugcgaaucugaucuuauuuguuacucaaaaaaucuuauuucugacuggauucagacuuagaaguggaagcucgcagagaggacagucugcgucucuucacgauuugucccuggugcuucuuagccuccuucauucucuuggccaaaaguuuagcauauucugcagccucuucuuuauuuuucuuaauaugcggcugcuucagagcaauacgccgcuguuugugcugcaggacauguggagugacaaggcgcugaaucuugggugcuuugguccuagguuucuuaccuucuuuguuuaagggcuuuuuuacaacauacuggcagacaucauuuucuuuagagagacugaaaaguuuacggauucugcuagcuguacugggccccaggugacgaggcaucauagucucagucaguccaggaauacccuucucuccuuuuuuuuacaauaaccaaguugagaacacucagauuggcauccacgaugcaaccaugaacugaucuucucuuucuuucuccaguucuccuuggucuguaauaggaaugccccuuacucaguagcaaguggacacggccaugggucaagacacccuguuucaaggggaaaccuuguuuauuguucccaccacugauuccgaccacguaacccuuccauucuucacccagagcgucaacagcaacuucuguggccauacgcuucucauaaaaaguacaaaguuugcguucaucguccacuucaaugaguuucuggcagccaguggcugggaaggagauguucagcuucaucuugaagcagcugaacaccuccgagacaccac

SEQ ID NO: 13233 - RNA, 572 nt, Homo sapiens
ucggccggaaccgccaucuuccaguaauucgccaaaaugacgaacacaaagggaaagaggagaggcacccgauauauguucucuaggccuuuuagaaaacauggaguuguuccuuuggccacauauaugcgaaucuauaagaaaggugauauuguagacaucaagggaauggguacuguucaaaaaggaaugccccacaaguguuaccauggcaaaacuggaagagucuacaauguuacccagcaugcuguuggcauuguuguaaacaaacaaguuaagggcaagauucuugccaagagaauuaaugugcguauugagcacauuaagcacucuaagagccgagauagcuuccugaaacgugugaaggaaaaugaucagaaaaagaaagaagccaaagagaaagguaccuggguucaacuaaagcgccagccugcuccacccagagaagcacacuuugugagaaccaaugggaaggagccugagcugcuggaaccuauucccuaugaauucauggcauaauagguguuaaaaaaaaaaauaaaggaccucugggcuacaaaaaaaaaaaaaaa

SEQ ID NO: 13234 - RNA, 34475 nt, Homo sapiens
auaauuuaacagucauaauaauccuuuauuaguaccagcucuuaaaauuuuuuuuuuuugccagagcuaaacaauuuaauauaaaaaaugccauuuuuuguccauacaguauuuauaaaaaaguacauagugguuaguuuugcaauaauuucuuuuuagccagaugucauaucaucauauaaaucuaugaauauaacaaaugacauaagaacaguauaaauaaguuuuuguaguauuuacacuuacacagaaacuagcccaaaugguguccuaagaaauuguuuacaguuaaagugaaacuacugauucaacauacugacacuccaaugcuuuuuaaaguuucguauuauuuucuauacuaguuuuggcuaugauuuugcauagaauuacuuauaaaguaugagcauuucacaucacaguaggagcuuuuaguauaauaguacaaaaaaacuagcucagaaaaggucaaauccuccuaaaucuaguuuuucuuaacaucuggcuucuuacuuuugggaacaaggaaaacauugccaucucuuguuugcugcagggaguauucacuaggagaauaagguuuuccaucuucaucacguagcaugcugaaaacuucgagauauaaggugcugaguuguuuuuucaguaggugaaggcuuuugucauuuucuccuuuuucuuugagcaauuuuucuuuuucaucuuucaaaugaucuaaaucuugcucuaguucuacuauauuuuccaguuuucuuuuucugcaauucugagcagccacuuuauucuuaccccuccuacguauaucccgaauuaaugcaaguugagcuucauugaacugcucuuuggacaucauuucguugaagucaacaacagggagguuaaugauuuuuucuacagggaaugggauauggagagcuuuugcccuaaguucaucucuugugagaugagccuccaagcggcuugaauguuugucuuuugugaaugggguuuuccgaugaccaggacuuacaggcaauucuuucucugguguguucucacauugggcaucaugcacgugagugcucugccccugagauggugacaaggguuguaccauauccccagaagaauguacugguguuuuaggaccauucuguuugacacuuccaggggcacuaucuagcucuuccacuucagaaucacugaggccaaguagugugucuccauagcuggaagauuccacugaguguucuggugaugccacacugggacuuguguuuagugaaaugccggagucagaaucauugaauucugcugugcuuucagggugguuuugguugaaagcuuugcaaagugauagaucagaaacaucaaugggcccauuuagaaguucagagagugaauggcuuaaaguagcaggugagggcaugcuguugcugauacugggcucagcuaugaaagcagaauaaaauucaucaccaaaaucuguguugacuguggcaucugaauuuaaugaguucacugucaacugguuggggucuucuguggagaggaugcugcugaaggaauccucaaaagcauuaagaaaauguggacuacaguuaccuacuucuuuuuccauugaggguauagaugaguaaaaaugauaauugucaacuucugucaguuuggcuucuggacuuggaaccaugguagucucaaccagcuugucauuuucaauauuaagacacugcaugagaaggaaguuuauacuauauaaaucaaaguuaauccaugauaauacgugauaaauuuagauaaacucccuacccacauuaucuucaggcuuaucucuauaauuuauuaucuauaauucagagauaauucucauuuccaauacauauuuacgccuaagcguuauguauuauuuucagaguucccagaucagacgucagguuuauaacauucuauccucaagauguccaaccaauuuaacuagcaugggcaguacucaugacuaaguuaauagcacccuccaauccuuccuauaaauaggugguauauaaauaaucagaaugacuaaaggcacugaauauaaaaaaaaucuccaguauuacauucuauuuuaguuaccuguaacucaggaauggauaauagcuccucccaaacuugcucaauguccuguugcauaccgucuaaaucaacaggggcuaccugagcaacagaaguuucaggugacugagccugauuaguagcaaugaagacugggcucucgaugugaccgggaauaucaggaacaagugacugaaacguagccgaagaaaccuaaaauugauaaggcauugauuuaugagucuuccaccaacaggggaugaguaagcucuaaggcaccacuacaaaacaaaauggaaucagcugcaguucugugucucucuacuuacuaaccagucaugaccccguuuguaaauaacaaaucuuuuuuuccuaccccacugacucaaauuuauaauuugcuggucuguuucagcuuaagcauuugaaaguaaacuuuaaaaugcguaaguacaaucuuuaggauuuaguuuauauaauaucuagcacagugguacuagauaaaacagauuuauuaaaauuguuaacugaacaagucuucguuuauugcccagcuggcucuuuacucaccaaaccucuuagauacuugcagcaaauggguuauuuguuuccaugguuaugcuguccauguuucuggcuaugcaauagucaaugguuuugguuuuguauugugugaaggguuuuuuuuuuucuuaauuguaaaguuauuuauaggcuaagguuuccuugacaagaguauuuccuugguuaaaaaauuuccuccuaaaaauguuuuuauucuuuuaaauggagauucauugacgggacuuacauagaauagauuguuauuuuauaguuaugauggaguuuuucuauuaaccagguuauuuuauaccucaccucauugucaucuacaaacgggaaugucugcgccaaaagcugcaugcagucaucaaaguacaaagcaucugauuugggaaugugggcaaccugauaaaagggaaugacacaaaggaaaacaaaaaugguuaaauauuccauugccaagcuaaauauucaauaauugauguucauaaaauauuuauaaucaaguuaaguaaauauuuaucuuauuucagagaucacuuugaugcacaauuugaacuagaccacauggguucagaucuuagcuccuccaauuuucugagugaucugggcaaauuauuuaaccuuugugagcuucaguugcucaucguagauaaaacagggauaaugguaacuaauuaauauaguuguguuaauuaaaucagucaguauauguucuuaaaacagugcuugccacacacaguaacgccaguaaucccugcuacuugguucuccugcuacuacuucuguugcugcuacuugauccuuacaggauguuucuauacuuuacaaaacucuuugguguaacuuaagucuucccaauccucacaauaacacuguuaagaucaauagguuggguacugaacucagguuagguacugaacucaucaggaggcugagguuggaaaguagauuugacaagguuaaguaaaagaaaggcaaagcuggaacucaaauccagauauuuuaauuccuugcucaguguuuccuuaaaccugccauaacuuucccaagaacugaguacucuguaccugggaguaguuggcagauccacugguuucugacuggaugugcugggcuggcugaauugggagaaauucaccugucucuucaucuaguuguaacugagcgaaaaaggcuuucucuugcuccuuuuggaguuguucuugucuuuccuuuucaaguuuuuucuguuuuuccagcucauacucuuuccgucgcugacugaagucaaauacuucucgacuuacuccaagaucuauaucuugccuccaaaguaugucaaucaaauccauguccuauguuuaagacaaaaaaaggaaggagagagcucauguuuuuuaaaugacagauaccacauaaauuaauucacauuaugccacuguugauggugggaaguggggagauuacaaauacaaucuaaaugagaacacagauccaauguucuagaagagcacaguuaauuccauucaaugaaucuauucauuaaagacaacaaacaaccuacaaacacauagccauccauucuaaucacuuggaucauuaaugauagggugaugguagaggucacuaaagggcaaagucacaaaugguuugaaugagaagaaaucccacccuuguuuaauggaauauagaaauuagagcaagcacucuaagccacuggcuuauauaagagaaguggggucuggaaaacauuacugaauacauggaguuuucuuuaaacuuugcucagcaaauauccaguuuauagagggauaacucucaaguuaaagugucaaucuagcaguugugaaauaucaccauucuuuccaucuuuccuacacuagauuaucuucuccccaucacugcuugcuacucuuaucucuguggcuuaccuauaugccuguaaucccagcacuuugggaggccaagguggguggaucaccugaggucuggaguucgagaucagccuggccaacauggugaaaccacgucucuacuaaaaauacaaaaaucagccggguguggugguacgugccuguaaucccagcuacucaggaggcugaggcaggagaaucggcuugaaccugggaggcagagguugcagucagcugagaucgcaccacugcacuccagccugggcaacagagcaagacuccaucucaaaaaaaaauaaaauaaaagcagacagggacaggugcgguggcucacgccuacaagcccagcacuuugggaggcugaggcagguggauugcuugagcccaggaguucgcgaccagccugggcaacauggagagacccuguuucuaccaaaacaaaaacaaacaacaacaacaacaacuggugugguggcgcacaccuguggucccagcuacucaggaggcugagguaggaggaucacuucaguccaggaggucauggcagcagugagcuaugaucgugucacugcacuccagcccgggcaacaaagugagacccugucucauaaauaaauaaauaaauaaauaaaacuauggcuccagggaaggauuaaagguauuaaguuuuaagacauaggaagaaucuuacaaagagggaaugguuuugaugaggagaggcugagcuuggugacucaggccuguaaucccaggaguuugggaggccaaggcaggaggauugcuggagcacaggaguuacuagccugggcaccauagugacaccuguuucuacccaaaaucaaaacaaauuaguugcacguggugauacgagccuguagucccaacuauuagggagacugaagugagaggauugcuugagcccaggaagucaaggccauggugagcugugauuguaccacugcacuccagcuugggugacaagacccuguuucacacacacaaaaagauacauggggagagaauuuauaugacuaggcuaggcauaggaaccacauccagauuuuccuaaccaaaaaugugucaauagcaguuuuucugauuuguaauuuuagucuuuggaaaaaucuaaauagguaggaaaucuaaaucuguuuccauuccacaaaucaccuauaggggaaauaauuaauuugagaauggaaaaaaaucaagaugggggaacgggaguugggacuugaaggccaguggguacaguguagacacgucacacuuugcauuucauucugcugacagcuggcaacgccagacuuagaguucuauuacuuucagcuucccaaggacgcaaauaacauggugguuguuucagugaggagucaggcuauuuuuauccaacagaggagcaggccacccagccuggaggcagcgcagcuagcuagauggcacaggccaccuguguccaugauugaagguuggcguuggaaucuuaaaugcuaugaaacccugcucauggggcucauuauucuagccuugaacaauauauauuguaaagcacacaaaguaggcauaguuaaaguagcacuuguaguuagguauaccucacuaggacauaccuaauuaucuuuaagccaguaucuauuaagggcuuccuauaugcuaugcacuguucuaaguacuuuacauauagaaacuauuccucaaaacagccuuauacagagaaaacauuccuguuauacaguauaagaauacugagguuaagaaaaaagauacuaccagaaaguggcugaacaaagacacauacccaggcagcuucagucggguucaugcuuuauuagccaugagccuacacuauuauaaaauggcauggcauuugcugcaaauaaccuaugcauaucccuuuauauacuuuaacucaucccuggauuacuuacaauaccuaguaaaguguaaaugcuguguaaauaguuguuauacuguauuuuauguguguauuguuauuuuuucggguuuuuuuuccacuuuuuuccuuuugaaauuuuauuauuuauuuacucauuuugagauagggucucacucugucacccaggcuggaguguggugaugcaaucauggcucacugcagccuucaccugggcucaagugauccucccaccucagccucccaaguagcugggacuacaggcacaugccaccaagcccagcuaauuacuuuuuguagagauggcgucuugccauuuugcccaggcuggucuugaauucccgggcuccauugauuuuccugccucagcuucccaaagugcuaggauuacaggcaugaaccacuccacugugcuuggccuuuuuccaaauauuuuugaaccaaucugccauugguugcaucauggaaccagaggcugcaugggccgacuguauauacacuuggcuuuggaaucuugguaguaugaagcggccagucugcaggucagauuaagucuguaggucaccuagaucaguuuccuggccaagagcaacaaaauagcaaccacagagcauucagucgacuauacauggcuaucuucucagggggauucccacuaaaauagguaugagaauaauuucuauuuuaaaaaaugauuuguuuccauucugauggacauguuuacccaaagguuaucaugggagacagaaaauucaaagguauagagaaaccuacuuuauuuuauuuuuuuuugagacggagucucgcucugucgcccaggcuggagugcaguggcacaaucucagcucacugcaacuuccgccuccaggguucaagcaguucucucaccucagccuccugaauagcugggauuacaggugcgugccaccaugcccggcuaauuuuucuauuuuuaguagagacaggauuucgccauguuggccaggcuggucucgaaccccugaccucaagugaucugccugccucggccucccaaagugcugggauuacaggugugagccaccacgcccagcugagaaaccuacuuuaaaauucugauuagcuugggccgcuucuucucaguaaaucuagauacauagcaggguauccugucuagacuuucugcaaacuggagcuaucugcccaagcaagguauuaaguguucaauauguucccaucuucuagguacuagcaccaaaaaugaaaggaaugcaugauccugcgaucuuaauugaacucuguaaaauaggcaguccauguucccacccaucucaagaagugaugugcaaagugugcaaagcucuuugcaaagucaaucaaagaaacucaaauacuugucccuguacguggggaaaaguguacuuugacacaucccugccucacccuagacuuccugggccugagguuuuuucuuguuaaggagaucccaggauaaaaaucaguaaaagguugugacuuuuucaugcaacugaagcaauuuagguugcaaacaucuucugcucauaaaucugacuugcaaaguauccuuacaaccaacccucaugagcuggaagaaaauauugaauggaauuuauaauugucagugucaaucaugccaagaauugaaauaacuauuuaauuuccuuucccccccuuuuccuucccaucagaugauaauauuugagggguuuggauggcuuuagcuauacauuguuuaauuauuccauccuacccaagcauacagauguuaguggaucaaaugaggcacgugaaaaguaucucucuauaaauguaaaauaugcaaauguuuacauguugacagugauaggcucuacuacuugcuguauaagcgagaccaaaguccaggccaauggauaauaaugagguuguggaccuaacuagggggagccuaaaauaauguugggacuaccuagauggucagaaagaaugagccaauuaacuucuaaaaucauggacagcuucauugcuugguucuuccucagggcaggucugaauuagacuacuauuaacauguuguaauaaaaaaggauuuugaucucagagauucugaauuauuuacaaauaauaaagcaaauuaauaagcaaauuagaaguuuuaguggauauugcucuugauggugguuuuguuacuguugguggggguaauggugauggcagugggcacgcccauauacauuugcauacacucuaauauaaauguuuacaaacauacacacacacacauucaauugccacucaauuccugcugugaguacccuucaauggacagcuccaaaccaauucaauguuuuuuauuugaauuucccuugacaugaccagaaaaagacaucuuuaugaauccuuaucaacaaacaggaaaaauaagacaugaagcauuauuuagacuagcucuugagcauccuguucacguuaccugaaacaaugcuggacccugggagacuaagcagcuccugcggcccuagcuuacugucuccaccaagaaugccaccaaaugacaucuaauugcucuucauuaggcugggggacauucagugcaaucguaauaggaccaaaauagguuucaaaguguucugaaagguuuuccuguguauuuuuaaguuuauauuuauguggccaggcaugguggcucacgccuauaaucuuagcacuuugggaggccgaggcgggcagaucgcuugugcucaggaguucgagaccagccugggcaacauggugaaacccugucucuacuaaaaauacaaaaauuagccgggcgugguggcaugugccuguagucccagcuacgugggggacuaaggugggaggacugcuugagcccaggaggucgaggcugcagugagccaagaucgugccacugcacuccagccuggguaacaaagugagaccuugucucaaaaaaaaguuuauguaauguuuuuucuugcuaugagaggucucaaaacaaaacaaaacaaaacugcuucauaaaagaaaaaagcuaaauuugaagcaacuauuuuggauucccaaaaacagacaucuugaucaaauuuagaaugcagcaacaauagguuuauuguuauggccuuaaugucauacucugugcuacucagauuuucacaucuguuucagcaggcaaaauccugcagagauuugauacuguaugaaacauucaaagcuuuauguuaaaaaaaaaaaaaaaaaaacagcagaaguuaacugaagacucacuguuggggaccacaagcucacuacuguauuuugugcuaagcuaauaugcaccaaccauuuccuguaaggagccgugugacugggcacaugauuuauuccacaaaugacccagcucucugcaaggcucacacaucaucuaagaggaaauaaucgucuggguggagcccauaacaaacaagaacaugacacuggacaggaggaaagggaagugccuaaggaagaacuaaaacugcucuucugcacagaaauccagggcuuugaggaagugcaagucccccauggaggaaggccacaguacaaaguguuagauaaguaggguuuggguagagagaggaaagcagguagauggguugcacagcacugcacagauacuuucuuacaacgggugagaaagcuucccaagggccaugcgagcacuggccaggagccuuugcauggcauauggagcaaaugccgucugccacuuggugucugaauuuuuuuugcucuuguccuuuagugauuccugaguguguuccaaauuauguugcuagcuuggcuuagacaaaagaagacaauuugauaagaaacacaaauguuggacaauucauguuaaaucaccaucuggccuaacagaaauauucauguuuaaaaaauauauaucaucauuugccaacuggguaaucuguuacacauuuuagggaaaucugaaguuggacaauuaacucauaccacuuuaaaacaaacaucuuuguaccaggauaaacaaagaagaaaggacuugaacacagaauccauauuaaauaugucuuuugcaagucaauuuuagugccuugaauaaaccagcaucuaucaugcuuagaugauccaaaauauuggaaaagauaaagcaaagauaauacaaucccuguccuaaauuaaagcuauucaguaaacugagacaaaguauuugaaaugaaaaguaaucuuuuagacacucaaaugucuaauuaaggcuugcaccucccauucccccgagucucccuucccucuccuacccucuaucuugcccugagaaugacaggaagguggugggagauuuccuucuaaaaauaaauuucaucaauaaacuguuaaaaaaaauuaauuauacacacuacuaacucucaacagaaagcgaaacugagccuugcuccaaagagaaaacugauccuugaucuuuuuacuuucauguaguauaaaguuggaaugucuuaaguuauuccuucuuaaaaucauguauuuccauuuaaaaaaaaucuuauuuuaauguuauuccccugagauccuuccuucauccaaaucuuaguuaccagcauucagagucuaaguuacacuugauuauauuuuucuuucuuucauuucauucuucauauuauucccaggugauuauauuauuuaccuaaaagcuaaaucugguucaauguuuuuuuccauagacacugucuaaguauuucugaagaaaaccagguggaacaugaaucauauccuaccaucuggaugaauauaaaccaaauuaagagcuauaugaggcugcaaaaauauuugagggcaugcuugaauuuugaggaauugauaaaauaacagccaggcacgguggcucacaccuguaaucccagcucuuugggaggcugaggugugagaaucacuugagcccaggaguuugagaccagccugggcaacacaggccucaacucuacaaaaaaauuuaaaaauuagccagacauggugagacacugcuguagucccagcuacuugggaaacugaugugggaggaucacuugagcccaggagaugaagguugcagugagccaugaucauguacugcccuccagcccugucuuaaaacaaaacaaaagcaaaaacaaaacaaaaacaacagagaucuccuucauuuacaaaucucugccuugcagucguaauccuuauuagauaaagcaaaaugacaccaagcagauguguuuuuaaaauacaucuugcugaugacuaauuacauuucauagauauguaucugccuauuuacuucucuggcuucucucacacugcauuacaagaauauagcaauaccaauuguuuucucagcaagaauucuaggucauucuuucuauuucccacauuccaguacuuuugguuuuauuagacugauuugcuaucuugauuguguugcuacaguaaguguaaaguaggugauuaaaauacagaaacacagaauacuggagacaaaaggggccuuacagccuaucgaggccaaguguaaauguugccagguuuauuucuauguaacuacagugccuuaaaaaaaauaacuggccuagcaacauguuguauacaucagcagagacauuuaagagguagcaacaguuaccacgaauccaaguuuuccuuucccuuaucuugaauaacuagagacuuuuaacagcauaaaaaagcccaaauacacacaaagacguauuauucaacaaguuaaaacccuaguucacaaauuuaccauucccugaguuauagaaccauuuuucugcccuuuuaucuuuccacuagaaagugguccgguuucuucaaucuggcagguuacuaugugcagccauuuucaugggcugcuuccuguucccaaacaaguuccucagucaugacucaaucuaagaaauaugauccagccaauuuacuggaacucucacccauuaugcuugucuguaaacugcagagcaugaugcaaagauaaagcaaaacuggaaagugaagaaagcaagaauuuggauuauuuucucaagaggcacaugcagaguucggucaaaaagaugucagaaaaaaaguuaauuuccaaaacagcaggugauccuaccugcuacaaaaagcacaugguacugaauuuuccaugagagguucacaucugaguccccaaggagguuuuguuuuuuuuuuguuuuuuuuuuggugguuuguguuugaguaggauacugcugcuaggcuucaaaggacuuauguaaggguuucacuacuuugcugagagaauggcuugguuugacaagcaaacauuaggauaaauuuuucuaaucucuuccccauuuuugaacaagccauguauguauugaguucuaaaugcuguccuccacagagaggaacuucucaccuuugggauuaggucuuguacugcccuuagaaugauccaacccuccccacacccgacccgaccccugccauauuaccaacagaaacuucaggaacauuggauccaacucccuaaccuacuuuaccaaaccuccauagaaauuaacugggcauggacugaccagguggcucagaucuccaccuugaggucaaacagcuuugcugcccaugcugguguacccucauccuccaaggaagucccccaugagggugggcacacacaauccagcacauucacaccguaaggcuucuacagauacuucugccacuucuaaacuccccaagugauccuuuacccucucuuuugauccuggauuuguaaagauaaauguaaagauaaaguucaauccuugggguccuuuucagauuuuuuuuuuaaaagagauuaagagucuugcucuguugcccaggcuggagugcaguggcaccuuccuagcucacugcagcuucuaauucccaggcucaagugauccucccaccuuggccucccaaguagcaugcaucaccaugccugguuaauuuuuauuuuuuguagagaugguucuugcuauguuacucaugcuggucucaaauucuuggccccaacugauccuccugccuuggucucccaaagugcugagauuacaggcaugaaccacugugccuggucaauuuucagauguaacuaccuacaaauagcuaaaaguaauaauaagucaguauagucagucauccaggcuugggggcuaaguaaguacuaaaugccauuuacugcugcuagccggagaccuugugugcuggugguaugaauuuuagauacauuuuauuaacaauauuauuauauguauaaaacacuuagcuuuaaaaaaaaaaaaaaagauccuugcugggugcgguggcucacgccuguaaucccagcacuuuaggaggcugagguagguggaucacaggaucaggagauugagaccauccuggcuaacacggugaaaccccgucucuacuaaaaauacaaaaaaauuagccaggcaugguggcgggugccuguagucccagcuacucgggaggcugaggcaggagaaucgcuugaacccggggaggcagagguugcagugagccaagaucgcgccauugcacuccagccugggugacaagagcaaaacucugucucaaaaaaaaaaaaaaguuaaaacuuguagaaugguggugguuauaaagguaguagucaagaucaacaagauuaguguaaauacccuaaguggaucacuaauccaucuacccaucagauaccacccccucagaugccagggauacaaagaugaguaagacacagucucugaucugaguuaugagacaaagugaugagaagcaaguagaagcccaggcagcauggaggaggugccacuaaaucugcacagaaagaccucacagaagagguaacgacugccacaaaguguauaacuggccuacugugugaauauccuuccaauaaacaaggguuaaaucuauuuuccaaaggcccagcccaagugggcauuugaaagcaaaggaggcuauggagauggcaagaacacacaagaaguaaauaaucucggcugggugcgguggcacacgccuguaaucccagcacuuugggaggccgaggcgggcggaucacgaggucaggagauggagaccauccuggcuaacggugaaaccccaucucuacuaaaaacacaaaaaauuagcugggcgugguggugggcgccugugucccagcuacuugggaggcugaggcaggagaauggcgugaaccugggagguggagauugcaguaacccaagaucgugccacugcacuccagccagaaggacagagugagacucugucucaaaaaaaaaaaaaaaaaaaaaaaaguaaauacaucuccauucucuuuauacauccuucgucucccuucuuggugguggcaauguuuucccucaucuccuccccaagaggcucugagucucuagcucaaggaaaauucucauacauaaagagacuucuuccucguauuuugacuuuucaguuaguaugacucauccaucucagccaagaugggaauuacuguuaaugccacacugucacggaacgcuacaacuggaagggaccacaggaaucacccagacagccccucuuguuuugcaaauaagggaacaggucuaaagggugagaucauuugugcagggucagaggucaaaggauuaucaaacuacuaagggucuacuuuucuaauuuuacaacucuugccaaguuauuuggcagagggaaaagaucuuugcuucaccuuaauucuuuuuaaauuagcaucucuugcucuugucugcuggccucacagguaccuaacagcuucuauuacaccugguguuugcauacuucaugguuuacaggaguguucaugggugcuaucucauuugagccucacuacaguagcaugagggaguugggccagguauuguagucuuuuuuuuuuuugagacagagucucacucuguugccuaggcuggagugcaguggcacaaucucagcucacugcaaccuccaccuccuggguugaagugauucuccugccucagccucccgaguaguugggauuacaggcaccugccaccaugcccagcuaauuuuuguauuuuuaguagggaugggguuuugccauguuggccaagcuggucucgaacuccugaccucagaugaucugccugccucagccucccaaagugcugggauuacaggcaugagccacugcguccagccuguaaucuucauuucuagaugaacacguugaggcuucggggauuaagcaaccugccccaaaucacauauucaccaaguagcagaggcaggacuccaguccagaccuucugaccuugagccugggaagcuuguccacugcuccuugguguucacaccacaacagacacguucuggaaaccacuuuagcccugugccuucucccaaggcaggaaacuaagaguuaaaggucugcccucuggacacucagacuugccugccccauacgacuuaacaggcaaaucaggccaacguaacuugccuaaagagagcuuagcauugaaaucaggacaacucccuugcauagggagaguuuugcauugaaaucagucuucccauaaagccaguaauuaccccauacuuuguaugucuuacaggauuuucuuacuauggucugacuaaacucauuuagggcaugaaaauggcuuuuuaaaaauagauaccagguguacaugguauaagauuuaaaaguugcaaaaguaauuucccaguuacccuccuccaaggcaaucacuaguaucagguuuuuuuuuguuuucuuaggaagccauuaaauacacacaaucgcauauaagcauaguaucccacacucauuuaauauauuuuggagaugguucuacaucagggcacagaguuguaaguugucccuuuuucuuuuuuuucuuuuuuucuaagauagggucuuguucuguugcccaggcuggagugcaguggcagaaucacagcucacugcagccucaaccuccugggcucaagcaaucuucccaccucagccuccugaauagcugagauuacaggcaugugccacuaugccuggcuaauauuuuacuuuuuuuuuuuuuuuuuuguacagacagggucucacuauguugcccaggcuggucucaagcaauccuccggcuucagccucccaaggugcugggauuacaggcgugagccacugcacccagacuuugccucacuauuuuuaaugacuggacauuauuucauuacacagauguacugaaacaguauuacuuaauaacauaauuauuuaaucagucccccaucugacuuuuguuucuuuuugccauuacaaauauugcuauaaugaauauccuuguauauaaaucauuucauaaaugugugaggguaucccuaagauaaauacuuaaaaguggaguugcugggucaaagaguauauacugccaaauagcccuacauagagacuguaccuuuuacacucgcaccagcagugugagcgugcauuuccccaugccuuucccaacucauguguccuucacaccuuguaucauauuggcacaggguacccacucaauaaauacacauuaacugcuuauacaaggccuccuacauuaauuccaggaucauuucaaaauugggcccuucccacuaucucuuaacaauaaaauugaggccaaagaaaggaauaaaggccgggcgccguggcucaagccuguaaucccagcacuuugggaggccgaggcagguggaucguaaggucaggaguucaagaccagccuggccaacauggugaaacccugucucuacuaaaaauacaaaaaauuagccgggcgugguagcgggagccuauaaucucagcuacuccagaggcugaggcaagagaaucgcuugaacccaggaggcggagguuauggugacccaagaucgcuccaagccgagaucgugccauugcacuccaaccugggcaacaagagcaaaacucugccccaccccgcaaaaaaaaaaaaaaaaaagaaaaaagaauaaacuuccacuccagaagugucagccagcaaacagcauuucuuuaaccacuggugugugccuagccaugcuccagccaagcuaauuuucauuugugccuuuggaacuggcagcacauuuuguaggggcaaggaaugcagaggcugggguacccgcagauaagaccgaggcugggcaaagucucaggaacacucaaacgugacaggcaaaaucaguaagcucagccuuucuaauagacaaggcagacuugaaaaagcaaguccagccagguugacccaucuaccggcuccuuaaagauguaucacucaggaacagguguuuacuggccacuaaacuacauuuagaacaaccaacugacuaaggagagcugacagugaucguggagaccgcaguucaaaccccagguuuauaaaugaggauccugaggccugagaugcuaaaugggcaacuggccccaggucugaccuaacugagcagaauccaggggugggugguugucaccuggucaaccuaacacaaauuagauuucaagcuagacuuuccuacugcaauuucuaucacuuaaaaauucauuaaauauuaggaauuacuuuggaaacugacccuuagagaacuguugugugcuauucaagucuguaaccaaauuaauggccuaugaaauuguuaugagaaaauugcccaaugucugaccuguacucuguuucuuuuuuuuuugagacagaguuucacucuuguugcccaggcuggagugcaauggcgugaucucagcucaccgcaaccgccgccucccggguucaagcgauucucuugccucagccucccaaguagcuuggauuacaggcaugcgccaccaugccuggccaauuuugcauuuuuaguagagacaggguuucuccauguuggucaggcuggucucgaucuccucaccuuaggugauccgccugccugggccucccaaagugcuggcauuacaggcaugagccaccgccucuggccucuguacucuuuuuuuuauuuuucagaggacuuuccuucuccaacccacaagcucugaauauugugugguucuguaagacugugccuuugcucucaauacuauaggaauaagagccucccaguucucagcccuuucaggcagaucauguccccugcccagccuccagcauuacauuaucaagcgcaaaccuggcucaaaauuagcgugggccccuaaaaacugccaaaacaggcaugauggcucacaccuguuaucccagcacuuugggggaccaagguaggaggaccacuugagcccaggaguuuugauaucagccuggccaacauggaagacgcagucucuacaaaagagaaaaaaaaaaauagccaggcgugguggcgcguaccuguggccccggcuacucagaagguugaggcaugaggauccuggagcccaggagguugaggcugcagugaaccauguuucugccacuauacuacagccuaggccacagcaauacccggucuccauaaauaaauaaauaaauaaauaaauaaauaaggcauuuucuucacuccggaucugguagaaguucucugcagcucugaugucugcuauguuuccaaguaaaaccaggauccaaggcaaaggcuauaaagccacugggauccaguccccaucugggaggaggucagucauuuuauuguagccucuggccuuggucuuaucacuugcaaaauguuggagcuggauuaggugacccccaagauccuuuccucuaaauaccucugauucuaugaaguccauaagucugaaaauaaugauuuuuuuuaaauaggcuacuugcagcuaaagcagcacuaauagaaauauaaugcaauccacauggguaauuuuaaauuuuuuaguagccuagccucaccaacaaaaaaauaaacaagugaauuuaauuuuaacaauauauuuauuuaacccaauauauccaaaauuauuuuaacaugcaaccaaaauaagaaaauuauuaacgaggugacaaaacacaauacacacuacaagaaaucuuacccagcaugguaacacgaaauguagucuugccaacacuacaagguauauuuaacagaaaaauauuuuauacuauuucuguuuuaaaauuuaaaucaaaauuuaacgaaauuaaaaauucaguuccuugguugcaugagccaaauuucaagcaugagggacagugcaguauaaaccuacaaugugguccuccacacuccuuaggggugacuuugacggaaccaaacucuucgguuuugcaaauuaccuccuaaagauacacugaaaucaaugggaaaauucacccuuccaaaauaccugagacaguauuuguacuguuagcaauuauuuguaaaagcuacucaauaaccugaaagaacuggugugagucugaauuacuaggaaggcucaugauggcuaaauggaucauuuugauguuauucaacaauguuauggugcagaugcuauucaauuaccaugauuauugcaaaggucaucugaagaauggauagaagugagaggccuuaggugcugggaggguacuaccuguuccaacuaaggauauaaauuaacccggaguucagaaauuguauuucaacugcuuucacauguaugaacccacuaaauaauuauguugggguaguguuuaccugguaagcuuucauauuaagaucugagaaugaaagaucucagugucaagauucuaagcccagauaaagacaaguaugauauagucuaaguaguaacauaauggccaccauuuaucuuguacuuucuaugugcucaacacucuuccaaccacuuguccccaugaccuccuucauaugcacaccaauccacccagguggguaguaguaugaucauuaccauuuuggaguaaggaaacaaaaacagagagguuaaguacuuuugccugaagacaucgccccaucugauaaauggugacagugagauccaacucagguuuaucuuaaagaaccagaguuccuauccacucgaggcuuccucagggaggcugcacagugcgaugugcuuaggaagccagggggugccagguggggccucugcugcuaccuagcugcguggguaacuguggccuagccaccgaaccucccugugcuguuccugcaauggaaggccaagaugauaccagcccuuacggaaaaguuuuccauaugaaaaacaaaggauguaaaugccccuuaaaaauaucggacaacccaaggauguccaaggaugagguauuaguacuauuaauaaauucagcuccuguugcaaaugccaaaugaccaugagaagcaucuaccuuuuaggguucugggucuaaccaguaaauaaaagaauagaagaugaggccauuacuuguuuauguaucagcugugcauggcaacaacaaaggugguaaaaauguaaaacguucggcugucaucucccucaagggucuuagauuuucuuucccuucacagcucuggccaaauuuaguugggguaguuauuacaaaagaagugucuuaaagccuuuaaaggguuacgaagauggcaaaaggacaaagccacccaggccagcucaguuccuguuuggauuuagccuuccacugaugcauucccacuuucuacaaacucucucugucccuagaccuugccuauggacacuggguuucuaggcccagaaccucagaguaagaaaugcugccacaagugaagggcugagucuggaaaggaauccuaugagaugguuuaacaauccucauaaguacaaggaauccagcagacaggcuggagggucuuccagaggagccggggcaacguguggggccucugccauucuagggcacacaccaggccugcuaugggguugguuuucugucucagaagaccucagucuccacaacaaccaggaccucacacaaggacaagaagaccaaggagaaugagagguuuauagcaaacagcaaaaaagggcgugaguguuuacacuggaacucgagggauuuuugccaggcgugguggcucaugccuguaaucccagcacuuugggaggccgaggugggcggaucacgaggucaggaguucgagaccauccuggcuaacacggugaaacuccgucucuacuaaaaauacaaaaaaauuagccaggcgugguggcccgugccuguagucccagcuacucaggaggcugaggcagaagaauggcgugaacccgggaggcggagcuugcagugagccgagaucacaccaguccagccugggcgacagagugagacucugucucaaaaaaaaaaaaaaaaagggauuuuuuucaagaagaaauggaaugaugaaaaugaucacaaccaccauuugcugaaggugugccaugugcuauuuccugugcccaguucacuuuguuaauucuaggaagaugaugucacaguaacaucaaucuaaagaugaugaaacggaaacacacccuauugugaaaucuaaugacauaaccucucuuugccucaguucuucaccuacaaaacaggaagaauacuccucaccucacagggcguaguaaggauugcaaagggcagaagaguuugucagagcacuuuguaccgugcccaguguugcagagaguccaacggacugcagcuguuguuaacagcauugcuagauguccacaucugucugcuuggggcucacaggaaaagcucauaggagagaaaagagaggaaauuguuuuuucuugucuugggcaaauauugcuaaucauuguaauuggaagcaaggaucagacuguuagaauuuacuaaaaauaguaaaucaaucuaagagaggggcaaaaagagagaaacucucucugugccaccuugaggaagaaaugaauccauucuuuaagcaaaauggcaacuucuggcuaguuuuuccuccccuuucaucagugaccacacugguggaugaguauuuuuaaagcacaggaacagcggagcaugcaagcuugagcacaauccacuucccuccuuaaaaacggaggcucuaaaaaguuauuuuuacaugucuaacaaggauacaauuuagaguuacaaugacagauccucaaucugugugcugaugucaaaccaacuaagccgucacaacaaugcucagaccuacaccuuggcaggagcccgcucaccaucucccugccuccaaccuguccaucuuccaauucaccugccacaguaacuuccuauccacauccaguuuaccugcccugcccuuuccagaaucuucuuccaugguuuccagaugcccuguacaaacuugaaacagugcacaugagcacugaaggcccucuauggcaacccccaaguuaaccuugucagccccacuggcccaauagucugucauaguccagcucauaucugcaccauugcuugggcuuccagcugaagccugaaccaaacaaaaucuaccugcuuaaaagaaaagucuaguuaaaauggcaguuccuccaggauauccucucugagcaccccaguuagaagucacauuuucucaucugcacugucacagcauugucauguaucacagacuaguuuauauuaaauaucaagcuccuagagggcaguuaauggacucacccucaaacugacugagcaacuauuacguaagcaccaggcauggcgcuagacaucagaauuacacaaaagauuaaaauacagucuuagaggaacucauauccuaagcagaggagacacagaggagcaauuugaaaaacaaaugucccucaagggggauacgugcugcauuaucuuggaagauuaaaacagcuucaugcccugaaagauuccuaggguguguagauaccuaauaaauauuugcggaaugaguacguguauauuauuuagacuaacaauucaguauuuucauugucuaccuaagauauaugggguuagaguucaaauuacuuaaguaacaaagauaccauguuuuauaucauauaugucccaacuacuagucauagaaaaauuauuuaacaucauucccauuaacaauacuucuaaauuauuucuuggauaugcuaccggaaauaaaguacgauaucuuaagaacuauuaacacucaccccuucaaauaaacaauacaauagauuguaagagaacaaaugugauaauaucuucaaauauccuuuaaagaauuuugcaauguggacaauauaacaaucaaucaacugcugauuaagugaauuuucuuagcggauucuaguuacuucccucaggcugauggucagaaaaaggaugagaagugggcaaacuuacuuuccccccuuuacucuccuaucucaguauucagacuucuucaaaaagugcccagcagaaaagguggcuaagccccagagagauaugacauauaugauuuuaacuucaucuccuugaaaauuaaaauaguaacaauguuuaguuuauccuuuuguuaccaauuccuugcagcuguagguccgagaaauggccaacuucagcaguaacaauuaccauauuaaauguugcucugugugaagggaucuggacaagucacucuaccugcauaaauaaaauauacccagacucuaccuuuguggcacuuucauuauauucgaugaccucugucccaucaccugcuucagguuaggauaaaagguauaaacaagcugccaccuggugagauggcaggcuucccuacaaaaaacaagaaaguaauauucugccauuuccuaagaacaagcagcaauguccuggcuucaaauggucucuagaaguccaugcaccaccgugcuuccacuggggcgguuguaucacccaggagcauuaggaauuguauggaggugggguggggcacuuucugcuugucacagcgauccguggaacaggacucugcuccaaagagaaguccagccccaugcgucaacagcgcccccacugguccacauggaaggaacuccuuaaguagcgacacuguccuaucaaucuuuauaaaggagucccucauucuuuagcagcugacagaaugucuguaggucauuagacaaugaaaaaagaaagaagagagggaaggaguaaaacaagcagagaauagggauuauggacagucaaaaucccaguucugcuaccugcaagcaguguuguccuggccaaauggcuuaaccucuuugaaaauauucauuacuuuucccuuuucuuccccauaaucuugccaguucugucuguauucagaugucuccuaacuccaaagucuggcucuuuucacaccauaggaagugagcugguaacaugaaugaagaugaaagacuaauuguuuccucagucuccauuacugcacaauuuacagcacaauuguacuguuaucaagugaacuuuggaaaccuguagcacagagcaagagccgcauacucccggggacccagacuuccaagaguccugcagaggcagaagggagggagaugaaugagcuucuaucuaggcgagucaugucuacccgcaucucucugaggaggaaagacuuuacuucucaggaucaacgagaagagauaugagcuucccccaacuuuucuuaagauacauucccccuccuuccugauccucccaccaaggguggccccuggaucacaguuuggaagucacugcccuaaggauuucaccaaacaggcagugugguaaagaaguuucuaacagagggugaagugcugucucuggaggauaagauacaaccugcacccacaggaugauucucauucuugguucuggucucugcuugggaaccagcaggagaagaacauguggguuggcgagugggggcacugcagcugacacaaaguaaaccagcccuguuccaguccacuaggguugauuuuucuuuuuuucauugagacaugaucuuacucuguugccugggcuggaguacaguggcaugauuauggcucacugcaccuucaaacuccugggcucaagcuauucuuccaccuuagccucccaaauagcuacaauugcaggugugcaccacuggauccagcuaauuuuuuuaauuuuuugaggagacagugucucaauauguugcccaggcucaucucaaacuccuggucucuagugauccucccaccuugacuucccaaaguguugggauuacuggugugagccacugcaccuggccuacgguuguuuuuucuauguguauuuuaauuaugucucauugagaaucaucaagaauaaaaauaacuugaaaaauuggcaaguuuuccuauugcaaguaaaaaacucucauuuuuuaaggaaaaugagaguuuuuuacuugccagaggaagucacuaccaggaauuuuaaugguuaaaaaaauuauuuucuuuuugcgaaauauucaugguucuucaacacucucuagacacaacagcaaggcucccuggccccaguacugcaaaacaaaccaaaaaaaaaguacagguccuuagucagcccucaaacaccucaagaagagguauauaauuccaucaugcaucauaccucugugccuguuaccuucacaaaaggcaacaaagaacuauagucauucuucccucuauucuagucccucaggcagggaauagguuggguuuuacauccaugugcaguauuauaauuuuaugcggaagcagagcagacaagagauugucaggucugaaauaaagcaaaauucuauaugccuuaacagugggcccccuaaauacacagucaauauuguccucauauuaaggucauuucuuucacacagacauugaagguacuaaucuacucugaaugucagcuacauucuugcaaaaaaaaaaaaaaaaaaaaaggaaaggacauugaaugagaaaaugcaagaaguguauguugcauagagccuaaaucuuaacugaaguccuucuguuuugagguacuugaaucacauuauguacaccauucaauacgaaacuccuaaguaaaauaacaggauaccauuuucaaaaucuuaaagcaacaaacuacugaugacuagaauuagaaaagcaugcuuccagaaaggugacuaaauacacccccccaacacaaaggggcaacggucaaagacaagacuggaauugggccuugcgagcucugccuggcaaccuuggcuguggaggccacaguggacagaguuacccacucucuucugggcuuguucccaccaucugugggguggguguauagggcuggggcuaagccagcuucagaagccccccaaccaccaccacaccaucaagucucucaagugggacugcugugcuguggcacgcacacccacacacaaguugccaacaguuuggaaguuagccccaguuuccaaauaugucaacccaaaagccauucagguaaauauaagugggagccacuacaaagugggacuuuaucaggcagauacagagaaccaaaaaaugaaguugcugaaagcugcuguggagauuuaagucuuuuguuuuuaacggaggaagauaaugaggcccaggaacacagcuuccuagaguaagacaguguuccguccuggccuccaggauguucaacaccuaucccaagcuucugagcauucuguccucacuggcuucucucagugcuauuuccaaauaaucuagauugcaaguuaucacaggccacauuccugaaaaaacacagagcaauccugcugacccacuucagggaagcccuuucauaacaaaguuacccaaaucuucuggagggguuuaaugagcccagguuauauauauuuagugaguuucaaacacucgccaggcacuuugaaacacaguuccugaauguagguguuaacuguaaggcugugaagggcaaugaucaaagacaaaagcacuugcuuucaugauuuaaauaagacauccuaaccagauuuucuaaaucacuauauacuucaauggauaccaagcacugagguggguccccuagggcagggguccccaccugcuggcugcggaggggucaguggcccauuaggaaccaggccgcacagcaggaggugagcaguaggcgagcauucccgccugagcuccaccuccugucagauuagcagcagcauuaguuuaucagagaagccggaacccuguuguaaacugaguaugcaagggauguagguugccagcuccuuaggacaaucuaaugccugaugaucugagguggaacaguuucauccugaaaccauccucuaccuccuucuauggaaaaacugucuuccacaaaacuagucccuggugcuaaaaagguuguggacugcugcccuagggcacuggcucucaaaccugacugcucguuagaauccccucagaaucuuuaaaaaauagugaugccugggccccacccccagagauuuugauuucaugagggauauggccugggcauuaguuuuuuaaauacugauggugagucuaauauacaacaguuugagaaccacugcuguaagaaacaaacagaaacauaaaaaguggaaacaacucaaaugaucaucaacuggauaaauaaaaugugguauagccauacaauggaauaguaugcagccauaaaaaggaaugacgcuauugauauacguugcaacauuuuuaaaccuugaaaacauauugcugugaaagaagccagcaacagaaggauaaauacuguaugauuccauuuacaugcuauuccauuuacaugauauguccagaauaggcaaauccauagguacagaaaauaacugaguaguuaccaggggccaggagaguugaggggaaaugggaagugacugcuaauggauaugggguuucuuuugaggguguugaaaauugauuacagugaugguugcauaacucuaugaauaaacuacuaaauucauaggguugcauaacccugaauuagauuaaauggguaaauuguaagguacguaaauuguaucuuacuuuaaaauacauauauaucuauaaauucuaucuacuauagaggaaaaaaaaacagauacauaaguaagacaaguaucaacagagauuuaaaaugccauuagagaggaucaccuaaguaauacagaagguaaacacuauaaacucagaggaggcaucaaagccuaagugauccauauuuuucuuuucuuacucauuuuucuucucugauuugaaaaagcaauagaguucagagcuugucaguguacagcugauaauacaggcccuaaagucucaguucucaccuuauuuggaauggcuauuuagcauugucuuagaauuaaaaacaaauauucagaauacaggcuguugauggacuguaaugacucucaagagucaauuaucaacagagccuuugaaagauggacuuggaggucaggcgcaguggcucacgccuauaaucccagcacuuucggagaccaaggugggcacaucaccugaggucgggaucagccuggccaacauagugaaacuccaucucuacuaaaaauacaaaaauuaaccgggcguggcggcacacacuuguaaucccagcuacuugggaggcugaggcaggagaaucgcuugaacucgggagguggagggugcagugagcccagacuguaccaaugcacuccagccugggugaccgacugagacucugucucaaaaaaaaaagacgaacuuggugcuguaaguccuacuuaugcccuggacuugucuuuacuaguaccagcaguuuggaccaaauaaacuuacaugcucaaauacacaaaaagacuuuuaaauaccaggauuugcaacacacagguauuauaguacauaugccguaaaaacgaaugauuaaacgugccuccccuacucaaaguucuuaauauacuuaauaaucauaguuaagaguuauuuauuauggcagaaacugacacacagaaggcucaaacuuuagguagcacaggauuuuguuuaacagucuuguuuucaugucuaggguauagucugguacaagaaauccaucuaggccaggcgcgguggcuuaagcuuguaaucccagcacuuugggaggcugaggcaggcggaucaugaggucaggagaucgagaucauccuggcuaacacagugaaaccccaucucuacuaaaaauacaaaaaauuagccaggcgugguggcgggugccuguaguaccagcuacucgggaggcuggggcaggagaauggcgugaacccgggagguggagcuugcagugagcggagaucaugccacugcacuccagccugggcgacagagcaagacugcgucucaaaaaaaaaagccaucuguauuucuccaaguuucugaauguuaauauuuaauauuauacacuugaacauauuuuugcuuucauuuacagaaaacauaccauuagcaauugaauaaaucuuggccuauaccuuaaagcccuuuuaauaaauguuuguuggcgcuuauuuaaaagcagguagcagugaaauuucaauagcuccuagaaauuagaugaucaaagaauaaacucuauucucuauuuguggcaaacuuauaaugaauauacauuucuacagucagagaugaagacaagcagguuaaaaaugacaucuaguaaacuuguccuccucuacccugcugugcaacauauuucagucaacuuucagaaaguggcuggaccaagcauuuaaaugcccugagguugaccuggaccaacuuuuaggcaaaucauccaucagauccuauaaguccugcagcacacuuaauucagacaaauaagacaauaauuccaaaaacaacuuaacaauaaggacuaagaaaguguuuaauuuugagauguacuauucucaaagacccaaguaagcuucaacuagauaagaguugagcccuuaugcuugcuauaguucagaagugccaaaacaugagauuaggguugaauuugcgccaucagcuuucugcuagcuguuuucaacucaaauuuuccccauucugcucucuuuccuucagccugguuuaacccugucugucacacucuucaccauauucuuacuaccaaacuuauuuuugagcacuacuucaaaacaaaaagagccaauggaacagaagaaauguaccaaguagcaaggcaaacaaaggcaaagacuccaguagcuaagagauuuaauuaagaaaaaaggcaguuucugaaaaaugugaggcagaaucuuggacauugccaaacaucagaaauuuuuaaaacuauuauuauauuaagaaacagacuggcgcaguggcucacaccuguaaucccaacacuuugggaggccgaggcggguggaucaccugaggucaggaguucgagaccagcccagccuggccaacaugguaaaaccccaucucuacuaaaaauacaaaaauuagccgggcagugggugccuauaaucccagcuacucgggaggcugaagcaggagaaucacuugaacccgggaaguagaggcugcagugagccaagaucaggccacugcauuccagccugggcaacagaacaagacuucaucucaaaaaaaaaaaaaaacaaaaaacaaaaaacaguccugccuuucuaaauugaauccaccgaggccucugugucuuccuuaaaaggaccacaguggguaccauugauggauuguauucacucucccuguauuuaacaagguccaccuccccacgucacauacagugauuaaaugucuugcuaaauggaaaagcugcagacauuaaucuuuuauauuccggccucuccuucccccagaauaggcaaaucucaacuuacccacuuuuuaaagugugagcuuuucuuccuauuuagaguuuaaggaguuuugguacagucuggaaguggugauuagaagcccccaggagucaaaccuguuugaaugcuaccuuggccacucaauaguauggucaccuuagcagguccuggccuuucucuaugccucucuccuaaccuuuccuaaccuaaugccugaucuaacuauuaugccugguuuucccaaccuggaaaccagggauaauaauauuucccgugagguuacuguaaaauuaugcaugugaagcaauuaugucuggcacccagggacgugcccaguaacuuaucuauuauuaucuuagugccaaauucuuccugcauacugaaaaguuaacccaggcuugaggaacaguuaaggaggaaauauugacacaaaacccccuuuaaaugucuucagucaggacagaggaaauucccagaaaaaaaaauguacuuguuggguuccuuuuuuucaugcagcuuuguuaaacaugauuuauccucaauaaaaacaaauauuaagaaaaaugaugcauuuggcuuucaacuuuuccugguaauccuaaagacagagucaguuuuccccccaacauugcuuauaagaacccagggcaagaaagaaagauuucaaaauggcccaaguuauuuuuaaugcguaaaagacugaugugaguuaugcauuuauccuccuacaugcugcuuccacaaccucucaagagauuuuucacauaucuaaaaagucaaguuguucuuugcuuaacauucauucaggagaugagaggccuguccuauuuuucuuuuguuugacuuaaaaauaaucucaucggucuauuucaauaucaacuucaucccucaucuaggaaagugcuuuaucucuccaagacacccuugaaaagaguaauggaugguuccuuccaccuaauggagauacugaaucuaaggcucuccuuacugcccuguuuaucaacacauccucugcacagaaggugaaaaacuauauccuacuaccacuucacaccuggagaguuuuuuuugacaaaaggucaagaaaauguuugacucuguucaaaucuuuauggaugacaacaaucuaauaugaaucauaaacaaaaucaauucuaaauuuucuuguucuuuuucuguuuucaaauaugcaaaucgaugucugauuacaaagguagaaaagcaguuauuuuuaucaaacguaauuggaaaauacacacuuaaugcgguacauauguuucacgcauuuuuguauaaggaauguuauauuacacagcaaagaaagaaaaauucaaaaauaauagagggcuguagacaauuccggaaaucagaaaaacuaaaguucauuuuuaucauauauccuucagucaaacaagcauuccuauagauaacucuugaacagcagcuauuaaauaaaucggaagguacaauuuaauucuucacuaguuggaaccagaagaauacaaucccaaugaagacuggggaaaaguucaagacaaacaacuuuaaagggggaaaaaagcacaauuaauacauuguccauaacuuaaaacuuuacaauagaucuuuggaauuaaccgaaaacuuuacauuuaacagcauaaacguauuuacuguacaucaaguacacauuuccuugaauuccaauuuuuuuccuaaaauucauuuacaaaagaaguuagaaauauaaauaucuacuuuuaaaguuucuacaaaggaugagcagaaacuucuuuucacuuuuauaacaauucacagaaauuagcaaguguuuugaaacgcaagcguuccacucucugccccugcagaagagggggaacauguuaagaaauugaggcaaauucucaacugaaaaggaaacauauauaaaguacucaggggagaaauaauagcugaaagcaaaaaauuacuaacagacuaaaagcaacagaaauucuaaucuacacucgcaacucuuacccuugacagcacagaagagaauaucccgucuuacacauuuuggaauugcaauucugaaacgcuaaauccaaagacaaagccgcucuggggaaaauagcaauugcgcaacagaucaacagcuccaaccugucccuuggcccuggcgcggcgagguuugcacgcuauaaagcaggaaagggccaaccgagggcugcugugacggccaaccgagcgcugucacggaagccaaggccacgcgcgcggugagcgccaccagggggcaccgcguccgaacuagaagccccgggugccgccgacuccggccucagaguccacugcccucgcccgcacuuucccgcggcguuacgaggggccaacuccgggugcccgagcccgaaccccuccccggccgagaaagugcgcggggcccggcucagccgccacacgucggggcuucugagcccgcugggcacuuaaggcgcuccucccucgucccggggcugggcuuucaagagagcucaaggcugccagagagugauccgagagauggaugacuucgcaaagccgcgcccacagacggcccagcggggugagcgcgucgcagcccgcacucaaggaggucuuggggcgcggcgaaggggcuccgggucccagcccgaaggcgaccucaguucccccgagagcggccccgugacuaggcacauuuuugccggcaccgaggcgggggagccgcgcagccccggaagggccgggccgcgccggcucagacggccagcguccgcccccucuugccccgccgcccaccgggccgcucaaacuuaggggcuccggagucccagcucucgggcccggggacgcggcuggauucucccccaaggcccacgcgagcgggcucaguccccagaccuucccgcaacuucccacccguucgcccucgggcucguggucggucggaucacccggccgcguccccgcugccccuccccgcccugccccggcgcaagcgcggcggcucuacccagcgccgcgguccuggcucuggccagacgugggggaagccgguugcggcugucccucccgggccgcgguucccuagcucccccgcccccgucccggcaccaccgcagggcccagagggccgaggcagcaccugcugggacgggagucccggcggcggcagcuccaaguccaucaugaugagcuguggaccguguguuggggcuccccgacggcggcccuguuccggcugccgaggcgcggcgcggacagggcggcucugguggcggcggcggcggcgguggcggcugcgucggcggcuccuccgggcuccccggcacucgguaaucggcuacacgccggcgggccccugccccgcuccgccucccgccccacaaggg

SEQ ID NO: 13235 - RNA, 3214 nt, Homo sapiens
uacuuuauucauuaucguauauuuuaacaauguuuauuauucauuuaucccucuauagaaccaccacccacaccgaggagauuauuuggagugggucccaaccuagggccuggacucugaaaucuaacuccccacuucccucauuuugugacuuaggugggggcaugguucagucagaacuggugucuccuauuggaucgugcagaaggaggaccuaggcacacacauaugguggccacacccaggaggguugauuggcaggcuggaagacaaaagucucccaauaaaggcacuuuuaccucaaagagggggugggaguuggucugcugggaauguuguuguugggguggggaggaguuauuucaauggaggaguuauuugcagauugcagagagaaaugagggaaguucgccuacaccgggccaucugcggggucugcaggugaggaaaagagagaaagcauuggcugaaucuauaugcccauuuuuuaaaacaagauccaaaguccaugaacauuuuacacacaagaauaccgaagcuuaugguaccuauugguacaaaagcccuaaguaccaauacgagaccagaguuggcauucgugccuuuaagagaucccuuuccuuuuucccucugcccucucagcaacccccuuacccccaaccaacacacacacacacacuuaccagugggggcugcuguaugucuuggcugccgaacggggaaggugacauaggcaucauagccaaagaggcacguagcgauuaggcccaguaccugggggacaggauaggagugaggggguuuagauuagcuggucagguuacucagucucuuaucuucuuguauccaccaccuccagcaccugccccacgcaggaugggacucaagcaccggguugguaagccagggaaaggccaagagagugcauccuaccccacucucccuccuccuauaccucucaacacagggaggccacacuguggcccuacccguagggggcacaauucaagucauacuuuuuuuuuuuuugagacacaguaucacucugucacccaucugucacuggggcuggagugaguggcaugaucuuggcucacugcaaccuuugucuucuggguucaagugauucuccugccucagccuccugaguagcugggacuauaggcgcccaccaccaugcccggcugauuuuuguauuuuuaguggagaugggguuucgccauguuggccaggcuggucuugaacuccugaccucaagugaucugccugccucggccucagccucccaaagugcugggaauacaggcaugagccacugcgcccggccccaauuucuacuacauuugggacaaaguucuugcagaugguagucuagugcguugacaaaggggccgccuguuuguaccucucaccaagguccuugugucugacaagggacuucccuucacagcaaaugaagaccuugggaggcaaaaccaaguccugggccagacuuuccuccaugucugaggacaagugugacuugcugugggucacacgauuucugccagaagcaaaggcagaaauggucccuggcuccucaaacccuucgcucugugcuucagagcugcucccauggccuuuaccccugcgacgauuuuggagugguuuccucucucaacaaggacaacaauggaggugaucagguagaggauugccgcuaugaggguucggaagaaauccugugagguguagggaggagaagagggaagucagcaaccacaguuccccgacaauccuaacugcccagaccccucccuggucuugccauuguggaccccuucucacacuccagggccaguugaugaaugguaucuuggugugcaggucacacauguagacaacaaagaaaauagcagcaaggaucaucucaaucaccgacagggaggaguagccugguguggaggcacugaagcagaucaggaucaccaggcauaauaucuggaagggugacaugggaaaggggaccucaaucagcaaccagggcugagaagauugguuuaaauugggggucccauacuaagaugccuacgagggcuggggaaaugacauacaauaauagcuaaacacuuuuuaugugcucacuguguuccaaauucaaucaucacgacaaucuaaugcucuggguacuauuauuacucuuucuaauuuauagacgagaaaacugaggcacagagagguuuaauggcuuggccagggucacccaacaaguaaggaguagaguugggugccucaguuuccucuuuucccuucuagguuacgggcagccugaggggaguggcgcugccagguguuuugugagccccgcugacgccagcuuuguggccuugaccggggcggaacacgcgguucccccagcaaccccuuugggaagcggugagagugacaccagagaggcaggacuccguuaaaggcgccgcaccccuuuuacaagugacucaaaggcggcgcccacuuugagaaggguggaaaccccgaaaagcuaaggacaucccgcccggccucugaagggcgaggaagaacuggcgaagggcggggcgcucuacaccgcgggacuagcgcggggcgggggggccccaccccaacaggcccugccccugggcgcgcugccagcccgcccuccugugcccaggccgcgccacgcccugccacaggaggcccccacuucccagcacccugggaccccuucgaugcguccacugaugaguucacgcaggcuguccccacguagcccuccguaugcguuauaggcuccuugcuucaccccggggaccaccagaucucaacaaccuucgucaaaccccaccgacucgcccugcgccccggguuucgggccuccaccgugaacccacccaccugcaccccacugccgagcgccccggccaagugccugccucacccggaccauccaguuccgcaugguccagccaccccaucccgcuuuugcccacgcgccugccccagaacgcucacaaucucagcaaacaggaggauucccuuucgagugcgcgagaaguuggugcaggcggcccagcagccaggagccgagaggcgcucagaauccgccauggcaugggcuggagucccuggugccucggaggaucugcucacuugcucgugguuucgaggacgcuguacacccagcugucuugcccgccgucuggccgggaagggg

SEQ ID NO: 13236 - RNA, 151163 nt, Homo sapiens
caagucgccgcgguggcugccgggaugcgccgcagcgaauggucgcgccgggcgccgcucugagugaccuuucacccgcgcccagcgguuccgggcggcagcacaaggcgguagccauggcggaggcggcggcugcagcgggugggacuggcuugggcgcgggcgcgagcuacgggucugcagcggaccgggaccgggacccggacccggaccgcgccgggcggaggcugcggguucucucuggccaucugcugggccggccccgggaggcucugaguaccaaugagugcaaagcgcggagagccgcgucggcggccacggcagcgcccacggccacucccgccgcgcaggagucgggcaccaucccaaagaagcggugaguagcgguauguggaaggaguuagcgucgagggaccaggccgggccugugcugcaggagggcacaggcgaggugggaagggaagugacacgggugggcggaaggcaucccggucccugaaaguagggacccaccucucuuucgagagaguggacuagacccuggauucugucaggaagggggcgggaugggaugguggauuuuggucacuaugugaggguaacaggcuugaagaacucucguuggagaaggguuuaaaggauuccuuuuuccugagcuuuuagugccaggaauucauuuuuuaucuugaauuaauacuuuuggugcugaggucuuggaauggguagcagagguucuauuuuucuccgaggagauauaaauuuguacuagaugauagaucauaggaaucucucucauucgcgaaagccugcugugggggaaacugguggugcccuggaaaaaggugcugacugguuucugugggguaaguuccacuugcuuaggaucaagauguauugacuuugagggaggaaaccgaugaaugguaagaagccauaaacugcaaacacuagcuagugguuuaagguguggugguauagcuacugagcucuguguaaccagaagcuaaaagacaagagucuaaccgaugagggauguuuguaagagaucuugacuuucgauguuuuuggagaaaucuuuuuuuuuuuuuuuguauuuuuaguagagacaggguuucaccguguuagccaggauggucucgaucuccucaaucucugaugaaggcuauuaggagaagcuacuuucugacguguggcuuugucaccguggauaaauggauaaaccgagagugaaaaaaauaaguagcuaauguuuaaaguguacuuuuaagugugccaaagugugcuaaauccuuuguuucuucccaagcuaugagguaugugcgguuuucucccauuuuacagaugaauaaauuaagucugcuggagucuuagcagauaugcugugugacagguuagaauuugaaagcacaucaaauugacuucauggccaaguuccuaagcuauacuugcuucugaugaauuaauucaacauacaugagucuuuacaaaauacacacuguaccagcaauacagaaauuuaaaaauacgguauuuacucuuaaggaaggaauagcuuaguagguaaaauuauaauacagcguuauaagaaacuuaacugggaacuauaccaccuggucauuuaacccaguuuuggguuuguguuuguuagugcaaagauguuccaaaguaaagauugucugaguaaauuuuggauguuugcauuacuaauaguuugccaaagggggaaauuguucuuggcauacaaacaguauguucacagguaaagaagugagagacaaauuagggaacugcugagacucaaguguaguaggagagggugagaaugacaggggacgaagacuggagaggugaaucuuguuuacaggauuuuacguggggcaauacaugauuagauuuaccuuugauaaaggucacacugggagcaaauugaagacaguugagcauuuuggcaguauaauggcugggaacauagaccuggauuucaauuuccacuacaccguuacagcucuaugaucuugggcaaaucacuuaaccucugagaguuucagucaccgucauuuguaaaaacgggaacaguaauccuguuuugcaguguugcugugagaauugaaaaaaauagaguuaaaugaucaaguguuuagugcaaugccuguuacauaaccuuucaaagaaugguagcugcaauuuucacagugucuaaaggcagagagacuaggagacuauuauuccagggagaaaugcugggauucugaacuaaggcauauuauugggaguaggcaacuuaauugagaaaaugcuaggagguaaauuuuccauaacuugguuacugagugguggggaggggaggaauaaaggauuucaucucgucuccuggcuucaauugagguuauauuauuaauagcugucauuagguuuaaaauuuucuaaaugguuucauguacauuuauguguucucauuuguaugcauauaugugauuguacauuuuauguagauucacacucuuagaaccaaguaaggagggcagguuuuccuuaugguuagauuuaauggcuugguuuacagcauucagagaaaaaauaguaacguuuguaaggcacaccaagaugaugguugaaggugacuggucagggaugcccuguguggcugcuccaaggacugaaggcaucgauaguucaggcacgacuguaacccauuuguugcauagguuacagcuggugggaagcccuggucuuugguucgggguuagacgacuagugguaaaaucuaguccuguacugguacuuugagauuuucaucaaaauaugagggaacacagaaacuuguauuagaugacacaucaaaagcuuccacagagggugauauacuugauagauaaucaugaggaacccaagucucccuucuacuuccuacuuagcugggccugcaguugccagcuacagaauccagccuaaagggaagauaaaugauagaggaagaaggaaccacaguauauaucuaauaaggugugaguaugccuauaugucaauuauuuuggaauaauuuugugauuuguguauuauuccuucccuuuuauuacuuuggaugauaacauugcuuguaauuguuuuaucacaugguuguuuuaucacaugguugguuauaucacauggccuggaguagugacuucuugaaaugccauauuuucauuccuguuacagaauagucaugcauauguuucaacauuuauagaguaguugcuuuaugaagguccuguccuaggcauuggagguaaagagaugaauaaguagucuucagccucaaagaguucacaaucuaggaagugagagacacagugcaguuugauuagagccacuguagauacagguacaaauguagcacaaaggaaagacugacuuacucuauaugggggugggaggguggggguggucagaggaagcuuucuggagaagauuuuaaaauguggaugguauuuugagaguuuauauuccaggcaaagggaacagcauaugacaaagcaaggggccaugaaagugcauaucguauuuacauaacuaggugauuuaguauugguagaggugagaauaaaaugaaaggagggcaguggcaggucauggaggucuuuggcuuguggguuaucaguccauucguucaugcauucauucaugcuuauaaaauauagcagugaacaaaaacucugcccuauggaacuuauauucuagcuggaguggagacagugaacaaacaacuaauauaguaugucagguagugauaaauauaaagaaaaaugaagcagcugaaggggcuuggugauagagaacccuugaaggaauuaagcugggaagagacaugaucagauuggguuuggguuugagagaagucacuccagcuacaguguuaagaauggauuggagaacgguaaggauggacauagaucaguuagaggagaucaguuagaggaggcuguuguaacacaauaggcgagaaauaaugaagaauuaaacuaagaugauggcaaugagaauagggaggaaaugaugugugugagaguuuuagaaguucauuaggugacaccauuaaaguuuaaucacacuuuaaaacuauguaacuaaauuaaugccacaggaguuuggagacugaaugacaauagaaaagggaugacacaguccagaggaauguggacauuucagagggcugaccaaacaaaaccugcuguuuacuuaucacauggucuccuaugaaguuggcaccaauuacuucuuuuucuuuucuuuuuuuuuuuuuugcuauggagucuugcucugucucccaggcuagagugaaguggcgcgaucucagcucacugcaacuuccugccucccggguucaagcgauucuccugccucagccuccggaguagcugggauuacagagccugccacugugcccagcuaaguuuuguauuuuuaguagagaugggguuucaccaucuuggccaggcuggucucgaaccccugaccuagugauccacccaccucagacucucaaagugcuaggauuacaggcaugagccaccacgucuggccggcuccaauuacuucuaucccggaacauauguucucauuauuugaaguugcugagcagaguauugaagugacaguuuacucuuggauccucccuuuuuccuuaagugcauguuacccauguacaguuuuucuuuugacuuugcuucuaagugcaauuuuagauccuuaaaaaucauaguaaaugucaauuacauaugugacacuuuuacgucuugguuuuggauuuuuuucaguuuuuuuuuuuuuuaaggcucuuguggucuuacgaaaaagagaagaaaaaauaccauguuaacuuucauucuuccacacugcuaaccucuuucccaguuauaacuuuggcuccaaccucauugugguuugcauuagucagaacugcucaauggcaguuuuuacggagguuauaaauguucaggucaaaagaaugauuaagaacgccacuaauuguuuagucuacuugcuuauaaugucacuuacaaaugccauuuuaauaaaaagcaguauauuaacgucgggcauggugacucacaccccauaaucccagcacuuugggaggccaaggcaggcaaaucacuugagcccaggaauucaagaccagccuggguaagauggugagaccccaucucuacaaaaauacaaagaaaguuagccuggugugguggcacaggccugugguuucagcuacuggggaggcugaggcgggaggauugcuuugagccugggaggcagagguugcagugagcugagauugcgucauuguacuccaggcuggacgacagggcgagacugugucucaaaaaacaaaacaaaacaaaaaaguauuauuuaacaucugccggaagcuuugguagauauuuuccagaaggaauacagcugaguuaaccucuuguaaauauuucccaagaggguauccugaagccuguaagagcugauacagagcaaagguuauuugcacaagugaccuggcuuaaaacuuaacaucguuuggcaaaauucgagcuuauuuugguaguuauguugaaugaaauauuuacccuauuuugaguuccuagcuaggaauucuagugauaguaguaauaggaguuuuaauugacuaaguccuaauaugacaggaaccaugcuaaagcuuauguacauuaugucauuuaaaucucacacaacagcucugaaaaaugagugauacuauauguacauuacaguugaggaacuagaggcuuagagaaguuaauuuaucuaaggccuugcauuugugaaaugaaagagauggcauuucaacucuguucuugcuccagaguccauauucuuuccucuaugcuggauuaccacaucugauguucccggggagauaucuacuuacuauucaucaaguugcugucuuugucaugcuaaguuucaaaguuuuugugauuaaauagaucaugaucaaauacuuugucauauaguuaagaaggcauuaguuuauguuguacuuaauaaauuauaaaacaucauucugucaaaaugaaauucauaauaagaaaauguaaugggugguuuaaaaagguagaccagccaguuuacuuuugugagugcauuuugccauuugacuuguggaagaagacaguguuuggaaugaaagggaauuaggaagaauguggaagacccaagaucagagaagaaaggaggaaaagagaauaggucauggaggguuuacugccuaguugcaaacugucuuuggacugugaaugaacaggaaacugaagauuuaaucgcugugguuauuuguuaauaugcuucucuagauugcauuuuaagauggaccagaccuucucuacauagacuuuuuuauguugggaaguuacuauagagccaucuacccuuguggucauuuaauaaaaauaccugagaaugaauuaagugaucuguuuuuaggcugcagagaaauggauugcuguuguagucagaugagauacuuuauggaacacuuuaaaagcaagugcuaagcaaauauuacuccguuugauuuuauuuccuuauuauugagaagauaacuucugcuguuauuccgauuaguauguuaauuucaacccuaaaccaaaucaagggaucaugacuagagucuaccguuguagcauaaaguauuaauagcucucugccuauuaguguucucuuuauuuguugggucuugggggugauauuuugucauauccuugucccaacaucugggcucagaaucaacugagagauaagacacaggauacagacagagagguaaaaacauuagcuuuuuuacugauaaugcugguuggagaucguggcuuagaucuguacuaccuaauauuuacccugaauuacacuccaucacaggcaguguaccacagaaggccuccucugcagguguagagccuaacacaugcuaccaaaacaguagagagagaacuuacagcauaauuaacuuuugcagaaugaacacaucuauuuuaucuguauuuagauuaagaaacagcauuaccaguacucuaggaagcccucuuugugcucaucccaguggcuccuuccaccaggauaaccacuaccuugacuucuaacauauagauuugccuguuugaacuucauguaaauggaaucauacaguguguacuuuuuuguguuuggcuucuuuccuucagaguauuauguuugugauauuccuccauguugcaucuagucacauuuuguuuauccucaucgaugaauaguauuccauuggguagauauauaccacaauuuauccauucuguuauugaugaacauuuagguggugguuacuuuugguccgaauaauuacuuguuuuaauauaaagugcauaucaaacuaguguuuuuauagauauuacugcauaggaagagguuaaaguaauuaaaauaguguuuaagaauuaauauauuuacuuuucuuaaguacaucaauuguuugagguaauaaacagaaugcucccagguacuaaaucauuuuuauaaauaaauuaaauuggauuuuuaaacaaagugaccuugcaguguucacauauuauuuacgagcuuauaagauuucagcuuaaaaucauaaguccaacucuauuacucaauuacacauuuuaaauuugaguuacaagucagucauucuuaaagacuagauucucuuaaguuuuguaaauauauaaaauaucaauuuuuuguauaguuuucuuaaaaacauuaacaucugucuuugguucucuuaagcauuuguauauuuaauucuggaucuuucaguaguugaaauacgcuuacucauugaaaaaaacugcuacuauuccaguaacugcaguuacuuuugaugagagaguuuugccuccugggugagauucggagggguagauaucgucuugucauucacuaagaaaacuguuauaugauugcauauaacauuuguucuugccagcauguuugaaauuacuaaucagagauuuggccagguugcugaccagauucuuguuguugaccucagugggacucuccaaauucuauuuauaguugcugugucagagaccucauccuauaagcaggggaaugcucagguaucccaggaccuuagaaucaaguaaugugaacuauuuaauuugcuauaaucacagaaguucgcauuuccaacucagauugauuaccuaguuggguuuuacauuuuuucuaaaggugcuugaacuaacuguauaggaauccagccuaaggaauauuaaaaugacaccuacuugaauucucuuaucacuuuagucacauauacuauggaguggauauuuugcugucaacucaaauuuuguaggucgacacuauccaguagagcuuucugugauagaaauauucuguaaucuguguuauccaguaucauagccacuauggagcugacuuuuaaauuuuguuuaauuuuaauuuaaauaggcacauguggcuagugauauaccgugcuggccaguacagguguagguggaaaccuaacucauuaucuucuuucucauucucuagaacuuauuuaucugggcuuucucauaucucauaguguuaacacuagucccacagucacauccuucaaucccuaucuugaacuucuuuucauucuuuuaagaucgaacuuucuuuugaauuuauucaaauuaauaauuaauucugcagucacucugcugcucucauacauguuugugucaucugauccucacaacugcccauuucacagauuaggaacugaaauuccuagauacuugccagaaaaauauauuagucaguuucuagcuacugagugguaaagcuuaaauuugaaucuagauuuuuuaauuuuaauuuuuuuuuuuuuuugcgacagagucucgcucuguugcccaggcuggugugcaguggcacgaucucggcucacugcagccuccaccucccaaguucaagugauucuccugcuucagccucucauguagcugggauuacaggugcacagcaccacgccuggcuaauuuuuguauuuuuaguagagaugggguuucacccuguuggaccaugcuagucucaaacuccugaccucaggugaucuguccgccuuggccucccaaaguacugggauuacaggugugagccaccgugcccggcugauuccagauuuuuaaaacaucucaauucuagagcuuuuuccuugauauuauauugauaucacccagcccuguucauuuuuuccuucacaaucuuucacauucauuuugugcauuaaacaaguauuuauugguuacuuauguucuaagcacuugggcuaugucagugaacaaaauggagaaagauuuuuauuuucuuggaacuuacauuccagugggugaaauggaaaauuaaacauaguaaauaaguaaauuauuaaguauguuagaaggugauaaguacuguagaaaaaagaaaaaguagagaggguaaggagguaggguucaaauuuuaagaaggaugucaaugaaaacaugacauuugagcagauauuuaaaggagaugaguuuagucauauggauauccaggcaaaugaguguucuaggcagaggaauaguaugugcaaauauccuaagaggaaaugcacauguggcauaucaggaaagccacaaggagacuggugcagcuggacucaauucauauccccucaccucuaaccgcuguuuaaaauauguagcuuuuaaacuucagcuucugauuuaccuagcucuucuacuguucuaggcagagucucuuauucaugccacauuuuucagcuuuuacaccuuuuauugugccauugucuggaagaccuuugcuuguugauugaucccauguuucagagucucuuguuuuggggaucuuuucuuuuuacuuuugagaacuggggaagcauugaucuaucuccuguuaccuuuuccccacgauuucucagguuaugaagaguaacuuuaaaacauacgguuaagugcuaagugucauaggauauaauauguaggucuagagccuugaauucauuuaaaucaccuagguacucuucagccaccucacccauuugaaacuucgucuacuggcuggccgcgguggcucacgccuguaaucccagcacuuugggaggcugaggcggguggauuaccugagguuaggaguucaagaccggccugacuaacauggugaaacccuguaucuacuaaaaauacaaaaauuagccaggcgugguggugcacgccuguagucccagcuacucuggaggcugaggcaggagagucacucgaaccugggagguggagguugcagugagccgagaucaugccacugcacuccagccugggugacagagcaagacucugucucaaaaaaggagaaaaaagaaaaaaagaaacuucaucuacccagguuugcaauuacuuugugucuuccauaugcuaagcacuggggaggauuauugacacaugguuuuugccuacugggacauguaggucuacuaaggaagacugaugugucuucuauuacugcaagauguaagguauaggaaaggaauggugacuacuacaacaauggaagggcaauuuuauaucaaagaaaccuagucuagaaggauuggaagaguauuguucuaugucaagauguuaugcaaaaauucuuaaaucugagggugaaaauauugaugagagagagcauuuggaugagaacagaaucagaagaauuaggguaggaaaaucugggcaauguaauaaaguuuauaaaacugguguggcaguuugcucuaguaaugauggucuuucagcaaucuggauaguguuuagaagugucauucugcuaggagcugaaugucuggcaguuacuuuacaaucauaaagaaaagggaaaauaauuuuggcauucuaaaauguuaugcauuuuguugcagaaaaaaauagaaaauaauaaucaaaaugaagacuaacauuaagagauaaccgcuauagcacauuggcuuagauccuuucagacauaagcauaugugugugaggucacgccauaauaaugucuugaaauugccauuuuucacucacugucuuguguauaccuuuccuuaucaagaaauaauaauguguaaaaucauuuucagugacucaggaaguauuguauuauauguagguaccauuuaucugaugaggacgguguuauauuuguuuccaguguuucccuauuauagagaaugcugugguaagcuuuuuacaauuaaauccuuaauaauuuccuuaaggcacauuuuuaaaaaagggccuuaaugagucaaagagcauuggaauacaucauucgcugaucucauugggcguggacagaaauaaggaacgauugcuuguuuggacuuaauucugacaaguaauaaaaaauugaaaaucaucggaaucuuuggagaacgacuacaucauauuugagcaaguuuguaucuucuaauuuagggaagcagcuuuccagaaauuuagauaaaaggaaauuagauguucuagccugagucuuuaaaggggaaaccaaaacaugaccacagggagccuaaggaauagugcuuaacccugccugggucuauggggguaaugagaaggagggagagcuaagacgacuggccuagauguaucaguuuaaaccacuuauugcuaucaguaaauaauguacauuccgugcuuauucagauggcuccuauuuacuguucaggcaaaucuuguuacauggagugauguaauuuaaggauuauggugucagcaguuuucauucccugccgccccccaccccaacauuuugcauguauuuaaacauguugcagaauugaacuucacaauacucauuaguguaccauccaccuagauucuacuguuaacauguuacugugcuuaucacauauccauuaauccauucuuuuuuccaccuaauauuaaucuauuuuguuuugaugcauuuuaaaguaaauugguaguuucauuuuugaaguuaaaucuccuucagaaagguucugcuuuuuucuuuuauaucaguuggcuuugauuuccagauaguauuuguuuugccuucacaaauuauuucuggcuuuacaacuauuagacuacuauucuaauuuugauuuuauuuccaaguucauaccugccaucugccauuauuuucagaaaguacauucuaguuugccaugccugcacucagauuuuauacaauugguaacuuaaaaaaauuaucauauuuugguauguauacuaaugagggauauuuguuauaaguauuaaucugagcuagguuaaagcagaaaagggaaauuuauucuaagaguacaggggugccaaagaacccaaggguaagaauggagcuuggccucaggauggaauuagagccaagaaccagaaagccaucagguuucuuacuaguaucacuucuugcuacuauuugcugcaggcuucucuaaguggaucagcuuuuucugcucuucuguccaaaugguaaaauauggcugccccacuccuucaggaauucagccaauagcacagaauaauugaaccccuuguuuccaguccuggguuacauguuuacauugcugcaaucaguuauugccuggaaggaaguggugguagucauaggacauagguagcugcccaggcagcuaaaugagcugaaccaacucugguuaucaugcauuuaaagaugauacaaccagauuaucugcucauuguuuuugaugauuccuucucuauaauccugcuccaugaauuauucuauugauuuuccuugagucaucaaucuuuuucucuuuguugauuuuuccugcugcuuaaaagcaugcucagauaacguuuugaaauuuuccacacguaucacucuuuugaaaaggccuuaacagccaugaauaaccuaauuauaaaacuuuuagccucuuaaccaauucugguaccugguagauguucuuaucucuucuuagcuuccauguuauugcacuauucuguuguuuuuuuuuuuuuuucccaccuuccugucuuucugaccaugguuuugcugacuuccuucucuuccuaagcuuaaaaaucccuaagauuaauuuuuagucauuucuucugcauuuucuuccuuaaucauuucaucuacuugaacuguaauagcuuuuaccacuguugggggaacuuuaaguuauuaucucuaacucucaacucucauuuuuacauuuuuaauuauuggguauuucuaucugaguaucuugcugguuucuccaacucagcauucauguguaaggucauuauuuuagucuccaaucucaguccuccacuguuucucuucacuuccgccauuauuuagaugcccaaguccaacaacaccugagucaugaguucuugcugagcuccaucccccaucccuuauuugguucauugacaaaucagauggacuccaagucagauggacucuauuaucgacucucaagacacuuugcuuuucucucauugccaccagccuagaugaaaucuuaauugucucacuucuagccuggucucccuuucuuuuguuucccgccuuuaaaugauucuucauucuauuaccagaccaaucuuuguucagagaaagugucaguacuugcugccugcuugugcugugcuacauucuaacauugcaaaaaugauugacagucaguggagauauauagauauauaaaagauaugauguagcuguagucauuguaugcagaagaaagagccauaaauucuugaagaagauaggaaaaggcuuuauagaagugacuuuuagacugguugccuccagggagagaagggcauuuuagacaggggauauauacaggaagacauaagaggacaugguguguauaaggaauugucauaacuuaaugugucugggaacagcuguuaaagaaggugaaaauguagaguggugcuguguuuaagaauugggauuucauccacauuggagaaucaacaaaguuuuaaaguacacacugcuagauuuugacuuuugguagaagcaaugaacauggaaaauacuguuuugauucuauuguucucuauugauuauugaaguaauaacaaucucuuauuuggcauucaaggcuuucagcuguucucuaugacuucuugaaugugcuuuaugcuucagccaauuuuaugcugcuuauuagaugggaaaauccuugugcuuucuuccucuguuugacuauugaaauuuuaccaucuuccaaagaagggaaaguuuaaaugccuccacaaugaaggguucuuucagcuagagaugaacaccacugagcucuuguaauaauuuguacuccuuguguggccaucauugaguauacugaaaucuuugcuuccuaguuaggaguguuggagccagacagucaugguuuaaauccuagcuguaucauguacuguuccugugacuggggacaaguuacugaaucuuucuggaccauuuuuuucauguuuuaaauagggguaaugacaccuacaucacaggauuaaagugagaaggaaauaagguaaugauuguaaagcccuuagcuuuauaguguuaugcaauacugucauuguugcaguaaacuacauagaaaggaguaauaagaauagagugcuaaaauaguuucuauauuagaccauuuuugcauugcuauaaagaaauacccgagacuggauaauuuauaaagagguuuaauuaauucacgguucugcaggcuguucagaaaacauaacucuggcaucagcuucugggaagaccucaggaagcuuacaaucauggcagaagaugaagugggagcaggcacuucacauagcaaaagcaggagcaagaguugagguugggugugggagggggaagugccacacauuucuaaaugaccagaucucaugagaacccacuguuguaaagacagcaccaaaccuugagggaucugcccccaugacccaaacacuucccaccaggcccuaccuccagccccggggacugcaauuuaacaugauauuugggcagggacaaauauucaaacuauauugguuucugaagauggaagcacagcaagaaguaggagguacucaguggcaauaaugacauuuuaauagagaaaacaaauuuccuuuuuuuuuuuuuuuuuaaaaaaaagaggugggguuuugcuuuguuacccagguuggaguguaguggugugaucauagcucacuguaaccuugaacuccugggcucaagaaccauuguccugaguagcugggauuauagguaugugccaccaugccugguuauuaaaaaauuuggagcagagucuugagguauugcucaggcuggucuugaacaccuggccucaggugguucucccaccucagucuccugagucgcugggauuauaggcacaagccacugugccuggcgagaaaacaaauuucuaguaaaugucaccuuaugcauuaggaaggaagguaagaacccaaaaaguguagaacaucagcaguuucucguacuguguuuuaggcugauugucaguaucacacacaugauguuuggucauucuugugcuauuucugguuugaaacucuucuccaugacucuuaguagucauggcucaccauugcuugcuucuaugugugauauguggccuugguggccacacauuggaauuugaauaaauauauucuugugcuaaaggaaaguuauuugauaaauaauuguuuuaauuuuuauacuuuuuaagacuuuuauaaacauacaugaacuaggcaaauuuccauagcggaucaaacuuccuaaaauuugcaucagaaaauaugaucucuguauagcccucauuucuccuuccagauaguccuuuguaagauuuggguauagauuuaugccaccuccucugucauguaaucauauuuccauuuccuguuaucucuuuccccugucucccacauggugagugcugccacuuugcccucuugcugcccauuguuuucuugcggaauucuacucagggccauccucuccuauagugaagugaauuuaaaguuuuuccuuuccguuucucucucucaauuccagucuccugauuuugguaagguuugggugagagcaacuuaauuguaaacaauuuacauuaaagcuuuguauuccuuuguggcuauucaacagaugaggcuucuauucuuaacuuuuucucaugucuuaagguaaugcuuacccacauguggucuguggaugacccucaucagaauuuucugagggugcuagaaauuguaaucaugggcugggucuaggguggcauccaaggacucugcuuuuaaaguaaguacccaaggugauguuuauacucccagaaaguuugagaaccucuguuguugugauuggguccugcuuuuaaugcuuucuucucuucccccaaacuuuaugggguucauuuuuuccauggguuugccggaagcaaagauagcaaucccaacuaccugucacuuaaaguagaaggggcuacugcugauuuuuuuuuuuaaucauuauuuuaaguaaaacaaaccaaaaaaaacccaacuacuguuuuguuuuguuuuuuuuucucacaauugcaagauuuaagagugaaaacagagcccauacaaugggaggagacccaaaggggguugccacucccggcaagaaugcuugggguuuauaucccaaucauugucccucccccuaugcucucaggugauauaugauuugacuuuuuuuuuuuuuuuuaccuccugcuuuagccuaauuuguauuuuagugagcccucuuuacuaucugauugguugggugugagcugaguuacaagccccguguuuaaaggugggugcggucaccuucccagcuggguuuaggaauucuuagucggcuuaggaaauccagcuagucuugucucucagucucggcucucaacaggaaaacucaagugcuguuggggagguuggccgacgaccgcucuuaacugcuuccugcugaauugggggcauaguaggggucaugcaguucagauuuccuugggaggggugccuucgaucucaucaacauuggagcaugggcuaguaggccggucuagggguccgcaguaguucaaaugcaucaggggcuccauuugaagaaccauuuauacuucuacaccuucuauucuggaagagacaaacuuaacaaggagguuaaagauacagggauugaaacguauggccugcagugcaggggauuauuucuuuggcacacuucacaggcccugacuaucugcuugauaguuuuuaaaaggccugguccaguaaauaaugauuuagccaucugaugggugcuaucaaugccuaaaugaaagguuuggugaaggguuuuaaguaauuuccauugguuagcugcaggcaaaaguauuuuuccuucuucaguggcuagccauccugaggggaggaaacuuguccucaugaggguccccauucuguuucuccugccgaguacugcagcuugguuucccggaggggauuaccccauacuagggguccuucuguaagcauuucuaauggaggguccugccuugcggcucuuuuggcuucaauauccgcuuggcaguucacuucuauuucccuuucguuuccuuucugaugacccuggcagcauaagacugccaccucuugagguuucuguacagccaguaguaaucuccuaaaggcuuccugauguuugauagguguucccucggaaguuaggaauucccuuucucuccauauugcugcgugggcauggaggacuagguaagcaugccuagagucuguguauauauuuacccuuuuuccuucuccuaauucuaguguauaauggccccuccuuuugcuagaaugucucucccuaacaaaggaguggggcuuucaagcauaauuagaaagccaugugaaaagaguaaaguuccccagucacaacuuaguggcugggagaaguauuuagugacugccugucuuaggaccccucagauaaugacagaucuggaggacaguuguccgggacagggagaguaagacugagaaggccacaccaguguccaggagacaguuaaccuccuggcccucaauggucaagcauacccggggcucugugagggugacggcaugggcuggcgcuuaccccaggcacccucaguccugcugcuggaucaucugguuaguggcuucugacucagagauccuucauccccuggggcagugggccuuccagugauucccuugacauaaggggcauggacgaggggguagcuuauuucuauucggacaaucuuuuuuaaaguguccuuguaggccgcacuggaagcaagcccuauuaggcauucaacuugcccagccuuucgguguuccagagccucaaaguccgcuuaccugagggccaugacuaaagcggugaccuuuuucuuaacuuguuugucccuuucugccugcucuuucugaucucuauuauaaaaaaacugagguugccaaguucaguaggguuucuaaguuuugcugcaggccuaaggcggacuuuugaauuuuuucuaaugucugcaacugacugaauaauaaacuuacccuuuaagauuaguuggccuucaauagagucaguugacagagagcuaugcuuccucagugccucccuuagucucuccagaaacgugguaggauuuucuuucuuucccuguguuauaguggacaacacugaauaauuuauaggcuucuuccuaguuuuccuuaguccuucuagcacgcaaguuaguaaaugucugcagcaccaaucuccauguucugauucugcaucccagugagggucuacacugggaacugccugcuggccuguggggaauuguucuuuccucuguugucauccuaucauugaccugacugagauaccagagaucgccaaacucucagguugcaguuauggcagcacuuuucucauuugggguuagugucugaucuagcaguaacauuauauuuuuccaugucagaucaaaggauuguccuaacccuuguaaaacaucaauauagccaucaggguuaucugauaauuuaccuaggucuauuuuaauuugucucucucucucugucugucuuuccucuccuugacuuacucaauuugcuuuuauccuguucuauuauguuguuguagacccauaguacugggucaucaguucuaaggcccuggccaaggagccaaggcuuggagauuguauugcagagggauaagcuggguagaaaucgggggaggagagcaucuuacacaaugggagagcaguccuccuagccauuuacaaacuuggggcccuggcaaguugguggggaacaggucccacauaacggucgagagcuguguggcuaaauugggagggacacgagggacaagacucacuggguugauagccuagaugccuaaggacacagcauagagcuucauuagaucccuuuggagauacaacuugcuccaauacgugggaaaggaaaugaaagucugaaccauuaguaucuaggaggcagggaucagaggaaguagauucagagguaaggagaauuuuggggcuacacuuucaagaaagucauggucaggacccaggagguaugggucagaaggaaagguggggugcacgcaugggugacuguugaguagagacuucuggcuguaccaugaugucaaccggcuaaugcugggaguucgggacgacagcuuucugccucuaguuggcccuuggcuuccccaggaaaauugaaagcgcaagcugguuccaggcagaucaaugcucccaacccagaagguuuggggguuguuagaaagccuuuucccagauagccucacaucugagucuuaagucuggcagccacgcuaaucguuuuuuuaacuggccgacaagcacccuguauuuuccucugauucuaaggaaggauagcaagcgaaaguaguccaauauuacucaccgcuuuggagagucccuucgugguugccaaaauguuaccaggguguccuugcuccuagagcucccaagauguuggcggccacuuccaagauggcagcaagccucuuguucucugaccugggguucuuggccucacggauuccaaggaauggaaucuugggccauguggugaguguuauagcucuauuagaagccaugggucauggaacagaaccguggaacccagcgacuaguguucagcuugauuaggaugaacuugggcacuuagcugugcaggaacaauggcaagccuuuagcccgaucgggaguggcaaugggugccucgcuggaucaggagcacaguggacacccugcuggaucuggagggguggaagucagcaucagcggcgggucugcgauggcggcaaacaacagugguggauggcaagugaaagcacagcuggagccauaacaaacacagaccagaagaguaugcaguugcaagauuuaauagagugaaaacggagcucccauacaaugggagggaacccaaaggggguugcccaacaauuacgguuuacaacaagaauacuguguacauuaagccgguauggauuucagucuugguauuuuuagggucaugccaaggguauuguuggucuguccccaaaggacagcaggggaagggaacuuaggcuugguuucaaugcuaaaauggcauauagauuuuuggagacauuuguauuuucuuugucuguguucaguuuuguaguuucuacagaaaugcaaggcucuaccagaaauggcuuuggucacuuauggauuggucaguauaauaagcuugugauacaauuccuuuuuuaauuacuaacaagcauggagugagcaaugaaagugaauuggcauuuucccaguuggugguagagacagucugggguugguugccaaaauugccauauuggguagauuacaaguggacaaugaagggaaaaaccaugaaauuuaaaguacaguccagggaacacaagaguccaagugaaggauauauccuuuucucuuuguccuuugcuaugacaaccuccugaugcagauuuggauuguuuuccucauuacguagaucaacaccugaggguaaaggguaggaugguuguuucuuuccaggcuuccagaauggcagguaccaagcuugugugaguggauauguggguacacaccugcccuuaccacaaaauauuuguaacauacacuacuaaauguaugaaugacuaauaguguguauuuccauuuucaaaugcgucauucaaacaguaacaaguuucuaauugguagauuaugguguagugugugagagaagugugggaguaaagaauggcaccccaagaaccugaagugauuagugacugcccagaguauucugucaaugugagguaaagcuggucuugccuuauuugcccuucuugccccccgccccuuuccugugccucuguuuagaauuuuuccccuuuauaccuguauauuacuuuuucuuucacucauuuauucaugauaaauguaguaggaauuggaccuuugggacgcaguuuuugagccuugaauucaaguuuuaaaagguuucuuucuuuucuuuuuuuugagacaggaccucacucugucacccaggcuggagugcaguggcaaucauggcucacugcaaccuugaacucuugagcucaagggauccuucugccuuggccuuguaguagcugggauuacaggcuugcaccaccacaccuggcuuuuauuuuauuuuauuuuugagaauuaggggucccgcuguauugcucaggcuuauuuugaacuucaaggcucaaguuauccucccaccuuggccucccaaaguggugggauuacaggucauugugcuuggccuuaaaaaguuuuuuagagugcuaguuucuuguggacuauaaaaaguugacuguagguaguuaaauguauauuugguuuaccauauaguugaagcuguuuaauucauaauggaauucuaucauucaaaaaaauuuguagcuauugcuaagaagcccaauagauuuuauaauaaaccaucaugaaaguucuguguauauauggaagaaagaauuauuuucucagaacagagagaaacugcacugagauucaaaggcugagcagcguauuugccucagguucagagaguugugguaacauacauuuuuaauguaugguauuugugugaggccucuaauuuuccuccaucucugauuacuaauuucaucugccuaucccaugggugccuaugaagguucguguguguguguguguguguguguauaauguauauaauauacauauaugaugaaugcauuauaaauaauauaucuggauauauuauauauaauauuuuguguuuugugaaauaugcaguguuauuuaguguguauauuuuuaauucccuuaaaugcuguuuuacuauggauuuuauuguuucuccuuuguguuuaccacuguuuuaaacauuucaucguguuucuauaugcauaucuauucaacuuacugcuuuugauugcugcauuaauauuucauggaaugcauuuuccacauuacuuaccugcuucucuagugaugccuccagcuacucuuacaaacaaugcuccagggaauauaucaaauguguucccuuauggaauuguauaugaauuuccuaugcaauauauacccaggaguuguauaguugggucauagaauuggcauuaccuaugaaagcuuacuacaugauugcucuguggaguggcuuaccaguaugcauguggauuccuuuucuucauguucuuguuaacaacuuucuguguucucaaaucucauauuuaagccacuuugcauuaucacacugcuaagaauuaucacauugauuaauaacuuauuauaucacagggucacauuuuuauucuggcaacuagagcugagaaacuuacaauggggauauugagggaagauugaaauucuuguugaaguuuaaaguguugcaugauaauguucaagaaggcucacugucuagaggacacagauuauaccuuguugacccaucuagaaacaugaucuuaucagaguccucaaguugauuacauuuagauagucugacugcccucaccaguuaccaaaguuaauuaacaagccaauaaacuaauucaugaugaaaaguaaaacuguagauccuuuuggccauuucaguuguccuuuuuuuuuucucucuaggaaaucacaauauuaucagaugaagguagcuuugugaguuuuauaucagggcaagaggaaauauugaucugaagagugaagcaucuuuuauuagaauuuugauuauuggaauuuuaucagaaaaacuuuuauaaaaguuauuagauagcugaacuuuuacaguuguuaacccagaaugaaaguagccaaaaucauuuuuuccuuuuccuuauuuucuagugaaaaauauuaugacuauuaugauuagaaauagcaauguagaaaccaugcauauauaucaggauguuugcaguuuauuacuaguagaggaauaguagugugacaaccagucuguaaacagagacuucaaagugaaaauuucccauuuuaagaauaaagaaacucuuuaugguuuuuauaauaguaaggcuaaaucuaaauauuucaccuaaagauuguauaauaacagcccugaaaaaugcaaaaugcugaauauguacaucauguacauaucaugggagaauacugccaccuugugcauauaggaugcuauuuuaugccuccauuuucuuuuguuacaccagcuaauacuugcuuuuucaguuugguacugugguuagauguguaaauguguaaaacauuuauuuuuuuaugcaguaaaaucaagccaacuauucuuucggcaggaggaggguuuuuuuuuguuuuguuuuguuuuuuugagacggagucuuguucugucacccagccuggagugcaguggugugaucucggcucacugccaccuccgccucccagguucaagcgauucuccugccucagccuccugagcaccugggacuacaggcaugcgccacuacacccagcuaauuuuuuuuuuuaauuuguaguagagaugggguuucacuauauuagccaggauggucuugaucuccugaccuugugaucugcccaccuuggccucccaaagugcuaggauuacaggugugagccacugugccuggcccggucuuguuuuuugaaagauguuaaauuugguauaguuagcucuaagaauuggaaugucugagaucauacugguuaauugaccucugggguuaguugagaauuggauucuuuuauuugaaucuuauggaaaguugaugauucuuuaaucauucuucauuuuagugcuugcaguacuuugggguuauucugaauggcagaauucauuacacuaucggaaguauagggaauuuggcuucugacacaaacauaucccuugauuuuuaaauguuuuccuucagcugaagugcagaagaauuacuacaacacagggugagcauccuuaauuugaaaaucuaaaauccacaauguuccaacauuggaaacuuuuugaacacugucaugagauagugauuccuuugcuuccugauaguucaguguaugcaaacucuguuucaugcacaaaaccauuaaaaauauuguauaaaauuaccuucaggcuaugugauaagauguauaugaaacauaaauaaauuuuauguuuagacuugggucccauccccaagaaaucucauuguguauauguaaauauuccagaaucugaaaaauaucugaaaucugaaacacuucuggucccaagcauuuuggauaaaggauacucaaucuauaguaacauguaauaguuucuugaaacaguauugauguaaaucaaaaaaugaguucuuucaaauauucugguuaucugacagccugacuuagauggguuucagauauuauugccucucugaagaggaagaauuaugagacuggaagucagccuuuggauacucacaacuaacuuagcugcgugaccagggaugcuucucugggcaguuucuuuaucugaaaaaugagcaauugaacuggauggguucugaggaucuuuuuaguuuucaaauucugugacuauauaaaguuuuacucuaauuuuaaaauguuaugcuguaauaccguucaaaauacuucuauguauaagaaguuauuaaaaaauuuaaucauauaguuauauuuaacuaucagaguauauacuaguaauuugguggggaugggguuagaauauguguacauaaaaguuuaaaacuagaagccugggaaauuuaccuguuuuuuauuuaacaccugggguacuugaagauaucagaagauugguuuggggguaaucuagauuuuaauuguauaugauuuaugcauaauccuguuuuggguauaaaugcauuccaaaugccuacauucaacuucugagaagacuccaaaaguugauauaaauaugguaaaguccauuucauaagcccaauuuuaugacugggaugaaaagagagaaaaagguaccuacaguugaaaauuuggaaguucuuuagaauauuacccaacuugaaaauuuaaggccaaagacucuucaggauguaaaucccuucauuuuauaguguauaacagcagaucuuuccugcuaucuugauucauuuccucaugaagugcuaagaaugaacccaugugaccaaguuuagcuuuuuacuuuggggccaucuggggauaaguuuuuaaauucuagggauaauuuuaaggaaaaugauuuucguuguuaagcuacauaaacaugccagauucaaccucuguacugaaaugauuuccuugugccuugccuugagauuuuugcauuuauuuuguguaauaccaaauuacuauuuuguagagaacagaauuauaauaaauguugaaauucacuaauaaaaugcaaucacauaaaaucuaugcauauuauaagccauuaaagauguuaauguauuaaaauauacauuuauccuucugauuauugaaauauaagaaaauacuaaguaaauuauacuucauaaaagugaagauaauuuaaucaugaaaaaaagcaaaguggaaaauauccuaaucuguuuuuagaaugugaaaaucuuaugguucaaucccaaguuuuggcaccaaaaaaaaaaaaaguaaaaucuuaagaaaaugugugugucacugguaacauuagucgugauguuucuccauagagauuuuuccaaaagcuccguuccaaaaucucucucugcaaugagguaggaauguuaugggauuagaaaaaauauuugguguuaguuuauaacuaaucuacaaauccagucucuggauugauacucuucagauauuuugaaguuuuuguagagggacuguagcuuuuauuaauagcaaaucauaguuguaaacagagcauuccuaguuucuuugucuuaauuuuauguauagauggagauuucagcucauaauuaauuaccuguaucuggcuuaguuguauuauguucauguucauuuguuugaaaagccuuugaacuagaacaagaauuaugauuguaauaaaaaaacuugcuugucaguuguuauuuucuucuuucuugagaauuacagagaauaagagaacacuuucuaaugcgugcaucuuuauuuugaaauuuuaaugcagcaaauaacuuucaagauagaaaaggguuuuuguuaaguuauuugcaccauaaacugcauaguugaauuuguaguaagaagacucaccaccaauuuauuucaguagccaagaucaaacuaggguacuaugccaaaacauguaauaaaaagugaugcaauacuucagcaugauugcuuuuuauguuuuguacagguccagaccuaucuauucuuacaugaugugcaaaauugaaugauucaaccauugauuuugauaaauaaggauuuuuacaacuaugaaauauugguguuuugcaaauuaaaaauagcauguuaugaaauauugguauuuuggaaauuaaaaauagcauguuauuuugaaauauugaaagugaguauggccauuaacuguuacaauauguaggucaagguagagauugguagcuauauggaauuugaagaauuuagaauguaaacccagcacugagauuuuuaaucuacuuuauugugucuacuacuagucagucuacuugguaaauuggucuuuuuuuaaaaaucguagcagaagguuaauaauuaugauuuuuuucucauguguaaaacuuuguuuccuuaguuuuaauugcaaagcuuuuuaggucauucuacaguguaaacccaauaacauguacaaaaugagacauuuauauuuuaagcauaucuucuuccuuuuugcaacuuuuuauuucuuccuuugaaugcauuaaauuuauugguuguagcccucugugaagcaggugcugcucaucagagugauucuauauucagaaauauuaguauauggacauuuuaaugugugcuaauuuuauuuaaccuuauacaauauuugugggcauaagguauuuuagaugauugugaguuaauaaucaaugauauacuguacaguuuuaagauguuuagcauuggucucacuuauauauauuuucuucucacuaggcaagaaguuaugaaauggaauggauggggauauaaugauucuaaauucaucuucaauaagaagggccaaauugaauugacugggaaaagguaacccugguuuauuucuucuuuuguuccuccuuuaauucuuucuuucuaugaaaaauuuuaaacacacaugaaaauauaaugauuccuccuugaguuuaaacauuaucaacauuuugccauaacugcuuuuugucuccugguaauauuucaaauucugauguugucaugucaccucuaaauauauguauuuguguguguguauauauauauuauaugucuuaaaaaauaaggaccuaauauaaccaauuauauaauauuauauauccaaaauagcaaaaaauuuuuauuuaguuauccaguucauauucacauucuccaguugucucacaaacaucuuuuauagguaguuuauuugugucaggauccaaauaaugucuauaagccacccaccacccaauucccaugccauucaguuuuuugaaaguagcuucauauuuaaaucugguaauuuacaaggaguguggguuauuaugaaaggugaaugauuuuaggucugugugaauauaaauaguauuuuaaaaaauuagcuucugagauaaauuaggaaagaagugauagggaaagaucagucauuuuugugauagcuuuucuaugucuuaaaugugguuauuuguugauaagaauuacaaagcauauugguucaaucauaccucaguaaaacuggaaaaauauuaaaaagaauucuaaaggauauuuguguuauuccuguuuguucuagauauggucagaauuguaaaacgaguucuuuguugguuuuaagcaauacugccuuugccaaagcucuguuuuugguuugucuguugaauuuugauacauuugaaagggcagugaguacaaauauguaauacuuaaaugcuggaaccaaaaauaaaaagaaacugagacuaaguaaaaaauuggaucagauauauuaugagucuauuccaguauuguacccugauuuaauaucuauuggacauuacuauacuuaaguuaauguuuuuaaaacaugugcuauaucaguauauuaaaauaucagcaaaguaaguuucauuccuuuggagaaguuauuuauuuccuuuucauugcaauguauuaauaauuuuucuauuuuucugacauuaauauuuuguaccuaaaauaaaaccucaggaauaguaauuugaaaguaauuuuaaugaaguucugaagauguacauuugacuuuuuuuuuaauuaggaaaauaaauauuaucuguguucucauucccauccuuaauugugacuggguagcaagcaauggaggcuuaguugagaaauuguguaauucagguagaagggauuucugguuaauaucagauuuaccaguguucuaaauguggaaucuuuuauguuuuauuuaaauagaauaaugccuaauacaauagaaacaucgauguagagaucggcuuuucaaaaucuucugaaggaguaaaaauuaaucuucugaacuuagaaaaccgaauuucucucuucucggacacuguccucauuucuccuucucuuuuucucuguguuuggaccuugaagguauacaguauuucuguuuuauggaacaggguagauagucacuuguauuucagcaaagucuucuguacaguacuguaggccauguaaugguuuauaugagaagguguguguguaugugugugugugugaaaugaaugacuagucauaaaacaucacagguaauuauaccuuagugggucccauguuuucaggaucucguucuuauuuuggguguucuggcacuugauuugucaguuuccuggaagagaugaggcuguaggggucugacacacaugccacacuucuaagaaacugauuuaaaaaauuagaaccucaguguauucauuuaugguuagauuauugcuuuuucaggguauggaauacuuguuagugcccuuucugauguuaggguaucuagagaacaacauuugcaacuuagauauucuuuggagagcauacauucagaacaaaggagauuugauggucuugauagagauuuuuauacaggcuguaauagaaccagagaauuuaucuguugguuuuaauggguuacuaccacuccuaccagaaugcauuccuuaaaggccucauuucuuugcauuguugacuccuaagucagaguccagugggggagagggagaauaaggguucaucugacuggaagagccugcaagggagaccaggaaagugaauaucuggcaaauuugcauuaguggaggguagcuuuugccuuccuucaagacuuacaaaaaggauaauuccccaaacguauaaaugggauuuaggugcucugagauuaaauauauacuaaacaaacaauaacuaaaaugaaauaacaaaacaaaauucaauucccauuuuggugggaagcaccaguaccuugucacaggauaauaaacuggguugaauugaaucauaacuuucucuauaucuagucuguuuuccuaagaauaauuggugaaugaguagguuucucugauuuuuaucagaaaacauuuacaaacacucuuaagauaauaauaucuacuauuuauugaguaucuacugaguuaccuuacaauaacccuaucagauggauagaguuaccuucuuaaaaauaaugaggaugaggaaaguuaaguagcuuaccugaagucaccugcauagugguaaauugggauuaaaaaccagguguuuuuuuaaacuucauucuucugcaguuucuauuauacugugcuucugaguuauuucuguagauaacuaaacucauccacuguacugaucuuguucugucuucaaacccugggagcacuacacucuguauaccagcacgguagaauuagucauauuauaaaagguuaucuugugucaaaaauuccuauuguuacugugaaaggcaaaggggagaagcguaagaagauugugauauuccugaaagagaaaauggaauucaugacuacgaagacugaguacaagaaaacacuguuuggcugaacaguauuaauucacucuuauuuauuaauaauauuagaugguaaggacaauuuuugaaauuuuuuguagagacuuucuauucuggcagugagguagacagaaauaauucaggccccucgccuucuauaaccauacagaaaaguuggauaaaauauuagaagaaagaaauauaacagagcuggaaagaaagaaagggaaaucccaggugccagaaacuaaugugauuaucagugaaaauugaugaggugugggguuuuccuauuucugauccaaagaacauugaaaagguagauuuuuauacggaaauguaguugauugucuauauuuugcaggagggcgacuuugacauuucaagcccaggcauuacauuguaagcaauuauuagaagcuauuauagaauaacagcuuuuccccuauguuaggagaagagucugaaauuuuuuucugagcagucuaucuucugaacagauuuauaauuuaucaguuuauaaaucucuagauuuaucacuuaccacucuuauuccuucuaaguaugagugaauuuaguccuccuggguuuaagcagcauaaggcaauacucuggagccaauucuagagauuuuuuuuuuccuucagcuuuuaaguucugggguacaugugcaggaugugcagguuuguuacauagcuaaacgugugacauggugguuugcugcacagaucaacccauccccuugguuauuagguuauuaagcccacuauccauuagcuguuuuuccugaugcucucccuccuucuacugcuccccuugaugggccccaguguauguuguuccccuccuuguguucauguguucucauuguucagcucccacuuauaagugagaacaugcgguguuugguuuucuguuccuguguuaguuugcugaggauaauggcuuccagcucuauccaugucccugcaaaggacaugauuguguuccuuucuauggcugcauaguauuccaugguguauauguaccauauuuucuuuauccagucaaucauugauggacauuuggguugauuccauguguuugcuauugugaauugugcugcaaugaacauaugcaugcauauaucuuuauaauagaaugauuuuuuuuuuugccuguacaacuauuuaaugucuguaugccucugaauaguaauuaggagaaaacauauggaaaugaaaauuauuucaaauuuuaaaaucuugaaacagaaagcaauauuuauaauguaucuauuccuuuguguauuuacccaguaaggggacugcugggucaaaugguauuucugccucuagaucuuugaggaaucaccacacugucuuccacaaugguugaacuaauuuacaguccaccaguguaaaagcauuccuuuaucucugcaaccucacuggcaucuguuguuucuggacuuuuuaauaaucgccauucugacgugaggugguaucucauugugguuuugaugugcguuucucuaaugaugagugaugcugagcuuuuuuucauguuuguuggcugcaugaaugucuucuuuugagaagugucuguucauguccuuugcccacuuuuuaaugggguugguuuuuucuuguaaauuuguuuaaguuccuuguagacucuggauauuagaccuuugucagaugcuccgauugcaaaaauuuucucccguucuguagguugucuguucacucugaugauaguuucuuuugcugugcagaagcucuuuaguuuaauuagaucucauuugucaauuuuggcuuuugcugcaauugcuuuuggcguuuuugucgugaaaucuuugcccaugccuauguucugaaugguauugccuagauuuuuuucugggguuuuuauaguuuuggguuuuacauuuaagucuuuaauccaucuugaguuaauuuuuguguaagauguaaggaagggauauaguuucaauuuucugcauaugccuacccaguucucccagcaccauuuauuaaauagggaauccuggccgggcgcaguggcucacacccguaaucccagcacuuugggaggcugaggcggguggaucaccugaggucaggaguuugagaccagccugaccaacauggagaaacccugucucuacuaaaaauacaaaaauuagcagggcaugguggcgcaugccuauaaucccagcuacucaugaggcugaggcaggagacucgcuugaacccgggagguggagguugcggugagccaagaucacgccauugcacuccagccugggcaacaagagugaaacucugccuagaaaaaaaaaaaaaaaaaaaaaaggaaauccuuuccccauugcuuguuuuugucagguuuguugaagaucagaugguuguaggugugcagucuuauuucugggaucucuauucuuuuccauuggucuaugugucuguuuuugugccaguaccaugauguuuugguuacuguaggcuuguaguauaguuggaacuuggguagugugaugccuccagcuuuguucuuuuuguguaggauugucuuggcuauacaggcucuuuuuugauuccauaugaauuuuaaaauaguuuuuucuaguucugugaagaaugucaaugauaguuuaaugggaauagcauugaaucuauaaauuacuuuggguaguauggccauuuucacaauauugauucuuccuauccaugagcauagaauguuuuuccauuucuuugugucuucucugaguuccgugagcagugauuuguaguuguccuugaagagguccuucauuucccuuguuagauguauucauagguguuuuauucucuuuguagcaauugugaaugggaguucauucaugauuuggcucucuucuugccuguuguugguguauaggaauacuagugauuuuugcacauugauuuuguauccugagacuuugcugaaguugcuuaucagcuucagaagcuuuugggcugagauggugggguuuucuagauacaggaucaugucaucugcaaacagaaacaguuugacuuccucucuuccuauuugaauuuucuuuauuucuuucucuugccugguugcccuggccagaacuuccaauacuauguugaaaguaguggugagagaaagcauccuugucuuaugccgguuuucgaggagaaugcuuccagcuuuugcucauucugguauaauauugacuaugaguuuguuauauauggcucuuauuauuuugaaguaugguccuucaauccuuacuuuauugaauuuuuaacaugaagagaugcugaauuuuaucuaaggccuuuucuguguccauugagauaaucaugugguuuuugucuuuaguucuguuuaugugauaaauuacauuuauugauuugcauauguugaaccaaccuugauugugguggauaagcuuuuugauguauugcuggguucaguuugccaguauuuuauuuaggauuuuugcauugauguucaucagggauauuggcuugaaguuuucuuuuuuuguuguugugucucugccagguuuugguaucaaaaugaugcugaucucauaaaaggaguuagguagcagucccuccuuuucaauuuaguuucaguagaaaugguaccagcucuucuuuguaccucuaguagaauucagcuguaaaucugucugguccugggcucuuuuugguuggcaggcuauuacugucucauuuucagaacucauuacuggucuauucagggauucagguucuuccugguucaaucuugggaggguguauauguccaggaacuuauccacuuuuuucuagauuuucuaguucaugugcauagagauguugauaguauucuuugaugauuguuuguauuucuguagugucaguggugguaucccccuuaucauuuuugauggugucugauucuucucucuuuucuucuuuauuagucuagcuagcagucugccuauuuauuuuuucaaaaaaccagcuccuggauucauuggcuuuuugaaggguuuuucacaucucuaucuucuuuaguucugcucugaucuugguuauuucuuguguucugcuaccuuuggaguuuguucuugguucucuaguucuuuuaguugucauguuagguuguuaauuugagaucuuucuagguuuuugaugugggcauuuuagugcuagaaauuuuccucuuaacacugcuuuagcugcaccccagagauucugguacuuuguuucuuuguuuucauuaguuucaaauaacuucuugauuucugccuuaauuucacccaggagucauucagguuguucaguuuccauguaguuguaugguuuugggugauuuuuuuagucuugauucuaaccugauuguguuguggucugagagacuguuaugauuucaguuauuuugcauuugcugggggguguuuuaauuccgauuacgugaucaauuuuagaguaaguguuguggcgaugagaaaaauauauauuuuguuguuuuuggguggaggguucuguagaugucuaucaagucugcuugauccaaagcugaguucagguuuugaauaucuuuuaauuuucugucucagugaucugucuaauauugucagugggauguuaaagccucucacuauuauugugugugaguguaagucucuuuguaggucucuaauaauuugcuuuauggaucugggugcuccucuauuggguacauauauauuuaggauauuuagcucuucuuguugaauugaacccuuuaccauuauguaaugcucuucuuugucuuuuuuggucuuuguugguuuaaagucuguuuugucagaaacuaggauugcgacaccugcuuuuuucuguuuugcauuugcuugguaaauuuuccuccaucccuuucuuuugaguucaugugugucuuugcauuuuacaugggucucuugacagcaugcuaaugggucuugacucuucacccaccuugcaauucugugucuuuuaauucgggcauuuagcccauuuacauuuaagguuuuuauuaugugugaauuugauccugucaucaugaugcuagguaguuauuuugcauacuuguuuaugugguugcuucauagugucacuggucuguguacuucaguguguuuuuauaguggcugguaaccauuuuucuuuuucauauuuagugcuuucuucaggagcucuugcaaggcaggccugguggugaugaauucccucagcauuugcuugucuggaaaggaucuucuucuucgcuuaugaagcuuaguuuggcuggauaugaaauucuagguugaaaauucuuuucuuuaagaauguugaauauuggcccccaaucucuucuggccuguaggguuuuugcugagaggucugcuguuagucugauggguuucccuuuguaggugaccuggccuuucucucuggcuacccauaacauuuuuucucucuuuucaaccuuugagaaucugaugauuaugugucuugggguugaucucauggaguaucuuacugggguucucuggacuuccugcauuugaauguuggccugucuugcuagguuggggaaguucuccuggauuauauucugaaguauguuuuccaacuugguuccauucucuccaucucuuucggguaccccaaucagucauagguucagucuuuuuuacauagucccacauuucucagagguuuuguucauuucuuuucauucuuuuuucucuauucuugucugccuugaagacuauagucuucaagcuuugagauucuuuccuccacuuggucuauucugcuauugauacuugugauugcauugugaauuucuuguguuguguuuuucagcugcaucagauuaguuaugcuccucucuaaacuggcucuucugguuuucagcuccuguauuguuuuaucaugauucuuagcuuuuuugcauuggguuagagcauguuccuuuagcucagcgaaguucguuauuacccaccaucugaagccuacuucugugauuucaaccaucucagccuuagcccaguucucugcccuugcuggagagguauuguggucauuuggaggagaagaggcccucuggcuuuuugaguuuucaguauuuuugcauugauucuuucucaucuuugugggauuaucuagcuucaauuuuuugagguugcugaccuuugagugggauuuuuguguggucuuuuuuuugaugcuguuguuguugcuuucuguuuguuuguuuuucuuuuaacaggccacuuuuucguagggcugcugugguuuguuuggggauugcucgugacccuauuugccucauuuuucccagaccuggagguaucaccaguggaggcugugaaacagcaaagauggcagccugcuuuuuccucugggagcuccgucccaggguggguagugaccuguugcuggccuggaugcucccauagggugucuggagaccccuguugggagcucugacacagucaggaggaacaggauggcuggguuuugguggagcagcugugccauguuggggauaacccuuucauguccagacugccuggacucuucagagccagcaggcuggaaaggcugagucaacugaacugcagagacaucggcugugucucccccaaggggcucugucccagggagagaucagaguucugucugugucacccugucuggaguugcugaaauucccacagggaguccccacccaaugaggagcaauggauuggggucccacuuaaaaaaaagcagucuggccacaaucuggcauagcagcuguguugcauugugugggauuccuucucauucagaccaccuggacugccuggagcuggcaggcuagaacagcugagucaaccuaaccacagaaauggugguugcuccuccuucagggaacucauccaucucaggcagucuccagauuguugcacuggcuggcuggaauuccaagccagugggucuuaacuugugaggugcuguggaaguguggccugcagaacaauguugcuuggaucccuggauucagucccccuccuaggggagugagcagauggaucuuccaccuugcugggauuccuaggguggagucuguaaaacuccuggguuacugugcgagccugagugacuguucuuuugagacacggcucuguguauugaacccaaggcccuggugguguggggucaugaggggaucuccugauccacagguuacaaauauggagugggagaagugugguuucccuggugggguugcacaaucucucacugcucugcuuggcuggggguggggguucuuuuggcuccaugcuucucccacuuggaucaucaccccacccuccuuuucuuuguucuccauggguccagcugucugccuagucaguccugaugugagaacguggauauuuuaguugaaggugcugaauucaguugcuauuuucauucuucuccaugacagcugcggaucacagcugcuucuaaucagccaucucagucccuauagauuucuauaaacuaaaauuuuugaaaaaugucacuauuuuugacuuuauggguauuauacauuaguuugguacuuagaaaucacaaguuaguauauaaaugaaaaauuugaguuuguuagacuuugucuuuuugauggcauaauuuuuaauugaagcuuuaucugauuauaaaaaggcuguuaaauugcuuagcaauuguggaacucacccugaggcuagaugauuguauauacuuaucaggggaacccacccccaguauuucaacauagguucuauuuucccuaagugucggcuggucugagaaauaaacagaaagaguacaaagagaggaauuuuacagcugggccgccgggggugauaccacauuaucgguagguccauaaugcccccugagcuacaaaaccagcaaguuuuuauuagggauuucaaaaggggaggggguguacaaacagggaguaggucacaaagaucacaugcuucaaagggcaauaaagaucacaaggcaaagggcaaaguaaagaucacaaggcaaagggcaaaauuagaaugacugaugagggucuguguucggcugugcacguauugucuugauaaacaucuuaaacaacagaaaacaggguucgagagcagagaaccggucugaccucaaauuuaccagagcgggaucuuuuccccacccuaauaagccagaggguaaugcaggagaacagggcguaauuucaguccuuaucucaacugcaugagacagacacuuccagagcagcuguuuauagacguccccccaggaaugcauucccuccccaggguauuaauuauuaauauuccuugcugggaaaauaauucagcgauaucucuccugcuuucacguccuuuuauaggcucucugcaagaagaaaaauauggcucuauugugccugaccccgcaggcagucagaccuuugguuguguucccuuguuccuuaaaauugcuguuauucuguucguuuucaaggugcucugauuucauauuguucaaacacacauguuuuacagucaauuuguacaauagugguccugaggugaccuacauucucagcuuaugaagauaacaggauuaagagauuaaaggcaggcauaagaaauuauaagaguauuaauuuugggaacugauaaaugaccaugaaaucuucacaauuuguguuccucugccauggcuccagccggucccucuguucggggucccugacuucccacaacauauacuaauauuuuugcugcuucuuaugugcugccccagagugagagucacuuugcuuuuagucauugucaguccugaugugcacuucccucuuggauaauuuuuguccacagaauuuuuucuuuccauguagaaugauuucauuggccuugaaaacuuguucugguucuguaucuucuauaauauagucuauuucagcccuaugggaaagugauaaauugaucucaccuuauauuuuacaacaaaagccauuuaauauucucaaacuaaucuucagucauggaaaagaagaagauccauucaguagucacugugauucaacaauugguauaagugcuuaacuuucccuuuaucacaucucugguuaaaguuucauguucucugcccauguguucaucucacaaauuaaauguugcuguagcuuugacuaagcuagguugcaaguuucuuaaaaacaggagucauaauaccaauuccauguauucugcaaugcuaaguacagucuucugaguguuaaauaaauauugugcauucagauauagagauauaaagacuuuauuuuagugauagaagguaguuuuaaauuuuauacaugauaguaacacuaacucuguaucuguaguuucaaguaucuugaagguggucaccuuuuuauuuuaugggaauaccugagacuggguaauuaauaaagaauagagguuuauuuggcucaugguucuguaggcugugcaagaaacauggcaucagggucugcuucuggugaggaccucaagcugcuuccaguccugcagaaggggaaggggagcugguaugugcugagaucacauggugaaacugaaagcaagagagagaugguagggaggugccaggcucuuuuuaaacaaccagcucuugagggaacuaacaacucacucacacuucucucccuucccccagggcauuaaucuauucauaaagauauacguccaugacccaaccaccucccacuaggggaucaaauuucaacaugaggucuggaggguuugguguccaaacuacaggacuccuuuaagagagugaaaggauaaaucacagaguaagagaaaaugucuaauauguguaucuuucauuuuauaaauauauaaagauuucuuacauguaauugagaaaacaauaacccaggaggaaaaugagcaaaagacuugaacuggcuuucaaaauggaggauauccaaauggacaauaguuauaggaauagaugcucaauuucauaaguacucaguaaaauucaaauuaaaauuguaaugagaugccaauggaaugucucagauucaauuauagaauuucuguuguguucuuuuuuauaguuuuuuauuucucugcuaagauuuuuuuucuaauauucaccaggaguacauuuuccauuuuguccauuggcguagcaacaauagcugcuuuaaaacccuugugugcuacuuccaguaucuugggucauuuuggggucagucaucauuaauuguccuuuuucuugaauaugagucauacuuuccaguuuguucuugucuaguaauauuggaguguguuuuggacauuguacaugauaugauguaggagcuguggauucuguuauauuccucugaagagaccuuuaaaagacuuuuuuuuucuuaaaucaagcaauuaacuugacugaucugaaacucuaaauucugucucccuguggugagcagcugaauugccuguccaguuuuuuuuuaagcuuaacugggcugccuagaagauuccaguauguauucuauacaugcuauucagagucagccagacauuuggagagagcugauagauugguuccucucuuacuugcuucuuucugugauuucucgguaugcuuuccagaugcagcauucaccccaaacacugugcucugguucuuuaagccaggaagacuguaaauuuucagcauuuuuauuaccuuuugaggcaccagcuggggccugccauaaggcuaaaacuuauggaaaaaacaaaaccaaacuggaaacuuaugaacuuauguaguauuuuuuccuuuuuucaaguguagcacacccuucuccccuauuuuugacugcuuuuggucugucuauacugccuuuagauagcuggguuuuguuuguuuuguuuucguucagaguuuauaguuacaugugaaaguguugguuugauaguagcugcuugaccaucacuggaagcagaauuuaagcuuuaaauuuaaaugaagauacuuugcucuaauauuuuuacuuucuuuguaccuuagguacccucuuaguggcauggguuuaccaacauuuaaagaauggauccaaaauacccuuggaguaaauguggagcauaaaacuaccucuaaaguaagcaaacaaaaauuauuacuaacucauuuaacuguguuuuuaaaacccaaauuaauuugauuuaucuuuguaauucauuauauuggauuuacugcaacugucauguuuuuuguuauaaagccuauuaauuauauuggccuuguuagacuguuagcggcaguuauucauugucacagauauagaccuuagucucagaauuuauuugagauuuaucuggcaaacuuuuuauccucucugagccuugguuauuuuuagaauugggaguaauaacuauuuguucugccuaucacaggguaguagugaagugcagauuauuuacuuccuuaaagagugcuuuguuacagaaauauaaguugcuaucauguuuagauuauuuaauagacugacuguaaucuaggauuaauagagaauaauuuaaaauaaaaauguaaaaucacauuuaguauuaggauauuuagaauauuugaagaauuauaaaaaguaaaaauuugauuaagauaugagugauugaggauuuuaguuuguucauguaguuucacuuuucugaaagugggauuaggaaacuuuaaacuguagguauauauauauauauauauauauauauguaugaaacuaaugaaauauuuagcguuucuuuuuauuauuuuuguuguguuuuuauuauuguugcauuucuuuuuauuauuuuugauguguuuuuauuauuauuuugcuguagcauaguauucuguaugucucucuaacuggauauaaguuccauaaguacagggcuaugucuuauacaauauucuccacuguauccaacuuguuguuaagugguauagguauuuggugaguacuuguuggguuuauuuaaaaauccacaguuauuuuacucuaguuauuaaguuaggcugaacaacuaauucuaccccuuccaagccaucuuuuaacuuuuccuagacgucucuuaucucuuaaauucucucucucuuuugaucucuugacuauuugcaauuacuuguuuuugacauugauacaauccacauacuauaguuagaaauuucaccagguuuugagcccuuuucaauucuuaaugacuuaaaauauuaauauauuuuguuggaguucuuuuaguauuuccuucuccuaugggauaaauugcacagggucaaaauuuuuuuuucuguuuaacucacuguuguaucaagaccuugaagaguggcuagcuuauagcagccacucaguaaguauuuauuaugcaguaucuuaauaagagauuaagauaauaugcaaguaucauauuuguucuuugcauauucuuauauacuuucuuuuuuccaaauacuguaugauagcuucccucaaucccccguagcagauuuuacuuggccagccguuuauagacuucuuccuauauucuagccaugcuauuaggugcuuuucacaaaaauuaucacauuuaaccugccuuccuuauaguagcacuauggugacaaugucauuuaacagaugaagaagccaaggcucacagaaguugggugacaugcccaaugucucauaguuuuaacuuugaaguugaagauuagauuucaaguuaccuguuaggugaaauugaauaucaaguuuauaauuauguugugaguuuuaaagcagcucuauaaaaauggauuuauuacuuauuuugaggcuuucuguugaucacuuuaaaauggcaauugaagaauaagaaaugcugaauuuuuuuuuuuuuuuuuuugcgacagagucucgcucugucucccagagcucugucgcucuggagugccgugguacaaucucggcucacugcaagcucugccucccggguucaugccauucuccugccucagccucccaaguagcugggacuacaggcgcccgccaccacgcccggcuaauuuuuguauuuuuaguagaggcgagguuucaccauguuagccaggauggucucaaucuccugaccucgugaucugcccuucuuggccuccgaaagugcugggauuacaggcgugagccacugcacccggccagaaaugcuaaauuuuaucgacagguauaaguguagauagugcgaaagucaaguagcuuucucccagucuccuuaaucugaaauggaagauuuaauacuuugcugucuucccuguugauuacaaucuuuagaaauuuguaauuuguuacucucauaaagcugauuucuauauauguuguguuguauuuuccuaugcuucagccuuacuuugaauguuuaaaaaaaagucuacauuuuauagucauucucucuaacugaaguacccaaaauucguugucuaaaaauaagucaaagaaaucaauuuuauuuucuaggcauccuuaaauccuagugauacaccuccuucuguuguaaaugaagauuuucuucaugaccuuaaagaaacuaauauuucauauucacaagaggcagaugaucgaguauuuagagcucaugguaaguuacuuuauauuagcccuauuuauuuuuaacaaaaaaauucuauauuuuaagcuguuuuuguguuuuucuuuuuuuuaaccacaaaacaggucauugucuucaugagauauuuuugcucagggaaggaauguuugagcgaauuccugauauaguuuuauggccaaguaaguuuuccccuccucguaucauuaauuuaguauugcuaaauuuuagguaaauuuaacauuggaaauacguacuuuuuggcauaugaguuguaaaaaauauaaauugcuguauuuuuaagagaguuuacauaacagucuugaagcucuuucuugacuugguuguucugaacuauugguuuuaacaauucauuuuguugcugauaauuaaaucaucauuuuaaauguaaauaaucauauuugagaugucaguggaaaaacauauuuuuggauaauuuggaagcuucaugaaauuagugucaguaauacauucagauauauagaauuauuaauauaauugaguacugcaaacuaauauuaguaauaauuuguugauaucagcuugugagcuuuaaaaagccuggucaaacaaguuuuauguauuauguuuaugcaugcuauguuuaaaaugaauaauuaaauuuugaguaauuauuaggauuuggcugggacaggggauggaugagcuuucuguuguaauuuugcucuuagugaguaguagguacuauauuuauaaaucugaaguuuuuaccuaucucuuuuagcagguaauuuaaagcaagauggguauauuguuccuugcuguccauuauugcauuuuuuaaagaguucuauugaucuucugauucauuuucucuucagaucuuccuuuucagaguguauauuuuauuuuuuaauaaauuggcucauucacggacucucaguucuuaaaugagauccuucuacuuuggagggacugagagaaaaauuauacuuuaaugugggggcaagaggcaggugagauacacagaaggaaaauccaagagcauauguagcagagaugaaguuacuuuccugauacuuguauauuagucuaugcauuuggaauauuuaugaaaugucuuucaucucuauuaguuuaguauagaaauuuuaacuguuccugaggaaaagauauucuccaauagaagaaauauuuuuguuuugcuuccuugcuuuuuaguagcuuuagguuacuucucuaccaagauuuggagaagguuuauuccauuuauuacuggaaaacaugaaagcaaaauuuaucaauuuucacuucccacaagaaaccuaauaggccauccuuugauguaucuuaauaagaacuuccaaguguaccuucuaggcauuuucuucaugucuuucaauauuaaaauacuuagagaguugggcuuggcagugcaugccuguaguccccguuacucagaaugaugacgcaggaggauuacuugccugaaguucgagucuagccuggacuagugagucccucaugucuuaaaaaacaaaaacaaaaacaaaaacagaauaauauaguggaaguauauuuugcuuuaagaaauccaaauauucucaaaaacucagauguaguaaacaauauuucacaaaaguuucuuugcuuuguaaaaucccucccauuuuauugguucccuugcaccuuugcucuuccacuuuuuuucaucccaguuuccaaaucaguuccuucucaguguauauccagguuuuugugaagccauaaggguuuucaugccgcauguuucuugccccuuaagccucccauacaccguugggagauuaauucaauaauccuuuugccaacuucuuccauacuucaagaaucuguaugaaugguguauuccuggcugaaucaaguuuauaauuuuauucuguucaauauccuaguauaaugacuucuuuggaaauaguuucccgacaaguuauuaagucacugaggucuuuauuuaauuuuaaugugaauuuccuacuggcgaugaaguccaaguuuuucuuugcaggaggccuaguuuugagacaaugaagaaauuugaggcaaugugguauuccauagaguggauguggcugucucauucuugcaauacacacacacacacacacacaacuggaaaucuguuguaguugucuuuaagucuggcuuugaucugaaucggaauucuauguguugcuuaauaggaugcuuagggcuuaagaguaaggacaauuacuucacuuauuaaauuuaguauuuaugcauuauuuucaguggcuuaaacaccagaacuuuagaacugugaaaauacaggcuagguaguugaggauaagcagugaauaaaacaaaaauccgugcucucaagugccauacaauuuaccgaggggaaacagauaauccacaaguaaauauguaacauauuggguaguguuaagugcuguaaagaaaagaaaagcauguaagaggguagugcgaacaaggauguguaguggaaugggggugcaguuucagauaacaugguuaaggaaggcuuuugauuaggugacauuccuagaagauaauuuugccuuguugaagauuuuuuaauagacaucuuuggguguuuugugaauuauuaauuaaugaguauucuauuuaguaaauuuaccacagauagcaagcuuuauaaguuuaauccaaaagcuugaaaauagauauuuauuaaaaaucggaaugaaacaaaugacauguuuucuuagcuuuacacaaaccuuagaaaagauaauugcaacuuuuauggaacuauuuuugcuuucauaaauggauauucauuugcuuuccucagcauucuuauuuccuacuaaguccuuaggcucuuagcaacuaauacuggaguuuugcauaguuuucuugccucaagucucgcuccuccaugccaucucuuauuauaucaggagauugacuuuucuaaaacaaucucuuugccaucuuguuccccuccuuaagaaccuccacuaauguccuauugccagucaaguugagucuuagcaccucuugcuuggcauuuaaaaucuuccagucagguuuuuguuacuuguauaacuuuuacaagcauaaagagaacccuuuaguucuguacaaaggaaaggaauuaugugcaguguauuuugugcaauauuguaaacauuuguuuaaacaauaaaucaucaauggugcuaaaauuaguaggugaaaguaugaugagaaucaugauauuuuacauagucuaagauauguaaauacugugucacuagguuuucccacuauaaggauacuguguuucuuguugaaauuaauagguauuuaaauaauagguauuugaacaauuaauaccuauuaauuuugacaagaaacagaguauccuuauaguggggaaaccuaguaacacggccuaaccaaaugcuguauuaauaaguuaacauuacuggaaaugagacauguucauaucaugugccucuagauguaaugcacugacaaagaugcaacaucacuucuguggaauuacucccaaaauauauaaccugaacuuaaucaugaggaaacaucuacaaacccaaauugaggggcauucuaugaaauaacugaccauuguucuucaaaacugucauggucaugaaaguuaaagauacucuaaggaaaugccuauuuuuaaagaagacacaaggcaacuaaaugcagggugugauccuggaguugauucugguccagaaaagaggacauuaguaggacaauuggaaguauuugaauaaggucuguagauuaguuuauuguauuguaucaguguugauugcuugguuuugaaauuggacuguagcuacauaagauguuaguauuuggggaugugagaugaaggaaaauuuucguacuaucuuuguaacuuuuuuguaagucaaauuauuucaaaaugaaaaguuaaaaagguaaaguguuuuaguacucaauuaacucauuguguuaaugagcaaaugaaugaaggaaaaguuuagauaaagaauuucguagguucuuauuugccaagguuaucagauuuuauuuaugccucuguaauuaauuuauuuucccuuuuuucaacagcaugccaugaugauguaguuaagauugugaaucuagcuugcaaauauaaucuuuguaucauaccaauuggugguagguauugugccuuuugaauuuuaauauguaaauuuguucuauuuaaaauauuuguauuuuaaauauuugcgucacccuacugaaaacaaacauuauuguaauugugaugugguuauucucaaaaauuggucaaugaugcucauuuuuguucuaaguaggauuccuuaaacuguuugagacaugguauaccuuaguucauggcuuuuuccucuaugggcccuaguugaagcuguaauuuaaugccugaauaacaaaauguuucugcuuuaguaauuacuuuuuaaccuguauauuuauggagagaauuuucuuuuucaaaagcuaaauauaaauauguccuauauaaaccuuugagauuagcauaggaaugguaauaagacucccaacaauucuagaagcuccauauucccucuucagcugaugcuuucuguugaauuuaugcaaaaaaggcacuaaaaugccauuuauuaugaaauauuuuucuaauuccaaaugacugugacaagcaaauagugguuacugaucacaggcaucacguucuuaaccaacaguucaugaacucacuuuguaaaauuacgcugaaccuuacagauuaacacccccuguacuucuuguggaaggugacuuucacauguuuucuuucaugcagaacuuauggaaguaucagucaagaauuuauucgauauauggugauuuagaucugguuaagaacagagaacauuguuuuguucuuuaaugguaucaagaaggcauuuuuccuuugacaguaaauguuaagacaacaguguguuuaaauacuucuauguauuauucuauauuaaaaucacuuuuucaccaaagaacauauaaauguuuuuaaauaccucauaaucuagacauuuuaagcuuguuucuauucuaauuuauuaaagcuuuuuuguauaagaauauaagauuauuuuaaaugauaaaugaaucucauaauugugguaaaaaggaaguaaugaugucucuaguuguauaggaugggucuuuuuuucuuuuaagcuaccucuccaugguaauuaucugcuuagaacuuuucuaaucauguuuuuggaguuccacaaauugcuaggggcuucacuugaguguggcauuuccaggggauggaaccauagcccauugcuuucaguuccguaauauugcuucauuuuggcacucagcauaaaauaaaggugaguuugcuuuuaguguguuagcauuugcaaguuguauuuugcaaaguauuaauagguaucacuuuucuaguggcccuaucuguauacuugauaugagggauuugccauagaaauauagcuaaaaacagaauauuuaaacauaaaaguuguuguuuccuauuuuggcaggaggaacaaguguuucauauggccugauguguccugcagaugagacaagaacaauuauuucuuuggacacuucacaaaugguauuuaauaauuugagauauauuuaaaacauuuucuuuauuggcuccaccuuaauugucauuaaaaaagaaucuagccacugggcgcuguggcucacgcuuguaaucccagcaccuggggaggcugagguggguggaucacuugaggucgggaguucgagaccagccaggccaacauagcaaaaccucaucucuacuaaaaauacaaaaauuaaccgagugugguggugugugccuguaaucccagcuacuugggaggcugagacauaagacucgcuugaacccaggagguggagguugcagugagccaagaucacaccacugcacuccagccugggugacaaaaaaaaaaaaaaaaaaaagaaucuaauauccauuuuguuuuaaauguauuucaucauuacauuuuacccuuguauucaguucuccaaaagguagguuuacuuuuacccucagguauauauguugauggcuauuuuaccaaauuugaauuuuuuuuucaaauaccuaaguagagagaauaguuuacccauuuuuuagaugaagucguuauuaacauuuugucauacuuucuuuaucuuucuuuuuuuucuaguaguuuuagagcaaauucugauacaaugcuacuuuacauguaaauauuucuguauaaucucguuuaaaaaggacauuuucucacauaacuauuauuaucacuccuggcaaaaucaaaaguaauucuuuauguuauuuaguaguuagucuacauuaaauuuuugauaaaaagugucuguuuuauaguucauuuguucaaauggggauccagacaaggcucacauuugcuuuccauuguagcucuuaagucucacuuuauguaaaagcuucaucuuacucccuguuuuuuucuuuugaauguuauagacuuuugaagaaacaagguuauuuguaguauagaaugucauauuuugaauuuaucuguugcugcuucuugucauuuaacucuuuaucuaagcccuguauguccacuaaauuagaaguuccauauaaagucuaguuagauucaggcauugccuuuuuuugguuuuguuuuuacagcaagaaucccucauagaugguaaugugcuuuuaaaaaaaugucacauaacaucaauagagguguguaguagcugauugucucacuuuuagugaugcuaaaauugaucaaguucagauggugaacacuuuauuuuauuguaagguuccccauuaaccuaucuccuuaucccagauuuuaagaaaaggcaauuuauuuccucagaagauagcugaagaauagccuguucuggaauguuaacauggguuugguaguauauaugggauguaauaggguagccuauauguuuucuuuagguuuuucugugagugccuaugaaguuuuuucugcuucuuuuaauuuccuuuuucuaccaaaagauauguuugaacucuugguagcuacaagguauauauuuagaaugaguauguaauugccucaagggccagucuguugggggagaagauauauauauaagguaccaucagaucaauaaauucuuugucuuuucauucugcaauuuaauaauacugucuuuuguuuagcugccaaaggaccaaaagccugauuauaccauaguuguauugaaguuacuguugucagccaggcgugguggcucacgccuguaaucccagcacuuugggaggcugaggugggcagaucaucugaggccaggaguucuagaccagccuggccaauguggugaaacccugucccuacuaaaaauacaaaaauuagccaugugugguggcgugugccuguaaacccagcuacucaggaggcugaggcaggagaauugcuugaacccaggaggcagagguugcagugagccaagaucaugccacugcacuccagccugggugacagagcaagacucugucucaaaaaaaaaaaaaaaaaaaagaaagaaagaaauuacuacugucuuauagugagaguauaauuaugaguuuuauguaacauaaaacuaaaagugcauucacauacaucaucuuauuuaauguuuuucacaacgcugugaauuaagcagugcaguuauuuguauguguucagauuuggaauguaggcagcaacugcuauuuuuguauuguauuuuguauugucuguugugcucuuuccuuuuuauuauuaaguagauuuaucuauguuaguuauugccgugaaauugagcauaugaaaguagaaagaaagcuucccugggauccagaagaagguucuauauguuacccaauugcucagccagauagaaaggggaaagaagucugcucuuaauaguagaaaguaauucaugaaaauucauauauguauauaaaaguuaggucaaauaagaaugccaaauaacauuuuuuauuggcagucauacguuugguaaguugagccagaugaaauuuaguuccuucuuuugagcccgaggcagggauuugcuuuguuuuguacauggggucucuggcccuguuuugaauuaaaaauaaaguagggaugccaucugcuauauucaaauguccuugcagauuguuuuuucuaaucuuauggucauauucugauauucuuaaauuagauagugauugcuauguuaacacagugcagauaguauuugcacaaugccaggaccuguauaugcuguuuuuuuacauggaguaccucauuuaauuauuguagccaacacuuuauguauuauuacuauuuuacauuuuacaaaugaggaaacaauaagcuuagacaguuaaauaauuugccuaagguaagagaaggaauuuaaauuaaccucugaauaaagacagagucuauguuuuaagccaaccccugcauaauaugcugccuuuguuacuauguugucauguuguauagucugggauaaguggacuugguuuccagugugggugguugaggggaacccuucuugcuuaaucacugucuuaccacuuguugcuuugaauuaggaaguuauauuuccugagaaaauauuaguaguuccuggagaucagauuucuuucuuccuuugcaacagaaucgaauucucuggguugaugagaacaauuugacagcucauguagaggcuggcauaacaggacaagaguuggaaagacagguauguuauuuauuuuucuuauuuuuuuaaauuaacuuauucuaauaucaauucugauguuauuucuuuaaugaaaguuuucaaaacuguauccccucuaugaaugaaauaccuuuuaugauacauucauucacucaaagaauuuguuuaguuucuauuaugggucaagcauugagcuagauucugaggacaugauagugaauaaggcauugucugcuaccuucagguagcuuagauuaggacagaaaguucgauaaauaauuaauuauuuggagugaaaauugcuauguggaugcuaaaugcaggguauuauggaucaucaaauggggcuaggugggaacgaguugggcaaagaagguaucacauagaaccuggcauuuuuuuuguuguuguuaguacugagucaguggcaaaggacacagcauuuaaaaugagacuucaggaugagucugaguuagcaaaaaaggaaagaacaauccagaggaaggagcauacaugcagggcuucucagggugacuguuacuuuuuuuuuuuuuauuuuuuuugagacggagucucacucugucgcccaggcuggagugcagugacgugaucucgguucacugcaagcuccgccuccuggguucaugccauucuccugccucagccuccccaguagcugggacuacaggcacccacuaccgcgccuggcuaauuuuuuguauuuuuaguaggacggcguuucaccguggucucggaucuccugaccucgugauccgcccgccucggccuccugaaguguugggauuacaggcgugagccaccacgccuggccgacuguugcuuuugagggucugcagauagcugaauauggcugaaggcuaguguguguaugggagaacaugucuucuugguauuuguauauuggguggguguggguacaguagugguaaaggaucaagccaggaaaacaugaagaguucagaucauaaagggccuuauaaagccccuuuuagaaguuugaacuuuacuuuuuuacugguauuguucuggcugcuguguggugaaauggguggucuauguaaggguggacuaagagacugcaacaauaauuuaggcaagagcugagagugacaugaaguaguagaaauggaacaaaauggaacaguuugaacauggaauucuaggaucuuggugauauauuucaucagcugggugaauauugguauucauugaacuuuucagugugcaauuucauugacaacuacucauuucauaaauucaugaaauucuuggaguucuuauaguaccuuuuugggauccuaaugaauuuuuggaaaacuuuagguuucuuucauagauucuaagcagguaauagugaaaauaaauugguuccuucaacuuccucaaacauaaucaagauaacgauaacucagcuuuuguaaacaaaaauuagaaaguccaauuuguuagugauguacugaccauuuuguucaacuuggguuauagagaccccucuccuccaaaccuuuaauaggaagagaugugaugugauuguuaucuuauuuuguuguuguuuucuuuucuuucuugaaaaguugauugacauugaucugcuccugaccauuucuggaugauaggcuuugaaaaaaaaugauuaaacuauuuauuuuuuauuuaaugcagucagaugcagauaacuggaauaaaauugaacuuauuuguugagacaguguuaaagauccucaauaaauuaagguuuuauaucagauaaauagauuuaucaauuauuauaguuuauaaugaacuuuagugggcagaauaauaguauuuaaugaaaaaaccucuaaaaaguccuguaucaguauuccauuaugcuuaaaugaggcauuaucagcacagcacuuuuuuuuauaacaaagaauggccuuuuaugucaccaauuuuguaucuuuauuauagcauuugauguaguauuuuaaccuuuccaaguuuucuuuuuuuuuuuuaaagguuagaauuaaaauucaaggaacauauuuccuugaaauuuaaaugacauuuucccagacuaggaacuucugauauuuuaccuacuaguucauuucccuaaaugccgauauagaacuuucuuuuuugccuccaguaggcuauaauguaguuccuacagcuauuuugaucccaguaaaaguucuuccucauuaaacuuuuguguccuucagauucuacuucaguugagguaaccaguuuaaaacauccuggcuuuucuuucugcaagcuuaaaaugacacaaauacaguaguuggguagcacagauuuuaaucgcuuuaacuuguaaaucacauugauguuaacaugauaaaauuuaauggaagcugcuaacaugucaauuauggauuuggagaauuuuuccuacguuuauuaaaucuuuggcuacuuuuauugguuaauagucugagguuaucugacucgaauuuuuuuuuuucugcuuaggcacaucaucacuaauaaccucacauuaucuuucuuuguuucuaauagcuauuagcucucacugcaaaccucaauauagcuccuagcugugugaccuugggcaaguuacucaccuuuaagccucaguuucuuuaccuauaaaguggguaucauaauuccuacuucgugggguuuuucaucaagaugaaauaaguuaauaaugugaacuacuuagaacuuugauucauuccacuaauuuuuauugagcacuauuugcuucauucaggcuaacagacuuuaaauauucuuuuuaugugcuguagacuccaaaauuuauauuaucauccuagacuucuuugcugaacugauauagccacuugccuaauugauaucuccacuugcguauuuacagacauuucaaacuccgcauuuuaaaaacugaauuuuuagaggaaaaauuugcaaucuugucuccaaaaugugucuguucuguagccgccuucuucucuucaggagauggaaauucaauuccuuaggcagcuuggaccacaaucuuugaagucauagauuuuuguuuuauauugcuuuauaauagcuugagauauaauuaugaucuaauauguacaauuuaauguguacaauuugauaaguuucgacauaugaauauaaccaugaaaccaucaucacaaucaagauaaugaacauauccaccaaccccaaaaguuuuccucuuucuccuuuauaauccuuucccacucccacccacaacccuuaagcaaccccccaggaaucacugauuugcuuucugucacauagauuugcuuaaauucccuacaauuuuaauaaaguggaauccuacaguauguaugggaggagggucuggcuucuuucacuaggcauaauuauuuugaaauucagccauauuguugcauuuaucaguaguucauuucuuuuuguugcucagcaguauuccauuguauagauaugccacuguuuuguuuauacauucaccuguugaugaacacuuggauuauuucuaguuuugggcuauuacaaacaaagcugcuaugaacguucaugugaaaguuuuuguauagacauauacauuuguuuccuuucgguaaguaacuggaaauggaaugaauagaucaaaaugguagguauauauuuaccuuuuugagaaacuaugaaguuuuuucccagagugauuauaucauuuuauauucccaccagcacuguauaagaguuccaguuucuccauauccuugccaauacuuuguauugcuagucuuuuuaauuuuagucuaaacuuuaguagguacauaguaguaucuuauuguagguuuguuuuguuuuguuuuuugagacagugucucaugcugcugccugagcuggagugcaguggcacgaucauggcucacugcagccuugaccucccugggcuuaggcaauccucccacuucagcuuccugaguaacugagaccacaggcaagugccaccaugccuggauaaucuuuauauuuuucuguagagauggaauuuuuugccauguugcccaggcuguuccugaacuccugggcucaaguguucugcccaccuuggccuuccaaaguguugggauuauaggcucgggccccugugucuggccucauuguaguuuuaauuuauauuucucuaaugacuagugauguugaacaucuuuucaugugcuuauuugccauccauauucuuuauuggugaaguucuccuuaaauuauuugcccaauuuuuuuuuuuugagauggagugucgcucuguuguccaggcuggagugcaguggugugaucucggcucacugcaagcuccgccucccggguucaugccauucuccugccucagccuccccaguagcugggacuacaggcgcccaccaccaugccuggcuaauuuuuuguauuuuuaguagagacggguuuucaccgcguuagccaggauggucuugaucuccugaccuugugauccaucuaccucggccucccaaagugcuaggauuacaggugucagccaccacgcccagccuauuugcccaauuuuaagauuggguuguuuucuuauuauugaguuuuggaauucuuuauuuauucugggaauaagucuuuuuucagauauaugcuuugcaaauauuuucuuucagucugugguuucucuuuucauuuucuuacacuaucuuuugaagaccagcuguguuuaauuuuuaugaagcccaguguauuaauuugucuuucuaucaugcuucugcuguugugucauaaugcaagguuauagagauuuucucccauuugaguuuuauaauuuuuagucuuagauuuaggucucuaaucaguuuugaagauuucugaguuauuauuuguauaugguauaaaauuggauugaaguuaaugauuuuugcacauggauauccaauuguucagcaccauuuauuggaaaagauuauccuuucuucacugaguugacuuugcaccaucauuuaaaaaaaucuguugucuauauaugucugcuucuaguucuggacucuauauaugucucugugcuaauacuauacuguuuggauuacuauagcuuuaucacgagucuuuuucaaaguuguuuuggcuauucuagguucuuuguauuucuauaugaacuucauguucauauggaaaugucaguuucuguuaaaaaaagaaaaagucccauugggauuuugauugggauugcauugacucuauauaucaguuugaggagacugacagcuuaacaguuuugauucuucugaccugacccaugaacaugguauaucuuuaguuuuuuguaggucuguaauuucucucagcagugucuuacgguuuucuauguacaugucuuucauauauauauauuuuagagacaagaucucauucuguugcccaggcuggagucuaguggcaccaucauagcucacuguaaccuuaaacuccugggcuuaaaugauccuccugcuacagccuccccgguagcuaggacuacaggcaugugccaccaugcuuggcuaauuuuuuaauuuuucuggagacagggucuugccauauugcugagacuggucucaaacuucucgcuucaaccuaccacccuggccucccaaaguguugggauuaucgguaugagccaccauaccuggccucguauauuuuuaaaaacaggauuugucccuaaguaguacauauuuuuuggugcuguuguaauugguauuuuuaaaaauugucaguuucugguuguucuuuaauaguguauaaaaauacaguuuuuuauacugaucuuauauccugcaacuuuacuaaauucacuaaauuuuaacuuuuuuuuuguagaucucauuggauuuuuuacauagaugacuauguugugugugaauaaagacaguuuucuuucuuucuuuccaaucuguuugccuuuuuuucuuuuucuuaccugauuguacuggccagauaauguugaaaagaagcgagacuuguuucugauuuaggagagauguguucaguccuuuaacuauuaaguauuuguuaacuauagguguuuuuuguagaugcccuuuaucaaguugaagaagucccuuucuuguguuaauuuauagaguuugaauuaggaauggauguuggauuugugaaaaaaauguuauuuugugucuuauaguugagguuaaguugaaguaauuuauuugaguucagucuuauuuucuaaaguagaaaaucagugcugauuuuuucccaauuguugcuuuagugacaugccaccaauuuugauauguuuauuuucauuaauuugaaaauauuuucuacuucuuugauuuuuucuuugaucuaugguuuacucaccauguauauauguuauuuaguucccaauuauuuugggauuuuuccagauaucuuucugucauugauuucuauauuaauuuuguuguguucagaaaacauacuuuauaugacuugaauccuuucaaauuuauuacuacuuguuuuauggcccacaguacagccuauuuuuaaaauguuccaugugcacuugcaaagaauguguuuuccugcugcuguuuggugaaguagucuuuaaaugucuguuaggucagauugacuuauaauguaauucaggucucuuauauuuuuuauuuucugucuacuuguucugucaguuauugaagggggguauuaaaaccuccaacaguaauuguagauuuguauauuucuucugcaguucuauuuuugcuugguguauuuuaaagcucgguuauuaggaggauaaauguucaggauuguuauggcuucucgauuaacugacccuuuugucguuaugaaaugaccuccuuuaugugugauaacaugcuuugcucugaaaucugcuuuuucugauacuaaaauagcuauuggaguuuucuuagcaugguauaucuuuuugcuuuuuccauuauuuuacucuuaauuaguuuguaucuuuauauuuagaauguuuuucuuauaggcagcauauaauugguucuuuucuuuuuaucuaaguugacaaucacuaccuuuucauugagguguuuagaucauuuaccuucagugugauuuauugugguuuaguuuaaaucugucaucuugcuauucauuuucuguauuucccaucuguuuuuguucuucuuucccucuuuuacugccuuuuugggauuuuuuuuuaaaugauaugcuuuaucucuuuaguuucuuuaguaguuuuaaguuuuuguuuuguuuuaggauuugaaguauacaucuuuaacuugugucagcuaccuuugagugauauuguaauacuuugcaguaucauuuaaaaaauuuaaauaauaugaaagcaucuuguguauuuacccaucuaguuaaccuuuccuauacccuuaauuuugucugauguuauuugccuucugcuugaaggacuucuuuuaacaugacuuuagugugggucugcuguuggcaaauucuaauuuugucugaagaagucuuuauuucaccuuuguuuuuaaaaaagauauuugaagugaguauauaauuguagauugauauucuuucagcaguacaaagauguugcuccacuguuaccuacuucauugcuuuucaugagaaaucugauauuaucuuugucuuuguuucuguguauguaauaugcuuuuucccccucuggcuacuuuuuuuuuuuuucuuugagacagagaguuucacucuuguuacccaggcuggagugcaguggccugauaucggcucaccacaaccuccgucucccagguucaagcgauucuccugccucagccuccagaguagcugggauuacaggcaugccccaccacgcccagcuaauacuauauuuuuaguagagaugggguuuuaccauguuggucaggcuggucuaaaacuccugaccucugauguuccacugccucagccucccaaaaugcugggauuauaggcaugagccaccacagccagccuagguugcagacuuuacgacacuuaacuuaaauacaucagcaccaucuccuaaagacagaagaauaguguucuucuuuauaacuauaauaccauuaucaugucuaagaaaaucaguaguaauuuuuuuuuuuuuuuuuuuuuuggagacagagucuuacucugucgcucagcaggcuggagugcagugguucaccacaaccucugccucccggguucaagugauucuccuaccucagccucccaaguagcugggauuacaagcuugagccaccaugcccggcuaauuuuguauuuuuaguagagacgggguuucuccauguuggucaggcuggucucgaacucccgaucucaggugauccgcccaccucggccucccaaagugcugggauuauaggcgugagccacugugcccagcccccucuggcuacuuuuaagauuuucuuguuaucacugguuugagcaauuugauugucauggaccuugguguaguuuuucucuguguuucuuuuguugaggauucguuaagcuuuuuugauuuguggcuuuauaguuuucaucaaauuuugaaaaacuuuguccauuauuucuucaacuauccaauaaaccccccuccccgcugaccuuuagggacucuauuuacucacuuauuaggcucuuugaaguuccacagcgcacugcuacucuucucauuuuuuucuuuuaguuccuguugcuaugucuugaaguucacuacuguuuuauuuugcuaugucuuuucugcucuuaaucccauuaaauauauuuuuaaucucagacauuauauuuuucaucuccagauguuuaauuugggccuuuuuauaucuugcaugucucuacuuuuugaacauauagaauacaguuauaauaacuguuuuaauguucuugucagcugugucuaacgucuguguuaguucuggauugguuuugauuauucaccccauaaugauuaugggguguuuucccgcuucuuuguagcuugguaauuuuuauuuuuauuuuauauauauuuuauuuuuauuuuuaauuuuauauuuuuaauuuugaaugguaauuuuugauuagaugguagccauugugaauuucgauguuuuucaguucuacaaauauucuucagcuuuucuccugggaugcacuuauguggaaacaguugauccucuaguucuugcuuuuaugaucuuuugcuuuuuucagucugagacuaauuacuuuccacuacugugguaugacauuguuggauauccuaccuaauacucugugaauuaauaguuuucucaguuggacuaguggaaacagguacuguuucuggcccucugugagugcuggcacuauucucuaaucuacugguguccagcccuuugaaugugaggacuuuuuugguggcagauaucaugaaaauuaugcauagaccuuuuuuuuuuuaagcucaucagcuguuguuaguauuaguguauuuuauggguggcccaagacaauucuucuucuuucagcguggcccagggaagccaaaaggcuggacacccgugcuguaauccaucuggaguauaucuuccucuggucuuugguauuucacucacuugcauuuacuuuucaguacucugcugaagaccugaggggcacacucugcagaucuccaggcaccucucuuugugcugcuuuuuucuguacuuuuuccugugaacucuaaaugccuugauugccuugacugagcucuaugcucaaucucaacucaguguuugccaaguugugccuggauucuguuucuguggagcgcuaaacuagggucaagucacagugcucaucaccuguguuuacuuucucauaggaucaccguccuuccugacugcaaguucaguguuugaaaacuuuuuuuuuuucuuuuuuaaaauacaaggauggagucucgcuauguugcccagguuggucuugagcuccuggcaucaagugaucuuccugccucagccuccuaaaguguuaggauuacaggugugagccaccaugccuggccuguuucuucuauuuuucuguguuuuagucuuauugggugggaggguaaauccuagcuccuuuaacuucaguuuggguagagggggaaguuccugcucugcuuuuuauuuuuuucaucacacuucuaauuauucuguauaauuuaauuaugauucuuaauuucaguuuccuuuacuauuucuccuguuuuuuuuuuuagcagcauauacauuuuucucaauauugcucuauaauauaagcaccauaauuuagggauuuuuuaaggaauauaucugaaggucagcuuguaguccguaaauauuuguuguuucaguauugaauuggaacacaagugagauaaagcuuuuauuccccuagagcuucauggcacaugguaaauaaacacaguuauuuuuaucuagcgucauauggggcagagauguuauuuuauuaaaaaagaaaucuugagucagacaugguggcuuaugacuauaauuccagcacuuugggaggccaaagcaggaggaaugcuugagcccaggauuggaggcugcaaugagccaugauugugccauuauacuccaguuugggagacagagugagacccuuucuuggggaacguggugggugaauauuugauuaauuguaugaguaaaucuguggaccuuucuucagcaaauuuuucuuaccagcuaauggcauuaacagagacacagaccuuauaggagaaagcggcuaaauguauaugaucuuagauaccauuuauuaagcacuuacuaugcaccagcaguuguuucucacuaaauuugcauauugugguauacugcgguaugcaaauuuucuagcaacaguaaaugacaaauuucaaacccagggauuuuuguuuguuuucuuaaacuuuuuggcaagaaaaaacccagguuuucaaccauuacacuuucuucacuuauuuaguaggaaguuaguaagauuuuaaaugaaguaaauuuaaauuggugugguagagcucauucagcauggggaacaucugguuuuuuugguaucuguaucuuuugcuuuacacaauuccugguauauaguaccugcuuguaauuggagaagauaaugaaguaaccuaccugacaaaagaaacaaauuaaucguauauauaauauuggauauacugauagaaauaaaguguaacaccgcacuguuaauacuagacagaucaacgagacagaaaauuaacaaggauauucaggacuugaacucagcucuggaccaagcggaccuaauagacaucuacagaacucuccaccccaaaucaacagaauauguauucuucucagcaccucaucacacuuauucuaaaauugaccacguaauuggaaguaaaacacuccucagcaaaugcaaaagaacagaaaucauaacaaacaaucucucagaccacagugcaaucaaauuagaacucaggaauaagaaacucacucaaaaccgcacaacuacuugaaaacugaacaaccugcucuugaaugacuacuggguagauaacgaaaugaaggcagaaauaaagauguucuuugaaaccagugagaacgaagacacaauguaccagaaucucugggacacauuuaaagcaguguguagagggaaauuuauaacacuaaaugcccacaagagaaagcagugaggaucuaaaauugacacccuaacaucaaaauuaaaagaacuagagaagcaacagcaaauucaaacacuagcagaagacaugaaauaacuaagaucagagcagaacugaaggagauagagacacaagaaacccuucaaaaaaucagugaauccaggagcuguuuuuugaaaauaccaacaaaauagaccgcuagccgacuaauaaagaagaaaagagagaagaaucaaauagaugcaauaaaaaaagauacaggggauaucaccacugaucccacagaaauacaaacuaccaucagagaauacuauaaaugccucuacacaaauaaacuagaaaaucuagaagaaauggauaaauuccuggacacauacacccucccaagucuaagccaggaagaagucaaaucccucaauaaaccaauaagaaguccugaaauugaggcaguaauuaauagccuaccaaccaaaaaaaguacaggacuagacggauucacagcugaauucuaccagagauacaaagaggagcugguguaccauuccuucugaaacuauuccaaacaauagaaaaagagggacuccucccuaacucauuuuaugaggccagcaucauccugauaucaaaaccuggcagagacacaacaaaaaaagaaaauuucaggcuaauauccccgaugaacaucgaugcgaaaauccuuaauaaaauacuggcaaaccgaacgaauccagcagcacaucaaaaagcuuauccaccacaagcaaguuggcuucauaccugggaugcaaggcugguucaacauaugcaaauaaaucaauguaauccaucacauaaacagaaccaaggacacaaaccacaugauaaucucaauagaugcagaaaaggccuucaauaaaauucaacaccccuucaugcuaaaaacucucaauaaacuagguaucgauggaacguaucucaaaauauuaagagcuauuuaugacaaacccacagccaauaucauaccgaaugggcaaaagcuggaagcauucucuuugaaaacuggcacaagacaaggaucuccucucucaccacuccuauucaacaugguauuggaaguucuggccagggcaaucaggcaagagaaagaaauaaagcguauucaaauaggaagagaggaagucaaauugucucuguuugcagaugacaugauuguauauuuagaaaaccccaucgucucagcccaaaaucuccuuaagcugauaagcaacuuccacaaagucucaggauagggugcaaaaaucacaagcauuccuauacaccaauaacagagagccaaaucaugagugaacuccuauucacaauugcuacuaagagaauaaaauaccuaggaauccaacuuacaagggaugugaaggaccucuucaaggagaacuacaaacugcugcucaaggaaauaagagagaacacaaacaaauggaaaaacauuccaugcucauggauaggaagaaucaauacuaugaaaauggccauacugcccaaaguaauuuguagaugcaaugcuauucccaucaagcuaccacuuacuuucuucacagaauuggaaaaaacuacuuuaaacuucauauggaacaaaaaaagagcccacguagccaagacaauccuggacaagaagaacaaagcuggaggcaucaugcuaccugacuucaaacuauacuacaaggccacaguaaccaaaacagcaugauacugguaccaaaacagauguauaggccaauggaaaagaacggaggccucagaaauaacaccacacaucuacaaccaucuaaucuuucacaaaccugauacaagccaugggggaaagauucccuauuuaaucaaugguguugggaaaacuggcuagccauaugcagaaaacugaaacuggaccccuuccuuacaccuuauaaaaaaaucaacucaagauggaucaaagacuuaaaugcaagaccuaggaccauaaaaauccuagaagaaaaccuggacaaugccauuuaggacauaggcaugggcaaagacuucaugucuaaaacaccaaaagcaauggcaacaaaagccaaaauugacaaaugggauuuaauuaaccuaaagagcuucugcacagcaaaagaaacuaucaucagagugaacaggcaaccuacagaaugggagaaaauuuuugcaaucuauccaucugacaaagggcuaauauccagaaucuacaaagaacauaaacaaauuuacaagaaaaaaacaaccccaucaaaaaaugggcaaaggauaugaacagacacuucucaaaagaagacauuuaugcagccaacagacauaugaaaaaaugcucaucaucacugguuauuagcgaaaugcaaaucaaaaccacaaugagauaccauuucacgccaguuagaauggcaaucauuaaaaaaucaagaaacaacauaugcuggagagguuguggaaaaauaggaacgcucuuaugcuguugggaguguaaauuaguucaaccauuguggaagacaguguggcaauuucucaaggaucuagaacuagaaauaccauuugacccagcaaucccauuacuggguauauacccaaaggauuauaaaucagccuacgauaaagacacaugcacauguauguuuacugcagcacuauucacaauagcaaagacuuggaaccaacccaaauguccaucaaugauagacuggauuaagaaaauguggcacauauacaccauggaauacuaugcagccauaaaaaaggaugaguucauguccuuuguggggacauggauaaagcuggaaaccaucauucucagcaaacuaucacaagaucagaaaacaaaacaccacauguucucacucauaagugggaguugaacaaugaguacacauggauacagggagaggaacaucacacaguggggccuggggcgcggugggaggcuaggggagggauaacauuaggagaaauaccucauguagaugauggauugaugggugcagcaaaccaccauggcauguguauaccuauguaacaaaacugcacguucugcacauguaccccagaacuuaaaguauaaugauaaaaaaaaaugcaaguaagagguaccauuuggggaaccaucaguuaaaacaagugauuuaacuguuucccaucugugaaaauaggaauaauaauagugucagcuucauaugguuguugagcagauuaaaugaauuaacacacuuaaaaaauuaguuaaaguguguacuuaaagauuugcuucuguauaaugugaaguuuguuuugucaugacaguaugugaaaccucucuuuucaguaccugguacaucuuagggcuccaugaaugucuuuuuuucuuuucccaauuucauaaaauugaguaaaaguuuauguuuuaaaagaaaauugaguaacaguaguguuuuaagagaaaauaauucauaguauuuuguuuggagauggaguuagggaagaaauauaauguaacagucugauaaucuucauuuuaaccucuucagccauuuauuuaagcuucuuuuuaauagauggauauuaaucucuuaaaacuaaauaauauauugaauauuuaguggagaaacuuuuauuauauaacaguugaugucuuuuaaaaucuuguuuuccuagcagcaaaauuagaauagauagagaauuuguauugcugauaugcaaaaccuaacaaauuauauuuaaccuaauaggcuuucauauuuuggauuacaacuuucacaccauacuuaaauacaaauauacagacguggcugacauauucuacauagcuguguggcuuacuugaaaaauagaacaguugcuuaacuggaugacuaucaaaauggucaacacagauugaugggcuugaguguagcagacagcggguaugcagaugguggugucuguaccguuugagaagagauggcugagucuuuaaaaugauuucauuggaauggcuuuggugguguugcaguaaagggcaucuauucaaucucaggugcugugcagauggcaaagccaagauaauauagaaaaaugagaaacaagugacuauuuaauguauaguaaugcaugaucugcaucacaaauaaaugacguuauuacaugcaggaaaccuauccagaugccuguacauuaaaacacaugacuccuugagagaauuaaguacaggcaauuugcucggauuuucugcaggccugcugcauauuacauuaggguagagagaacaagagauuaagugcuuuauuuauugaaaguguuuagguaaaguuggcuguuauuuaagcauaaucugaucuccauaaauauuuaaacuaucucuuuguagaaaaaaaaaguggggaaggacagcuggccuuaaaacaaaaggauguaaggaguaugauuaucuggucaaccugugaaaaauagaacuucuuuuggccuacauuuuuuaaucuuguaacauuuuccacuaggcaaaagcuuaaaaaaauuuuuaggacuagugugauaaaaguaucuuuuuuuuuuuuuuuugcuauguaggaauuaauaaauucaaauaucaaugacauggaaauuuuaaagugggaggaguuaauguguugagugcuguacguaaugggaccauuuucacuguaaaauguuaaauuuuuguuuuucagcuuaaagaaagugguuauuguacaggucaugaaccagauucccuggaguucaguacuguaggaggauggguaucuacucgcgcaucaggcaugaagaagaauaucuauggcaauaucgaggaccugguaaauauuuuucuaguuauuauguaauaauugauuaguauauagauauuauuauaaaaugauuagaagccuuuaaaaauuaagaguugggccugggcgcgguggccaaugccuguaaucccagcacuuugggaggccgaggcgggcggaucaugaggucaggagaucgagaccauccuggcuaacaaggugaaaccccgucucuacuaaaaauacaaaaaaaaauuagucgggugugguggcgggcuccuguagucccagcuacucgggaggcugaggcaggagaauggcaugaaccugggaggcagagcuugcagugagccgaaauugugccacugcacuccagccugggcgacagagcgagauucugucucaaaaaaaaaaaaagaaaaaagaaaaagaguuggaugguagauuccccccucccauaaauaaacuccuuuugacuauaauaacauuggacauguauaguagaaaguuaaucaaaacacaacuguggucauuauuuaaggaugccccuuuucaggugacuacauuuuaagcuuuguagauguuucacaguauccagcucauaaaauacggucagcucucuauauccacugguuucguauccacaaauucaaccaaaugcagcucaaaaauauuuggaaaaaaaaauaacaauaccacaaggaaaauaauacaaaaaauauaguagaacaacaauuuacauaguauuuacauuguauuauucauaaauauucuaaaaugauuuaaagcaugugagaggaugugcauagguuuuauauaaauacugugcuguuuuauguaagggacuugaguacuauggauuuugguauccucgaagguccuagaaccaguucuauggggauacugauggaugucuguauacaaauauuauuuuacaagccucguggaaaugaagucuucaacucuaccgugauuuuaguccauuuacuuagaugauuucguuuuugcuacucuguuuccuuaggagauuuugcauuuuucugaaaauaauuuuuccuguauagaauuaaauaggcugauugaaauuguucuaccaaguagugguaagaccugucauguuuuaugugcacacugcuuuuuguagcugauauggugccacuuugcugggaguuaguauaauaauaguauauaacucugggcacccuaguuagggauuagguaucauuuguugcuuuuucaaugauuaguugugugaauuuguacaaauugguuuacguuucuaaacuucaguuuccucuucuguaaaauagaauaaugauauuugcugcauagaauuauugugaggaguaaaggacauaaaaugaaaacucaaaaucucugguguguaguaggugcuucauaaauguuguuuccuuaucgucaauauuuucauaguaguuuaaaagaacuuuaauuugagacuauuaaagugauguucccaacauuauuccuggagcuauuuagcuuugcuuuugaaaucuaaaguuuccacauuuucaucaauaucuuuguuauuaggaauauuaaaucuuuaauaaaauauauugguucuuuauaguuaacacugaggaauuaaaaacuuuugucuauauugugaauacuuuuuaaauauuuucauuauccuauuuauuuuucuuuauucaaggcauuuagaaaagcacauuuuucuuuuugcaauuaaaauaaccuaaauucaguuuuggggagaaaauuugauccuuuugcuauuggauuauuaaggacuuuaucagaguuaagcaaauauuugguaaacagcuacauuuagcacugugaaaucauguaguuuauuuuaaucauuuuuuggagauauuuaagggauacaaauuauaaguguacauccuaguguaauuauuugcauuaauaauuacuuagugcauuuuauuuuauuuuauuuuauuuuguuuguuuuugagacagaauuucgcucuuguugcccaggcuggagugcaguggcacaaucucagcucacugcaaccuccgcgucccggguucaagcgauucuccugccucagccuccagaguagcucagauuacaggcaugcaccaccaugcccagcuaauuuuguauuuuuaguagagauaggguuucuccauguuggccaggcuggucuugaacuccugaccugagguacuccuccugccucggccucccaaagugcuggaauuacaggcaugagccaccgugcccagccagcacguuuuauuuuuaacuuaaauuuuuaacucugcaauauauaguauccucugaagcugucuuaauuuauauuguuugcuuuuaugacaauuuuucuaaaguugauauucuuuuaauacauguggcuacaauggaaccugugaaaaaauuaaagaacguguuaauauauuucguaacauuagugcauauuuaauuaaagcacaguaacgaugcucauagcuuauuuaacuguuugaaaaaaguugaagauaguuguuuaguccaaauuuuuuaaaaauuuaaaaguuuuaacaucugaagagucagaagucuguguacaaugggauauacuuuucaucuuaaauucugguucccacuuguuuucaagaucauuuuaaggaauuccaacuauaguccaucucaaauacuucucaauuuagugaaugucucuucacuaacggauuuccugagcauaucugauuacacuuucuugugcuaguguuacagagcugaagcucaucgcuauuagcgguaauccacugcuucuaugaaaggagccuugcuacauucuucaguuaugaagcacuguuagaaggaaaaacauugaacucuguagugacaaaaccaaacuaaaaauucuggaucuucacaaaagaaaguaaaguaugaugcagugagcauuucauuuucugaagaaaaugcuucuuuuaaaauuauaauuggaauagacaauucaagcaauuagaaacuuauuuuuuauuuaaaaauauucauuacagaaguauaaaaaauguaugcuauagcugggcaugguaguucacaccuguaaucccagcacuuugagaggacaaggcuugaggccaggaguuggagaccagccugggcaacagagcaagaugucaucucuacaaaaaauuaaaaaauuagcugagcaugguagcacauacuuguaguucuagcuacucaggaggcuggagugggauaacugcuugagcccaggaguuugaaguuacagugagcuaucaucccaccacugcacuccagccugggugacaaagcaagauccuauuuuuuuuuuaaguguccuguguauauuaaauacauaucauuuugaacacuuuuaacaucuucguauucauccuucugucaugggauucuuggggugucacuuuuuuagccagaaacuucugucuggcggcaccuuugcccaaguuuugcuugggcccacugggcuuguucagcccacucggccuggcaggcugugcuuggcucacgcugcuggucuggaucccaugcuugccaacggcgagccaggcacagaguagugaggggugugugaaugagugaguguggagucuggccacagcgcacagucaggcacgccagcuguggcaggacgggcagcuccaggcaucagcucccuacaaggcugcugcuggaccaggcauacugcaagcagcuuccauugguggcaccagggaaugugguggugccuggaagcuuggagacgccagggacugcagagccccaaagagugagccauagcccuggcucagggagcuccuaggucugggcuccuugaagggccacagcucuucucuccuucucuuuccucucuuucccucucguugcccuccauggggcaaacaagggguguguuucagcccuguuuguguuacagcccuuucagcuccgccauuuagcggguccugaguuuuugucccacauccaggaagaaugagguaugcggacaaguggagggugagcaaggugaaggagugcuuuauugagugacaaaacagcucagaggagacucauauuggguagcuccuuuccgcagguaggccauccugaugagcauccagcucucagcagagagcccacagaggguaguuccucuccacaggcagggcauccugaugaguguuuagcccucaggagagaggagacacacaguggguagcuccucuccauaagcagggcauccugaugagugucagcucucagcagaaaggagauccacaguggguagcuccauucugcagacagguaauccuggcaucugccuaauucuggcugaguccuggguuuuuaugggguucagaggggaggaaguuugugcugauugguccaugggugguuaugggcaaucccggaaaaagcaucauaaguucccacuccaguccguggaacuggcagcccagcccccaggcgucaggcccucccuggcuugaaggugggguuucaccggggaccgcccauuuccgcccaggagccugucugccuccugccacuguuuauggugcccagaugcccaggcuguucgugcuaagggccuccugcaggccagugccaagcugcccucagccagcacuuauccucccuucugugcucauuggugcccaaagucuggagggggcugaggcagcagggugcuggcaugucagcacugcccugagcaugcgcacacccggcuggguugcaacagcacgcaggcucggccucaacuuuucuccaagauuggagcaggcacuggaauggggagaagccaggcgguggaagcagacacuuccgagccugcaggggcugggggcuucccaggcccccaagaguguagagaugccugggucugcagccacagcuggguggcugcagcuguguccaggaggguaggauuccugcgugcuuccggcccccaagagcacagggaugccuggauccagagccacagcugggcugccacagcugcacucaggaaugcguggcuuuugcucugccaacuaggaaggggguggggcuuccaccuguuuccagcucccguuggcuccaugcagugcacagcccuggucaugccacccccacugcagccaaugucuuugcagcagccacuccagaugggcugcuggugccaucacuucuagaacuguuucuaggcaugcaauaagcacaugaauguaucuaguuuuuaauauaaaaaagaggaccauauguguuucaucugcucuuuaaauuaugucaucaauauauuaacauguaaaugaacagguuugcaccauuguuuuuaaagaguuauauaauucuuuuauugagaaugcaugguuuauuuaacucccucuuaaugaacauuuaaauuauucuugauuucagaauuacagaaaauaaaggaaaaauauucuuuuuaaaauuucuuugguauauacaucuuuaaucauuuucuuuggguaagcuccuuuaguugauuuguuggaucaagaaguuuauacauuuuagacuuuggauccuuacagccaaauugcccuauaaaaauuuuguaccaauugacauucucacuaacaccaugagaaucuuuguaauuuacuggacgucuuauuuauguuuuuguauuuuguuaauugcuagugaauguaaacuuuuaagggguccucauuggcaauuuuuauuuuguauuuuguguauugcuuauugauguucucugcucauuuccuucaauaauaaauagacuguuguuauuuaucgguccaaaauucauucuaaaaauauuuuggauuuuuaccuaaccacuucugauucagaucucaggaacuauuuuuagagugauccuacuuccccaguauacuuacuuucucauuuguaugaugagucacacaucucuuuccuucucuuaaguucagucauuguuucuacugcuucaucccaauuugaccuggucauaauuaauauuuaauucuuuucacuguuuucuacuaagugggauugaagguggggauaaagggagaauaauuuuuuucuuagaauucuaagugucuagagcagugccugacaugaauaauaugcuucauaaagguuaugauuauugcuuaguuuuugaguccguuaguucugugccauauggauaacccuaaauuugguuuaaauaaauguguuauucuguuguucuuaagauaauaaauaaaccacuuuaaaucaagagauguacaaucuuagaaugguuuuucccucuuuuaagguuauauacaaauuuaacuuuagucuaaaaauuacuaaaagauacuagaauucuuaaaagcaucacaauuuauuacuuaacccaauacuuuaaaaguagguuuuacauaaauauauauaaaugucuguacauagacacacauucacuaacagaugucuagaauuuacaucguguauuguauuaaacaggugguucauauaaaaaugguaacaccuagagguauaauagaaaaaagcugucaaggaccucguaugucaacaggcccugauauccaucacuucaucaugggaucugaagguaaauauaacuguaaauuuauuaagaaaaaauacagguuagucaugcaguuuugugaaaaucuuuauauugugacaucagaucuuugaaagacauguuuuauauguuuaaggaauuuuuuaaauuuuuaucauuuuaagacuauaaaguuuuauuaugagaacaucugauuaaacuuccucuuacauuuugcuuuuuuauguuucuagagacagcuugaucuuuuaauuuuuauuuuagaauuuuuaaugaauuucaggaaaaguggucauuaggauuuaaaaugguuuauuuugacauuuuguauuauaguauucuuaaaucuugucagaauuaucggaggaaaggauugauaaagcauuaucuuauugucuugucuuucuguaauuauguauuuuauaaaauuaauuacuauuagaaguggaauuuaaaauucugguucacauauauuuuaaacuuuuguuggucuuuuaauuuuucacuacacaaauaguaucauuuucuugguuacuuaaugcuggguggauuugaauguaguucaucucgucuaaaacauuuaaguccugugcagaucuggaaagaaguaaccuuaaaauaauuauuauguaggcauggugaauuguauggauaaaguaaacaugggcuuauuuuucaauuuuuaggaugggagagggacauuccuuaaauucagagaaauaaauuaaaauaaacaaguguuucuacauuaacagaggagcucauuauucacuucagaaggugguccaagcugcagaagauauauuuugguaacauuuagcuauauucaugaauaaaagagcagguacaauaaacuaagauguuaggcauaaauucuauucuuugacaguaacaucaaagagggaaaguauaauaaacuauguuucuuagugaugugguagagaucaguuguuuggcugaugaccaguaguauugcuuagauguuuuucaugguaaccaaugacagaccuuugucaagauaucucaccaguuuacucaguuuauuccuuuucugaucagcauacucuucuaugaaaaaacaaaacuauauuuguaauaagaaaaauaaucuuaaauucauuuaaaauaauaugguuacuuaauauuauucugggacuucuuauacuaaugcaucaucuacaaauuagaggaauguaacuuuuugccaucagaagucaaguugaauaacgaaaauagcuauuaaaacucauaauuuuucauuacauuauugauauuuacauaauuggagucaacucuauaaauauaaauaauuuuuuuuucaaauagccacauuauacuuuuuuuucucccaucaguuagccuuuuaaaaauucuaguugcuagauauuaugcugggacauuugagacagauaauaacagacaauuauacaacagcgugacaaauuacaugaucaaguaaaaugcagaagaaauaugaacaagaugaaguugauaggugcuuacaaaggcuuccccagggaggccauaccuaaaguggucuuugagguugauaagaagaaaauaauuccaggucaaguugagggaagacagaagaggggaguugcccugcagagugaccaucauguuggugggcuuagaaaugagaaagggccaugucugccucauuaugaggcugcugguuuuucaguaugacuggaauguaagguuuaauuguggaguagaacaggcagcaggucuaggagcagaaugguaagggcuacaggguaguucgagagauaauuuggucuuuucaugccuuuuaaaaugauuugaacuuuuaucuaaaagacugggcuaccuccguagguagucacuaacuguaugaauuuaaggaagggacaaaguuauuauaguaaaguaagcaaagaacuauaagagauugggcugggcgugguggcucacaccuguaaucccagcacuuugcaaggcugaggcggguggaucacuugaggucaggcauucaagaccagccugaccaacauguugaaaccccaucucuacuaaaaauacaaaaauuagucgggugugguggugcaugccuguaaucccagcuacuugagaggcugaagcacaagaaucgcuugaacccgggaggcagagauuacagacugcagugagccuagauuaugccacuacacuccagccugggugauggagugagacuuugucucaaaaaaaaaaaaaaagaaaaaaaaaagaaauauuuaaaauuuaugagucuaaauuaccauaguuaaaugagauuuuauuacaaaguacaugcaacauagcauacugauaaaagagcaugaaccaugaagucuuuaucagaucuggauuuccauccugauucuacuacuuauauuuccaugacuuuguauaaguuagauaauuuucagugcccgguguccucagccauaaaaugggaauaauaaaauuauucaucuucguaaguguguuauaaggauuaagugagauuaugcugaacaauuuaguguaguaaauacuguuguagcugcuuauuauuuugauaucagugaucuuuacaauuuauggucccuaauccccauuucaguuugugaauauagaguuauuuuaauauaggccaggagacagcaugauugaaauaguaaauuuauaugaaaucauauucuuacguaaaauguauuuuaucugcuacuuugaccuaccuguguaauaacuuccugccuuaaaugugaaucauaaacuuuucuugagcuuuaaaaaaauuucuuucaguuaaaucauuugaugacaaccuugaaaguauuacuauccaaaaaccuauuuucuccauccgacuaagcucuauacgugauuaaccauauuaaguuuaauguguuugucuuguuuuguguuaugaauuuuucaugauuuuuuucaacaaguagcuuucuccuauuuuagaugcuauaacaugaucaguauaaugaaaaauguaauaaauauucaagcauuugaaaugcuuuccauucuguuucuauauaugguauuuacuauauauggauuugcucuuuuauuugaaaaacaaaguacauuuuuguuuuuuaacccaugacucacccuucuuuuagucuuugucuacaauuaaagagauggaauacucaaugucaguucuuuuguaaaguuucacuaguuauucuuugcuuaaaugaagaucauccuuugguaguuuccucaggaaaggcacauuuauauauccccagaguucuggaauguuccaaacugguuuucuguggcugugauacuugaaggacagcuugagugaauauaccuuuuggucauuaauuucuuuaaguuucuuuaaaaugcuauuuccacuguuacuuuguuuuauauauuauuuuaaagaaauaugauaccuguuuaauuuucuuaguaggcuaauuuucucuuuuugccuggaggccuugaggauuuuuuuucuuuauugcuaaagucuaauacuuuugcaacuuagaguugauaguccuggguuauuuugcuucagcacccaguggacccuuucuauuuguagauucaggucuccuuuuauuucugugaaguuuuuuuuuggauaguaguguuaaauauuaggguuuuuuuuuucauuguuucaguuuucauccucagggacauugauuauacguauguuugacuuucuuugcuaguuuuccauuucagucacuuuuucucugacccuuuuucucugacuucuuaauuuucauucucuugauuauuuuucugguuuuuuuuuucaaugcccuguauuaaguuuuaauuugaaucuauuuuguauucuccuuuggguaguuuauaacauagccuuuacuuuuuacgugccuuuuuuugguucuguuucuuuccucagguuagucagcucuuguuucauuucuuguuguugguuuuuguuuguuuguauuucugauucaagguauuuuuucauaucccuguugcuugauugaugauauuuaauucauguuguguuacagcuuucuucaggaucguggcugguuuuaggguggagacuuuucaccaauaguaauguuuuuauuggcguuuucugacuuuuguaguuguuuuguuuacagaucugauaugccuuuuucuaguccuauuuguuacuuggaaagggcuccuauuuugagaguguucuuuccugacacuucuacccucugcuaugcuauuuguuuauaaauggugguguuuuuagugaaggaagaauuggcaugucuuguuucucuuucauuucuauagggucuuuaauuucucuuuauuauuuuauucuuucucuuuacuggcuugucugcaaggaguccacauacuuuuacguguguacacguguacacaucuugcuucuccaaggcagccauuucugguuccuuccauuuucaaacuucuucccauagccagggcuauggacuaccaaguccuguauaauauuuuggcauuauuauugcacuuuuguuuucugggaguaauuuuggcuguacuuccucuaguuccucuguuacucucuacuuuuuguguguagucuuuuaauaagacuccuuuuauuuacuuuucauacuuauaagcuuauagcagcuggaaggcuacaggaaaucuguuggaauuuuuucuuuuuaucucuacuuagagguaauuugaaaguugcaguguuuuuuguuuccuuguaugcugaagaucuagguccuguguggcuuuguuuuccuuguugauuauauuuuggggaguugaagaaaauagagggagagaaaagauucauaaucaaaugccugcugugcuuaauccuuaaguccugagaauauauuuucaaauuaugagagucacuucaagcaaauacuugcauuuuauaucaaacagcauuugaagccuucaguuuucuuugagaacaaacauauuugaaaauuaugaaacagaaaauucugaaguuuauugacacuauuuuuuuuuaagcagaauggaaagugaaugacauacaagccucucugaugucacauugccauggaguuauuuggaaacaauuauacaaagugaauauaaaguacuggcauaacauacauauaauuaaguaauaaauaauuuaaguaguuuuauaucacucuguugacauaauauucccagaaaaaaagaaucaauaaauacauuaaaacucuacauaaaugggccuuuugaugcagugaauuuggaauauccauuugugauuagcugaguuugaacuuaagucagaauggaagcugccccugucaaacugcauuugggaccuggauggauuuuuaucuuacacugggaccaugcagaauuccuagcuggcuuguugcacagacucaccuuggucauuucauuaaccuugcaguaaugcaaugccucguuuuauacuacuaauuuuuaaaagucucauuuauaaauuuauggugaguuucacuacuuuagauugccugcaguauauauaugaagcaauauacagaaauuuaagucaugaugccuucuuacuaguaccuuagaauuuugauguagaaugagaauuuuaaagaaaguuuguuaauguaacaguauauacauuuaagaauaaacuuuuugaauaaguaauaacuuguacauuuauaaaauuuggauauguagaaacaugggaaauucaaaaguuacucaagaauguuauagggaaaaauuugccuccuaucccugucuuacaggcaucuucccuguccaaaggcaacacuauugcuacauauaacugaugcaggauuuuuguuccuuagcucagcuaaaaucuuguuguaugacuaggaaaaaauuagccaugcagacacguugaaaggugaggagggcggaaguuauuaaaagaaagcucucagcaaaaaaagggguucugccaacaggcucccaccucacagauugaauaccaggccaccacaugcacaagcugaagagcccaggcuucuucccccugcacaagacacacauuccuggugacuguaccccacucuuccagugcacaggcgggcccccagucugcugugggcaugcccagacaaggccuugguuagguucccucaucugcacaaaagcaucugauguaaacacuuguggagcggguuagagauucucugggacccucccuuaucugccuccuguaucuaccauaaccaucuauguauauauuuuuuaaaaaacaaaugggagcuuacuauucuuugcucaucacauuuagagccaguucauucuuucugacagcugcaugauauuccauucauugaauauacccugauguauuuaaccaaaccccuguugguuggcauuuaagugguguccaauuuugucuuuggcuuauauuuagauuacaaugcugugauucaaauaaauauucucaaaugucuucauuucuuagaacuuaggaaauauuucaccaaaagcuuagaacuuggaguuugguucugaauagaaauguuuuccugguuaaagucaggguuuauacucaccuucuuuaaugaauuucaaucuugugaguuuugaguuugaucaagugguuauuaaaguuuuccauagucuauggacagauaagagcaaauagaagagaugauucaugccuuaggaauuucugccugacaaauuuccaauuuauuuguaacaacaacuaacugugaacaugagauguuaauuccaagauaccaggaauuucuaaaaguguugaaaagaguggaaagaaugacagauaaucuuagugauauugucaguauaguggaaggaaauucgcaaauuaaagugauacuacuugucuuggugagaaagaguaggugugguagauaauucuguguuaggggguaagacagcauaguacuaauagguaaccugucaacccuuugccucuucugacaaaguuuuggaaauucaccucagaaagaaacuguaucuuuuagcuaucaccauuccuccuuccagcuccccagcaauccugccccaagcccuaagcaacuacugaucuucuuuugaucucuauagauuugccuguucuggaaauuacacagacuuggaauuauauaauauguaaucuuaugacuggcuucuuucacuuaccacauuuuaaagauucaacaguuguguguaucaguaccucauuccuuuuuuuauaacugaauaauauuccaccgcaugcauauucuacauuuuguuacuccauucauuacugagauuguuuccacauuuuggcuguuaugaauugugcugcauuaaacauuuauguacaaacuuuugugugacauauuuuuauuuuuggggguuuauagccuaggaguggaguugcuggccauauaagucauaacccuauguuucaccauuugaagaauagccagacuguuuucuagcauggcugcaccauuuuacauucccacaagcaguaaaugacggucccauuuucucuaaguuauguaauuuauugcuauacaguuguucauaguguuccuuuauaauccuuuuuauuuuuguaagauuacuaguaauauccccuauuuuauuuccaguucuagugauuuguguccugucucuuuuuuucucggucacuuuagcuaaagauuuguuaauuuuauugaucuuuuuggagaacuaccuuuugguuucauugauuauuuuuuauugguuuucuauccuugaucucaucaauuucaccucuaaucucuaauaauuccuucugucugcuuguauuagauguaguuugcucuucuuuuucuaguagcuuaagguagaagguuaggcuauuugagauuuaaaaaaauauguacagauauuuaccaucacaauuucucucuagguauugcuuuacuuuaucugauaaguuuugguauauugugucuuccuuuccauucuucucaaacuguuuuccaauuucccuguugauuucuucuuugacucgauuauuuaguaguguauuguuuaauuuucacauauuaguuagcuuuccaauuucuuucuuaucaguuucuuauuucauuccauuguggcuugagaacauacuuuguauuauuucagucuuugaaaauuuguucaaguuuauuuuaugaccucgcuagcauguagucuguccuggagaauguucugugagcacuugaaauaaauguacauucuucuguuguuggguggaguguucuauucuguuaggucuaauugguuuauaguguacaaguccuauugccuucuuggucuugugccuaguuguuguguccauuauagaaaguaaggcauugaagucuccaacuguuauuguugaauuaucuauuucucccuucauuucugucaguuuuugcuucauauauuuuugugccuuguuauuaggugcauucuguuuauauuuguuguuuugucuuccugauggcuuaucauuauaaaauguucuucuuuauagcuaguaauauuuuguuucagucuguuucguaugauauuaguauguagucacucuagcuuucuuguguuugcuguuugcauuauauauauuuuuucuuucgaucuagucguaucucugaauuuaaaguguagauucuguagauggcaaauaguuggaucuuuuuaaaaaaaucgucucacuaucuuugucuuuucuuuugguuguuuaguccauucacauuuaauguuauuauugguauggucggauuuaugucugccuuauuuucccccccucugugggucucaugucuuuuuguuucuguaguuugugauuauugcuuucuuuugccuuaagugaguauuuucuaauguagcauuuuaauugccuuagugauuuuuuucaguauacuuuuuugaguuaccuccuuaguaaccucuauaaauguuacaaaccaacaauacauugcuaacauuaccacuauauauaauuggcuuucaaagaaacugaaagaagaaaggagagcaaguacagguugagcauccaaacaugaagauccaaaauccaaaaugcuccaaaauuugagacuucuugaucacugacuugacacucaaaggaaaugcucaguggagcauuuuggaguuuggauuuuuggauuugggaugcucaacugguaaguauaaugcauauauuccaagauuuaaaaaaaucccaaauugaaaacacaucugguccuaagcauuucagauaagggauauucaacauuucuagacauagaacuuuuuuuauauuacccauuuuguuuaucuuuucugcuucucuucauuuguuccuguggguuuacauuaccaucuguaaucguauccuuagcccaauagagcuuuacuuucacucacuucuuuugugcuaguauuggcacauauaucacauuuguauauguuauagauccaaaaauacaucauauauguauuguuuuauaccaaugcuuuuuaaaucagaugugagaagaaaggagaagaaauaugcauuaauacuaucuuugguauuacauaaaauagaagaagacucaaaagugcucuuuuuuguauauauuaauuugaauuacuguuuggggucaccuuugguauuuauuuuaagccugguuuuccagcagugaaguccucucagcuuuuaucugggaaugucuuuauuuuguuuucauuuucgaaagauaacugcuggauguaggauugcugguugacacauuuuucccccuuucagcauuuugaauauguuaucucaccacugucugacuuucauuguuucugcugauaagucagcuguuaacuuuaugaguuuucucuugugauugaugagucauuuuucucuugcuguuuucaagauuuuucucuugccuuugacuuuuagcauuccuacuacgaugugucuguuuguggauaucuuuguguugcuccuguuugaaauuuguugagcucccuugauguauagguuauugguuuuuaauaaauuuaggaaguuuucagccauucuuucuuugaauaauuuuuucugcuccuuucucuguuuuucuuccaguacucccauuacacguaaauuggugugcuuaaugguuuccugcauuucucugaggcaccauccauuguuuucucuguucuucauguugcauaaucucuauacaucuaucuucaaguuucauauucauucuuuugccagagaccaucuguuguuaagcccuuguagugaauuguucauuucaauuauuuugcuuuucaacuccagaauuucuauuugauucuucuuaauaguuuaucuucauuuauaaucuuuaaugaugugacauugucaucagaauaauccagaauaauccaaucaaauucagacacuuuagaagggauaguucuggagauuaguguuugggauuuuuagggggagcgcaagagggguccuccccauugucucccaggcaaacuagauggccuacauuuuaggcuauaucucuagugaaucuaccugugucuucccaauuaccuuuuuaccacaucauucacuguuuuugagaauguccuuggacuuggacuucaccaugcucuguugcaaauaaagucauuuccauuggaaagagauuaggagcuaucugucuuauggccuguuucucuccccagagagaaucucugaaccacggcucaggaguuagggguggggacaauggcauguuucuaucuaaguaacaccucugcuuuaggagcugaaugcugggagaagguggggaaggaaauuagguuaucuagguuugcuucuccuggcaagaaaccagcccuuuaugagccaggacaaggggauugaaaccccaguuuuagugugcuacacucaagguagagcuuuugucccacaguuggggcccggagcuacaggggagcacuaccucccagcugcacucaccuggaacuuagccuugggaaaagguagcugggaucaggauauuauauggaauaggaucaaaauuuuuucugaaauuaagaaagucuuuagauauauauucaagagaaaggaaaacauguguccagaaaaaaauuguacauguauguuaauugcagcauuauuaauaguagccaaaaaguagaaucccauauguucaucaacugaugagcagauaaacgaagugaguuauacuauacaauggaauaauauuugggaauuaaaaaguaaugaaauauuaauacaugcuauagcauggaugaaccuugaaaacauuuugguaagugaaauaagccagucagaaggccagauauuaugagauuccuuuuacaugaaauguccagaauaggcaagucuguauagacagaaaauagauuugugguugccuauggcuagggugugggaguagaaauggagaggguuuguuuaguggauaugguuucuuuuuugggaugaugaaaauguucuaaacuuagauuguaaugacaguugcacaugucugugaauauaacgcaaaacauuguauuuuggggccgggugcaguggcucaugccuauaaucccagcacuuugggaggccaaggcggguagaucaccugaggucgggaguucgagaccagccugaccaacauggagaaaccccgucucuacuaaaaauacaaaauuagccaggcaugguggcgcaugucuguaauccagcuacucaggaggcugaggcaggagaauuuacuugaacccaggaggcacagguuguggugagccgagaucaugucauugcacuccagccugggcaacaagagcgaaacuccaucucaaaaauuuuaaaaaaauaccauuugacccagcaaucccauuacuggguauauacccaaaggauuauaaaucgugcugcuauaaagacacaugcacacguauguuuagugcagcacuauucacaauagcaaagacuuggaaccaacccaaauguccaucaaugauagacuggauuaagaaaauguggcacauauacaccauggaauacuaugcagccauaaaaaaugaugaguucauguccuuuguagggacauggaugaagcuagaaaccaucauucucagcaaacuauggcaaggacaaaaaagccaaacaccacauguucucacucauaggugggaguugaacaaugagaacacuuggacacaggaaggggaacaucauacacuggggccuguuguggcggggggaaguggggagggauagcauuaggagauauaccuaauguaaaugaugaguuaaugggugcagcacaccaacauggcacacguauacauauauaacaaaccugcacguugugcacauguacccuagaacuuaaaguauaauaaaaguauauauauauaaauuuaaaaauuuaaaaauaaauaaaaaauaaauuguauuuuacacuuuaaaugggugaauuuuguagucuaaauuaugucucaguaaagaugcuaaaacaaaagagaacguuuagucacuuuuguuaucuuuuaaauuuuguaagacauaucuauuuuguauuaaaauauuuaucaagccaaacuugcagagcuuuuaugaucauacaagucauaaguuauuuuauaaccucaguaggaaaucauguguauauguggugaauauauugugaucuaauguaauuugcuuuucauagacuugucauaguuuuuaauccuguguuauauauugacaaguuguuuuaauuauauuguaaacuuacuggaagcuuugguuuuugcgaaacuuuuaaauuucuugcguuaugaagaugugcaguuucaaggauuucuccccgucuuuacucuuuuuuaaaaaugaugcucagaaaauuuacuaauaaaguuauuaauuucuaauauuuguacaucagaaaccauucauuugaaaagcuuggcuuugugaauauaauaguuuaacuuauuuuuuccucucuaauuagucccucuuauaauaaagaaaagagcauuucuuuuuuuaaucuuuuuuuacuuuuuguuuuguuuuguuuuuuuguuuuuuaauuuguguguguguuuuuauuuuuucuuuuuaaagagcauuucuuuuauugguggucaucuuauguuagauauuuauaaugacuacuuugucuccaucugguauuuuuuguuucuuaaaagggcaucucaguaaugccuuuaucuuuucucucuauuaauucuuaggaaaaaaagcaagauaauauuuccucagauuucuucuaucaucuuagauucucauugaagguuaggguuuuuuugcccaauaaauuguuuuuaagacuaaaaauaagcacaaauaucaaaauacgcuuuugucugaauacauaugagacauaagaauccauuguuuuucaauuuuuuuauuuuaauaaguuguaauacuuuaaaagccauuuaaaaguaaccuucuuggagaaaguuuacuuuaaaauguugaaaaauauuuguacaugacuaauuaaagcguauuccuaaagcuuuuuugagaaauuguaaaauuugcuuaauuuuauaauuuuuucuagaaugacuugaguagccauuauuccccagguagacuugauaaauuuaaaugugcauaauaaauugaauuaauagauuaaauagauuuaaauaugauuuagaaaauugucaugugauguacuggauuauucccccuucuuuuuuucaggaacucuugguguaauaacagaagcuacaauaaaaaucagaccagucccugaauaccaaaaguauggcucaguagcuuucccuaauuuugaacaaggaguagccuguuuaagagaaauugcaaaacagguaaaagaaaaaauauauauauauacauacauacauauauguuuauguauuuauauuuuucaaauucuacuacauaguugauugugauauguuacaacuaaucuucauuuuuaguuguauuauauuugugguuuuuacccaguucuauaugaaaagguaguguuguacagucauccuuuaagugcaguuacuauuucuuugaguaaguauauugcuaucaaaccuauuucuuggucuagauggcuauaugauuguaagccaagguaagauaguacuuugauugguagcuucagaugacuuugccuuuuauugacuguuaugugucuuaaguuauuuuuggguaagauauuuuaugauuaauugaagugauauuuaauuuaaauugagacauuuauugaaauuaaaaguaauggcuaaauaucaaagaccccaaaauuuaaauauagguaauucaacuucaucaauucauagaaugugcugcuacuaggcuauacuuuguuucauaauauuaucuaagcuauagcuuaaauuaaggaauauacuauguguaauaagcuaaaaagaauuuuuauuuucuccccuccuuaaaaaauauauuauuaagauuuuuuuuaagacaagauaaugcuaaguaauuuuauuuauguauuuaguucugucaguauggaaauuucuacgucucucucggcauuugguuuauuguuuaaacuacaacugucuaugaauaauucuuaauucaacuuuucccagcagggaggaagucaagggaauguacucuagccucucuuuuuuuuucuuucuucaaacuccugaaauuuuaauacuucuauuagcuauacccaaguagaaucuugaggacaagggaguuuuugaugugacccauauaggucagcuuccugauauccagagcaguguggaggaagaaucuguugaggcaaaggaaucauaucgagcaaguagucuauguuuaucuuggaauuuguaagguacagaaauguaaaaugaugaagagucucucauuuucccaucaucucaagacaaccacuauuaaugcuuuaaagaacuuuaaaaugagaaaaaauauauacauuauuuacucacauauauauaucauucccagugcuguuuauuccauacacucauaaaguuuuacuuucuaagacacucuuucugucuggcagcuucccacuuucaugaaguacagcuauaugaccaccuaauucaccagcugaugugguaauuuuuguaauuuucaaguagcugcacuuacuugucaguuagauugcuagacuuaguauagguccuuugaucuugauugcuagacuacuccuggguagggagaggauucaaaaggaaguaggguccuggaauaagcauucuuggacuuguggcaaguuacuuugguagugguaaggcagaagugauuaguaacaguugaaauccuuacauuagaggcccuaauucacuagaacuuugggaauacgauauuaugguuagggagcuagaguauauaguauuaacaccauguuagcuaaaaugacgagguggcaauaauauuuaaaacauuaaaggauuauuaaguagaggaggauuggagauaaguuuuuggaguaaauaguauuuguuauacuaaaguaacaucugagcacugaguggugacauuccaguguguucugguacuuguuucuaaaauauuccaucauucaaaggcagaggaaaggaguuucaaauuaagauaccccagauauuaagaaguaaaagaacuugcagagccuuaugguuuugccuaugaauuaauacauaaaagaacaggaagcuaggguguuuuuuuuuuuuuuuaaaugaccagaaguucacuaauugaaaaauaaaacacagauguuuccauauauauuuucauuaauuucagacuguucuuaaugaggagcuuuugaaauuucaaguguuuucauuuuguauuaugauuuauccuuguguaaugauuuuggauuacagucauugggugaacauccuaagaauuuuuuaaaaugaauaaaaggacaaguuuuacugauuuguguaaggaugaaggaaaauuccauccccugcuugucuuaaauaguuuuauuuucccucugucuuugaugagcuucacuauuccccccacaaaaagugugguuuuuuguuuguuuuuuuaagauggaauccuacucugucucccaggcuggagugcaauggcgcgaucucgaugcgcugcaaccucugacucccggauucaagcaauucucuugccucagccucccgaguagcugggauuauaggcgaccaccaccaagcccagcagauuuuuuuguauuuuuagugaagaugggauuuugccguguuggccaggcucgucucgaacuccugaccucaggugauccgcccgccccggccucccaaauugcugggauuacagucgugagccaccaugcccagccacaaaaaguguuauuaaagaauuguaguucaugucauuucuuguucaagucuugaaugacauaauucuaauucaccauuauugccucuaauuuuaugaaaaaaaauaugaaugccaaauuagauuuuuccuuucugagacagggucucacuuucucauccaggcuggagugcaguggcacaaucacagcucaacgcagccucucaaucuccuggaugcaggugauccuaccaccucagcuuccugaauagcugggaccauaggcacacaccacuauaccuggcuaauuuuuuuuuaaacuuuuguagagaugggaucucccuguguuccccaggcuggucuugaacuccuggacucaagcgauccuccaguuuaggccucccaaaguguagagauugcuggcaugagccaccaugcccggccccaaauuagauuuuuuaaaaaauuacagaaguuauaaaaguaguuuggauuuguauuuauuuucaacaaaagaucucagagaggucguguucagucuguauugaccaacucugccccuucaauaauaucuccccucuauagaacacagauuuaguacacucauaaagcuuuugauuagaugugugcauauuuuguuuucuugaugcuccaucuacuuuuccacacugcaaauacuuacauguaaaucuaucuuaaauuucauuaauaagaagugauguacaaauguaucaaaauacuaaguuuauaauuucauuacaauggaaauguugauuuccaacauuuccgccauaaauaguugguguaaucugauacaguuuuuauuacaauucgauaugccccugauagaaagugacacagaagaccuacuugugcuauugaaaagcaaguauggaauuuuccuucauccuugcagaaaucagugaaacuuguccuuuuacucauuuaaaaaaauucuuaggauguucacccaaugacuauaaucuaaauucacuacacaaaacuauagugagccaggugcgguggcucacaucuguaaucccagcacuuuaagaagcugaggcaggcagaucacuugagcccaggaguuugagaccagucugggcaacauggcgaaacccugucucuauaaaaaauacaaaaauuagcuggguauggaggcaugugccuguaauccuagcuacucuggaggcugaggugagaggauccauugagcccaggaggucgaggcugcugugagucgugaucgugccacuguacuucagccugggcaacagagcaagacccuaucucaaaaaacaaacaaaaaaaacuguauuagcuauauaucuuggaacaaaauaaagauaaugauugauagacagugcuaccaugugguuaaaaaagcaggucguaaagaaagguccuuucuagucuauagcuaugacaguucaguucuauguacuuaauaauugacaguuuuuagaaauacaaauauuauggacuagaaaguuugucuuacuugaaacugauuuuaaaaguccagauagauaauauucuauucucgagcauugcucuuaauaauggagcaauugcuaagaguaguuacugggauuuggauaucuaacaguuuuggaaaccuacauauuuuacuucuauuauaaugcacauguagagaggcauuaauguuuaucuuaccuggaaauggauaaaagguuuuauaaugguuuagggaaaguuguauauuaguuuguagaacauacaagucucauaugucaagagugguacaguauuugcugccuuccuuuguaauaguguuuucaggcagaaaaauugaaaaaaucagguuuuggaacuagucauuguucaauuugggauuuggaauuucaguugauagcaggggaauuaagauccauuaaaguagaugguacauggcuuaugauugugccaaauucuugauugaauaaugaauugguugcuuguaauucuucacugucauuuuauagcacuuccaucuuugcaauauuuucagauucaaguugcuuuugaaaugggaaacuguaauuuuggauaaauaucuuuugggaaagaacauacaugacuguucacaaauagcaaagugggcuauauguauauuuuuauuacuauucuuacugaaggaaauaaauuaagcaaccuuauacuagcauuagaaggauucuacuaaagucucucauccgaucuuuguccaugugagcaaguauccucuuucaauacuucacugccuugugagaagcuagaaaggaggauuuaguggaagauuaaugugauucuuucucauaaguggcaguccaguauaaucuccuccuuuauucaguagauggguaaaugauuuuuaagacguucucagaaaauacauuuccugcuguagccuaugaagaggaggaaaauaauguuuuuuaaucagcauaucaguguuagauauaacguguuauuauucucuaaaagagauaaauaaaauuguuaguuuggaaauaacgaugucuuuacaagguuaaaaggaaaaccgaguguuaaaacaagcucagaagcaguuucugaagcuuggguuuuuuuuguuuguuuucaauaaaaacuuaggaguagugcccuaugguauuuugagaggagcauuuauuccaacaagaggaaaaacuguauuugguauugauuaguacucauuccucucaaaacucuucucaguaaaaccuaguuucuucgaacuagguuuuuagaauuauagaugaaaaugcagcuuuucuucccacuaccuuuugauggaggguaauuuuuccuuccuucuaucacuuuuauuuuaaacaauuuuaaacugaugaagguuugggguuuuuuguuuguuuguuuuaaugauuuuagauuauaauuugggaagacauaaauuuuaugaauuguucuguuuuaaacuuaauuuaucuuggaggaguucaaauaaauuagaaggagucagguuuagcacuuaccuuauaaaacacuuaaaacuucuuuuuauucaacaguaauucuugggaguauuuauuacauagagaaacugaaauuauuuuaaaucauuuuuuuugugucaugcguuuuuuucucugaagcagagagaauaacccuagucaaguguuugguuaauuggaucauuuacuguuugauccagcaaaauuaagacaguuaugagacauguucucuaccagaagccacucagaacaaguuauuauaccuuuacuaaacugaaaaacuauaaaguuauaauuaggagacuggcauuaucuuuuggucuuuuccuuaauauaaguggagggcaauauucacucccuauuauguauuauuuuauucuuuaaaaccaagcaacaauugacuugucaaaauaaaaaguucuuauuguuuaucauacggacuccuagcuguaagucaguaugucaucucuaagaugaccaaccaguaauaacuguagccuuaaauagucuaucauuucaucugugauaccaacucugacuuauuaguuagaagaagaauuugucuacauuuuaaguuuuuauguccagaaauucacauuuaacagauuaucuuuuuuuacauagccuuuuuugaacuuuuuuuuuuuuuugagacggauucucucucugucacccaggcuggagugcaguggugccaucucagcucacugcaagcuccaccucccagguucaugccauucuccugccucaggcuccugaguagcugggacuacaggcgcccgccaccacgcccugcuaauuuuguuuuuguauuuuuaguagagacaggguuucaccguguuagccaggauugucucgauuuccugaccuugugauccaccugccucagccucccaaagugcugggauuugaacuuuuaaauuaaucaauuuuguugugugccuuauuugagguagugugcucuuagcuugauaaccaacauaaugcaauggauaguaugcaguuauaugugguuccucacuucuagugaggauguugcauauuaugauaauuuuuugugcccaaauuuuuguauagcacauggaguuuaguauugaagcauuugcuucugauacaacaugagauugauagucuauuuccaagguagucucuaggcucaagaauuugggcuguuccagagucuacauaggauguggauuuacccuuugaggaaacaaauguuuucaaucaaguauaauucauuccuuagccauggaccagaguuacauggcugccauucaaugcuuauacuuuuauaguuuauccuuaugacauuacguuagcagaaaccccucagacaugugaaauauauguuaauguugaauuuauuuugcugguaacuagucuuuuaagaggugccuucucaaauaugucucaucugaauugcaaguucugauuuuuucugugacaaguaagagcuaugacuuaguuuuagaaaaaccaguuuugcagaauauuuugauguuucuuuuuuuuuuuuuuugaaacggagucucgcucuauugcccaggcuggagugcaguggugcgaucucggcucacugcaagcuccgccucccggguucaugccauucuucugccucagccuccccaguagcugggacuacaggcgccugccaccacaccagacuaauuuuuuguauuuuuagucgagacaggauuucacuguguuagccaggauggucucgaucuccugaccucgugauccgccugccucggccucccaaagugcugggauuacaggcgugagccaccgcgccuggccaaggaaauauuuuuaaauaaaaugauaggauugagaaauauguugcuuuuuaaguuagugcagagaguacuaaguaaauaagacuaaucagaauaguuuuuacuauucagauuaugcaaucaaguaaauuccugguuguagcaucccuaaagggaagaaauugccagcaauuugacuaagucagucuuguauccauguugugaagucaucgugguuauuuauuucauuauuaaaguacaaaaaguauacugauauuucuguauuaguccauaucagguuucauauaguuucagacuauuaaguauaaaauauaguuagguacaaguucgaugauuugagagauucuaguaaggguacauuuaucguagcaggaaagaaaucaauuauuucauuagcucaguuuuaguaagcaauuucugucugaguauucuugaauucccugaauuuaucauuaacccaucauuaaaauuuguaaaaauauucccucucagguuaguuuugaucgcuuaccagcaggggucacuuuaacucaaggaccuuuuucccuccuuuacaaaaucuguggaauacucucagcccugcauuaguaaauaacaugggagugaauuuagagcucaaauucucagaacuugugcugucucugacuuuugaaggcaaucuuuugugguuuuuuuaaaccuaccaaauuaguuuuaaagcaguggaaacauaaccuaaucuuaacuguacauauaguaacucaaauugauguuguuuuuuaagaauaguaacauuauuuugaucucuugauuauagaaccuuccauuuaauuaacuguagugguaacuuuuaauuauuugaauuauaagaaauguuuucagcuuuauauauuuagaaugaugugcagugauuuacaaauaucaauuaccaggagaucauaaaccaaccuagaugcuauuuuugagugcuuuacuuauauaagcauuuaguuaugacaauaacugaaaaacucuacugacuuuuuaaaaaucugguacuauugaaguaugagacuuuaaaaccguugguuugaauuagauaauuucaaaaaaguccauguuaaaauaauuuaauaucuaaaauuaaaaaaauucuuuagcuuauuaguucuguuuugauaguguuugucuguuaccaucuacuauuccuccuugauacuaauaggaauacuggauagcuagcuuaugugacuugauuaucaaguuaaaaaucacacucaauauaauugaauauuaguugcuauaugauacagcaguugcccaggagcuuucuugccuuuuuuccagcuuuuuaauuugaaaauuuuaagcauacagaaaauuugaaagacugguacagugaucaccugucuauccacuucauauauucaacaauaauuaaguuuuugcucuguuuaacauguacguguauauguuuuuuggaccauuugaaauuaaguugcagacuuuuuuuuuuuuuuuuuuuuuuuuuaaagacagaguuuugcuuuuguugcccaggcuggagugcaguggugcaaucucggcucacugcaaccuccgccuccuagguucaagugauucuccugccucagccucccaaguagcugggauuacaggcaugcaccaccacggcuggguaauacuguauuuuuaguagagaugggguuucaccauguuggucaggcuggucucgaacuccugaccucuggugauccaccgccucagccucccaaaaugcugagauuauaggugugagccgccauacccagccuagguugcagacuuuacagcacuuaaccuaaauacaucagcaccgucuccuaaagacggaauaguguucuucuuuauaacuacaauaccauuuucaugucuaagaaaaucaguaggaauuuuuuuuuuuuugagacagagucucgcucugucgcccagcaggcuggagugcagugguucacugcaaccucuuccuccuggguucaagcaauuccccugucucagccuccugaguagcugggacuacaggugugugccaccaugucugacuaauuucuuuuuuuuuuuuuuuuuuuguauuuuuaguagagaugggguuucaccauguuggccaggcuggucuugaacuccugaccucgggcagucugccucccuuggcuucccaaagugcugggauuacaggugugagccacugcgccuggccaaucaacaguaauuuguuaaugccaucuaauauucauuauauaagauuauuccaguuaucuccaagauauguuuuaugaauaguguuugcaaaccaagauuuaaucaagacuugcauauuuuaauuguuuuaaagauuaaauacccauagaaauuuacuacacuaaauguaauauacuuuccuucccccccccccccuuuuuuuucauuuuguuuuguuuuguuuuugagacaaggucuugcacuguugcccaggcuggagugcaguggcacaaucuucgcucacugcaaacucugcuucccagguucaagugauucucaugccucagccucccaaguagcugggauuauagguguauaccaccacgcccaguuaauuuuuguguuuuuaguagagacaagcuuuugccauguuggucacgcuggucuugagcuccuguccuaaagugauuugcccaccucagccucacaaagugcuaggauugcaagugugagccacugcacccauccccucccauuuucugauauauguguacuuacgugaauuguuuucauuaauaauacuugccauugauaaaggugcgguagaaugugguuguuagcaggagauggaauuuacaaguugcugguaggaacuuaaaauguuuuuguuaugaaugacagaguggcuguuacugucucauauuuuacuuaugugcuuaagcuagaauauauaaauauauauguuauauguauauucuacuuaugaagaaaagaaauuuggucuaaucaggcuuuguauauuuuauuagaagucaaugugcccacuuuaugaaaaacauuucagauuuguaaacgugaagaaaacugauuuuccuuuaguauuuuuggaaacugguaacguuuuuagaaguaucaacccaacuacaaagauacucuuaugccaauauuugaaauuacucagguaguacauuucuuuaacauuuuuaaacuauuauacauuuaauaagacuacaaaauagaaaauaacauaguuuuaauguaauuuuuguuuggaauaugauaaagcugugugugcaugugucuguguuuuaagugauuuuuggaggcugugugguuugccugaaauagugcucaucuaaaagucagaaugucuucaucuucuaccuuuacuguggauaaaauacaguauaguucauaaaauggcauaauacuugaggcacuggauuuuaguuuuagaaacaucuuuguucuaaaauaauccacuuuggggucugguauuucuuuuaggauauucucauaugucuuugccagacauuaggcagcuuuuucugcugauaaauuuaaaaucuguuaacuuauguuuguauuuauuuaucuauaucuguagauuucuucucuccaaauauuuuauagaagucauugauauuugucuucauaaaaguauaugaaaaguuaacuuuuuuuccucuguaaauccuuaggaacuaagcucuugaucucuuaaauauagaaagauaauauucacauucuaccugucuagcuucuuacuguauuaaauuuguaucacuuuuuuuuuucuuuuuaaaacagagaugugcuccggcaucuauucgccucauggacaacaagcaguuucaguuugguaaguaaggagugguaauuuuaaaaugucauuuagccacagaaauuuaugaaacaucaguaggaagaguacggagugcagagguagaaagaacgucagucuugccuuucaggaagaugucagucuaaugaagauagacaauuacauaaaugagugaggguagcaguguuggagggccugugaaagaagacugcacuggauaccaugggcugcaaaugaaggaauugauucuucuugauuuugcuugaggauaaagagucagaaaaggcuuuuauaagagagaugcuugagcuaaaucuucaaaggugaauauaaguuugccuagaugucucuucuucuucucaaccagacuucuucacuuggcagcaaaaaugugaaggugugaaacucaaugauguguguuaggggacuucaaauuguucuauguggcucaaauagagggugggguuagaguuguuacaugagauaaaguugguugggugggcuagggcuuugcaggauagauuuggauuuugucuugucagcagugggauuucuuugaagaauaaaaucaaucaacuuuacaucuuagcucauucuggcagcauugugcaggauagauuagaaggguacaugcauggaggagagacacuaggagaugaaacagcucaagaagcaaaguuugagggcuuugagcauggcagcagcaauggagauagagaacggaugauagauuuucagaaaaucaguuugcuaacuggauguggaaggcuaaauaaaaggaggaguugaagacaacaccuagacugauuugauuggguagauuaaauaacauagaagaaugggugguggucuugggaaaaagauaugauaauggguuguaguuauauugugaaauuuacuuugggauuuaaguuuauagaauuuaaauacccucaaaacaauuccuaaaaucaugagagugaucguucaguaauaaauacuaaaggcaaagauaggcaggcuuuugucaugucuaaaaguaagcugagauuuuaauuuagggaagcaugguuauaguuacauagaaacuuaacuaaagucagguucguaacauauuaagaguuuuaaaauuacauucuucuaaguuagucauaauuguuuauuucuuuaaguaaauuacuuucaaaauacuauacuacugacaaaaguuuaagauaaauauguucuauaaguaaugaaauacuuaaaucaagugaaaaaccacuuguguguuuuggccugcauuuaaagaucuaggucuuaaagagagccaugcaucuaauuaauaagacuguguuauucguuuauauguuauuguuguuguaaacaauguuagaccuaggcauuuguaaaauuaguuaugauuuggccauacuuauuuauaauuggaguccauaacaauuuaaagugaagguuuaaagaaagucuuccugucaucccucuuccauguucucauuacuauaccugaaaacauacuuacuugcuccccucuagcuugcuccugucugugguauuauagguucuaccuucucuagucuuuacugugucuccccucucucugcccuuuacuuagccaccaaagugauccuuuugaaauacagaucugaucaugcuuuuuggcugucuauauaaccuuuuuuauuucucaauuuuaauugaagccuuuacauuaauauauccugccauggcuucaugaucaagcaaaagaggaaauaaugcuuagcacaacaaaaggugccccagacccugcacuaaccguauggcugauuggucgguguuuauaccacauugguuguuaacaaagcacaugccauauuauuaguuguuaauauuuuuaauauaaucucuacuucagguacaacucuuaauacauuauauugacauuaucuaauuuuaguauauugaaaugauauauaucauuguguauauugaaauaauccaaagauguccucuauaaaccaaaguuucucgaauuuaggguauguuucuuagucauuuuucuaucaccugcacuuaucacguaauaggcauuuauauguugauucaauuaaucaucaaauuggcaagggggugaacaaauccuagauggcauagugcugauuacauugucaauagcacacuuuauaaaauucuauucaugacuguucgucagagugguauccccacuuuacaaaugacucaaagacucauuauuuugacuacgguccacaaaucauacgugguagagcuagggaugaacccagauuugucugacuacaaagcccaggaguuuuugcacugucuguaaccacugcuuuaaaauauagauaauuaauaaauccuguuaaaugacacgauuaacauugaaauaacagaaaauucacugaucaaacuguccagcuaguaaauuuggaagugaguuuaauauuuuaaaaaaccacaauagcagcugggugcagugccucacgccuguaaucccagcacuuugggaggccaaggcaggcggaucaccugaagucaggaguuugagacuagccuggccaacauggugaaacccugucucuacuaaaaaaaaaaaaaaauacaaaaauuagcugggcauguuggcgagcaccuguagucccagcuacucgggaggcugaggcaggagaauugcuugaaccggggaggcagagguugcugugagccgagaucacaccacuacucuccagccugggugacacagugagacucugucucaaaaaaaaaaaaaaaaaaaaacaaacccacaauagcuagaauauauuuaaaauguaauuauauuguuaggcaacauauuuaagaaaaaguaaaagauaauauuaucuaguugauacuaaugcuugacccaccuaaaagucaguaucacuuuuacaauaauuuauucuucaaagcuaucaugucaccuuaguaucacagauguaugugaguaauucuacuagcauuaauggaaauugugcauauaaaucucgaugaguuaagugaacauuuacccuuaaggauuauuucauaucagaguaguaucauauggaguccgcaugcauuguauaaagauaagugaaucuuuuguauaaagaauagauaauuucaacuucugccaagaacacaacaugcacauucaauauauaaauguuuauauauguauuucuaauuguuguuaauauaggaugaguuccauuugggaccagaaaugaauguuuugaugauacguuauuucuaucuuuauagauauuagaaauugucucuuaaagcgcuaguuauacuaggaagcaucucugauaguuuaaaauaaaagaaaaaaauccccaagcguaucucuuacuugugauccaggagcucaaaaagauugcuagguugaucucuaucuaaccugcaguucaguuuguuucuuuguuguuguuuuuuaaugccucagguauagcauagauaucuaauucuuagccucugguuaagacuucuauuacuuggucuuuuauguaacacaguuuccuauuauaaucagcaaaaauguaguaaguaguauuacagauugagauucuuauaaaaaauggauagaaaaaaacuaccagugauaguuuuagaaacagcuaguuugcucuuugcaccuauuuuaaaagaaggaaaggaagggccuacacuuuaaaaacaaacaaaauccccaaaccuuaaaggcuuuuuuaaaaaagaaaacuuuuuauuuggagauaauuuugacuuacuuaagacugaaauucuuuauaaaaauuuuguauaaaugguaugacaccuuuuucugaauugggcugcuaacacugaggccagaugcaugacucuuaaauguagcaaucauaggaguugagucguuacuacuuucugaaaagugagaaaacaguaaaagguuuucacucaauuaagcuuaaucugcaggcaaagauguuaauuuaacagacuuugagacuccauuuauguuauuuuggcaauuuuaacucuccgggugugauuaaggaagcaauugcuaguuuuaugccaagaauucuggaugaauuaacaauuaauuaagaaacaaccuuaaacuuggcauuaacuccauauuuggauaguucugaauaguuucuauauaauuaaaaaaaaaaguaaaaccagccaccauggguguucuuaaugaaauaaaaauuaaugaaguaauuuuauuauguguaaaccauaccguugaaagaaaaccuaaacuauguguaguauuaauuacauauagugauuugacuuaaaaaaucaaauugauaauggguuuuguaaauaaaaaguuguuugugacauuugaaagaagauaaaaguagcaaauauuaauauaacuauauaucguaauauaaauauuuauguaaauaacacgggaagauuuuaaaaauuaaaguugugaaaacuuuuacuuucuuuuaggauucuaaguuggaguagcuucuugaucuucugaaaaacauagacuaaccuauuaauauaaacuuuuuucucuucuuaggucaugcucuuaaaccucagguuuccucuauuuuuacaucauuuuuggacggauuaaaaaaguuuuauauuacaaagguaagaauuuuuauaaaaugcuaaaauuguaaaugcuuaagauaucuguuuucugcuuucuucccacaugcaccuauuguaaggguguuuuuccauguugcuauguacauuucagaauuacaguuuuucauguuggaauaaauauuaaguaaaucaggcagucaauuucagaaaauuuuauuucuuuuccaguuuugaagcuucuaaaaauaacacugcauuugaacaguuuuguuuucauaacauuuucuauaguuuaaauuuuuuccuuuauggaagguauccauaaagugaaauaagaguguggauuuuuuuuaaccuuugauuguugaauuuuuuuccuagaguguuaagccaucuuauaauacaugugugccuucuuuuccuugcauccuuguuauuccaugugggauucuuuuuguuacauuuuuaauuuaccagggggaaaacaguacuuucuucuaguucauguuuuuugaagcuccaaugagacugaacguuaacauuuuuuuuauuuucuagaucuaauuuuugugugaauucguuggauaugguuauuuuugccagguggugguggggggugugcagcuucauguuuuuuucuugguacuuugauguaucuuuuuuugagauuggaauuauuagauguccuuugucauaaauguuguaaguaauuuuuuuucccagucaggcaucuccuuuuuuaauagggauuuuucuuuuuugguguaaaaguuucaaauuuuuauaucuuuuccugugauuauuuaauauagucuaagcuuagaaaagccuuccuuccuccaguaauaugaucagggccauuuucuucacucucucucucuuauacuaaaugagaauuuaaaaaaaaaaaagucuuuauuacuauuuguauuuauuucaauuuuauuaugugaaaaagaucuaaauuaaucuucaccuccugcuccuccaauuguuaaccgguuguggcagcaccauuaauuaaucugugcuucucauacauugauuugcuaugccucauaucuuauauacuuaucuaagaaauagauuccauuuuagugcaucucagucuuuuuuaaugagcuuuuuguucuugaaaaauuaaauagauuucauuguuguaggucuauuuuucccucuugcuauucagaauuuuccuuguuaucaccaucaccuauuauucuagaaaaauuuuagaaacuuuucaucauuuuaggaaguucauuguguuuuuuaauuagaauuggaauaaacuaguacauuaauuuggagaaauauugacugguuuauaauacuuaguuuaugcauuugggagcauacgucuuacucaucuuuuuuuggauguguuuuagauauguuuccuaauauauuucuuuuuaagauuguuagauacuguuuuuguuuuaugcauaagaucgccuuugaaaacuuuauuuaauaagaaguuauuguuaguauguagggauguuguugauuuuugcuucccgcccaauauauccagcuacuuuauucuaucauucugcaguuuuuuauuugauucuuuaucauaguuauuauuucaacaaguuauuuguuguauuuacauaagcaauauguuauuaugauuaacacuguggcauacuuugaaauaaaguguuuuuuucuaugcugaauagcuuugcuacguuguaaugaccuaaauagguuuauuaaacauucuuagugauugacauguaaaguuccaaagcucaauuuuuaagaaaucaguguauuugagcccagaucagaaggaaaagagcaaaauguauuuugauuuauuguuuuguaggauaagacuuaucuguaauaauaaauuuuuuuuuuuuuguaguuuaaaggauuugacccaaaucagcuaaguguagccacauuacuguuugagggggaucgugagaagguucuucaacaugaaaaacaaguguaugauauugcugcaaaauuuggguauggcuucaaguucauaaugccaagagaaagaguuaaaagcuaagauucuaauaucaccaagcaauuauuaaaguacuaggcauuaaugucuccaaacagacugcaugucucaaaguaguuauuaauuucaguuuaguguuaaauuugugguaauuuaugauaguaaacuuaaaauauuguuuugguuuacauccagaauuuuuaggaaguuagauugauauguugcucuugucuaaucauauauauauuauuauuaaacauuguauuuuuccuagauuuuuacauuaaugucaauuucaugauauuuguucuacuagaguaaaauagaaaauucauuguccucuuacucuguggugauaauaguguauguauaaagcgugcuacuaguguguuuuuaaaaggaaauuguguuuaaucgaagguauuugauaaauuaucuauacugcacccccugucacuuacuguuuugugcugguauaaagaaacagaaaacauuucacaucuauaaccaacugaauaaugguagggugguuucucucugucuucuugauggauuauaagacugauugaugagaacuauagugaaaaugccauuuaucaggacuauguuuuuuccuuuccuuuuaaaguacauaaacuaacaguuucuagacacuaaucuuuucuuuuuugauuucagggauuaaaauauaucauauacauuaugcuuaauauuaguucuuuguaaauauuuauuuucauuucuuuuucauuguuuuuuaagaaaacaaaugaacacuuaauuuggacccauguguuuuagaaugccccacuuuuauguauuuuuuuucauaucuaauauuagcccuuuauuucuaggguugucugaauuuaguguuaacgugcaguauucuuaaaggggaaaauagucuaaucuuagacuuaaauuuuaguuuucuuuugcacuauuuuuaaguauugaaaaugucucacuuuuacccuauucugaaauuggcaaauggaauuuuaauuuuuucaguaaaagagaaaguuuauucaucuuucaucuuuucucgauagcuguuuugggaauugcugauauuuuaacuaaaucacuuaaaaauaauugugcuauaaaauccauguaaugaccagauggcuugaauuucaggucaucucauuuuuguuugaauuuuugaaauguacauguuuuccuucccagaaggaauuuagcccuauguauguacccguuuuuuaguuucuaaguuauagggaguacguauguaauuugauuaaaggacuguuuucuuaaaacauaugauguuaguaaggcacaaggacauuuaaaaccuacucuagccuuaaauauuagagacugaagcuuuaaaaaauuguucauuguguauuuaaauauuuacuuggauuucauaauuucuaagaagggcuuguagggaaauggaagggugcauuuugcuuuaucauuuaaauaacuguauauagaguuaaauuugcuuaguuucaccucagucgucucucugcucacacacaccuccacaucuguacacacacccacacacagaggaauuucaguuuuuaggaucuaucuuuauaauuucaauuaaguauggcuaguaacucauuacuaguuaguaaugugucacauuuccuguuagaaugggguaggaugaugacauaaugcuuguuuguugugccucauaauuuuuauagggcaugaccuaucuuuuucuugugcaucacuguugaugucuaguucauucuagauacuugauuuaauaauuguugaaugaaugaaugaaagugaauacuauauuuuccugauaucuuuuauucuacuuuguuuaugccuaauuacugugccaccuguaaaacaguguauuuucaucuuuagguauuugucaauacauuuugucaggauuuuuuuguuuguuuguuuuuguuuuuguuuguguuuugagacggagucuugcucugucacccaggcuggagugcaguggugugaucucagcucacugcaaccucucccgcccagguucaagugauuguccugccucagccuccugaguagcugggauuacaggcucaugccaccacgccuggcuaacuuuuguauuuuuaguagagaugggguuucaccauguuggucaggcuggucucgaacuccugaccucgugguccacccgccuuggccucccaaagugcugggauuacaggcauuauuuugucaguuuuaauuugagccaccgacugacaugaaugucaguaaugccaguuuuguuuucuuauaugucacuauccauuuaccaauuaaaacuauaagugaaucuucuuuaaaauauggcauccagcugccuucagauacugacacuuaggcccaagcacuauugcuguacuucuagcaguuuugcuuacucaaacaaaacuuguaucaaauuuguccauuaaaaauagguuauaguaaaugagacucaauuuaaagcaaggguaaagaguuaaagauuggcuccguuugaggucucauuuuuuuuuuuugcuguuauuuguuccuucuuaguuauaauuaauuucuuaaugugcuuucauucuggcucccuuuuauuagauguggacaucuucuauuuuaaacaacccagauuguuauuuggcagauuacuuagauuacuuagagccauuucgauuuuuuuuuuuuuuuuuuuuuuugagacaaugucuugcucugucacucaggcuggagugcagugaccugaugaucauggcucacuguagccucagccucccugggcucaaaggauccuuccucuucagccgccugaguagcugggacuacaggugcacgucaccaugccuggcuaauuuuuguguguauguguguguguguuuuguagagaugggguuuugccauguugcccaggcuggucucagacuccuggucucaagcaguacucccaccuuggccucccaaagugcugggguuacaggcaugagccacugcgccuggccuauuuuaaguuuuuaauacuuggaaauaucuucuuuugguuuucuaccagaaguucuaguaucccaccaguuuucuguaggcacuaauuuuuuguucuaaucacugaagauucaaggauauuuuacuuagguaaaaugccacucuucccaccucaauccucaaucaucucuccugcauaacaagacaaaagaaagcaccaccaaguuucuuucugcuacaguuuucaugugcuaguuuagcucauguauuuuauuuugaauuggggcauuauucaucuaucccuuuuuuuuuauuuguuuaugaaacucucuacugccuuauuagcuuuacauugauuuuuaugaaguauucccaacaauuuagagcauuuuuauguguugucuuagccauuuuuucucuuugcuuacccuucacucacaccccaacauaguucaauaccuuugaacacauaugacccaacagaacauaguagccacauaaugaauaaucauacuuugauuguuuauccauguuugcuaguaauguauuuuaacuucuccaagagcagagcagaauaaacauuaccugucagcacucaugacagguguuuugacauuuaccauagaacuuaagguaauauguuaucauuauuuuuaaagcaugcuuaaguuguuuaauauaauucaacaugagagugauuagguucaccagauggcccuuuuauauaaaaagauugucucucauuccucuuucauuagucuuuccaguccuuccucaugagacagcuuuaaauuuguuuaaaaaccuugaauugauguuugaaauuuguggggacagcaggaaguaggggaucgauguugcuacuuuaacauaaagcaguuugaaucuacaugcagucauuuuggagugauuacaaaagucacaauuuagaagcauuugauuuuuaagcccuacuauucuuuaauauauuguauuuuaagguaauucuggcuagaauauugacaguucugaaagcuaaaaagagaaaaguuucaaaaaguucagucauaagucuaugauuuccuuguaaagcccagacugacucuacuucuuugggcuuaugaauuuagaaaggacauccaauuucuuccugcuuugaauuagaaaaugcauguuucucugugguuugucucccuggauccuaaugugaacagaucuguuuccucccuacugccagauauuagaaauauuagaagagggucuaaagaaagaugacuuaggacugaaaaguaagacuuuuugucucaucucgacauaacagaggcaagccuauuaaauguuuauaccuguuacuucucaucagauacauacuuggcauucucuuuucucaaauauucccaacacaggugccuugcaccuuuuccuacuccucacucucuuuuccuuuccuuccaccacuagguucaggauggaugaacuguuucuguuuccuagaccuguggugcuuuuucucucuuggacucagagucugacucuauuuuauaucuacuugagcuaugggcuaagcuguuuuccuuuacgcacuugccacagcaguuuucugacuuguuuuccuuuuguuuugaaacuuggaggcuuucuaccuccaaccucacauccaacucagaauuguguuuuaucucuucuucucacuuucagcugcuugaccaaaguuuuaucuucuuugcucauuaacauucuaauacaaacaguccccuucauuuuuuuuauuauaccccauucucaaguaguucuagacuagagcugcuuauaucaaaucuuugccacuucuuuuggauaacaccaucuaccuauaguggcaagucaggaaauuuugauuuagcccauuuagcuugaaauuaucuuacaguauuuguacagaacaagaguacaucuacauuguaguguuuacuuacuaccaaauucaacacaacuucagaagaagaaaauauuuaauuauaagguguuaauugaggugauaagauaaacaauuuuuccuuuaguugacuaaaguuaaaauuuuaauuucuguaugauaauggaaaaagcauaauuaaaaacuauuuacuaaagguaguggaaaaacaguauucauucauugucuuuuaaaauaagaauaacuuuuacaaacaagaguacuuggacugaauuauauauuuguaugggauuaauucuaacuagaucaucaaauacaauuucuauggaugaaauuuuccaauugaaagagauaguuuauauguucauaguaguaagaccuuaccuguguuggucuuguguuuguuuauacauugcuuuauaaaauauuucuauguaaguauguuuugucucucauuuaaaucauaaauuucauaaaauaaacaccacaucuaacauuccaaauacuauguacucaucuuguauucuggaagcuucucaguauuggggaguuccuagucgucacauuucuucaaauaugagugagacaguaauaacauaugaauauaugaguaagaauaugaugaguaaaauaagaauacuugugugaagauuauuucagcuuauuuguuucucauaguuaauucuuucugugcuuuuuugagaauauggguagaaguaguugaguuuaugagucaauuuuauuucguggauaaaaguuugaaauuaagaugaaacagaaauauuaaaaguguuuucagauuuuuguuauucaaacuuauucucuugacagcuuuuugauacauuuaugauaaaugagauuaagauaaaaaauuuauuaacaguuuguucuuuaauuacaguggguuggcagcuggagaagauaauggacagagagguuauuugcugaccuauguuauugcauacauucgaguaaguuauaucauauuucccuugccacuuaauuuauguugcaaacaauacuuuuucuuacuuuaagugaaugcaauugucuucccuauuuuuuaaaauuuuaagcuacuguaauuuagcauaucauuuuacaugaaccuuauuuuagcuacaaaucuucagaagcccauuuaaaccuucuccauaugcucuugaagaaguuaaagaugauuuaauaugucuuucugcucuuuaaaagaauggagccuuucucuguuuaaaaguugagcauaccauucauaacauuacuugguuaaaaucaagcuguuuuacuuagcaacacucuucacuuaauaaucuguuuuaaugauguguaaaucuuuaacuguguuguaaaauuuugauauuuaacuugaaguaguuauuuguucacugaugaugauuauagaauuaaagaaauaauuauguguacuugaacacucaaauguuucuaauucuagauuuucuacuuacgauauacugaaauagucuuauuaucucaagucuguuguauuuacugauaugaaauuguucuuuugaaauuuuauuuuuucaauuuaguuuuguuuuucuacuuuguaacaaauucaaauuucuuaauugcuuucugcuguugcugggguuacuuuuuuuauuuuuuauuuuuccuguuuacauaauuugaaugaucuuacucuaaaaggucauuuuuucagauauccuauugagaauuuggcuuccacaaauacucagcuuucuuguuuuaauuauaaaaauuuuuggaaauuuauacauaauaaauauacauauuuucaggguacguaugauauuuugauagcuucauauaauauguaaagaucaaaucaggauugggauauccaucaccuccaaauacuaaauuuacuaauuuuucucuuggaaauuuugaaccuuauacacaacaauuguuguaagcuuauguacaacauguuuuucucuaaaaaaggcugaauuaauauguucucauuuuagcaaaaauuuaaucccagcuaaaaucuaaauguuaaauugcagugaauuugaagcauauaguccuccucuuuuguccccugcccccacagugaugaugauaaguaaaaguauauuuauugccuguucagcauuuuagaaauuuugacuaagagauguacugaucaugaaagguaauagaugauuguagaucuuguaaauaauaucuacaauuaucaauugucaauaucauaguuucuucccauaguaagcauuuugaauauacauaaaauguuguuuguuaggcauuuucucugaggauauuggccuuuuccccauaauacugaauucagaauucuagaaaaugaaauauaacuguaacaaguacagcauagacacaauuuggaguaucuaucuuaauuuuuaagguucuaguuaauguuaaaacugagucaaaagcaaguuagggauuccgcccccccuaccccgggauuacauguuuucuguuuuuauaaguuuuacaaugguuaauaccauugucucuaaauauauuuuuacugaauaaaugagugcauuagagaaaaacacaugcuuuagaucagaucaguaauuuggggauuuuuuuguuuuuuuccccaaacacagguggguugaaaugacucauuuuacuugaagugaaaacuuaacauauguugaguuuucugccuuauaaaauuuucuuuaaaaucucuggacuucugugaagcuuucuuuccaauuuugauaacaaaacaauauugcucuggguaaagaaauuaaguauuauaaguuacuuguaauaugaguauuauauccucuauacuguaaaauauuuucguaguagaagugccuccagauguuugaucuauucugucacuucagauagcugcacuauauuacuauguuuucuaaauuuguuuuuaaagaaaaguugauuuuaagaaaaaaaucuccucauucuaaacaccuucccccugccccucacuucuugaucuuccuacuccuuugaucuugacuaauuuucgauauugguuaauuuacuauuuaugccacuaaaauucuguucugucaguauucucuacauguacacagacuguuccuggauagaaacuccauucacuaaagaaauaaauuugaguucuugcccugagucaggcacucugccuggugccaaggauacagagaauaagacagacaagguuccuuuaguuacggaggcugcaucucacuccagggacaacuuuucagugcucuuaugagguggauaguaaagaguggaugaaguuaaaugagaaacaugugauacuaacaaugaauaugaaagacuaacaguguuauugauucuucugcaucuguuguaguuucuugauuuuucuguuugugucuuaauaggacuuggcuuuggaauacuauguauuaggagaaucuuuugagacuucugcuccuugggacagguaaaauauacuaaagugccugauauuauucaaauaugcgauaugaauugcuugaaguaauguuucuuuuugugugaauauguaaguuuaaaacauuuuaugaagaaacauugagacaaggcagcuacuuuauuuaaauuaauauauucaucagaaugccguauuuucaaguguuuuauuggguggagggaguugaagaaaauuugucugugauccaaagaacgaagguauuguugaaguuuacauuuugaagaauguuauugaaugcucaguguuacuaugugguuauacuucgcuuugacuuaaauucuuaagugauuaauauugcuuaaauguucucuaaaaaguccucccaaaguauaaaaccaguuaacuguccuuuauaauauuauuuaguuuuugauauuuguauguguaaaaaugggaauuuaggugguuuauaaaggaaauuuaguuuaggaaauuauguacaauuucuguuuuuaaauuuaagcaaaauguugauacuggagcauauuuuaggaaauggcccaaauaagauagauggaaauagauuuuagaaggguuucuuuacuggaaauacauacauacaguauugguuagugacuuaauaaaaacugauuaggaaaugcgaaaugguuuauuaauagaccugugaguuguauuauaacucauccaguaauaaaaaaaauccucaaagagauugucuauacaaucccuuauucaaaaugcucaggaccagaaguguuugagauuuuagaauauuuguauuauauauuuaccaguugagcaucccaaaucuggaaauuucacuggaaaucacugcagcauuucuuuugaucaucauguugguacucaaaaacucucagauuugggggcauuucacauuuugguuuuuugcaggauauucaaccuguauauuuuuauuuguuucuaguauacugauauuuuacuuuucuuuauaaaauuuauaaaguacuuuaaaucuacaaugaaguguauaggacggaacaauucccugugaaucuacuucuuagauugcauaucuuaauauuuugguuucuuccaaucccucuuuuuucccccagaaaacuuuuuacuuuucuacaugcagucaucaucuacugaguuaguacgcugguguucguauuccaugcauuguuagcuaguaacccaguuuauguuauacuaucacucagucauucacaauuuuuuuuauuuuuuaagucagauuucucaaguugaaauguuauucacaaauuuugaugcuaaauuuuaacaaggggaauaaauccuuucaauaaaaaaauuaucaagucaucagccuuugaguaguagaaauaguuuggcagcggcugggcgcgguggcucacgccuauaaucccaggacuuugggaggccgagacgggcagaucacgaggucaggagaucgagaccauccuggcuaacacggugaaaccucgucucuacugaaaauacaaaaaauuagcugggccugguggcgggcgucuguagucccagcuacucggcaugcugaggcaggagaguggugugaacccgggaggcggggcuugcagugagccgagaucaugucacugcacuccagccugggcgacacagcgagacuccaucucaaaaaaaaaaaaaaaagaagcaguuuggcagcuauucauaguggucucaaagaucuuuuuuuuaguaugaaauuaguuuuuauuuuuaacuaaaaauaaaugcuuaacaucuuuccaaaaucaaaacuaaggacgaauacuuagaaaaaaagguggaaacauauuuuuccuucccuggagaaaccaguaaggcagacauuuuaacggagcuuguuuuuuuccacaggacuagucuacgcaacagaaucucucuccagcccuuuuucuaugucaguucugucuaccuggcaggaaaaaccaaaagaaacccugaaacaaccccuccccacaaauacaacacaagacaagggacuugaaaaguuggggaaaaccuuuuaacgcgucuaagaccauuguaguguuuaauuccucucuuuggguaucuuagccaguuuggccugcuauacagagcaccuuagacuggguagcuuaaauguucuuagacaagaaacaauuauuucuuacagcucuggaggcuuggagucugagaucaggauguuaacaugguugggguuuuggugaaggccuucuuccugguuuuauagauggccaucuucuuaguaauaccugcaccuggaggaaagcagagagagagagaaagcaagcccucucauaucuuuuuauaaagcacucaucccauuaaugcagcuccacccacaggaccuaaugacccaccuucuaauaccaucuaacuggggcuuaggauuucaauauaugaauuuugagagggaugcaaacauucaguccaaaucaccgggacaguggauuagugcaaugcuaccucuuaagaguuaaugaauuuccuugucaucaguuaguacugaugauugacaucuuguuuuuuuauucuuccaacuguggaagcuaauaaugugcaauuuuuuuuuguuuuucaucuauucuuuauauauacuuacauauuuauuugacacacugauaauuucuguuuuaugcaguuacacauuuguuuuccuuuaaaacaauuucuucagccgaaguuuuaauaaauaauauuaauggaaggcaacuacauuuuuauguaaaauuuacuuguugacaaccauuuagcaauuuucuuuuucuuucaaaccuuuaacuagcuagaggacauguuugcaguagcccaugggaucacggucuuuuaacuuucacacauuauuagauuauuggcuuuuucauauauaagccacuuaagggauuaccggucauacuaguuuuuguguauuccuaagugucccauccuauuguguuccaucccaucccuaccacaauggcugcaccuguuagguucucaaugaauauucuucauagauucuuaugaaugagcuugggaauaauuugagaguacagucuauaaaaauagauauuuuaaggguuggagauauacauuuuuuguuguuguuguuguuguugagaugggaucucgcucugucacccaggccagagugcagugacgcuuaucacggcucacugcagccuugacugccugggcucaaaugauucucccaucuuggccuccuagcuagcuaggaucccaggugcacgucaccaugcuuggcuaauuuuuuuuguuuguagagaugaggucucauuauguugcccaggcuggucuugaaccccugggcucaagcgauccuccugcauuggccuucgaaagugcugagauuacaggcaugagccacugugccuagccgauguuacagauuuuggagacaccagcaagucuucugauuaaaaccaagaaaguggauacaaacacuuauagauaguauggagugaaggaaaaaaaagaaggccuaagaaagagguccagggaaccucaacauuuaagguuacaaacaaaacaaaagguggcaaaguguauugaauaauaauaucuagaggauguagagguaauccaaugauguaaaaaaagcccagggaaguuuuuuucagggaggaaauggucaaguguuaaauuugcuaauaaguaagaauuugaaaauaugcaguuauguuucuguccuauaaaaggauugauccaaguggacuguguuagccucuuaucaaguucugugagagaauacuuucagaaaccuuucccuaaaaaucauuuacugaaagugucccauuguggguuauaacuguucagucugguccuuucuccaucuccuuuucauuauucaacuaucagugaggguuuagauauaaggagcucuuaauauuuuccuguuuacuauuguauuuaagaugauuggauacauuuaagugcauuuaaacugaaaugcaguucacacagugccauaacuugcaaaggacuguaacagcagaugauuguauucuuagauuuuuuuuagacuacuuagcuguagcacuuaaauuucauuuucuagagccaacauaaagaacuuguuccaaagaaaagaacuuacuacuuuuauaaauuuguaauauacguuaacucuuauaaauauuaaagcuuaauagauuuuauuuauauuuaaauauuuguuuuauaagguauauauucaaaauaaagacauauuaaauaucagucaucuaaauguuuuaugagauuuuuuuuaaaugugcauccuugccaugcauaagugaugcauagauaacauugauaagucauguauaccugcaacucucauaaauuaaagaauuuaacuuaagaacauuguuuuauaaaauuagauuuuauaaaacuuucagauacuguauucauaaagauaaaaaaugugacaugcuaauaagacacuaaagcccuuuuuguauuuauauuuuaaucauauacuguuuguucuuauugacaauauggauaacuuuuauaaaguaugaucuguuuaaaugcuacuguuuuuuaucaaagugguucucauacagucaagucugcgucuugagacuagagauaagccaaccuuuugaguuuuucugguaucauuucaagucucaugaugcuaaacaaaucaagguuuaaaacacagaaucgguguuauuauguggccaggauauuuauuggggaauaaaaugggacuuuaauaucaaauaguccagcauaacacauuaauacuuuacaucguuugucuucaguagaucuuugucaaacuggauuucagcuugugaguaagcuaucgaacauuugauauaacaucaugauuauaauuuauuuugaaagacagugccuugcucuguugcccaggcuggagugcaguagugcgauguuggcucacugcaaccucaaccucccaggcucaagcaguccuccugucucagccucccaaguagcugggacuacagacaugcaccaccuugcccaacuaauuuuuuugauuuuuaguagagacaaggucucacuauauugcccaggcuaguaacaucaugauuauuaauugaaucauuauuauuauuauuauuauuuuauuugagacagagucuuguucuguuacccaggcuggagugcaguggcgcaaccauggcucacuguaguccugcccuccugggcuccagcgauucucccaccucagccuccugaguagcugggacugcaggugugugccaccaugccuggauaauuuuuuaauauuuuguagagauagggucucacuguugcccaggcuagucucaaacuccugggcucaagcaguccucuggccucggcuuccugaagugcugggauaacaggugugagccaugcacccagccugaguuauuucuaaauuaaggaaaacuucuuagacauggguaaagauugguauuccuguaaccuagaaucgaauuuucauuaacaucuuuauagcuuuuuuaaagcucuuaaaaucuuauaaucaaauugauuuugaaaucaggcuuuccuaaguguaggaaaccacauucaggagacuugaguguguucuugugacuuucuguuuuccuuaagucaaaaaaagaaaaaacuuucuucuuuuugaaguuaggaauggagggcucaauuugagugaucagggcucuuuuccauucuugaaaggacaacuaugaaagcuuuagcuaagaaaaugucagacuugaaugaugccagauuaaccaacguuuauuagcacuuguguaguucucacuugaaaacuuaauauuguauucauuuaucuuuuuuuagggugguagaucucuguagaaauguaaaagaaagaauaacaagggaaugcaaagagaaggguguucaguuugcuccuuuuucuacaugcagguaaguuuuaaaaauuguucuuauacuucuuauucugaaaaaaauguuuuuuuuaaucaagggggggaauauaauuuuccagcugagaaaaagcuucagucuauuacauuuggccagcuuuccuaaccuucacuuaccaccuuguuaggauugugccacuggaauuuuacaguaguccugagccuuuuaggaguaggacacccuucugugaguaagccuucccugccaucuggguggcauggcagugaagagccaggugucuggacuccuggaaaaagaagaggacuacucuacucacugaaacuauaaauuauauagucaagaaauuauaaauuauauacauacucaacaugacucugaagagugaaggcaguguuuuguuguuuacuaguaauuuaaucucuucaagcucuaauauuaucaguaaaauagugguaaugccauuucuucaugggacuguuguaaaaaugaaaugagaaagcauaugaaaaaacuguuagguucugcuguaguauuguuuugacauaauuacauuaagcuugagguagauaauccauacuaguauuaguaaggaaaauuuguauauuucccuuuccuuuccaaugacaaguccucauuaaggcauucaguuguuaagcuuacuugcuccuuauagcaugauaauuugcauauauuuguuuuccaagacuagaaauauuucuguauucuuuaaacugcuaauuguauguguguguguuuuuguuuuugucuuuuuucuaucuuuucuauugucuuaucuuguacuuuccuaguacuaguguuguguuucuuaguuuuccuuauuguucccauugggaagagauacccuuuagaauuugcuaaauugcacuucugcaagguaagaaaguaaaauucuaacaugagaucugaggaaagcaucuuucuuacaccuuaaauguucauuucaaucaaaaggaucuccuuaaaguagccguuucugcuucugugugggagacacuguccauguuuaacaagccuugcagaaaguacuaagucaucuguauauuaacauguuuuaagcaaguacacugacgauaggaucagagauuauaaaagcugaaaaaguagauuuuagagauuauuugcugggcauucgagauaucugaaggaaaggcaaagagaggucuuguucucuguaguaaaaagcuuacaaugggauuaagcuaaugucgacauaguggguguaagaaugucauguuacuuuuaauuuauuuuaaauuuggggguaucuuuaacaaugcaccuuuuaucuuaaaguccuuaaaaucuaagacaaaaauuuuuguguuuauauuaucaacccaaacugaugcuucauuuuucucuugauagcccagucuuuuagcagucagcucucuuuuauuguaauccugaaaacaaaucagacauaauaauccaaaagcuauuuguuaccauuagauuuugaaacauuuuagauagucaaaucuauucuuguguaguugagaaauuuuuauuccuuuguuuuuuugaaugguaacuuaacagauuuuacccuucccccuucuuccuucugcccccaaguuccuguucaacaucucuuaagaaccccacccccgcuguaacauuaugaaacuaucgugauaaaccacuaccuauggaaaaugauuaggaaguaaaauauucugccuuagggcacauucuguaauuacacuuaaaucuagguucuucagaauguauucaugaggccuaagaaucuucauucuguauuguagauaaguagaauuaguauauuuagacugaauuggccauaugucauuuuuauuaaauagcaguagcuauguuuuaagaaugguuuuccuauaaaagcuuauguguucaguuucugugaccaucuuauaaaaccaguuagaauaugcaaagccuaguuacuugaguggcuuugauaaauaagacuuuuaugguucuuauggcucauacuugauuaaacuaacauuuaauuagaauuugauuucaguuuaguuugguuugaccugcuuaguaguggcuaaggagauuauuccauguugaauaugugagauguauuuuuuaaaccaguuuuuuaucaggugcuaugcucacuaccugggugauaggauccauacuccaaaccucagcaucacgcaauauucccacuuaacaaacgugugcauagacccccauaucuaaaaucaaaguugaaauaacauuuuacaaagcuguuccaaaguuauuuaaaaauaauuauggaucuauuuaaaaucaaggauccuaagaaaaauaacucagguguaggguacauuuauugaguucauuuauuucauuuuuguccauuaaaauguacuuuguacauuggaauagaaauuccaguccaaacuuuucugaagacguuauaugggaaguaauugcuagucauugagucuaauacaaauaaaguacuccaaaaaguagggagcacaaaaaaauuuuuuuaauuaaagaauaauguagugacuuugacaaccacgcuauuacuuguccagaugauuuugaaagagguuaguguuuaagugucuuaaaugauagaguugaucuauuguaaaagguguuagaucuaagucacuuucugaaauggacccaaauuaagguauuccauaagguguuuuucauuauuuggacuugucugagauacuaaucaaucaggcccaucaagcuuuguuaugacuucaguaaucuguucaucuacugaaaacugaacuguguaauacauagaugcuggauuuguuugaaagaugauaaugcucuauuaauauuuaguuacaucuauuuaugaauguuagugauucucuuaugagugauauauauuuuacuaauuucugcaaguucguuucauucauuuauccuucacacuuuauuugaauuugguuauuccuaaugauagugcccuuggaguuaaaaugguucuccguuguuucuuaaacuuuguauaucugguacuuaaaauguaaauauucaagggaucuuuuuuuuaugagggugaauuaacacuagaagagaaacacagcuggcaaauugacaguagcauuguuaaacaguucauuucuucuguucugaggcaccuaacauuuggccuaaaaugcgauuaaaauuguagauuagauucuauuuguauuguguaguaaaaagaguauuuccucugcauuugcuccuucuguuaaauuaaauucuuugugggagccucuguaaauugcauauggagauuugacuaugauuaccuuaccucccuuuuaaaugcuuuccuaauugcauuuugaaagcucagauauauauuauauauaugauuuaauaaucuaacauucuugauaucuuuuguauauacacauucaacauguauaaauauugagucauaguauuuuaaggcuaugucacugcauuugguacaaucauccuauuuguuuuccaaaggcuuacuaauuauuaauguaaacuuagugaagaugcuauauuucacucagucugaucauauuugguauuugggcauuucucccauuucuuaguuuuuaauucucauaucucauacuuauuucuuuuaacuucgagggaguuuggaaaacuuaacugaucaccacguuucaucuggucuguuuagugacugacuuuaagugcaguauacuuaguuuuuuaaaaaagaaucccucuugauggagaugggccaauuggaaaaacauuuacauugcuuuuaaauuucuaauuuugggggagguguaacuagacuuaaaaaaaaauaguauuguacaaauauuuccuguguacccuuuacucaucuuccucaaaugcugauaucucauguaauuauaguaugauuaucaaaaccaaaaaauuaguguuguuucaauaugauuaccuaacucacaaaccuuucuuuaucauuuguccuacugauaucuuuaucuuucauaaccuucauacauuugaagaauacuggccaguuaucuuguaaaacaucucucaguuugaguuugucugauguuuucuugugaucaaauucaaguuacacauuucagcaagauuaccucagaagugauagugaagugcucuucaugguagaucaucucagaagaagcaugauauuuauuaagucucauuauuggugacauuaacuuagacuacuugguuagggugguaccugccagguuucuccacucuacaauuacuauuuuuccccauuguauuuaaaaaaauaucuuauggcugggcacaguggcucacgccuguaauaccagcacuuugggaggcugagguggguggaucacuugaggucaggaguuugagaccagccuggccaacaugaugaaaccccgucucuacuaaaaauacaaaaaaauuagccaggugugguggcaggcgccuguaaucccagcaauucgggaggcugagguaggagaaucgcuugaacccgggagauggagguugcagugagccaagauagugccacuacacuccagccugggcaacaauagcaaaacuacaucucaaaagaaaaaaaaacccaaaaaccuuauggggagaaacuuugagacuaugcaaauauccuguuucuuauaucaucuccuaaucacaucaauaucccacuguugauucuugauuacagcaguuauaauugugauacuuguaaauggugauuuucuauuuuaaucauucauuuuacauuuaucaauuggaauucacuguaaagaagagcuuuccucuccucucuuuuucugcccgccccccaccccuugccacuaucuaucugucuguauaugagucuaucaguagggacucauagacauuuuauugucuggaauauagccauuauugucauuauucacuuuguugcucagauuuucccaguguggcuauugggaguuucuuuaaguuggcuucuguguccuuuugaucugggaaaguagguuuuugaagaggaagaaaaugggcgcacauacuuaggaagagucagugauugaggcaaggugugaagauaugaggccuagggagaaaggugagaagauaugaggccuagggagaaagaaaagcaggucugugggccacagagggucuguguucuguagaguuggugcugagugaagguauaucuccucaagcuuucacagcagugauagccguugcuccuuugauauugguuucuuccucaaguucuuugguuuuucuuauuccugaugucagaauuguaguuauuuucagcucauuuuucccugcuuuuuucccuuaaucuuuuuguucaucugguuccucuacucauggaugucuagcuuuuuuuacucuccuuuguuaucuccugguugauuucuccuauaucuuaguaauauuggcauuuguuuuaccuagaacaauaucuuauguuucuuugucagucuccauuuagguaugccuuuccagaacacuuuucccaauccgaccuaucccaauuuucuuauucuuuguauagacugauuuuuaagcugcauaagcuaauugauggugucugucuuuauguucucucagcauucuucaaucucguuugucauucuguaucuuuagacuaugucauauuuuggcuauauacagcuuagaagaguuucuucuagugcauuuaaauuaucuguguagaaaaaaauauuauugauauuuauuuuguugucauuuauuuuuaaaguuauagccagaacugaacagugucuuuguuuuggucucaacugcagugauuugcuuuuuuucuacccagaaucuuuaagucuguugagccaggagaauccaaacaaaugaugaguucauaguauuguugccagagugugacaggaaaagggucccaggaugauccagaccucaggagaagguucuuggaucucacacaagaaagaauucagggcaaguccacagugcaaagugaaagcaaguuuaucagcaaaguaaaggaauaaaagaaugacuacuccauagacagagcugccccaaggucugcugauugcccauuuuuaugguuguuucuugaugauaagcuaaacaaggaguggauuauucaugccuccccuuuuuagaccauauaggguaacuuccugauguugccuuggcauuuguaaacugacauggcacuggugggaguguagguguagcagugaggaugaccagaggucacucuccuggccaucuugguuuuggugggauuuagcuggcuucuuuacugcaaucuguuuuaucagcaaggucuuuaugaccuguaucuugugcugacuuccuaucucaucuugugacuuagaauggcuuaacccucugggaaugcagcccaguagguagguuucagccucauuuuacccagcuccuauuuaagaugcaguugcucugauucacaugccugacaagaggacuuaauguacuuugaagagauuauaauuugcccauucucuaucaauauggauuuuuuaaauaaugaaaauugacuuuagucaguguuugcauguccauauguauucuaugcauuucauguuccuauccucagcagugacggagccaaugaaaggaaccagguuucuuguuuugagucuaauuuugccuuuuucaaggggcagauguuuugcaucccaucuguuuacuguggcaguacaaaauguaguuuucacuugcacauauggagcucauugugugguccuuuggcaggaaaacacgcucuugaaaaguaauggaguuguacuauuuguaguauggaagugccucaaauuuugucuuauacaagucacaugaagaacuuaauugugcauaaaauuuguuaaauagcagaaagagaaaaaguuaguguuacuuuuauugucaagauauguauguuuuuaaguaauuuuguuaaaugucauuuugauuaugcaauuuaaaacaaugaauacucaugcuuaccugacuauauauauauuguuuucacacaugcugcugauaguucucauuacuucuagauaacaaaacaauaaaaucagugaaaauggcauuucaucauaaaauucugauacaauguauaaaaguuuuuggguuauuucccaauagaaguuuuaguaacaugggacagacaugaaaaagauugaauauguaccuauaauauugacuaauuugguacuucagugaagguaaaauucuuguuuugcacugcguccucaguucaccuguuuuggcggacaacucuaaagcaagccaauguguauuccuuccauggaguagaggcugggaagaaacugagauuauaucuuaaacuaaucauuugggucgucuugacuuucaguuucuagauguuaaaucugauuucacuuaacuuaaagccccuguggggauuuuguuuguuuuuuagggugacgcagacuuacgaugcaggugcuuguaucuacuucuauuuugccuuuaacuacaggggaauuagugacccacugaccguauuugaacaaacugagguaauuuugcauaccugcauauagcuuuuacagcuguugauuaauuucaauaaauuuuacugucaauuuaugaauuuuaaguugagucucuuuaaucacacaugguuugccuagcuguuagcccuuagaaaugaaaagcauauuuguuucccuggcuuauguacugaauugugagucuaaaauuaagguacuguacaccuagucugugauucuucaguuguuacaguacauaauagcugauuaaauuaaauaacaauuaggaauucauuaaauuaaauaacuauauaggaaucuuagauaucacuuucacagcccacucauuuccacauggugguugcuguugaggucagcagcccuaaugcccuuggucuguguuguuguaaugucauucuagauuuguaauuuuuuuauaugcuauagcuguaagugggugcuuuggguucauuagcuagcaguuucuauuacuuucuuaaagagugucaaacuguuuauuuuuauaaagcuuucucuugauaaccaauauuucuccuuaugaguacgccuaaacagacuagaguguggaggauccuguaggaagcugagguuucuuaaaaacucagguguucuacuguuuuaacugcauugcacaccugcuaaagcuaauuucaguagcacacuuuuagacccaaacuauagaaaggguuugguuggcuuccuccuaugccuccucuuuuuuuuuuaagcagcuuuuuugaaguacaauucaaguacaguaagcuguauauauuuaauguguacaguuuugacauauguauacaccugugaaaccaucaccccagucagaauaauaucauucccaaaagucugaguacuuuuuugucacuuuagccuuucacugcuucaguguugcccucuggcuacccaaaugucccuucuguacaguaccacagagugaaauuauuccuucuuucucaguccaaacugcuggucucuaagugcuacugaucucaaguagcuauugcuuaauuuaaaguaauuuguuagaggauauaaauucuuagagcaggggagggcauauguaugauucauucggaaaacccuaaguaaugaggguuuuuuggagaugaagucucacucuguugcccaggcuggagugcaguggcgugaucucggcucacugcaaccucugccucccggguucaagcgauucuccugucucagccuccugaguagcugggauuacuuacaggcgugcaccaccaugccuggcuaauuuuuuguauuuuuaguagagacaggguuucaccaguuggccaggcuggucucaaacuccugaccucaagugauccacccaccuuggccucccaaagugcugggauuacaagcgugagcuaccgcacacagccgaggguucuuauagauuacuuugcagugggaugugguccgucugucccaccugggcccucuccuacccuggccuaacuccugauaguuuauacauacacaacugaguaauuuugagaggcccaagguacuauagauauuuuaccucguagccauuauauauucacgaaucauuaggaacugaaggcaauuccaguuucugucauccuuuuuuacagugcucuuuagucauucuauauuuuguuacaaguguuuaucuuuuccuaccuguguccucuauaaggagcuugguuaggaccuuacauauuaggguaaaacgagguuuuucuuuucacucuuagguauccauaagacugacaaguaauuuaucccaagucauugaccuaagaaguguucuccauaaaggcauuuaugguugauuucuaauagguuuaauaaagacucuaauagcuuuauaacucugaugcccacuauaugauauuaggcaaauaauuuaaccuaucuaagccuuauuuuaucugugaaaugggaguaauuguaguuauuucauaaagcuauacugaaaauaagauacugcaggcaaauuacuuggaacuuuucugguacacuuauaggaagcagucaguaaauuuuagucacuuuguugguauaaugagagauguucguuacuaaguagaaccugacucuacauuuacaacuuugcaguuauuaauauuauuaacaauuuagugugcugaauggucauuuugucuuuuuucccuagaaucucaaagugaucuuuagacauugugacuauucacuagaaaaaaacuuaugaagcuaggcuacuuauuuaauugcuuuuuaaacacauuugaccaaaagagaggaaaguuaggcuucuaguuuauuauuuaacccaggaaacaugugccuucuuugggaguugggucuuuuucuuucacugcaaaaugaaaucuaacuagcaacaauuuguuguguuguuuccaaauacaggcagcugcuagagaagaaauccuugcuaauggagggagccugucacaucaccauggagguauucuuuuuugggaguagaauuucuaauauucuuacuuuaaaaaauauucaguucaguaaaaugcuagggagagacaugguaugaauaauaugagaguacuugagguuucuuuaaaguuucuaugucuuugaaauagcuguuacugagguagauaguuagguugugguaguagccacuagaagcuuacuuugacacgccugccuagaaauggagcccaggcaaccuucugaggucucagggaccucauguuaucagagaauagcccagcuugccugggagguacuugaccauuacagcaaacguuuuuaaaggaugauggggaagaaaaccuacauaaauguuuuucagccacuaucggaauguagcuggucaucaguuauauaauauauugaagggcuguuuguucugcccacccaaagcucagcaaauuaaucaagacaggauaugagaaaaaucuuuuuucaagguuuuaaugcuguuuuguuauuacuuaguggucauuuugguaaguaucgaguguugucagaauuuaucacaucaccaauaaaaauuauuacaauaugucuaucuuuguuacuagcaugcuuaugaaaauaaugaggcaacccuuuaaaacuuaaacaauggccauucuguuauuaaaauggcaauguuugagguuauccacuuguucuguagaauagaaauuuguucuuaauauaucccucaauauaauuugaugccuaggaaaauagaaauguguagauuuuuaaauaguuuuuaggaagcacagugacaauaaccaccuaauuuaaaaauucaacugcucuggacuccuuauauccuuuuuuuuccuguuuaauuuucauucauagcacuuauuauuaucuaauaugcuguauauuuguacuuuuuaaaauuuugucuuccuacugcaaagugagaauccaugaggacaggaauucuaguuuuguuuguugcuauaugguagcaccuagaacagugcuuagccccagucagcccuccauacauugaugcagaaugaaugaaagaauucuguuggaaaaggaguggacuauggaagguguguguccauaucauauucuuacagcaaggucuggaaaagauugcuaauguugaugaauaaaguagcucccaacgucauugugucaauuuaaucuuuugcuauacuuuucucuuaacccccacaaaugaauucuuaacuuagccaauagcauugaagauaauaugcuccucucuccuuuuucuauuuauuauccuuucauuugauggugguucucaugaaugcuagcauaacaaaaauggaaaagggagggaaaugaauauuagaaaccucucaaguggaauuaaaagcuuccgauuacucuaaaaguccaaaccuaauuuuggaaauuugaaugaggaguuacuuaaagauacuuagauuuuagcaccuuccuguaaaauuuucagaaagccauauacauuauuuuaaauauuuuuuauucuguuucaaaaugacacuguauuaauauucagggaacuuuaauauauauaaauauaucaugaauuauucguuuguuuuuugucuaaauugauuacaugggacagaggaagcgaaaugauuuagccauaauuacuuguuugaagaaaaauuaaaacuuucccaguguagccaacaaauuugcccuuugguaugugucagcagccaauaguuuacuuucucuuuuaaaaucaagaaaugugguuucuguguuuauaaugguaaauaugggggagaagugauucugcaagagggugagagcagcugaaucauauauauaacaaggaaauagaggcuuaauugucuuuagguaauugguuauuagaugagcuguuuccuuaauugugggaugauguucucaguuuauucagucuuuauacagugucagaaauucucuagaaguuggaaaugaccaaaugacugcaugcauuacagaggaaaaccaaaccaacaguuuuuuccucggccagugacucugcuucuuuagggucuaugaggaaauucaagucccucuaauagugucuauuuguaagaugcagaaaguguaauauggcagaacugcugauuuuacuuauucagauguaccccagacacugagagcuucuugguaggcucuaacagagucuguguaaacauacuugaaauaauauauucauaaagcugucauuacagaaaaaaggaaauaugcacaaauauaaaauaauagaauuaaccaacucuagugcaaaucuguuugaaaccuggauuucauuugugagagcuaugguaauaguccauuauaguaaucaauucacagaaauaaaaguuaauuaacaaauaguuagaaaauguuaauuuauaagaucauguuuauucaauucuugaucacaaagcaaauaauguaaauagcuucuugucuuuuuuuuuuuuuuuuuuuugauacugagucucacuuuaucacccaggcuggagugcagcggugcgaucucagcucacugcaaccacugccucccagguucaagugauucucaugccucagccuucugaguagcugggauuacaggcaugcgccacaauucauggcuaauucuuguauuuuuaguagagacggguuuucaccauguuggccaggcuggucucgaacuccugaucucagaugauccgcccaccucagccucccaaagugcuuguuauauuuuuugauacaaaguaugcuuaauaccuuuuaauguuguauaaucuguuuuccauauuauaaguacuacuggucuacuaggcaauaugguuucaaagaauggcaguccuucccgugaagggccuuauaguccaguagaauaaaauauuauaccauuucaaaagcuacugacaaaaacugaugggauuauauuauugcuacuuuaagguaagagucugcccuuuucuuugaagagcauucaaaagaugccuuuaauaaacauguaaaugcuauagaugcugaaacagugaagagaaaggggauagaauaaaggaaaagaauuaacauuuauaaagcugugaauauuugccuagguguucugcauacuuaaccucuuuuaauucugcuuaaugcaguggaauagauauuauuccugucuuucacaugaagaugcuaagguucugaauauaaaguaacuggcccaaaaaucaguaauaauuguuagugccagaauuugaauuugaacucaggucuuccugccucaguauccuuguccucuuaauuaaaagccuaaaaugucuggaaugaguaaaaucuaaaaagauugaaaaugacaggcuuugagaagagacauguaauuaauuuuuuuuuaaauguauaugggcugggcaugggggcucacaccuguaaucccaacacuuugggaggccuaggcggguggauugcuuaagcucaggaguucgagaccagucugggcaacauggcaaaaccccaucucuacaaaaaauacaaaacuuagcugggcaugguagcauguaccuguaaucccagcuacucaggaggcugagguaggaggauugcuugacccugggagguugagguugcagugagccaugaucacaucauugcacuccagccugggugacagagcaagucccugucucaaucaaucaauaaaaggaaaauaaauauuauacauuacuauuuuuauuuuaaaauauaaaaucuguuucuuuagugaauuaaaauuuuaauuuccucaucauagauauuuuuauuguuuucucaguucuuucccauaagucaauuuuacuuucugguugcuuuuauacuuccugauaguagguuccuaacaugucagcaguaucagguaauagaacaaauggcggucauaucauguuacauuaaagcuauguguauaaguuaugugcauuuuucagguucuagguuuauaggccuucuuuuauugaagacucccaauuuggugaaauaauuuauuuuuuaggaauuauuggguugaaguugaaucuagcaacguuugauggcauauuaauuuauuuagagguuuugccucauuuaaauagaaaucuuuuaugucuauccuauuucuuguauuuuuauuuucuauguggucaaaauaugaccgcauggaaacagacucugaaauaccugguuuucucuagugcuuagaaaaagaaacuuugauaagucugaauacaaaacauacuuuagguaugcugauaaaaugaagaugcuuucccuuuucuauuuuuuuucucuucuaaauugcuaaauauuggagucuuccagggcucagcccucagaccuucauuucucuauauucacucauuuauuugaugauuaucucaaguuucacaauuuaaaagaccaucuguaugcuaacucccagauaucaaaagauaacaccucuauaccacuacccuaguugcaaucacuauuuucugcaguagccuccuaacuggucuuucuuccacucugcuacuguauucucauuucucuugcugcucgauuaaucuguuaaaaaaaucaaugguuucuucucacauucagaacaaaaugaaaacuccuuaucaugaccuucaaggauacauuguauaucacucuguccucagcuuugauuacuuuguaccucuagcagcauuggccuucuugcuauuccucagacauacuaaucccuuuucccauucaaggccuuugcuguuuguucccucuuuuuauaauguucuuucuuuuguccucuccuucagauauuugcaugacucacuuucuaccauuguuuaggucucuaauaaaaaugucaccuucuuagagggaucuucccuguccucuuguguaguuucuguaauccccauuugaauuaaauuuauugagguuaaugacuuuaucuuguuugucacuguauuucucacucccuaaacagugacuggcugcucuacauaguucaacaucauaaaugcucaaugaauauguuaaaugaguggauaagugcaugcccaaauaaaugcucacagaauuugagcaguuuugcaaauucucaaauagcucugaaucuugcauauuaauccuuuuuuuuuuuuuuuuuuuuuuugagauggaguuucacucuuguugcccaggcuggagugcaauggugugaucuccacucacugcaaccucugccucccggguucaagcuauucuccugccucagccucccgaguagcugggauuacaggcucccgccaccacacccagcuaauuuuuuguauuuuuaguagagacgggguuucaccauguuggccaggcuggucuugaacuccugaccucaggugauccaccugucucagccucccaaagugcugggauuacaggcaugagccaccacucccggccgcauauuauucuuuuauauuagaacagcaguaguuggcugugguucacaccugcauuccaaacacuuugggaggcccaggcagaaagagugcuugagcccaggaguuugagacagucugcgcaacauagcaagacucuaucucuacaaaaacuaagaaaaaaaacuagcucacugugguggcacaugccuauaguccuaacuacuugggaagcuggggcgggaagauggcuugagcccaggagguuaagguugcagugagcuggcaucgcaccacugcacuccagcaugggugauagagaguaagauccugucucuuaaaaaaaaagaaaagaaaaaaggcaguagucuuguaguuaauuuagcuuaacauuugguaacuaggccuaaauauugaauagagggucauauuuagucauagaaagucucaguuuauucucuaauauuucugggaaagcauauuagcagagugaguuaguuauucacuggagaaguaggguaaaauaaugugcauuuuucugcaacuccauaccaccaaccauuuaguguucuuccauaaaugcauuaaguauguaagguuucauucgaacuuuuugucuuaaaaccaauauaaauuugaguggcugaacaacagaggggaaauaauguaggcuauggaaucaaaucuauauuggauuccugguuuugcauuuaacugugugaccuuagggaaauaauuucucugacuuacacuuuccucaccugcaaaaugggaauaaugguaccugucucauauguuuauugcaacacuuaacguguuaaucuauguaaaacaucuaaaugccuuacauuuaguaagugcuuaaaaaacaauaguuuuguuuguuuguuuguuuguuuuuaauaauagcaauaaacagcaccagguggcaaucuguuuggcacucuugccuuaaccauuaaagaaaggauuacaguguauuugagaaagauccauacauucaagggauaugauucaacaauaguuuuaacacuucauuuauaaacuacaguugaucucacccuauaggaaaguuucuuacaaucagcaugaaagaaaaauaaauuuccuucacaguauuggcuaugaaauuugcuaucgaagaauguuauuuucauaauagcuuuucuguuuauagguaaucauauaauuuguguauuucaaaugccugcugcuauucaguauaauugcauaaagcagaaaccuuuucaacauaaauuuuaaauaauguuuuuaguuaccuuacuaaacuuauucaaugcuagagcuuuugagagaucacuuauuuuuauguauagaaaagauuuuucuugauuugcacccugaacuuaaaacucaaguugaacucauaguagcgucuuuauuuacugaccuucaggcagugucaugacacucucaguaccacuuuugaguuccagaguaaaagggccagggguugggagaauauugaugcaauuucucuuagaggguuuggccuguaauugugauuaauaacaguugcuuucacuaucuggcaacaggcugguuugucugccuacaaucaugcugugauaaauggagcuauguuaacucugguuuuguguaucagagaaaacagauguagucuggaacuggaggcuauaggaaauauaaagccuacuuaacuuaaucuucauagugcuuguuuuuguaacugaugagcuggucaguuucaauagcaaaguuuaugucagccauguauuuaauuucaauuuaugacuuaaguuuuuaaguuguucauuugcuaaaaucauaccuaaguccuugucaggaaguuaaaaaccuugauuaaguauaaccagccuuaguuuaaauauugauuuuuuuuaccuaaccaaaauuacucccuauuauaauuauagggcagcugcuguuaccuuuuuuugguagucuuaccagaaucuaauaguauuagaaacuuuaaaaguaaaaggaaacuacucaaagaagcugaacaaaaaaaucaguuuagggccauuuguuaauuuguagugugaaacaaaaggcauauagauuggaaaggaggaaguauaacuaucccuauuuguaggugccauuauugacuauauagaaaaucccaaagaauguacaaaaacaaagucagcaagauuucaggauacaagaucacacacaaaaaucaauuacauuucuaaauacuaacaauuaagcauauagaaaccaaaucuaaaauauaauaccacuugcaguuguuccaaagaaaaugaaauaggcauaaaucuagcaaaauauauaccgaauuuguauucugaaaauuacagaaucuugaugaaagaaaucaaaaaagaccuaaauaaaugaagagacauacaguauucaugguuugguagaaaacucaacauaguaaagcugucaguucuuuccaaauugaucuaucuguuuagugcauuuucugccaaaauuucagcaagauguuuaaauagauauagaaaauauuauucuaaaauuuauaugguaaggagaaggaacuagacagcuaaaacaaauuugaaaaaaugaauaaaguaaaagcagucaaucuaccuuauuucaagacuuacuauauaguuacaguagucaugacuguguguuauuggaggaggacacauagaucaguggaacagaauagagaacccagaaauagagcacacaaauaugccaagcugaguuugacgaaaguacaaaagcaaucuagcggaggaagcauagcuuuuucaacaaauaguacugggcggagggggcggggggaagaacucugaccuaaaucucauaccuauacaaaaauuuaacucaaaaugaauaaugaacuuaaaaguaaaacaaaacuauaaaaccuuuagaaaaauuuaaagaauaucuucaggaucuagagccaggcaaagaauucuuagaccggacacuaaaaguacaauuuauaaaaaauugauaaacuggauuuuaucaaaauuagaaacuuuugcucuaugaaggacucuguuaggauaaaaagauagguuauagaguaggagaaaauaugugcaaaccuuauauccaagaaaagacauaucuauuauauauaaaucucauagcucauuaguaaaaagcaaauacuuuaauuagaaaauaggcaagagacaugaagaaaaauuucacugaagaagauauacagauggcacauaaucacaugaaaaaauguucaacaucguuagcuauuagggaaaugaaaauuaaagccacaggagauaucacuacacaccuaucagaauggcuaaaauaaaaaaauagugacaauaucaaauucugccaaugaugcagagaaacugaaucacucguacauugcuugggggaauguaaagugguacagccauucuggaaaacaguuuggcaguuucuuaugaaacugaacauguaaucaccacucaacccagcaaaugcacaugugagcauuuguaccagagaaaugaaaacuuauguucacauaaaaaccuuaacauaaauauucauagcagcuuuauucauaauagcauaauagacccaaacuggaaacagcccagauguccuucagcuggugaauggcugccuacacauacugugguacauccauaccauaggaauacuacucagcaauaaauaaaaacaaugaacuaucgauacaugcaacaacuuggaauaacucuccagggaauuauguuaagugaauaaaauccaucccaaaagguuacauacugccugguucuauuucuauaacauuuuugaaaugacaaaaucuuaagaguaaaaaaaagauuagugauuuccaaaaguugaggcuggagagggugugacuguaaacagcgcagggauccuuaguuugauagaacuguucuugacuauaucagugucaaugucuuauuccuuugauagcuaccagaugaguuuagccuuuccaacacugaaucuuuaucagauuacuauaagauagaaaauuuguuuugccuuuuaauuuuuucaguuucuuugacuggccuuuucuaacaaaacguauauguugauuauaauauuuuuccauugaagcaauguuguaguuagaguguaagaacauacuguggaaaccaacuuaacccacaauuuaacugaacauuaaacuauuaauauuucagcuguagcauagguuaaacagauuugagagcugacagaaaaaucuguagcaagaagauacugaucccugcuccccaccccaccauccccccaccccugugugacuacaggggccaagcccaagacaaaagggccagggacaacauuguguuggcugucucuuaccacaugcuguaccuuuaguagcuucuagccucagguauaucaccaggagagugaguauagguggcuuggauaauaucacuuagcuuuggaucucuaaagagaacuuuuucucuuugacaauuuuaugucuauaacuuaaaaauaauauguuuguuaaucugagaaugccuguauuacauuauuacauuguuacagaauacuuuuauaguuaguuucaugugauuagcaaacaguuaauccugggaagagguugguuguccccucuaacacuacuuucuuacauaauccagcaguaguuuggucagauuaaauuaaaucuugaaauacaaagucaaugcucagaucacucguauaagcagcuaagucuggguuuucuucuuaaaaucugaccuauagaauagugcuaaagagauauccaggauacucaaacuagaacuuucaaaauauaguuguuauaaugguuagaugcuuuuugcuuuggcugaagucuacuucugagcuucaccuucaaugaucuucuaaauguauggcccauuucauaauuuguucuuuuuaauaagucuauaaucuuuuugacuuauaaucaaaugugugauucaaaaaauuaaaauuuagcuagagaccucugugaccagcagacgcuggauuuaucccuuuuagauuaggacuguuugguaguuucugcuaaaucuucaauccguuaagccucaaagaguaguuucagauaauuuuugguggccagauuggccuccauguccacauuuuccauguacaucauuuuaucucuuauaccuugcguacaugucuguucauucauuuaugcuguugaucauaccacaacuucuuucuugcauucuuucuugaaucucuuagcauccaggggaauagugagccuguaauuugaaaaacuguacuugaaaguuuucauauucucuguuccaaaaguaaaguuuuaaaaauguacuauguguuguggaagaauacacacaacuuguuugauccagucucuauauacauuauuagaaauuaaauuguaaaacagugaacuccauuuuuaauuuaagcacagccccccaccccccgccccauuaguuuucuuucuuuucuuuucuuuuuuguuucuuuuuuuuuugugagcuauggagucucgcucugucaccugggcuagaaugcaguggcaugaucuggacucacugcagccucaaacuucugagcucaaguucuccuuccgcccaaucuccugaguagcugagacugcagaugcgugccgccacauccagcuuauuuuuuauuuuuuuauuuuuauuuuuuuagaaauggggucucacuauguuacccaggcuggucuugaacuccugggcuuaaaugaucuucccaccucagccucccaaaauguugggauuacaagcaugagucacugugccuggccuaguuuucuguaauauucaguauuuggcccaucuuuuuuaugucuuauaaaauacaucuaaauacuuaaguacuuaaggaaucauauauuuagaauaauagagaauuauggaaugcaagguacuuaucuuguuuucagagauggugaucuuggcuuuuuguagcucuaguguugacucucaggcuagauuuauacuucuagagcaucagaagucaaaggaauauguugggucaguagcuaugaauaucccacaucagaugauucaggucuaaaaaagaagaauaggcuuuaugugguauguguacacaugccuuucaguagauaacuaucacauacaagguaaauugaaauaguuuuaggccaccuguuauuugcugucuucaguaauucauuuucccuuccuuuaauauggugugcuacauaagggacagaguauaauuucuucccuuucugaaaaugagcuuuacagguguuuaauaaggaacugcuauauaguuguauacccauguguguuaacauggguacagaucaguauggucagcuaauuucugaaugcccagcaguacaacuaagaauuguacaaagggcauuauuaguggugguguuuagcucuggaauaaaaaucuuguacuuugaaguguguuucuucuccaagauuaaggccugugguguuuguuguuuuauugauccaugugggguaacuacauaagguucuccagaaucucaagaagacuccaauaauugucuuguuguuaaggcauauugaacguuuuuguuugaauguguuuucuaccuguauauguauccugugaaguaguugacuuaaauuguuaaacaaagccaaagauuucuaguaccuuuaauugcauaaaccaagauuucugaccccauuucaaauucuguuaucaguggcagaagaagugccagaccucugccacgaagggguuaaaugcuuuuaucaaauguguuuaugaggggccacagcuuuguuggccguacugcccuuuuuuuuuuucuacuuucuacuucacuaaucaaauguauauuagauugauuauuguaaaaguauaaaccauagaaaauuugacaagauagauguguaaauuauccuucugacagaaguaaugaugcacuccaagcaccuucuguuuuccagcgcuuggugagugacuucauuaaauaugcaauggcuguuggguggcuucucagacgaugguucaguuccuuguggaauugcauuauuacuagagguguaaaaccaggcagacaagcuagcuguugggcauccugcugagguucuaaugugcuccaucuuguuggagcaguuguuugcagucuuuucaggacaauuacauccauaaccacaggauacauucagugaaacuguauuacagauaacaguggagacugguauucacugcucgucaccccucucucucuucagcugccucagugugggcagcuuauaguaguaugguaaagccccuuuuaccauucacagaguaguuguuuaaaaaaaaaaaaauccuguggagcaaaucuggaaaaaacugauuuuuaacuuuuuuaaaaagugcuuaaaaucauagaauauuagaguugaagagaccuuauaaagucuaauccauuugcaagugaaaaaacaggcugaaucauagucaugggcagucccuuaggagauaauagaagguccugguagaauaucuuuuaggugguagagauugcaggaauagggauuuauuuacucuuagcuucugguuuuagagcuaucucaaacaaaauuuuucauuuugaauuuaagguuuuuuuucugcugaacuucauuuccccccgucuuaauaccagcaauaccuuuuuauuucugaaagccaagcagauaauuugcuuucugagauuaucacaguauuuauuauuuugaugacaauuugaugguuucuuagagaacuggacacaaaagaugguuuuaguugagcucgaaaugguauuuaagguuuccaaaaggcagaugcuaugauguaucacuauagccuaauaaaugggaaugcauuauagaaugacaggcugaauacuuuaaugaaagaagguuucccauuucaguuggucaauuaaaucacuguugaugacuuuggaucauuaaugaacauuuguagaaaaugaccguuugaauucaauuaguaugauaauagguuuuuuggagaaguacaaguacaaauaauccuaacuguaaauuaaaagauuuauccauuuugccacagauaaguuagcauauugcuugcuuuuuaauaccagagcaaacugacauuucagaauucuuuuacagauuaaguacauauucuuucuuacaaaaguucuacuuacaaaagguuauguuuuucauugaguaccuuuugaaauauaauuuaugcugcuaaccauuauguuacuucacuauucucagaacaaauuagcaagaccuagaaacaaaaaaagggaacuuuguacaguauguaaaagcaaaagauuaaguuuacgauggauuagguauuugauuuauuuaaugccuuaggaaaaaaauucuaaaucuggaaaaacaguaggaagaaaguaaccauuauuugggaacaugcaaauuuauuuaaaaguacugugaaaagaaaauguaaauagaagcuuaauagccagaauuuuuucuugagccuauuaaaguuucaaauuuucuuauuauuugaagccuuuauguucguuaaaauauuuuaaggauauauauccugucauuuuugcugaauuuacccaacaaauucgucucaaugugauguuuuucuuuaguuaacuucauuuucucuaaaacuuggguguguuuugguaguuaaggcagagguggguucuuucgaaaugcacguuuuucucauuuuguuauuuguaaaaugggcuauaaucucuguccaagcuuccuucaaucuccauuucauaguuuacagagaaaggagacacuguggagcacagacuuccccugggaauacauugggcuuaaugagcuugauagucuggugggcucaauaaaucaaauaaagcaaaacauuucucauuuuugaauaaaagcauuuaucacacaguguuuguucacucauggucacaagauugauugguucccaguaucauagcauauauugaagcauuuuugauuuuguuuuuccagugggcaaguuacggaagcaauggcuaaaggaaaguaucucugaugucggcuuugggaugcugaagucugucaaggaauauguggaccccaauaacaucuuuggaaacagaaaccuuuuauaaauccauuaguaccauuacaaaaaaaugucaauuuuuuuuuuaaguuuucaacugugguuauacuaguaaucaaauauaucauggacuauauuuuggauacauuuguuucuuugguuuaaaauaaguuuguuuucauucuguaguuuguuuuguuucuacaucuauggauugacagauaguauuccuaaaucucucucauuguagguacaucauuuuacauucagcgguugucauuucaaauuuuagucaggcagcacaaagcugucaauuauuccagaggaagcugcugccagcuguuuuguauuguugcuuccucuuggggaacaaagacagauuugguaucauugauugcucagcuagccucuuuuuaaaagaacguuucugggaaucagaugucuagggaaggauuccacugaggagugauacacguguacauuguuuaagagcauagucuagugugaguaggccauuaaggggaaggauauucaugaaagaauuuaggcaaccuguuauuuagaaagccuucacgucuguaaggugcuuggccuacuuuuuuuuuuaaauuaguauacaugcauaaaaccuuguaucaucaauauacaaauuauucuguuaggggacauguuuuuguucuccauguuucuguuucuauugugguaugaguuguauuuguaucacugagauaaccuauuguuauauucuaauucauugauaauauguuuuguaagaaaagcugacauccuucauugcaagugaagaacagguuuaccaugaaaugaaugccuuuauucaacuuagaguccuaauguuucugauuucacauucuuguugcugaaaugcagaagaaacagcuacagcaagagcagaaggaaaacucuuagacuuaaugucuccaauugcaagaauuguuucacuaaagaaacagucaucauucaacuacugaauuugaaagccucagcaguuucaaugacaaaaaucauuuuugauuuuuuaaaauuaaucccaauggcaugauaaauuuucauauaaaaaguaaaguuucaauuuaguuuuuaauaaugguuuaaugccuuuuuugaauaacugguuuaaccuaauuuuuuuuaaauguaauguauuaaugcauauaccauaaucaaaaguuugaaauauccuguuucuuaaauaaugagaacauuaaucacauuuagcaagcauuuguacauucaaaccuggauauuaaagugaaaugauuacuuugaaucacugucugccaagguucaugauucacauuuugagauggauucuuuucuuaaugcaauaccuaacuuuugauaauuuuuuaaaacuaauauuugaucagauaauguaagucaaaaugcagacgauccuuuaaaaggaugcauugucuguguauguagcaacagcuccaaaguauuuuugggcaguuugauaccuuuuauaucugaaguagccuuaaccagaaaaaugguaauuuaaaauugacaaaaugauauuuuuaagacuucaaaaugauaaauaauuuuuaacuauuaaaauuggccucaaacuaauaaaucuguaauuaaauuagaauuaaauaucaguuuaacaacaaaaugaaauauuuauuuuuuagaagcugccucucuucauuggucauuuauuuuuaauuauaaaauuuccaacagaucuuugcuuuaagcccuugauauuugaccuaguuggacacuugaugaggaaguugccucuagaauuauaaaaaucucagcuuuauaaaaugcaucuguucacgaagguaauuucuuuaauuggugaucaaaauauaaaauuaagguacuaaugucucacuggaaguauauauauauauauauauauauguaugcauguguguguguguauauauauauauauauauauguauauguuucugaguaauuuuuaaaaaauaaaacagguuaauaagaagauccauuccuuugcaugugauuguuauaacauucuuucccagggaguucaauuucagcaaccucagaaauccauacuugauauuaggaaacuguaaauguaacaccugaaauuauuauguucacuauucuacaugaaccuuauggaaauucaugauuuaugucuuuguuuuucuuuuuccaaguauaugcaggacuccccaaccuugauuuuauaauggugacugcauuuuguagguggaaucauuucuaccgaaaucauuuugaaacacaagaauauugaucaguacuguuucacucugauuuaguaaaucagaaagccucccccuacccccagcccccacuuucacauaccuucugggaggugccucaguauagacuugguaucugugaaggacugaguucaugaauaugcacagaagcacuuaaaccaugccucuuauuucuauaauaucugaaaauggcuucauaaaaguuaagucaggagaacacuguuuacaugacacuucuuaacucauuuuuaauguuuauuuuuaauuucaaaaacuuguugccuauuugguuuucaguacugcauaacacugacuuucuuaaauuagucauaguugcaauaauuuacuuaaauuugguaaugucacauuuggguugggguuucagugggaauaguaacuugccgcuagugagaaauggcauugaauacuaaagacucaauaugaacaggcuuuauagacccuuagagaaacuguugccuuaauguuuggugcaauuucuaguagugcauaagugaauuuagucuuaugauaaguaacuuugagcuguuuuuagcuuaguaagaauuguggaaaccacauguuuauugugcccaucauuuuacacaaagaaaagaggauuauauuauuucuucuaaggaaguaggaguuuucuuccuaaaagugcuuacauauuguaguacuauuacuuaaaaguuauuuaugaaguugggagccuucuaguuugccuguguugauguauuuugaaaacaaaauugcaauaaaggaugagcuuccaucgguguguaugguauaccagauacagaugguugcaaggaaaccuuuucccccacuagaauagucuauuaguaacugcuaaguccuagcuugcauuuuugaaaaugccuuucugcauguuagcacccagacuuuccuuugucauauuccuuuauagcuacaacuuaacuguagcuuaucagagaagcucuguaguccuacacugaaguguguucccuuggcuguucauauggggcuggguuugguugaacuuccauucuguauaaaugcuagaacacaguuacuacagauugauucacaaacugcaugugcuggugcuugaggcagccaaaauggaaugcuguggaaagcauaucuauaucuuaaaaaacacucagacaggaguuaaggacagcuuuaauaauuuuuuuguuuaccacuuaaucuuuaucaacuuugauuuuaguuagggcuuagcucaugguugaagaaaaguggaaaauaacaagugcccauuuagguuugaagaauccagaauguuuuaccuuugacuuuaugaguuauagaagcuuggcuuugcucuaggcuucauguucccaaaugagccaucugucaguauauucacuuaauucuuacuaauuucaguuuccuguaaaggaaacaacuuacauauugaugcuuaaauccagaaaguguaaaagguuuucuuaaacuguuaaaauauagugucugauauaaaggauguaaguuacucagcuuucugcucccuaagccaaacaguguuugucuucagugugaaauuuaacuguaaaaacuacuuguaaugucaagagauuauagaucauauuauuaauaaaauggaccugggucuaauauuuuuuuucuucaaagggagugugaagcuguuuauucuuuuauuugcauaugaguuuuucuuuuaguuuuaguuuuucauguucauauuuccacugauuugaaaacacaaaauuuauuuuuauaauuuuguugcuuguagcauaaucaagugcaaaaucaagugcaaccuacuugugacuaaaucucuuuggauuuauagcugaggauauuguuagcuagguuuugucaaucccuaaucauuuuuuaaaaucaaugcuguauucccaggaggcuuugagacuccuaugaaccugaagcacucccuuuugaaccuuggaagauccucaaagagugagcacucuugugcucuucuaaucauaauuaauuccuuaacaaaucagaguaaggaccacugacauauagaacccucaagccaaagaaccaucacagaauuuaguaacuuuaguucugugaacaugaaaagauuucuuuuuugguuuccaaaggagauuauuuauuuuuccacaaggaaaaacaucuugcagagacucugaauuccaaaucugagugagaaagaaaaggaaaaaaaucuguuucaugguggauuucuaagcaacauauauacauguuuuuaagacaaccuuuuguuggcaguguuuuuccugaacaccauaugcacccuaggaaacauguuuuuccuuuaaucuuguucacauaucagaaaaggacaugaaaugcucauacuggcauacaaguuucuauaaguaguuauuuuuugagcuacuuauacuauauccccaaaagcucacagugccuuguugggauuuuuuuuuuccaugaacuagccauuauuuuaaaugagugggagaggguaagucuuuagacagaggucauucagcaguucaagacuauuccucuucaagaacaugucaggaauuaagcaguuauauguggaaacacugguaauucuuuccacaguguuguuuuggauaaucuguucuaguauauuuaacuaauuguaugguggaccuguacucugauacacaucgaaucagucaaugggauuuguaugugcuuuuccuuccuacauuuucauuccuacugccccaaccuaguagcccuaaguuguggcuugguggguuuggcauugagccucaagacacucacuacauucuuucuggauguuugcucacaggcucccugaggagcagaaccuguggagcuggggagugcgggugguuucuauuccuaauauugugugucaguccuuuuucgugugauggugccuucagaauaacgaauauuucuguucuggacaaugauuaaaucuuaugagaaauauauguagguuauauuaauucuuguccauuuuugcuaagccugugaaauacuuuggcucugauacaacuuaacuugaauaauaucuuauccugagucuuccuccaaggcaguacauauuccugccaggacuguaguaauccuuugggaacuacaugugaguaagcacuuguauguaagccauuauacugcuguaacuaaugcauacaaacaauucuucucuuuacauuuauagucuaaaaggggauaugcagugggaaggaaaauuccugagagauuccagcauagcuuugucaauuccgacugagccauacuguuuuccacaagggcucaacacauagucaguauuccgugcuuucaguguguguucagauucuccucuuacugguuuucuuagacuguauuguucuauaagcaaaugcccaugugugauuuuuaagaugugcuggggaaaaauaaaucaauaccacaaccacc

SEQ ID NO: 13237 - RNA, 17241 nt, Homo sapiens
cuggcgccggacuccucuuucucccggaagcggagcaccgagccggcaaaggcuugggugugagacagcagcgguggcagacaccgcagaagcaaagagcagugaggcuccugcauucggguggagcaccauggacgaagcuggcagcucugcgagcggcgggggcuuccgcccgggcguggacagccuggacgaaccgcccaacagccgcaucuuccuugugaucagcaaguacacaccugagucggugcugagggagcgcuucucgccuuuuggcgacauccaggacaucuggguggugcgggacaagcacaccaaggaguccaagggcauugcuuucgucaaguucgcccgcagcucacaggccugcagggccauggaggagaugcauggccagugccucggccccaacgacaccaagcccaucaaggugcgggugcccgggucggggugcccucgggggaaggagugggccucuuggaccucccuucaccugcugcucugccggggugagggaggaguggaacauccguucccggcagcugaccagacagcaccuggcuuggggacaggggcugcuuugaggagaggcuccccucccacgaagcugcgccggguugcagggaaggggacgggaugcggaguguuugccccacgagagcggacccggcagccgcggccaccgggugacagaacagcaguggcugggcuuccccucucccucgcccucacuaauccaccagcucuugaguucacugccaaacucguccuagccuacuuugaguacuuuucugaccuuccucucucagaugcccagauuuccauauauaaaaaacggaaaaacucuacuuuuccucagguacagaugaggcguuaacaacuugacagaaguacuuuaaacuggggagggaccucugguguuggacguuuuccuaguaccaggcgaaagaauacauguacagaaagaauaagugcagguguuuaaaacggucacuguuacauauucuucacauuuuguuauuuuggaaaauuguuuugaaugagcucuguuucugaaaguguuaauagcauacauuugguucuugacccuuucuguuacugcaacuuuucuuugaaagcagaccaaaguaaacugccuuaagaagagccaaaucauugugauaaugacacauggcaggaaggaucauuuugaggguuauuugacauaauaugugcugucagcacagugccucacacaggguaagcccucaauaauguccuuguuauugaucaguaguagccaagaugucacagcuuacucccugugaucucaaaucaggacucaauccugagaaucuggcaauugcuuaaauuguagccuucgucugccccauguaaauaguugcuguguauguuauucuguugguacuuugcacaaaaauauuuucucaauuuuuuaaaaaauuguuuuccaaacugagaaugguauuaauauggauuuauguaaauaaagggcucagagauauuucagucucuggaggucuugcuccauccaccaaagagaaggagccugggacucuaccaacaacacaguaaacagucccuuccucccacuucuccaacccucugaagugugucagagugacagcaacaaaauuaauuguagggccacagcauacaggaucaggaauuggcaaacuuuuucuguaaagggcugacuaguaaauauuuuaggcuuugcaggccacauacagucucugucacauaaccuugucuguuuuuacaguccuuaaaaacuguaaaaacaauuauuacaucaugggcuauaccaaaaauggagcugugguuugcugaccccuguacuagacuaaugaauuuuaucgcuguccaauuaugaccuuaguggagaggauuuuuauauuuugaguguaacauggccacagagcccuugugggcagcccaaaaaacugucccauauuugaaauugauggaccaccuuccccugauaaauuucuauaagagaaauuaaaggcccaacaccgaaauguacccucucuuuuagccucagagaaauuaaagaucuuguucccaaaaagaaauaaacuuuacuauuuucuuugucacauuuuugacuauucaguuuuagccagaagguuguuucacuguaguaccuagcuagacagucuaguuucuguuucuuuuucuuuuuuugagacagaaucucacucugucacccaggcuagagugcaguggcuucuugaucacagcucacuguagccuccaccucccagacucaagcaauccucuugccucauccucccucucgaguagcugggacuacagaugugcaccaccaugcccagcuuauuuuuuuuauuuuucuuagagacagggucucacuauguugccuaagcaggucucaagcuccuggacucaagugagccucccguuucauccucccauuacaguugugagccaccacacccuaacagacuaguuucauucagcagcugcagcuugagccaucuucaacuggaacacucuuggguuguuuucagcauuuccaguuaaauuaauucagcuucaauauuucuauuguacuuugcuuuuacaaaguuucagaggaucuguaagacaacaauauuaucuuaccagcccucagccagaaaagauuguccaaguaaaaguuauucugugaccaacuauguuaucuggcggaaagggggaaaccuagaaaacagaagaaaaaaaucuuggcuguaguuuugcaagaaugcuucuuaucuagagccuaugaacacucagucuaugaagguaaaaauuuaugggagaaaucuaccaugaggagguuaauuauuuuacguauguucuacauagacugucuccuuuaucagagauuugaaacaccucaguccucuaaaauauagaaaucugugcucugauggcacuuccaauuucaucuuaccugagguucuuuuuuuuuucucuagugucuuugcauauacuuaaagcuucccuauuuguauuucccuauuuaccauuuauuacugauaucagccacaagacucuagugggccauuuccauguuacucaauaguuguacucauauggugcuugacauauaguauagauuuauugaaggaauaacuagaaguagacuauaaagggauaugucucuaacacugugguuuucuugguugcugcuuccuacuguggaauuucauaaguuccaguuuucucaugcuuuaaugauacagagcccccuuuaccagcaguggaucagagaccaagauauagagaccccuuuaaaggaaaaagaaacaaacaaugcaagugcccuuguuuaugguguuuuaauuaauuguauuacguuucuucaaauuacucuggcuaaaaauaaaugcaaaaguagaaauacauuugggaaaaacacaaugcagagauugguauuaucucauaaaaaaaagucauugcaggcccagcacaguggcucacaccuguaaucccagcacuuuggaaggucaaagugggaggaucacuugagcccaggaauucaugaccauccuggacaacauagcaagaccuugucucuacaaauauuaaaaaauuagcugggugugguggugugugccuguggucccagcuacuugggaggcugaggugggaggaucacuugagccuagaauguugagacugccgugagccaugaucacaccacugcacugcagccugcuuuuuuuuuucuuugagacccugucucaaagauuaaaaaaaagucauugcaagaauaauugcuuuugaaaaaauuuaagaaaugggaaaauaguugacauuauuuuauuuugggaguuuuguuuguuucuuagguuuucauugcucagucccgaucaucuggaagucaccgagauguugaagaugaagaacuuacaagaaucuuuguuaugauaccaaaguccuacacagaagaagaucugcgggaaaaauuuaagguauuuauucuaaucagcuagcauaugugauaacucauaguccugcauagguuguauggguacuaaaucugaaauguuguuggaauaaggucaauagaguagucuuggggaauuacauaacugcuuucaucaauuucaaucuacucuuuaaauauuaaaccuagcauaaauuaguuuuuaaaauuaaagaauauauaaaagcuggaaaauaguaaugguagucucucccuacuuuauugugaaaguagagauucgcagaaaugaagcauaaagcucagaaacuuuuaaguaaagucacacaacuaguaggugguagagcuaugauuuaaacccaggcugucggagucuggagccugcucuuggucuuuaaaauuucaaagcacgcuuuuaucacuccccucuauugccuggcauguagaggcgaaucaggcagaccugagugugugaacuguauuaucuaguauugagaacgggccuaugguguguugacaugguacucauucacagaaaggcuuauucuuugaagaguuuuuguccuaaaauugggccuuugaaggaauuauauuuaaagaagaaaacguaaauauagcucugaccuauauaagugaaauuugaggauaauuuuaugucuuuuuagccauuaacuuaugcagugaugagcuuucacacaaauuauuaaaaagcaauuuuuuaauuguuuugaauuguaguuuuuuaucuuuuuucuacuaauccucccaugaauuggguggcaacaagcaagaaagaaaacaagcaguaaaaaguaauuuucaaacuuucucuccuaccccaauugagaauucaaugaaauacuucaaaaauaacaaauaccaaaaacguauauuuuauacauccuccaguaguaaggaaaauguuuuuuaccuuaaauauuuauaaauuuuucuuuuccugaaugaacaaauauaacacuuuaauguauaguaauuaaguugcuaauugauuacauaagaauuuauaaaauaaauaauaaauaccaauuauauuccauauuucuuugaacauugaaaguaaacacuacugcauguuucucagaauaguaacuuucugagugaaccagcauauuuuagaaauacccuuugaaaagcacuccuucaaaagaauacacaaucauuuauguuccuguuagaagacagacaaguaauaauagcuaauguucuuugaguauguuccaagccccauguaagcacuucacauguuuuacuucaguuaacccuuaaacaacccugugagguagauacuacugcuagccucuuuaauaaagagguaggcacagagagaauaaguaaacugccuaauuaaugagugguugauucaggauuucaaucuagaaaguuuaauuccagagcucuggcucuuaaccacuguugagcaagacuuuggagcuauccagaccauguacaaauucuuacucuucugugacuuugucccucuuugauuucucuaaagcccagcuuccuuaucuaugaaauaagcauauuugcaaauacaaauaugcaauaucugcauauuuuauacugccuauuucuuuguuugcaugcaagggucacauauaaacaaauuuuuaguucugaaauacucuguucaauuaauuuuaaguccccuaaaaucaugucuuuuaacucucuuagguguauggagauaucgaguauugcagcauuauuaagaauaaagugacuggagaaaguaaagguuugggcuacguacgauacuuaaaaccaucacaagcugcccaagcaauagaaaacugugaucgaaguaaggauguguuuaacauuguuaaaaacuuuuguaaaaaauucugauuauucuaaauagcugaauuuaauauuaguuuuugcuaauaacuguaucugcuaauguaauuuuagcaguggguauuuaaauauuuacaguccaaggaagaaaaauauuuugggguuaugauuaaacauucauugaggcacuaucuugaagaaauaagagcaacuacauuaacuuaguaagugaaaugcauacuuuggguauuauuuuuauagguuuuuaggguuuuuuaaguguauuuuagaauuuuaaguauuaaaaacuugacuuaccuuuucaagguuuuuaaaauauucuuuauauuuguuuauauuugaucuacaucccaaagacuauaaaguauaacuaauaaaccuauagguuaaggguaagauuuauaagaugugcuaacauagguaacugauauagauaggguuaauuucaagcuagagugacaugaaugugaucuucugauguugcuguauauauaaagaauaagaauuuuaaagaugucaaagagaauauucuuuguugguauacuucuaguuagguauauugaccuuuagaaaugauauguagaguaauuaaauuacuggauuuuaggacauuauaaaaauauauacuuacuggaaagaauuacuguuaaucaguagaauucuuagauaccccuaagguacauacccagauuuucucuuagauccuucuaaauuucucauuuagcuagcaguaauugaguaccugcaguauacugaucaauaugcuaaguagagggauacagaugaaguauauggcagcccucacauuuaaggaauuuauagcuguauuggguagccaagaucuaauaggcaaaaaauaaagaauaauggaagaacuuuuuuuaaaggcucuuugaaagcaagaaguaugccuuauuugucugucacuccagguaucuaguacaauaauaggcccucaauaaagauuuauuaagcucucuauaaaaguaaaugccauuuauaguagacucaguaagaauuugccaaaugaaaaaaauguucauaaguguaugguagagucugucaauggugaaaaacaagugcuggaugagcauggcaacacaugccgaggggguaggacuugugucuggugucgaggaggcaggacagaaggugagagcagugcuagcagaggcacaaugccaggaauaaacauguguuuugcuuggugcugugaaggcagcugucugaguaaagcacaguauuucugcugagacauucugagacacaguuaacuagguacauuggaacaugggaaccauauauuggagguuaggaaaaguucaagguuaguccgcauuaggauuccuuuguagauuguuuagaaagacaaaaguaagaacaguugaucuaaccccacuguauuaaugauagauuuccagagaagaauucaaacuggcugguuuuauccuuuuuuuaagccacugaauaaugugaagaaaacugaacccuugaaauaugcccaugugcacauaaaugcauaauaagcauuuuguuugaagugucagaggguuuguggaaucuucccaccuuuugaagcucauccuuggaccccuaguuaagaacccuugauccagaagcaaaaaaaacaguuaaagggcucuuguaauuaauugaagagaaucuaaauuaaaaacagaggcagggaaguuagaguaaaagauagcauauuccaauugugugcauuucaaaggaagaaacuuggugacagguuaaauauaaagaagcccuacaggauuuuaauguugaggagcuuaggugaaugaaugacgauguuaucuguaauagggggagaugggaaaggauagcauagaauugcugaucuuucaugucuacauugacccguaauuugggauacuugcuguuugucauuuacucuuugccaucuuccagaaagcaaagaaguaggucuggaggagauggccauuguauagauuuugcuuuguacaauuauauuuauaaagcugagucaggcacuagcaaucaaguauauuugcagguauguuaaauuugcugugaaacuugaaauucaugggguuuuuucagguuuuagagcaaucuuggcugaaccuaaaaauaaagcaucugaauccucugaacaagauuauuauaguaauaugaggcaagaagcuuugggacaugaaccuagaguaaauauguuuccauuugguaaguaggcaaccuuuacuuuuaauaguauaauguaguauaugcaaucuaauuuggguuuuaaagaauacucuguuauugggcaucuauaaauuucaccuagugaauaaaaaucuuaaauguaguuuuuuuauuccuaaaauguggauuaugacuccuaaaguucuuaauauuuaacacuuauuuuguuuaacugauuucuaauuauaguuuucucuguuaaguuacgcauuccucauauuagaaacuauuaccacugccacuuuuuugggugagcuucugccucuauauagcugaccaaaaacuuaaaaagacauauguagagauccucuccguaugaguccuaaaauuuuguuccagaacuacugcuacuuuaaaauuagggcuacagaaaggagaggaaugguaaaaguagaagcucuaauagaaaaaggggaaaauggguaaugaaaguaaggccugugaauguuauuugacguaaacauucagguaaaauacuuaccauauuuuucaguuuugcauacuaaacuucuuucugugaaauuagacuaugcauuucuucuuauauuucugcauuaaagguaggggaguggggagaguugucucuucuugucauuagucccaucgguaguucugaugaccagaagcguacuacaaaauacagugccuuuauucaguacaauggacucuguuuucuaguauuuaaaauguuaagcgaauuguuggcuguguagaaaucuaaagauuuacuuuuuuuuauauugucggagaacaacaaucugaauuuucaaguuuugacaagaaugauagccgaggccaggaagcaaucuccaaacgcuugucaguuguaucaagaguuccuuucacugaagaacagcuuuucagcauuuuugauauaguaccaggauuggaauauugugaaguucaacgagauccuuauucaaauuaugguaaaauaauguucacauuaaaaaauauauauauauguauauauacacacacacacacacacacacacacacacacacacacacagaguuuuguuaaaauggcuuuucucuaguggcacuuuuaugucaaguacugcucaugugacaggaauuuuaucuuuccuuuuucucuacuuuagaauucaaaauauggugauaccuuaauaaacaaagcccuggaaauauaucuucuuuuuacaaaauuguucacuguaaaauauauuuuaacucccacaaaauauaacauucuguauuccaguugcauaacaaaaaauaccucuggauagagccucuguuucuauguacucuuuugguuaaugcuagacaaaguuacgaaacucacaaaauuuccuccucauucaucccuagaucucuuucucuuaaauuuauaccccuccuuccuuucauuccaagcaucuaaaugcccugcuucucuccugcuucuuccaauucucaauggaagcaagucuccaauaucagccauuugaacuuauuaauuaguuaauugauuaaacccauuaucuaacauuagcuaacccaucuuuguguuuuaagcuuuugauuuuauuaaggcucuuuguuaauggaggcauuguggcauaaugggaaagucuggcauuccauuuugcauagaaucggguacaaaucccagcagugacauguagcuuugagaccuuggcaacuugcuuauccccucugagccucucuuuccucguauguaaaaugggaucauugauaccuucuuugccaggguuagguaagaauuagagauaauauauguaaaauaacuuaaugcaaguucuggcauguaauagggcacucaguaaaucuaagggguuuuuuuuucuuuguuagugaggggugguagagagaaaucauacuugguuggcaucucuuccaguuuuguaaggauaccugauuuaguccuuuuagaguggcauggcuauugacauagaaguagugacgugaguuuggucauguggaccaacaggacuaagguaacuccacccuucauacagacacccccacauacucacuaguacccaacccagcacuagucuuuuuguagaacugucuuugagccauccccagucuuaacccgaucauaugcgucauucucuguucuaagacuucuaggcacacauuuuuguguucucuggcacauuuguuauaugcauaugaaguuguguucauuuuguuuuguucccucccuuuuaucugguaugucaaaauguauuuguuccuguaccuccuguuuuguuucucugguuggaugugucugaaauauaugugucauuggaacaucuuuuuauuaauagaggugucaucauauaguucgaaucucauuugaauuaacuuuauauggucauuugauuucuguguuuuauuuuaauuucauuaaaauguuggaugcuuggguuuccagaugaacauaaauuauaaguguuuccccagugguuuguauuauaaaagugaaaaccuuuuaguugugucacaaacuccugggcucucuaaggaaugcauuauaacauugucccucccuucaacaucacccuccuaaauugaaauucgucccuuuggcagaaaucucuccaaaggaaaguaaaauauaucacuugugaucugagauccucuguucccuaucuuuuuguuuuucauucaaaucacuuuuccucucccuacugcugcagauagccgggaugaguauauauucuuuucaacuaucacuucucauuucauuuccuacccaguaugguugggaaaaucuuaaaauuucaaaguagauuucaaagaauaaaaauuuagacuuuuaaguauauugguaucauauaagaaaagcuaguauccuaaaacuaaacuuauuagacaggacguauguuaauauuccauuuucccuaaaauaucauguucauauuuuucccuaaauuauuucuuccuuuucuaggaauacaccuguugcacacaugauaacagaacuguguuuucugauacauucgauucuguauuuacuaguugugugauauuagaguucuacaugguuucauuuuugugauagauuguaacauaggccuuaggcacucagucugcuuuccuuuuucauuucuguauguucucuauuuuaggucauggagugguucaguauuuuaauguagcaucagcuauuuaugcaaaauacaaauuacauggauuucaguacccuccugggaaccgaauagguguuuccuucauugaugauggaaguaaugcaacagaguaaguaccauuccaggagugucuaaagccgagcuuugaguguacaugauugauaggacuugaagaauaaaaauagaaacaauugaccucucaggugagaaagucacacaaaacaagcuacuguuaaaagacugaauauuuuuaguuuucuguaaauuaucaguuauuuuuuccagucuccuuagaaaaauggcaacacagaugguagcugcacagcuugcaucaaugguguggaauaacccaagucagcaacaauuuaugguaaguagguaagaauuuaaccuuuauaauauaucaauagcauauaaaauaaaugugaagagaaaucaugcuuuguugauuaucuguguaugaaaauuuucagagcuauuguggaagaccacauagaugccaugauacauaucugucuuuagcucuuggccaaaaaucccuaaagggcauuuuuuucuuuuucuuguuuucuaccuguuaacagcaauuuggaggaagcucuggaucacaguugccucaaauccagacagauguuguacuuccaucaugcaaaaaaaaagcuccugcugaaacuccugugaaagaaagacuuuuuauuguguuuaauccucauccuuuaccuuuagacguauuagaagauauauucugguaagaaaguuacauuuuuuguuauauuuuauuuacacuaguaauuuaauuauucuuauaaucuagacacuuccuucacccaguaccuaucaaguagagaguauuaguucucugcuuuuaaaaccuccuuauuuguaucaucuuuuucaauuucugauuauuuucuucucuuguuuaucagucacacauccuaaggcuccauagagaauuuccugcuauuuuguuuuugaaacauaaagugggccuggugcaguggcucaugccuguaaucccaacacuuugggaggccgaggucaggggaucgcuugagcucaggaguucaagaccagacugggcaauauggcaaaaccccaucucuacaaaaaauacaagaauuagccaggcauggugguacaugccuguggucgcagauacuugggaggcuaagguggcaggauugcuuuugcccaggaggucgagguugcagugagccaagauugugcuacuguacuccagccugggugacagagugagacccuuuuuguuuuuuguguuuuuuuugcuaagcaucuucuguuuuguuggugcauuguaggauccuuaaggguuaugcagucgcauuguguaaacaauuacuugauuguagggaaaaauacauaaauguuuuuuauaauaaaaaagggaagguucuuauuuauuuuuguguuuuuaacauaacuccuuucuuugcuuuuucuuuuaggccuuuuucccauuugccuuacaagaauguuagugaauuugauagacaggaagcuuguuaaagagcugcacaaaauaucagggacauaaugugauaguauauugaggcucaaaaggaaaaaaauaucaggauaugguucaaguauuuugaccuuuauuuaacugauauauuuaguuuucuucuugaaccuccucuuuguucaaggcaggaacugugcuaaguacaagagacauguaaacaaaauauuaaauggacaagacauuaugauucuuguccucuuagagcugaucucauguaggaaacagacaaguaaacagaaaauuacaacccagggugauuguugcugugauaaggaauguguaagauacaaaggaggagcaguuaccuuagaaacucugagaagccuugaaagaaggaagguguauguggagaccugaaguauaaaaauaauuucuccacaggugaaagcuggggguaugcaugguuauuucugccauagagaauguaaaagaagggcuguuaaauagggaauuugagagauuguuaaggaagaugaaacuaaagaguccaaggacaaugucagaacggcucuagagcuauauuaaggaauuuguugucaccauggaggcaauggggagcugcugaggggacuuuuagggaguaaaugaucauauuuauguuuuagaaagaucacucagaagacagagugaaaaauggauugaagagggacaagcucagggguaaggaaacuagugaaaaaggaguuagauuaaggaaaagaugauggucugaaugagaagagagaucugaaugagaaugaauagaauugacugagauguuuaagauugacaugaguuggauguuggaucuggggagaagggugaaaauggagucaagaauggacuccaaauuuuagaccugagcaguuguauuuaucaauuuugguugauuauuuuuuucacuuuguuucagucguuuugguaaccugaucgaaguuuaccuugugucaggaaaaaaugugggguaugccaaguaugccgauagaauaagugcuaaugaugccauugccacucuacauggaaagauucugaauggggugagacuuaaaguuaugcuggcagauucgccaagagaagaaucuaacaaacggcaaagaacuuacugauucuugagguaagcccuuuuuaaucugaauuuuaaaacauauugaguaaauaguauaugaggaauauguguaaguacuuuauaaacuuuucuuuuuagugauuuagaaguugucaguuaaaagagcuuugcaacuauuuaaacuuuaaaaauuguugacauuuacugaagaauguuuuugcccuucuguaaaauaaaaucacauuucaauuuagaaagauaaauaauuguuuuuuguuugugaaaucuucgauuuuaagaauucaacuuuuuauuaugugcuuauauaaacuuuuaaguuguccggugcuagaauaaggauugcuuuaaaaaaaaauugaaauacuucuaaagauuuuuaacuugaaaaauuggugucuugaguuaugaauugagguaauuuauaacagucguuuauaaagauaauguuuugacuucucucuaaugaaaugccuaaaaagcaauaucaaauaauauaucauuuuuggaccuuuugaaccuaaauguugguguuuucuggacuuguauuugugaguuugugcauuaaaacaauacauucagaaaauauucucguaugcauauauguauuuuuuaagaaaaccugacaauuuaccaaaaacucuuuauuguaaauuuugauacauacagccauaugaauuccauuuccuauuuuauuuauuaguuuucaaaaaucaaacuacaauuuauuugacugugacagugaguuuauaucugugugguuuggggaaacauuccuuaaaguuugacuuuuuuuuucccccgagacgucucggucugucacccaggcuggagugcaguggcgagaucucgauucacugcaaccuccaccuccuggauacaagugauucuucugccucagcuuccccaguagcugggacuacaggcgcguaccaccacgccuggcuaauuuuuuguauuuuuaguagaggcgggguuucaccguguuucgaucuccugaccucaugauccgcccgccucggccucccaaagugcugggauuacaggcaugagccacugcgccuggccuaaaguuuggcgguuuuuauucuguaaaauaauucugaauuucaggggaagccguuuuccuguucccacacacuaacuuuccaagucuacuauaggucaaauguaguagauggcaggcacuuugaauucaguuugaaguuacuggcuugaaaccuuuauuuuuuucacuuaagauuuucuuucugaccaauugugugagcuagcacguaugagaaugauuccugccaggccucacugcugaugacccuuccucuccuagaacagaucacaugauuaguuccuccuucauagcuucauagaaggcauuugacaagagaaagugcccauugggcccauaauccuaauuuuuaaaucuuuuuaaauguuuuauuaaaugacaaaaccacucucauuguaccauacauuguuagcaauuuaacccuggauauauuaaauugggaguggaaaagaauuagcaagcauuuuuuccuguuuauggauaaaauguuaagaaugaauucuguuuggagaagcuauucucuagcaugcaaaaaauguguuuuuucuagucugugaauauuucaauaauaggaaauaaauaguucuugcuuuuacucaauaaaucuuuguucuuaaaaaggacaauaauauagacuuuagacuucucaguauagaaaaguauauaaauuauucuugugguugaaccuuuucuaaugauuauuuacauguuaaagagaauauugggcuuaaaauaaaaagccauuuaacugugacugggcuggucucuacgcccuuuuuuuuuuuuuuuuuuuuuuuuuuuuaaacacagaaucuuagucugucacccaggcuggagugcaguggccugaucucagcuuacugcagccucugccuccugggcucaagcaguccucacagcucagccuugcaaguagcugggacuacaggcaugugccaccaugcccagguaauuuuuuuugguaagacaggguuuugccguguugcccaggcuggccuugaacuccuaagcucaagucaucugccuuccucggccucccaaagugcugggauuacaggcaugaaccacugcgacugacccucuuugccuuuuugaggcccaguuuucucauagggcuuuugagagacaaugagucaacaaaauguaaaaugaaaaaaaggcuuugcaagucuaaacuaaaacucuugcauuuguagcuucagugaaaccuuugagauguccucuuaucuaaaauaaugacauccaaaugaucagaaacuaaaaguauaaugauauaaaacuaccuuguggccaguugguacugugagaacuaagcuuuauaaauaccacauuuuucccuuaaacucauccaauuuccuacaucagaggaauugcauuuucagcauggcuguucauaaaaauuuuaaucuaucauuuuucccuuuuuugaacuguuacgcauauucagggcagagauaaaauagggucagguuaguugaaaauggcuguuuggauaggauacgauuagcuacacgguuuugaauuucuucuaauugcagcauggcuuuuuuuauuuuugcugcggaucuccuauuuacaauggacuccauuaugagauucuucuucuuuguugguguauuaaauaaacauauuaccuuauuuuaaguuucgauaaaauacuguggaagacuuugccaaauuuuauaugauugugacaaguuuuuugggguaggugcacuuuuuuguuuguuucuuuaauuuuuaaaaggcugcaaacacagcucaugaaggcugguuucuuuuaucucugagguaugggccugggauuaagugagucaugccuaggaaauagaagcaacugauccaaggauauaacauugaaaguaguugaauucuauuuugagaugggucugauaaccacaauguaauucucuuucuauuugaggaaaauauaaauuuuaguauuucagagcaucagauuuuuuguuaauucacaacacuuucccucuagaaauucagcaccugcaucgcccuucuuaguaaguuugguuuuauuugggggcagcuaugauuaagcagauaacauuggguauauugaaauaaaggaacaauuccuaacauuuuaggaauacuacaacagcuauuuccuuuccuuucaggugaugauuuucauacuuguguuguguucuuucuacagaacaaagacuaaauaaugacauaauccucagcugacugacugaaaaugugacuggacgcauucccuguggacaguugacagcuuuuuuuuuuuccauauaccugauagucuguguacagcauuguuuugucugggaagcagggauugcugacauguauuuuugaauccauacauuaaugcuaaaacgaauauaguaguuguuccuuagagcaauauguuguuacguguagcagaaauaaaguuuucuuugcuuaacuaaau

SEQ ID NO: 13238 - RNA, 1312 nt, Homo sapiens
augauuucaguaaagagaaaacaaaaauggucauccuuauuagacaagaaguuccauuuuaauacuugaauucuaauaaauggauugcauuauuuccuuuucuagaaacaguagcucaagaacacauggauccugggaacugaagguaugguauugauaggagaucagacagaaauauucaguuaaaauaucaaguuguaguucauucauuacaauggccaugcuuugacuuuauuuaagguagaaaagucuuguccuuaguagaaaaugcagcucccacuauacuuugagaaaguuacgaggcccugugaaaauuuaucugaguaauuaucagagaaaaagggaguucugugacugucauauaugaauugaagacaguaucuggaugucaagguccaugugagcuagcuaaccuaggcuauaccaccgugggacucuuagaaacugccugucugaccaaaaugcugcagaaguggcagaaggaaggcaucggaagaccauuuuuaaacaguuguuuguauaugagguacaaaacucaagaacugugugaaaaggcaaguaccaguacuguuuucuacagaaacugggggaaauacugagcacagaagaauaaccaaagugcuucccaccaauaacuucugugaaacuacguucucugaauucuucuccaaauucuuuucugauuuuguaaguaaugauguuacaacuaauuuuuuugcucauauauuauuaauauuuucuagcauuaacaagacauagguaacagcauucauuagcucagaguuuuuaaggguuuuguuugcuugcuugcucuguuuuuuuuuguuguuuuuuuaugccagaaaaaaaauuaaagucaucuacuuuaaaguuauauacuaauuuacuagaaguucugauauauaaaaauauguaauuucauuuuuuucucucuuugucaacaaagccuaucugggccgggcgcaguggcugacgccuguaaucucagcacugugggaggcugaggugggcggaucacuugaggucaggaguuugagaccagccuggccaaccugguaaaucccugucucuacuacaaaaaaauuacccaggcaugguggcagucaccuguaaucccagcuacuaaggaggcugaggcgagauaaucucuuggaguaaucccagcuaugaaggaggcugacgcggagguugcagugagccaagauuucgccacugcacuccagccugggcgacagagcaagacuccaucucaaaaauaaauuuaaaauaaaacaaagccuauccacuguguuggguuuuggcccuaggagau

SEQ ID NO: 13239 - RNA, 13003 nt, Homo sapiens
ugugacgcaggacaacgccugccacgcgucggaacucggccgcgggacauccacggggcgcgagugacacgcgggagggagagcaguguucugcuggagccgaugccaaaaaccaugcauuucuuauucagauucauuguuuucuuuuaucuguggggccuuuuuacugcucagagacaaaagaaagaggagagcaccgaagaagugaaaauagaaguuuugcaucguccagaaaacugcucuaagacaagcaagaagggagaccuacuaaaugcccauuaugacggcuaccuggcuaaagacggcucgaaauucuacugcagguaggaaaugcugcgagcugcccgugcguccaguugcacaaaaucuugccugccuccaccaagcggaagccucauugguugguugguugggguuuuauuuuuuaacgguaaaaguugagcccuuuauucauuaaaaaaaaucacauuauauggcaguguuucucuaauaaacugaauauuuuuauuuaaaguauugaaaauguuguggcaauaaauuaucaaaaauacgauacauccacacacacaucaaccaccaccauuacccuugggaccuccagaauuaaaucaagguucugccuauaaggauguucacauuuuucccuugccagaaguauugagucuuuacggaggaauacauggaauaaagagauuuaauucuggccuucagaagcacgauuuuuauagguuguggccacuuucuaucaagaaaaacaguuacuucccuggugacuucuggugggcccugcucccucauuccaccuggugccuacucugauuuaauugauggcuuauuacucagagggagaaucuuuucuuuacccuguaaagauaggacugggaaaaacaguuccauccauuuagaauaaaauagagaaauuuaauaagaauuuauacaauuuuauaauuuaauaagaauuuaauaaauuauaucauuagaauuuaauaagaaaauauaccauuuuaaauuacuauuaaaaugacuuuuugaggcuaaaacugcccuaucauuuuuuuacaacaaacccagggaguuaaaugaguucuuuguacaagccaugcaccuaguuaggggcuggagacccauuaaaaaguuaacuguugaauaguuuuuguaaagauaacaauuuuaaaaaaugagauggcuguuaaugauuaacuuugggcaaaucauacuucuuucuggugauuauagggaaguuugagucaaacaccccauuaaggguuuuagaaagagugauuauaugggaaugaugguuagagaggacuccaauuuuaaaugcccagcuguauuuucaaguuugauuucuugaaaucaguuuacuuaaguauugcuuuuuguuauagccggacacaaaaugaaggccaccccaaaugguuuguucuugguguugggcaagucauaaaaggccuagacauugcuaugacagauaugugcccuggagaaaagcgaaaaguaguuauacccccuucauuugcauacggaaaggaaggcuaugguaagauguuuaauuuuaauuucuuguuuuaguuauauuuaaaaaaugauuaauagauuucuggguauauaggucugaaagaauugaaagcacagucucaaagaaauauuuguacagccaugcucauagcagccauguacaauagacaagagauggaagcaagccacauguccauacauagagaaauggauaaacaaaaugaauacaugcauauauggaagccaggcacaguggcucaugccuguaaucccaacacuuugggaggccaaggugguagaaucacuugaggccaggaccagccugagcaacagcaagacccugcucuacaaaaaaaaaaaaaaaaaaaaugaaauggaauauuauucagccuuaaaaaggaagaaaauucugagacaugcaccaacauguaucagccuugaggacauuaugcuaaaugaaauaaaccagucacaaaaagacaaauacuguauaauuccauuuaugugagguaccuggaguagucaaauuaauagagacaaaguagaagggugauugccagaggcugaagugagagggaaaaggggaauuguugaccaauggguauagaguuucauuuuugccagaugaagaguucuggagauugguugcaugguaguguaagcguacuuuacugaacaacacacuugaaaauuguuaugaugguaaauuuuauguuauguguauuuuaccacaauuaaaaacaaaaaagugaaauaaaaaaugauagaugaaauaaagagaacaguaaagcccaaugaccuuaagcucuaucuaguucaguccagucccuucuuuuugcuuauaaggauaauaugacauuguuugaauauagaucucuggccagaguucuuucuucuacauuguggcaacacucaugaugauuauauauauucuauaagcucuaccuuaagcauuuuuauuuguuuucagcauauguuauuauuacauaaauauuuauaacacagaucuuugguaagcaguaccaaaguuaaauucauaaaacucagaaacuggaacauguagguuuagaguaaaaggacaggacgggcacauuguaaaaggaacagcugagauauaaugggcugucagucauuauuaccccaauacaggacaagccuucaaaugugcaagaaaugaucuuauucuuucaauaucuugucauuuuaaaaauccuacagcaaaaagaucugaaaaccuagguaaagcaaauaagcgggaaaaauguuuguaacauguaugaagacuugcuaaccaauaaugaaaaugacauaucccuagaaaugggccaaauucauaaauaagcacccacuaacaaaaaacuacaaauggccuuuaagucuaugagaauacuuaauuuuauucauaaagagaaauuaaaaaugagacaucauauuucacucaucagauuagcaaacacaaaacaacuuggcaaaagcauggaaaaaccagcauuauugcugggaauggaaaucauucaacuucucuaucaacuguuaucaaaagugaaaaugcaggcccgggugugguggcucaugccuguaauuccagcacuuugggaggcugaagugggcagaucacuucaggucaggaguucgagaccagucuggccaauauggugaaaccccgucuccacuaaaaauacaaaaauuagcugggugugguagagugugccuguaaucccagcuacuugggaggcugaggcaggagaaucgcucgaaccugggaggcagagguugcagugagccaagauugcgccacugcacuccagccugggcaacagagcgagacuccaucucaaaaaaaaaagugaaaaugcacgugccuucuuauccaauaguuccauuuccaggaaugugcacaaagguauauguaaaagaacauucacugcaggcauuuuugggugggaggguggcaaaagguuggaaaccaccugccuauccaucaauaggaaauuaguuaaauaaauuauaguauaucuauacaaugaauuacuguguaaccaguaaaaagaaugaaguagagcuauacuuauuaauauguuaaaaauaaaguggaggccaggcaugguggcuucaugccuauaaucccagcacuuugagaggcuaaggugggaggaucacuugagcccaggagucugaaagcagccugggcaauguagggagacacaaucucuacagaaaauuaaaaaguuagccaggcguggcgguauccgccuguggucccaacuacucagggggcugagaugggaggaucccuggagccugggaggucgaggcugcggugagcugugauugugccacugcacuccaaucugggcaacacagcaagacccuggcucaaaaaaaaaaguggacaagacuauauuccacuuuugggauauauauugagcaucagugccaggcuuuguucuaggcacugggcauaaagcagugaccaaaguagacacuacucccaauccucuaugagcuuucauuucagaggaggaguuucacauaugcauguaucuacacagaauacaucuggaagaauaugcagucaucugaugacauuaaguguuccugggaaggaggccucagggucaaggaugagaagauuucuuuucacucuaacauuuuguaccauuugaaaguuuuauaaggcauguauuaauuuuuccaaaauuaaaauuuuaaauuacaaaaauugcauguagcagaacagagaagaaaauuuuuaaagcaggcaggaggaugggcagccugauaggcuguaccuugcauccuuaguuagguucuugcuccguguugcugcuugaaggcuauacagaaagaaucuuugccuccuuacccuauuuagagccacugcugacuccaccgguuugaaauaguaaagauuaauuuuccacaaugagauauuggcauugcucccaaauauuucauggaaguggcaugccuucuuugaggcaguugucuuagucauuaagaguucuuuccagcaaaaucggggcaucagugccccacacuggauuggcggguggugggggggugucagugcuuugagucagacccagucaggcuuaaaacuccuaaagagacaauuuccagauaacuucagcuuuauuuuuaaugcuuuuugccaauaauuugaucccaucagaacagcucccaugguaccauaauucauauauccuguuuuuauuuguauaggaaccuaggagaaagagaaggaaaauugaaaauaaauuaagucaaaugcaauacuugugcuaaaaauguugucaaaaguugaggccacuucuaggcaaaauguuggaggcagaguuugccuuucagucucuuucucauuuucaaaguuuuccuuucugucuugcguugugucuucagaugccuccacauucugccuaccacuagagcacccacucuccuaucugccuagagcacacacaucugucaucaucaggugcucauccaggguucaccgccaucaggcaaaggaccacuuagcuuaucuuuuucauaaacuaauuuaugcuuagauaugaaugacuacccaggcugccuaagcucuuaauaaaucagaaacuugcugcagagauauagaaguuugaugugaaacaaguucauauucaauuggagguaucucuaacaaacauuaaagugauuaaucucacuaguaauaccaccagcacccucauuuuacagaguaagaaacugaggcccaaaaaaaguguuaauuggaccauaguuaauacugaccuugccugcguuacauuaggcauuguaauccaauaccuuggauuacauuauuuuaaaaguugcaguguagaccuuaaguaacuguuuaacaaacaaccucuugauuaaauaagcauuuaaaaguaaguuguuauuaagaccuaacauuagcuauaacuuuauuuuagguaguacuugaagaagucuuucuucugcaaaauauccuugucucaugucacagaacaacccugcaugucuugaaaugcaugugacuuguuagugcuuaaauaacaauacaugcgguauguauauauucuuuaccuuaauuccuacuucuuugaucugcuucucuaaauauaaguaauuccguagcaaaugcauauuuuccucauuuuuauacuuuaguuuuuuuuaaaaaaaaaaaaaaaacaagaaaaagagguaauuggcaauauauccuuuuuuuuuuuuuuuuuuuugagauggagucuugcucugucacccagauuggagcgcaguggugugauugaucuuggcucacugcagccucugccucccggguucaagcuauucuccugccucagccuccgaggagcugggauuacaggcacacgccaccaugccuggcuaauuuuuguauuuuuaguagagaugggguuucgccauguuggccaggcuggucucgaacuccuggccagccaggcugaucucgcccuccuggccaggcgcagugguauaagccaaauaagaauugcuugaaccugggaggcagagguuacagugagccgagaucgcgccauugcacucuagccugggugacagaggaagauucuugucuaaaaaaaaaaagugguauaagccacugcgcccggccaauauuuucuauguuuauagcaaaauuguucaaaaacugcauauguaccuacaauauuuuuucuuaagaaauucaaguuuugggcugggcacaguggcguauagcuguaauccuagcacuuugggaggccgagguggguggcucaccugaggcuaggaguucaagaccagccuggccaacauagugaaaccccguaucuacuaaaaauacaaaaaauagcugggugugguggcuugugccuguaaucccagcuacuugggaggcugaaacacaagaaucacuugaacucgggagguggagguugcagugagccaagaucgcgacacugcacuacagccugggcaacagaacagauucugucucaaaaaaaaaaaaaaacgaaaagaaaagaaauuugaauuuguguuuugaguuugccuugaauuauugucaggagacaauaauucugucauaaggagauaacuggaaaaaauaggaauggguuuuauaaaacaaucauugacucaaucucuagcucuucuacucuaaagucagguaauauguggugcauuagguuaggacuuuuauguuagucauaugaugcauggguagaucuuucuauguuuucucuuugaaaacuacuaaucugcuacuccuuuuggcuauaacucacaaacucuuuucucuucagacuauauaaagacuuuagcuagaaugcuucacuuuuuuauuaaagaaauugcuguuuccuuccaaggacaaacauuuuaaaaauaaaugauaugggucauucauucggcaaauauuggacugccuguaguagauuaggcacuguguaggacacuggcaauauacugaugacacaagcuacccgcugccccuuagcaagucauuuuugcaagucacuuuuaugacauauuuaucugaaauagcccaucacuuauuaaaaucaccugugacaucauggccuggcacggugacucacgccuguaaucccagcacuuugggaggccaagguggguggauccuuugaggucaggaguuugagaccagccuggccaacauggugaaaccccaucucuauuaauaaaguauaaaaaauuagccaggauugguggcaggcaccuguaaucccagcugcucgggaggcugaggcaggagaauugcuugaaccugggaggcagagguuacagugagccgagaucgugccauugcacuccagccugggugacagaggaagauucuugucuaaaaaaaaaaaaaaaaucugugacaucagcuaauagguuaacuuaauuaaagagagcaauucuggccaggcacaguggcucacaucuguaauccuagcacuuagggaggccaaggcaagcggaucaccugaggucaggaguucaagacuagccuggccaacauagugaaaccccaucucuacuaauaaugcaaugccuggugugcaccuguaaucccagguacucaggaggcugagguaggagaauggcuugaacccaagaggcagaggcugcaguaagcggagauugcaccacugcacuccagccugggaaacagagugagacgccgucucaaaaaaaauaaauaaaaauaaaaauagguauucaacuuauugcuuaaaaauguauacaauuucuuuguaaaauuguuacugaauuuuuauuuuaauucuuuuuuuuuuuaauagagacagggucucacuauguugcccaguuuggucucaaacuccugggcucaagugauccuccugucucggucucccagagugcuagaauuacacgugugagccacugugcccagccuguuacuggauuuuucuaucauugcacuuauuuuuuaaugucuauaaaaaauuugaaagacaaauauauuaauacuuauguuuuauuuaugcuuccaaauaacuacacaaaaucacuuucuaaaagaugacucaucuaugcuuugcaauuuuucugcccaugcauuucuucucugugccaccucucuucuguguugaugauaggagaguacaguugucucucaguaccuguuagagauugguuccaagaccuucucauggauuccaaaauccacagaagcucaagccccugauacaaaauggcaucacauuugcacauaaccucuggacaucuuccgguguacuuuaaauuaucucuagauuacuuauaauaucuaauacaauguaaauguuauguaaaagauuguuauauuguauugguuagggaauaaugacaagacaaaagucuguacauguuuauuacagacacaacuauccuuuuuuuguaugaauauuuucaagccgagacugguugaauccacagaugcagaacccacagauauagagggucauauccaugcauuaauaaaaaguuuaugauuuuuacuuaaauuaaucaagaaauaguggucccauagguccuuugaauugacuugguuuggaaacauauggaaaaaauauuccuaaaaaaguauuuauaaaaaaaagagaaaaaaaaacaaaaaagaaaacuauugaaaagccgaaaaaaguuauaaaagaugagaaaaaauuaaaaauugugaguauucagauagcaauucuuaucaacaugaaauaauauaauaugguuauggcaguucaugaauagauauuugaacuauaucuuuacauaaguuaaacuguuaaaauuuauacccuuagcagaaggcaagauuccaccggaugcuacauugauuuuugagauugaacuuuaugcugugaccaaaggaccacggagcauugagacauuuaaacaaauagacauggacaaugacaggcagcucucuaaagccgagguaauucaaaccaauuucauguguauagucuaauuuuuuuaucacaguuuaaauacaucuguguuacaacuauuacuuuuuaggucuagcuagcaugggcucugaucacugcuuuuauagagcuggucacuaaaaaauaaucuaagcgcuuagaaaaagcucuaagcuuuuucaguauaaaccuugugagucauccuguucaauugccuuucucccugcaagagagucauuaaaaucccgaauuauuugucucuacagugcucuuccaguuucuagauuacacuagcauaucucuuuuucagacagcacuguaagaauuugcaacagggcaaauaauucacgccucauaggaugaugaaaagagcuagcaagggucugaauugagugggcuagaaaguugguaaacaggagccagaaguucagccagcuagcgucuguaucucagccuuguaauaaagaucuuguaauaauaaugauaauugggcugggcauguggcucaugccuauaaucucaacacuuugagaggccgaggugggaggauugcuugagcccaggaguucaagaccagccugggcaacacagggagacccccgucucuacaaaagauuuaauaaauuagccaggcaugguggugcauaccuguggucccagcuacucaggaggcugagagguaggaggaucgcuugagcccaggagguuggggcugcagugagcugugaucaugccacugcacuccagccuggaagauagacugagaccuugccuccaaaaaaaaaaaaaagauaauaauagauaacauuuauuuuauacuuuuaguaccagguacuauuuauaagcacauaaguaugugaacuuauguaaucuucaugauaguuuauggggcagacacuauugucaucaucuucgcuuuuagauggggaaaauaauaaucagguuaaucagccaaaaaucacacaguaguaaggggcaaaaccugggcaaucuggcuucaugacuguucuuacauuucaauuuuuuaaauuuuucuuagagacagggucuuucucuguugcccaugccagggugcagugaagugaucauagcucacugcacccuuaaaccccugggcucaagcgauccccgcagcaugccaccauacccagcuaauuuuuuuuuuuuuuuuaagagauggagucucacuacauugcccaggcuagucuugaacuccuggccucaagugauucuccuucuucagccucccaaagugcugggauuacaggugugaaccaucaugcccagcccacuacuauauuuuuaacuuugggccuagacugcuucuuucagagaaaaucaugaauguuucaagucuaauacuauuuauugaauucuaaugucuuacuuagucccacugacgauacuccugcuuaaaauuaguaaaccagcugucuccccucuuaacuaguuaggagacauuuaaaaauguguaacucuaccacauaaguaaguaguaaaagcuaacuagguugauuucaaguaauaaaaauaagucuuuuucucuguuucuuuuucaucucccucuccaauccuuuccccacccaguucaacuucuuacaccaggauauuaguaaugacuuucccuucaggcaucuugguuggccaacaguggaagaaggagaagggaacauguccuguucuuaagaagaagggcaguuaccgggguggcaaaugguucccaaaguguacuucucuauugacuccuuaucacccuuuuuuagagugaauagcagcugcagaugaauucgcauaguacccaagagcucagccuaugcacacagaccacucauuaucacaggcacaccaagagccacguucugcaguaugaauacuccucaguaagacauuagaugaucuuaaguucuuuucuggaaaauaaaaauagagaaaauccaaaauaguaaucuacuuaucuacaauuuccccagaugucuaugugauaucagcugcuuuauugccagauggaugagagugauuuucacuaacuugaauaacaauagcugucuuuuauugauggccauaaucauuauucuaauccucauaucaauccuacaauauagauacuuacuuaucuccuuuuacagaugacaaaacugagguucagagagguuaauuugcagaagaccacacagcaaauccaagacaaagccugaaguagaaacacgaacuaaaaaaacaaaaacaaaaacaaacaaacaaaaaacuuuauucauugucagaaagauuaaguaaacuauuucaucaguguacaggaaggaacauuuaaaaaagaaaaagaaaaacuuucuuuaauauuaauaaagacggaaaggacgggggaaauacaguauuuuauuaaauuaaaaaguggaaauaguguggaacccauuacuagcaaaauuaaggucauguucuuacccacugucuuuuuguaccucuguacuguaguuuacuggaaaaggagucaaguuuaagcaucagcaauauugguuauguaaaaauaauuugacuuacuuagaaacugagaaauauuugaagguauuaaaaauuguuuaccccuacauaggauugcuaagcuuuggcuggaagaaaaaaaugugucugccucauguaggaccaaagucccauuugagaacaguugauguauccuucauuaagguccacugauugcucuaaaauaaagucaacuugcaauggguugacccugggauauguauugcuaaaaaccucucaaacucuagcuuucaaaaauacucuugccucuauaaugccagccuuacugaacauuaccuccagaugauugugcauugcuuucuuuaguuauuauaaggauuagugcuuuccaaaggaaauacaauuguuacacauauaauuuuaaaauuuuuauagucacaucuuaaaaaguaaaaagauacaggugaaauuaauuuuaauguuauaucuucacucaauauaucuauaauauugccauuucaauaugagaucgauguaaaauuaucaaugagauaacuuuuugaagucuucaaaaucuguuauauauuuuauauuuauaguaacauaucucauuuugaucuagccauguuucaagugcucauuagucacauguggcuaguggcuacuauauuggacaauacuuuuaauguguguuugcauauagaaauuuuauauaauuagugaauacuucaggauucuuuauuugacauuauuaaagagauuauuauaguuauguagacuuggaggagagcuauagaagcauagaaaaacuuaaaauacuaaauuuuauuucaaaccccaugguuguguuuuauugauuauacaacauauucauuaguuuuagagauuauagaaaugccaauuggguuucuuucacuaauggcagucaugcgugauuuuccuuugauaauaggaacagcauggauuauuagaaagcauuuaguuucaacaaaauucaguuuaaauauuaaucuucgaguauguaccacuaaccaucuaucaucuuagggaaaacuaauuugaagaccuguuucucuccaaaacauugcuucaaagaauaagaaaaauaaaaccucaaauagcuuuucauacuguuguaucauuuacuguaaguaaucuugcacaugaguuucauuauuauaacuauuccuuaaaguuacuggaaauucacugugauaccuuuuaauuaaaggaauguuauuuuggccuuccagauaaaccucuacuugcaaagggaauuugaaaaagaugagaagccacgugacaagucauaucaggaugcaguuuuagaagauauuuuuaagaagaaugaccaugauggugauggcuucauuucucccaaggaauacaauguauaccaacacgaugaacuauagcauauuuguauuucuacuuuuuuuuuuuagcuauuuacuguacuuuauguauaaaacaaagucacuuuucuccaaguuguauuugcuauuuuuccccuaugagaagauauuuugaucuccccaauacauugauuuugguauaauaaaugugaggcuguuuugcaaacuuaa

SEQ ID NO: 13240 - RNA, 5352 nt, Homo sapiens
cuaaacucuugcuguggucacagaacucucaaauggugaagaucauuuuaaauaugcaugagacaccauguuuuuucuuccaugguuauuuuuuuuuaaggacauauauaauguuuuacuuguguauguauaucaucucaauuaugagccccuagaaauaagggauccaauuuauuucauucaguaaguuauuaguuguguacacuggaauauugguuugggugcuuaggauuagcagugaauaaaauacacgaaaauuccuacccuuauggaguuuacuuucaauugcuaggagacagaccaaaaaaauuuaaaaguguauauauauaugugugugugugugugugcguacgcacacauucucacacacauauauguauguuagaugguaaguguuauggagaaaaacaaaguagggaagggaaauagugugugcagugagggagaaagaaaggggagguugaauuacaguuauaacaaggguagucggggaagaccucaccuaaaaaaugagucaagagcugaagauggugaggaauaagccacauaggaaaagaguccuacaggcggagggaauaccaacugaaaaaaucuuguaacaagagcaugcccaaugcauucaaaagguagcaagugcuuaggagggcuggagcaggugagcaacuaggagaggaauaggaggccaggucaagaagaugacaggugggcagaucacauagggucuuguauuucauuuuaaggaguuuggcuaguauucuaaauaagaugggacaccacuggaagcuguuuuuagccaacgagcaacaggacaugauuuauuagaaucugaucagucagagaaaaacuugcuguggggcuaaggaauugggagcagggggaccaguuaggaggcuaaugcaguaauccaggugagagauaccagugacuucaaccugggugguggcaguguaaguaguaagaaaaggucagguucugguuaaaaauagagcuaagaagauuugcugauagauugaauauguggugugaaaaaggaguuagaguuuagggccugagcaaacuaguaggcuguaguugucauuaaccaaggugaaaaacucgagggugaagcaggauagggagaaagauuaugagcuuaguuuuugacagguuaaguuugaaaugccuauuaaacauccaaauggaagugcaagauuggauauacaaauuuggaauucaagaguucugggccagggauguauauuugugacacgugaguguguaguugguauuuauagcugugagaccuaugaucacucacucaagggaaugagugcugcuagagaagaaagaagcuuaggcacucccagcauuaggaggcugaggagagaugagucagcaaaguaauccaggaaggaacgcucaagaagugaaaggaaaaucaggagagugugauaaccugaaagggaaguaaaaaguuucaaggaggugggaaugaucuaccccaugagagacuacugauaagccaaauaaaauaaggaccuaaauagccauuagcaacucaggaguccuagacacuggugacuuuuauaugcaauuuuguuggagcaaugaaauuaaagcuugauugaauaaaguaacaaggaauagagaacuuggagacuccugacaauuuugcagugaaauagagaaguagggaguaguuggaguuucuuuaagaugggagaaauuacagcauguuuguauauugauaggaaagauuagagaggaggaaguggaugguguaggggaggaggagcaguguccuugaaaaaguuaucugcuacauaauuuauucaggguguuuucaaaguucugcacuaccuuggacaucugucuuucucccugacuagagcagaagcucuuugggaagugcagcauccagcacuuacagcagcauugucauucaccaaauucuugaguuccccuagauaagcaagaggggauaggaucuaguacaagugagguguuuggcccuuguugugaauuugcagaggacaugggcauaggugagauuggaggguagaugugguucguaggaaguucuuugguagcuucuacuccuccaugaaacgagauguuauuggcugaaagugagaauggggagacgacaguucauacaucugugugacccauuaauguccagcagaguaacuagucguuuguggucaaguguaaaaaugaaugauugaguugucuaucuggaugagccuuucguuuauuucauaguuaacauguuaaugaacaugcaauuaaaacauccauaucagcucgaauggcuccucuuuuucaucagguaugguuuagcaguuguuugaaucuuuagcaccuuaauuuuuguuucauucaagugauuuuccugaagucauugaagaaucuaccuugacaccaauuuuaacuagagaaauucaauuauuugcugaaaguuaauacugcuuuaaaugcuggacacaaaaauaguuacgcuguguuucccaaagaggucaucauggucuagucaggaagagggguguccaaggugaguuacacagagcuuuggaaaagccucaguggaugguguggcagaugacgucccugaguuugcuagaggaaaaaugacucuagaaaacugaguauucuucccuguucuauuuuauggaugugguggucagagaaggacauagugaccaauuucugugacccucacuuccaccauuggucccguggcaagacucaguuacaagccuucucucccuuuggauuguaccucacucaggaaguacggaauuugaagaucagauuucauuuccagaaaauccauaaggcagucacagcuuaugaccaaggcucacaccuuuuuuucugcuuaccuuucccugcuauuguccugacuucuugccucccaagauugauauguaagaaguggggccauuuuuuugcuuuucucugaaaaacuagucagcaaagagguuggaauuuuaauugguuuaacuacuuaacuuagaaagccaagaguuaaauacuuagaagugaaacuuuuuuucuuuuccugauugggucuuucugaacaauauuuuugcugugauuauugcacauuuaagcccaacuguacuuuuuaucugaaaaaaaaauaggauaugacucuuaacugucguaagcagauuacaauaauauucuuuagaacacgggugucuaaucuuuuggcaucccugggccacauuggaagaauugucuugggccacacauuaaguacacuaacacuauaacgguagcugaugagcuaaagaaauggcccaugcauaaauaucauaauguaagaaaguuuacuaauuuguguugggcugcauuuaaagccaucgugggcugcagguuggacaaguuugcuuuagaauauuucacauuuagagugguaguugcuuucuuuuuuucuuauuucugaaggaagucaugucuugauucuguucucuuccuuccacuccuacugucucauucaggcccuugguuauuccuuaucuaaaggaaucuuuuaaaaguuauccucuuguucauccaaacaacaccaacccauucuucacaccacuaucacauuaaucuucccagaguaaacuguuuaucaggacagucccugcuucaacuucagugguugucuguuguuuacugaauaaacuccacacuccacuuucugucauuacaucaguguacucccuggaugaagcagcaucuauuucaguagcagcuucggaugcauucauuuccuagugaaauaccagagucacucuuaccaggggcagcaguuccguauaucacugaaacauauuuccucagagaaagugauagugacucauugagaacauuuccuuaauucaccaacucuucuucaagguuuucuguucauaggacuacaacucuuugaugcccugacguuuuuauaauuuuacuacuagcaguugaauguauugaugcauguaaccuuguugcuagccauguuaaguuucaaucaagcaucagaaaaugguuugcuuaagauacuuggcuaggcacaccaguauuuuaaaugugaauugauauacuuggugcuucaagacagauggugcauugcuucugugccuaagagcauuuggcagugcugaaauugagccuucuguucguucaaaauaauucacugaugagugggcaacuuuauacuuuuuugaggguuuuuuuuuuuuuuuuugcugaauucgaguauuggaaguguuuuagcuuacauguuagcuauauguaaguaccuucaaaaaaugacacuacaggcauaggcaaguacauaaucgggauaaguacuguauaucaguuugacauauggugccacauguuuuuauuuuuauuauagugauauguuucuaguaagauuuacaagauauuugacccuucaacaacacggguuugaacugcacagguccacuuaauaaugcagauuuuuuuucaaaauguaucagaaaacuuuuggaaauuuguaacaauuugaaaaaacuugcaaaccauguacccuagaaauauuuuuuaaaauaguuaugucaugaaugcauaaaauauauguagauauuagucuauuuauguguuaaccuacuucguuaucagacuccugguccacuguaggcuacuacuuuuggggagucaaaagccaugugugggauuuuccacuguguggcaucaccccccuguguugcucuucaagggucaccuguuuggccacuuuggccacauuuaaacaugggcccaaacuuuucagauuuaaaguuaacagacugauguuaguuaagcucagagggaaggcuuuucaaugaagugaguuuaagagaucagagaauuuuaaaucucauguuggucaccuuuccuguuucauguuguuaauacuucuccucaggcaccuugcuaaaacagcguuuucuuauuuaaggccuggcuggacuauugccaugaauaguaucucugaagucuguauuuagagaauagcaucucugaaauccuauauauuguuaacuaaaauuagaaaucauuuguauuucuuuugacuugcagcuuguuagaggcuucuuagucauuagcuagaaauguauuuuuucucuucauguauuuucaaagaaggauuuauguaaccauguugucauuugggaggcacugaguguuaaauaucauaggaugccagaagcccacaagaagauaagaacacuccagugaggaccucugaagagaaacagcaaaagcaucuccauccugcacugaguuguggguuauuauugucauggaggugaauaaaggaugauuuaggagaugguacuauaauguggaggaaacauccagcccauuuaugguucagga

SEQ ID NO: 13241 - RNA, 113613 nt, Homo sapiens
gggcccguccggggcugcgggaagcggccucguucucagccgccggagacgccgccgccgccgccgccgccgccacaccuaguggagcagccggggaaggcggcucguugggggcuggggcggagagcgccgggggugggggcggaagggcggcgggcggaaggcaggaggcugccggggcgcgggcugcugcgggagaaggggcuccgaggaguccgccgcggcucgcucugucgccggcgcgggauuggggcgcgagggccaugggcgcgcucuccuaaggcggaggucgcgggcgggaggggaggaggcccgagagaggcugcugcgaaggccgcgggcccgugacugggcgcgaggcggccggcggcggcggcggcaccagcaccaccaugucgcgcucagugcugcagcccagucagcagaagcuggcggagaagcucaccauccucaacgaccggggcgucggcaugcucacccgccucuacaacaucaagaaggugcgcacgggccggggaggccgcggcggaggcgggcgggcccgggagggaugaagggcaagggaggccguggggugggggcggcaggaggcgccggguguagaaaucucggcgucgccgcccgaggcccggcccggggucgccuggaugcgccgcggccuaaugcggagucccgggcgccucucccugugguucgccggccggccgaaggcagagaagccauuucccggcucccggcggcgggaucgggcgcugggccucgcacggggugggggcgccgcugggagccgggagcuguccccuccucggcgcccccgcccccaugauggggcccauaggaaagggaggguggugggugggcgaaauucuagguggguaggaaaacuugaguguuccauauucuuacggagauggcagcagugaacagggauuacaccccacauccccauuuuuuggugugggaauguggguagagaagggcugauuggaugaaucccguauccccuccacuuugccacuuuauuuuagauugcuaaauaaaaagccauugagaguguguugacgauuugggauuauuucauuuugaagguggagaggagggggaagugaggguggaaccaauuuucugaaauacuucuaggcugugagucacuagaacuggaauaacaaccuucuacucuuuccccuguacuccuccucauguuagauuuuccaauaccauuucuuaaaguucggugucuguacaaaauaaaaaccguaaaaauguugcaauugcugcugauuuauagcauagucugauaauuugagcaacuauagcuaauaggcccauuuaaaggcuuuuacauguccucaguacaguaaggaguggaagaccacuggaaguuuagaaaaguccauguaaagauagaacaaauaauuacauucauuaucguaggacaaaacaacaaaaucucuccccuuaaggcaagguugguaaguuuuaaacaauuugauaaagagaaaaagagauauuuggaaaauuuagauccaucgaguuuccaaugugucuuugaugucauaccuucauaacuauuuguuggcuuuuuaauauaucgugaauguuaccguuuaguuuaaucauagcaauagauuguagguugagagggcuucugaagaaagguuuuuuuuuuuuucuuuggaaauucauuuccaagcguuugaguguaaaauugauuuauuuuuuacaauuugauguagacacuaauucuaaagaguguccugguuuaaugaugauaaauuuuggauaaggacaaagucugguugcucaccuaauugcaaggcuuuauuacucuaaacccagugcuaucuggagaguaacugcaacaugcuuacucaguuuguuaccuuuuauguggcaggagcucagugucaugacaaagaagccccucugcauuuaccaaggagccuagguuauaaauuuauauagguuaggaauaauucaguuuuaaauaguauuacuuagagguugcauugaccugaacuguucggggagauugugcugcuuaaaaaacuuggaaauugauuccuauaugaauuuuguccaaaaaugaacaagucaaauauuauaaaaguuacuagaccugugguauugugguuuaaaggaaaugguuaugaugguuucuaaaagaggaagugagaguaacaucaaaagugauuuggguauuugggcaaaauaccuuuucuaagcauuuauuaaacauuuuuguaggauaaaugcaaucaaacuuuaauaucccaccuucauaaauaagauuaaaugaaauucugggcauuugaacucuaauaauuccaguucauugccuuuucucaaaagcacuguuuuuuucacuuccuguuuugggaagcuucagccucuuguauuauugaacuugugaaaguuaaaaugcauugaaugugaucauuauuauauccaugucaaauauuuugauuuauugaaacgucauauuuuagcacuugccuuauauuuuuaguuucuuaagaaauacauugcuuaccuugcuugagugugaauuuucucugggcagggacaguguaauuuuugaaauacuagaguauuuagggccuuaucugauacucgaggccuucaguuaggccagguugaaaugaaugaauuacuucccuccucucucucaaaaccugugugcucuaguuuuaauaauaauacccuuggguuugcucccuuuguguaauuuugcauguaaaugaaucagauaagauuuuggaucuuucagccuauagaauugucugugagucuggcauaucuucccagcuggcuaggaauugaaacauuuguucaaauaucuugccaaagaagugaguaagaucuguucaccauguguuuauuagguucaugcugucugcauucuuacugcauuauaaaccacauacucuuuucaaucucaaccucuucuagucuuaaaaaaaaaaccuuccaccucauaauacauguuugccaaucaauuaucacauuuucauuaaugcaugugcauuagauugucuaccagaucuaauuacucuguuucaauuggaaguauacaguggaaaugauauuuuagugaacauauacaaugaaaaauaguuaaguaaaauaacuuauuauugucaguaauaugcuuuggcgcuuauuagggaaguuggagcaugauuacugaagaauguuuuuuuuuuuuaauuucaucagucaaaaauuuugagaucuuaauauuuacaauuuaugggaauuuuagggaacuuguaguuugacggaggauguaggaacacauaaaagcggauuuuagggaaaagacuugaagguuguugguagcuuuacauuuaaauuuauuuguugcuuaauuccuuuuuuuuuguuuuuaaauauaugguuucccuuuugcagaccuaauaaugugacucacucauguagagauuuguaacauuuuuaaagguuccagcauggcaacuugugugguggugggauuaagagcacugggccagaaguuaagagacuugcauuccaaucuucauucugucacugagaguucucuaacauugguuaguaauuugacuuucuugagcuucacuuuuccucaucuguaaaauggggaaaauuaacuguaaaaggaacacuaaagucuauuccagcucuaucuuuaugauuuuauggugaaguaguagaguagaaauuauguuucauuuuaaacaauaacugaacucaguuuaguuuucuguaauguagggagcauaaugccugcccuacauacuucacagaauugcuucugaagguagaggaugguaauaugugaaaauaguauuuaggaaucugagcaucucuuuugggcaacauuguuuuucugaaauuguauaacuguucaacaaaacugccaaauacccaaagaaaacauuuugcucaguuaaauuuuugugugugugguuuacucucuucuuuuuuuccuucuccuuucuuuuccuccaccauuaccaacaugagauuaaucucuguauuaaaaagaucuuaguuaauacuugcgucuuuuccuccuguuaaauuucugccuguacuguaaaggucagagaaugagaaaaaaaaaaaaacccauacaacuauuacaaacuuuuuaaaguggaguauuguggugguuuaaaugcaguuuuacuucuuuaaaaacauuagaggaauauuuuucuuuuuuucccuauccuuuucucauuauuuuggauaaauuuauuuucuaaggaaaaguuuaacaggacuagcauuguaaaauugaaagucuuuagccaguaucugcuuauuuagugggggaagaaaagauguuugugaagggagcagugcaggguaaagggaggggaacugguuuuagucuucccuuucaguauuguauuuguuuccacuuaggguguuauuuucucuuuuggucaaucagaugcagaagcguguuccagagaugcuuaggaaaauaauuauuuuuaauuuuuaaguagcaaugauaaauaauccaucuuuuguuuccuuuauggaauuguuaaguaacuuuaaaauuuuuuaaugauuaccagaggaauauauguuuauugucaaaaacucaaacauaacauaaaugagugacuucaaaaauucacugucugcccaucuuuauaacuuuauaagcuacugaauuguuaguuuguaaguaggguuguauaugugccaguuugaaaugauucucuuguuuuaaguagaagaacccauacuggaaaaugcuuuguuauugcauaguugacuauuuuagauaguaauaaaauugcaucuuuaaaacuguuuuauaagccaucauaugagcuauucuuucaguuacucucaaauauugagguuuucccuuuuaauuuauucauuuacucuucguuuauugaauguguucccuggcaugagggaaauagagguaaauuaagaugaagucucuagugccaagaaauuagugucuuaguggggagagagauguauagauauuuaacuaaaaugcaguguguaaguaggauugucggagucuugagaagggaauuaaggauuauaaucugggagagaugguaaagaggagagucacauuuguacuugguuuugaaguaugaauagaaacuucaggcagccagugacagaaacuaacuaguuacuauuucagauugcagaguuuuuauucaguaggauauacagaggguccccaacuugugaugguuugacuuaacaauuuguugacuucuuguuggcacaaaagcuauggcaugcaguaggaagugguaugauacuuucuugugaucugauacucugcaguguacuguauuaccagauaauuuacucaacuguagucuaauguaaguguuuaagguaggcuaggcuaaacuaugauguuagguagguuagguguguuaaaugcauuucuucucuuuuuuuggagacagggucuagcucugucauacaagcuggaguacaauggcacgaucucagcucacugcagccucugccuccuggcucaggcgauccucccaccucagccuucugaguagcugggacuauaggcacaugccaccaugccaggcuaauuuuuguauuuuuuuugauagaguugggguuucaccguguugcccaggcuggucucugucuccuggggucgagcaauccacucgcuucagccugccaaaguacugggauuacagguguaagcuaccgcaccuggcugauuuaugauauuuucaauuaaagauagguuuauuggaauguaacccuauuguuaaguugaggagcaucuguauaaagauaacaaaauacagucauucugcauaaugauauuucacauaacacugaaaugauggacugccuauacacaguagucccauaagauaacacuguauucuuacuguuuuuuuuuauguuuagauacauuuagauacaaaaauacauaccauuauguugcaauugccugcaguauucucauuguacggguuuguagcaugaaagcaguaggcuauaucccauguacccuggguguauaguaggcuauaccaucuagguuuauguaaguacgcucugauguucacacaaugaugaaaucaucugaugacauuaagcaaugcaugacuguguuagaguauaaaauaguaaugcucuucuugcaggcauauaaccucuaaacuucacuuauuuucuaaacauuuuccguacuugcagaauauucugugaguugagagagcuagauucuagauaaugcucugauacuuuuuuuuuaguuugaacaaguuauuuaacauuucugggcuguagguuacuuacaaagugaggagaucagugguuccuagccagggauacauaauagaauccucuuggaagguuuuuccaaauuccauacaucuggauccugacccaaacuuaacuugaacagaaaaaaaucccugaaauuguuccaauguuaacuacugaaauaacugaaauguaaauucuuaaauaccuguaauuucuuuuccugcuaauuauuaacuguggugauuuaauuuaguugucuggguuauaacuaaauuucuggaaggcugcacauuggcugucuacuagcaaaaccagcuccaugguacuuauuugcucucagcuucuguuaugcuucaagcuguauuuuuuggcuuucuaagccuugcuagucuuauugauucuaacucuuguaaucuuaaauagauauuccaguuaucucacguuuuuggaauacgcuuuuauuaaccucauagguuaagaggagaauuaaaugagugaauccauaggaaguauugguacagugccuuguagcaagcguaagagcugaggaaaugguggcuguuguuacuaguucuauuucuggggcuuggaacauaguggacacuuaauaaauguucauucccccccacccccagauuaaauuaagcucaagacuaccuuuuaggaaacauuccucacuauucuauuuuacugccugauacaguuugacaucuacuuacugcuaagacagaauaauuauuuguauuucagaaguauguguuccacaguaguccuuuaaauaacaauuucuuuuuaaccgcaaagguaugacaauauauauacuuuaaaaaacugcaaaaacaccuuugcuucauaaacugagaugauccuguauauuggaagcugaaaacuguuuaaaggcaacagugacauauauaucuucuuguaaauggaaugguaauuaauaacucauuugaaucacuaaauuuuuuucuuuuuuuugaaucacuaauuuugaaguguauaauggguugaaguuuuucaaguucaugacuuucucagaacuugugucuaaaggacaauaacugugauuucuauauuuuuagaucucaauuauuggcuccaauuaagagguaguuauugauaaaauuacauuaauuugaaagcauuuccaauaauuucaguauacuuuguuaucaagccucuuaauccaaguuacuagcaguagauugcucucuuuucuuuuuaccuaccuaagagggaaagugcuaacuuaaagcagaucgguuggccaaaauauacaucauaacacaggaggaaaaaaauaaucggaaagcuaacuacugaugaauuugagucuuauuuugcucuugauauaaaguuuuccaguacuuauggacaauuuucauacuguaauauuuucauuauuuaaaaaauuggaacauaaaauaaucauagguauauauuacuuuuacauuccauaauuucagguaacgucuauucuuccucuagguauuaauuucaauuuguugaaaacucagggaagaaucuuugucccuuuauuccuucaauuuugcaaaacgugugguguuucuugguuauuaagucaaauuccucuuucgagucuaaauuggccacauuuuguauuuuucuccucauccuugacauuauucagauggggcugguuucugugcccucacgaauagcauucucacucugacuccugagaucuuguucauauuuuuucaguuaauucauuguacuagaaaaucauuuuguucuucccuauuuuggcauuuuuccaauuauuguacuagaaaauaauuguucuuccauauuuuagcaaaggaauguguuuuauuccugaguuagaauagaaauuaaaaaauaaaacugaagcuaggcacaguaguagugcgugcuuguaaucccagguacuuaggaggcugaggcagaaggaucucuugagaccaggaguucaaguccagccugggcaauauagcaagaugcugucucaaaaaaauaaaauggauugaacugaucagauuuuuaccgugauagcaacugcuuccugagguuuuaagcagcggagguuuugaauaaguggagcauguuuuuaaacauuauuuuugggaggggacauauauuuuuagauaguguuuuggaaucagguaugaauuucucuguagguccugucaguaguugugaaaucuugaucaaguuacuuaauuuuucagaagcuccuuuccuuucuguugagugauaauuuagauaauuucuaaagcauagguguuuugcacacaauaauugcacaguaaauguucuuuuuacuuccaacaucuuuuguaucuugauuauuuuguuguuuuuuuuccuucucucucuuuuuuuuuuuuuuuuuuucgagucagggucucacucuugccuaggcuggaguuugcagugguugugaacagggcucacuguagacucaaccucccuggcucaagcaguccuuccaucuuagccucccagguagcugggaccacagauauuuaccaccacguuuggcuaauuuuuaaacauuuuguagagacagggucucccucuugcccaagguggucucaaacuugugggcuccagcaauucuccugccuuggccuccgcaagugcugggauugcaggugugagcuacugagcagucuuuuuuuuuuggugucuugauuguugcuuaaucucuugugaauagauagaggaauuuuaaaaaucuguauuuuuuuuuuuuggcaucaugguaaguucuuggaaaaauaguaacauuaaccauguaaaguuaagcugugguauguaauccuaugcuguaauagcuugaggaaaggccucaguauggggguuugugguagaguggcagaaagauguguuuuaaagucauacuuuaaaauggcauagggucuaggcuugauguuucuaaucaaagauguuucuuuuguggcccggauaauauauuguguaguuuucugaaacauccuuguccuucauuuuuacugauaacaucagauuuguguuuuaaaaggaacuuagagauauugaauugacuacugaccuauaguuuuuuuuuuguuucuuuugagacagaguuucacucuuguugcccaggcuggagugcaguggcgcgaucuuggcucacugcaaccugcgccuuccggguucaagcgauucuccugccucagccucccgaguagcugggauuacaggcgccagaccauaccuggcuauuuuuuuuuuuuuguauuuuuaguagaaacgggguuucaccguguuggcuaggcuggucuugaacuccugaccucgcgaucugcccaccucggccucccaaagugcugggauuacaggcgugagccacugagcccagccuagaauuguuuuuauggaaaaucuuguuuccauaauugagaacucacuauguguauccauguauauaaagaaguuuuauuuaaaaaaauauuuggaacuuauuuauuaacuacauaugugccaggcaccuaaauaaacaguuuauguguaucuuaucuuuuaaauauuuuaacaguguacccuaugcaguagguaguaauaauauccucaauuuauggguuagguaacugaggcugagagguuaggcaacuugccuaaggucauauaggcuauuaugcacuugacccaagagacaaggguuuuaauuacuauguuuaaguguauccuuuaacaucacuguaauuuuaucugucacauaaaauaauccugacuuuuaaaauauuauaauuagaauauucauggagaauaaaguuccaauucugagaacuggaaauuuaaguauauaaauauuuaaauuuauuuuagaucuucugaaauuugaaauuauaguauuuuauguuuuaugaaaauaugcugacucaagauaaaguaaaacaggguacuugggggaguuuuuguuuuuucaauucuguacuuuaugcauaguuuucuuucuguguagugaaauaccucuuuuagucaauucucugaaaaaguuuuuuuuuugguagggcuauaaaauucagggauuuagacaucauuuuacacuguauucaccuuuccuuuuuuucuauuuuugggaguaugggggauagaagugcucaaauguuuaauugaauugguaauuuguuaaaucuuuugauuacgucuuucugguaagccuuucugaaauauauuagucuaaaauguuuugauaacuaaguuuaauuguguauuuaguuuuuaaaaauuugauacuucaaaaggugauaacuuugaguuaaggauuaauuuuguguaauauuguagauguaauagaaagauauaugauuucaaguauaccaauagcaggcuguuuucugaaaaugcaaguugugauuuucuuauccucaaaaugaaaguuuuuugaguuuggguggggaauaagaugaauuuuuauaaacuauaacuucugguuauuuggaauuuucuauacuguuuuaguaugguaggaaaccuuaaaguuuuuuuaaaaauuuuuuuguagagauaggaucuugcuauguugcccaggccggucucuaguuucuguccucaagugauccucccaccugagccucccaaagugccaggauuacaguugugagccaccaugcccaaucagccuucuuaccugaauuauuuguuaugguucuuugccaggauauauuuuaccuagcugauaacuuuuagucaugucaguuuauuuuuuucauagacuucuucuuuuuugccuaaguauuccccauacaagugucucucuuguuauuaagcaaauaaaucaaguaaguggauuuuagaaaaaagauaagauggggccuaguacuucuguauguauuaaccucuuauuuuuaauuggcauuuuuugggagcucuugguaugccaaauacucucguaaagucuacagguaacacuuucauguagugaacauaaaaacuuuuuagcauagguuguaauuauuaucuguuuaacaguugaagaaacugaggcacagauagaaugacuugcucauggguacacagcuaagugauggugccaagauuuuaaacauggacagccugucuugaaacucagguucuuaacaauuagguuaaacucuguacaguuacagcaaauguagacuuuaggcuguauuuaggcuguauuuagauguuuaggcuuaaagugaauaaaggaaauauuugauugagagaggggauuguauuuaauaguugcauaaggaaguuaacacuaacuugcuaguuguauauauauauuaugauaaagacuguuacuaugauuacuauucauauuagacuuggauaauuauuaucaucauuauagcuauuauuaaaaagcagcuagcauuuuuagagcacuuaugugcuuaucauuuugcuaaaugcuuuacaugguuucuuuaucucucuucuaauccuuauaauaacccugugagguaaguacuaauuuccccauuuuacagacgaagaaacauagguuaggagauauuuuguaauauauuccaggucccauggcuaguaagucaugaaaauugaaacucagccaguuuuauuccagaauauuuguuuuuaaccuuugagacauacugccucccaauuaaguauguuagauaagguccacugagcaguguggaaaagguaaaucaauuccagggaaagcagauuauauaguccuuuauuuuuuucugaauuuuuuuuuuuuuuuuuuaguuuuuaguuuuaagagacagagcuucacucuguggcucaggcugcgguacaguggugugauuacagcucuguagccuugaauuccugaucucaagugaucuucucccucagcuucccaaguagcuaggaguacaguugugcaccaccacacccuuauaauuuuuuuuucucuuaaagcccugagcuuacuucucuacaagcuaauuuaaaacauuuuuuuguagagacagggucaugcuauguuguccaggcuggucuccaacuucuggcucaagccccuuagcccccauuucuggaauuacaggcgugagccacuggacuuggacaaaaugaaauucuguucuuucuguuuucaguguaagaaggaagagcugcucauuuauauauguguauguguguauacacacauacgcacacacauacuuguuugguuaucaaccaacgaaguuguuuauauguuuacauucuuaaacaguaaaauuugugguugugggaaauggauauggugaucugucauuuucauuauaugugauagucccuaauagaggaauggauagcuaaauuuuucaauaguuagaauaugaaagacaacacauaugaaaaaacugaacauaauuuggaaucacuuuaggauuuugcacuaccucaagcauguuuaugacacuugauuuuuauuaugugauuauguaaggcaaugcuaaucuauagcuauuuguguuugggcaaauuuuuaguaugugauuauuauucuuagcuauuauauuuggggagaagaauauaaauuggaagauuuuaagaauauuuuaaagaaaugauagucuacucaaagaaaguuggauauauuuuaauauuuaugauguugaaauggaauuuacauaguaguaaugucagucuggcuaaagauuaugaaguucuaaauuucuuaagauuuuguuuuauuuaauuauauuugagaauuaagagauuucuuacugcauuccuauuuccauuuggaaaauauaggaauguuaacauugauuuuuauacuuuggcaugguaggaaguuaggugauguuugaaaaauaguuacaauuugagcugaaauacaaaagucauccaauaacaauuuauuuuuauucucggcuaccguuucuuuuuaagguauguaaaauuucacugaugguuuugcuccuguuuuuauagcugcauguagucuuuauuuuccuucuuucuaguauuauuuuaaguugguuuagaaagagcaccaagaaacugaccugauuguacacguacacaguaguguuuauaugaacaguauaaacucuauaaauuuauuuuauacuaaaacucgcuacuuagaauaccuuuaaaauuguagcaccauauaauucuaaucuuguucuguuauucauagucugcagugcauaaguuuucuucugaaacguauaucauaguuugacaaucauuguuuacacguaauuuucucucuuuuuauuacaaugcuuccccagcaaggacaaguuuggaagguuugcaaagcuuuucaccuucccucugcccgcuugcccgcuuucagaucaguuucauguuucauaacuucucuuucugcaauccacaacauagccauaguaaacaauggaaaacuauaaaauugcaguaguguauuuccucacacauggcagacagauguaacuuuccaaaggacacauccuuuucaaaaugcaauaaaaagaaguuaaauagaaauguuauaauuuuaguaauucccuaaggaauaacaucucgcuagcaagcaguuaauuuaaugucacguaauaaaacaggaacaguauucaagauuauauucuguauuguaauaguucagguagaaaguucuuucuaauaauaauaccuuacauuuguauagugccuuacaguuuacugcagagaaugcuguacugcugauacggucaaaacguaaacauauccauuuguucugugcuuaugauauauagaacagauguagauucauuguuugaagugcugcugguaugauggaaaacaguguuguaacucagauguucagagaauaagacaacacaccuuagcacuauaaagacaauuuuagcagcuuccaguucuuuugaacuagggcucuuguauuaaaauguuuaaagugaaugaggaaaacauuuuggaaaagacauuuaaacauaagcuuuuauuuuauaacacuuagaaagaaacaugucuaguacucuacugaauauuuaauuuuguaauauuuuauuagcuucagaugaauacaauccuaccucaaaccaagaauuuuuuuucuuuuucuuuuuuuuagguuugagcuuuuuccuucacugcuguucugcgcuaacugcuucgaaacuuuccaugcauuuuuuucaguagaagaacaucucuguacugucucccauugcauauuucagcugugacaaucccugcacuuugccuauucauuuuaucaccugcucaccaaaaacaauaaauaucucuuuaauuucuaauugcagauuugcuauuuuugauuuuagaagaagggugcauuucacuuuuuuuuauuacuguuguuuuauaggcauguggagaccccaaggcaaaaccauccuaucuuaucgacaaaaaccuggaaucugcugugaaauucauagucagaaaauucccugcuguagaaacccgcaacaacaauguaaguuaucuaaauuuuucuauugcuuaauuuuaagcaucuuuuagagaaacaguggucaacacagugcuuauaguagcucuuauuuaccuaauuuuuaacauuuugauauacagauuauauaccuuaaggguuuuuuugagacaauauucuuauguccgagaccggaaaaaaauaacucuuaacgacauugccacuuuauuacagcaaagaucuuagauuacuauauauuuauucccuuucaaauugcaacaagaguaagguaauagauauguauauauuccaaauucuuguguggauacuugggauauuuuuguuucuuauagucauaaacuuccuguugaaguuaguaaaugucugcauagagcuucuguuguuuuaaguaguuagcuguauuuaguuuuaaaauguguuuguuuuucuaguauuuucauaauugacaaugauuucuaaagauuaaauaguacaaguaaaugauuguguuagggucuuuauuaucuccauauuacuuuucauaugggaaaguuuuuucuuaguauacugaagaauggucauguucagaaucuuccugauauguuuacauaucuuuauaguaauuucuaugaauaacuacuuuugggaaauuagaguuauuuuuugccucaguguggcauuuuuauauaaauuuugacucagaaucuuucugccugucuucucuuuuuauuuuuuucucugauauuuucuuguuacuaucuuugcugccucuuuugcuuuacauacaaauuuaguuuagaaauuuccucucacauaugaucuucauaauuuugagaagcucuguugaaaagauauaucgucagcugguccaaaaauagugaguuaucucaauugauuguucugcgucaguuacagauccagcuccuuguucuacucuuugcccccuucucacuacugcacuugacugguuuaaaaauaaaaagauacauugucaccuuuuuguuuucucaaaucauguauguucauugaagauuuguauuuagccuguugauacuuuugcuuaaaaacgcuuccauguagaaagaaaaugcuaguaagaacuaauacaaauaagucagauaaagugcuuuuuaaggcauuuuuuuaaacaaaaucaagucuguuuuuggggaguacagguuaguagagguuucauaaaagauuguuuuuguagagacgagaucucacuauguuguccaggcuggucuugaacuccugggcucaagggauccuucugcuucgaccucuuaaagugcuggaauuacagacaugagcugcugugcgcagccagaaauauuguuuuauaauauaucaauauauuaaagcauuauaauuaguuccugauugcaaaauaggugauucaaaacuugcacuucuuaacacuuuuguuuguguggagaacucuuuuuuaguuacugacauuaauuggcuaccucaucugagagauuauauacucacucuaaaagagagauuuuguuaugaaaaucugucuuaaauuaauuuuauauacacuucuuuuucuuacagcucauaaaauuucugacaugagcucuucagagaaucuuugaagcuuaguuuacacauguguuuguguguaaacuuauaugugagaauaugcaucguuccuuaauauuaggucuuuccuuagaauuagaaguaucuggugaaacaacaguaaaauugucuguugucagcagaccaauuaagcaucugcuguucuugauaugccgggcaaacuguuuauuaucauccuguuguuuuuuguuuuuugauaguuuuacuucucuuucuaacuuuugaagcacaaaaucgauauuuuuaauaauaguuuuauugagguauaauucacauaccauauaauucacccauucaaaguguacaguuucaguguuuuuuaaguacauucacagaguugugcauccaguaccacaguuaauuuuagaacauuuucaucaccacccaaagaaacuuugugcccauuagcagucaccccugauuuccugccaacaccccugcccuaaggcaaccacugauguacuuuuucugucucugugccuauucugaagauuucaucaggaauaauguaauauguggucuucugugacugguuucugucauuuaacguaauauuuucaagguuuauccaaguuguagcauguaucaguauuuuguuuuuguuuuaagagacaggguuucacucugucacccaggguagaaugcaguggcgccaucauagcucacuguaacaccgaacuccuagaccaaaaugauguucucaucuuagccuccuaaguagcuagggccacaggugcgcaccaccaugcucagcuauuuuuaaaaauuuuuuuuaauuuuuuauccagauguggucuggcuauguugcccagguaggucucaaacuccugggcuugagcaguccucccacuuugaccucccaaagugcugagauuacagcuguaagcugcugugcccaaucuucauuucuuuuuauugccaaauaauacuccguuguguggauauaccacauuuuauucauucaugaguugauggauguuuggauuguuucuacuuuuuugccuauuaugaauaauguugcuauaaacauuuaugugaaaguuuuuguauggauauguuuucauuucucuuggcuuuauaaaccugugaaagaauugcuggguggcgugguaauucugugcuuaaccuauaaaauugauuguacaauguuguugaauguuaugacuuacuuguaguauuuacuuuguuuuguuugcaaagccugaguuuuuucauauugccuuuacaacuauucuuuguaaugcuacucuguuguuuuuuuuaccugcugaaguacuauguauugggcauauauaaagucuugugaucucaguuuugaucugggucugcuaaaauuuuggugagaaguuccuagcuagcuuggaucaggacaugagaagugagguuucaguucuauuauuauuuuuuaacuuauugaauuaguugauggagcuuaaagacuggaaaagauaguagcgucugggauugauaggagguugcagauuucuggcuacuaagugcacuguagaagugguauugauaucagucuuuucuuucuuuuuuucuuauucuugugcuuuggauuauuauguaaauaugugaaacagaacaugcuuacuuuuucuuagggaccuagguuauuacuauuucuacucugauucaugucuuacaaguaacacaugucccccaauuucagaaaagguacucauaaaaacagauuucuggugaaaaugcaauaaauuuuuuuuucuuuuuuuucuuuuuuuuuuuuuuuugggacacgguccugcuuuauugcccaggcuggagugcaguggagcaaucucagcccacuacaaccuccaccuccuggucucaaucaauccuucugccucagccucccaaguaguuggaacuacaggggcacaaccaccacaccuggcuaacuuuuuguauauuuuguagacauggggucuugcuauguugaccaggcuggucucaaacuucugggcucaagugauccucccagauuggccucccaaagugcugggauuacaggcuugagucaccaugcccagccucaaaauauuuauuuuuugaaguuucuaaaauggauucuugcaaaauucugcccuuaucuugcagcuaaaaaauuguugauuuuuuauuuuguuuuguuuguuuuuuguuuuuuguuuuuuuuaauaacugcccucaccuccauacuuuuuaaucccuuuagaauccuugagcacauaguuauuugauaugcaacaaaggaaggcacugcugacagguagcaggacugguacacaacaugacuucuacagugaugauguuggacucuguugagucauuuuuacuuucuuguuugugaccaguuguaacaaguuuuauauuuccgauucuggguuuagggaaaaucuaggaccaaggaaugagguuuuuuccuugggucaugauguugaacuaaaugccucaugcuucagagcaagcugauuaaaugaaauucaaaaugaauaaaagccauaccaguuuuauaauuauagcagccacuuguuaucuaaugugugccagguuauguguauuaauagaguuccucauuuaauuucagauuaagccaaguauuuuugagcugaaagauuaucuaauuuaucuguaauauaaaugcuuucauuauuuugaaaguguaacucucaaaugaaauuuguuucucguagguuucuuaaggguaccuggaggggaaucuguuauuuuccuggaugaagaaaauaguagaaacuccuuucuuauuuuauuaacacauacaaauuauuuggcucaggaaaccuaaaaggcaauguaagcaaauguucagguguauguuaaaacuuuucuaauuuuuuuuccaauauuuuuuaaacuuuuuuuuucucuuuccuauauugcauuacaccuaaaagguaguuuguguuuuuuaaaacaguaaaaauauuaucuggcacaauaguguuauuauggaauuagccuauugcacauuuuaauguaaaauuuuggauuugauauccaaauuaaugaggaaaugauaaaaauuacuauccuauguaugcugaauuagaucuugaagucuuuaagaauagggacauugcuggcgaguagagugccacaggagugauauagggauucuagacuaggacacaggcuguuguugaaauaauuugaaaauuauguuuuccuaaguuauaggaaucuuuuauguuauagauauuauuuauccccucucccaaggaacauagaauuauaagauguuauguaaaacauaauuuuuuauugaaguagcuuauaaagucacucuaggaaagacaaagcaacucuaaguguaauaaucagcaguaaaguuaguucagaggcgaagcaauagagccuuuuaaaaauguuuuaucccuagugccugacacauaagaggcacuaaauaaaugucccauuaaugaauggaacuauuugauacacucuaacauaaccagcuuucacuuguauucaaacauugcuuuagauuuaugucaggaccugaacuuauccacacuuuuuaaaaguuauggaguuaauguuagcuaaaaaaagauuguacuuuuuaguagaacuauucagauauaucuuauuaaugguauuauugaaagucacccagaaauagagcaagagucucaacuccuaaaaacauaaauguguuuuagggguggggugguggaauuggugauagguguagggaggcccuugacacaugcaugcacugugguuugguaaggacuuagaaggaaacaguaggcauauuuaacuccuucuuaacuugucuuuaagagggcauuccuuguuuugucaugacuccuauuaagauaguaacauacugguuaagaggauggacucuggauucaguaaaccagaauuugaguucuggucuuuccacuuauuagcuggauaauuuugggcaaauuauuuaacaucuuaagguaucauuguucuuuuuuguuuuguuuuuuugagacggagucuugcucuguugcccaggcuggagugcaauggcauaaucuuggcucacugcaaccucugccucccgaauucaagcgauucuccugccucagcuucccgaguagcugggauuacaggugccugccaccacgcccgccuaauuuucuauuuuuaguagagacggguuucaccaugcuggccaggcuggucucaaacuccugaccucaggcaauccguccgccccagccucccaaagugcuggauuacaggcaugagccaccgcacccggccagguaucuuuauucuuauuucuaaaauggugauaauaccaaucucaaggaguaguucauuguuuccuaaagcacuuaguacagugugugacaaauugcucuugaagaauggaagcuguuaacuuaacauuuaccucuuugacuuuuuggacuacuuugcuggcuuuucuucuggguacccuuuaaauguggguuuuccuaaaugacuucuccccccauaguguauaugugugaaaacacuuacugcuguggcuucaacuaaguacauauacgaucuccuauauucugugcucuagaucaggguccccaacccccaggccacagacagguaccaguccguggccuguuaggaacccggcugcccagcaggagaugagugguaguacccuaagcuucaucuguauuuacagccacuccccaucacucacauuacugccugagcucuuucuccugucauauuagcaguggcauuagauucucauaggagugaaaacccuauugugaacugugcacacgagggaucuagguugcgagcucuugaggagaaucuaaugccugaugaucugucaccgucucccaucacccccagaugggaccaugaaauugcaggaaagcaagcucagggcuuccacugcuucuacauuaugauaaguuguguaauuauuucauuacauauuauaauguaauaauagaaauaaagugcucaauaaauguaaugugcuuuagucaccccaaaccacccuccaccccuccgccccaguacauggaaaaauugucuuccaugaaacuggucccuggugcuaaaaagguuggggacugcugcucuagagcugaauucuagcuaccccuuuggacagcuccacaagcuaaacagaaaacuuuuuauccaauauggaacaugugauuauccuaccuuuuuuucucuuuuguguuuccccccuugagcugucaccauccacuuaguuauuuaaacuacaaccuucagaaucccuuuugacuuguaaaaaauaucaaacuggucauuuacgacuuguccggguuccccacuauaaugucauuugaauuuauccccuucaggucuacauuuccugccgggacaaaugccauguuaauccaaacauugauuuguaugccauccaaucucuccuacuuucgcccucccuuccucccucccuccaaccuccaccaggggaagcagaacaaaacaaaaaacaaucacuuucucugugguaccccacaucugcaucuuccuggaccacgcacucaucuuugaaucccucuugacuggcauguaguaggccaacaaauaagaguuugguuuagaaggaaucaccuuacuguaaaauaauguaacugggaguuguaacagcaugcugggaguuguaacagcaucaugaauaaauauauaugcccuaauggaaacucaaaggaauauuuggucccgaccaauuaaacauugccaggauuuaaggaauuuugauacaaugagaauuaacugaaaugucaauguucuuuuaaaaagauaucaucaguauugaguuguuaaugacucuuagacauguaaaagucuuuaauucuaucuugaacaaacaauaaauaaaagaacuccucaggagaugcaaguaagccuugcuuugauauauuuggaaaguaauugaaauaggucaaauaguggcagggaauugcaucagcacuggugaccuaccuaaagugauuuaaauuuuuuguuuuuuauuuuugcccaaagaacaugaauacaugauaaugaauaguccagaagaauuuaggaugaaaagugaauaucuccuaguuuacuuuuucccacccuagucauauuccucagagggaacuucuauuuuuagaauuucuacagguuacugcuagaacuauaacaaauaugcuuauucccuuauaacuucaguuaccaacuuuagacagugucucuccuaugcaacaaaagaugaggauuuagcuugcucaauuuacuuccccuuacuuccccucucaagccuuuuucccaguguuuuuuguuaguauuuuuggaucauugauuacuuccuuuuuuaacuuuaauauaguuuuuuuuuuuuauauccucacccuugguuauuuauccauuuguccuuuucuucucauguugucaaaauuguuaaugcuuuuuuuuuugguucuguaauuauacaguguucugauacuauauuuauuauauguugguugaaaaaaauuaaauauuaauaaaggccuaagugcuugguuuggauuucuuuauuccauugucacacuuugggcuguaagaugaauaauauauuuagccuuaaagagaaaaggaaucucucuuccuaaauucugucauuuacuuaaaauuauuuuacaguuucauaguuauaccaugacuuucugaaauuauaguuauaagccuuuuuacuuucuuuaaauuuauuuggccuuauaaucaugucaccuuuuuauaauuuuuuuuuuuuccuggagccuacuuuccucuaaccuucugucuucuaacaucaaucuagauaauuuguaaaagccugcuguguagcuuucauuauggguuauagcuuugucuucagugugaugauuuuaccugcgcuuuuccacugaauuuucaugaguuugagaauccccuaaaguugcauauagaauuugugugugaaugaauuauuaagcuuuuuuucauauucucaagggugguucuuaugaucccaaaacacaucuauuuuaaaacaucuccuuucuuauccuuuuuauauaauuaccugugguuucagaauauuauuuugugcaucuuaugugcuauauauuuuugucauacuaaacuauauucauaaccucuucaacucaaagagacuuucugcuuuccuggaaaugaggcugccaaugagcauuacacugggguuccauagcauagccuucaaguauauacauuucuggcaucuguagucauuuuuccauacucuucaaauuuccugaaguuaugucuugccuguaagugauaguuuuucagcuuucaaacaguuguugguccauuuggcugcaguggugauuuugaugcccuucauaguagcagaggacauuaucacuaccuaaucaccuauugaccuuuaacuuugguuuccuuggucauuucuuuggggccuuuagccacuuuuaaccuuguaccuuuuaaguaccuuuagcauguuaucuucucauuguuucuucauggcagguucaguacuaccuuuugucagaucuaaaguuaauugccaagauugaaaauaacacaguaaaagcuacaauggaauaaauaacacauguugcagaguacuuacuuucuuuuauucuucguaguacucaucuuggccaagaauauuuuaaauagguacauuaauggucccuggccaagaguaugcaggcuaguauacuauguuaguucccauugucuaguguaggauagaauguagaaccuaaggaaaauauauuugcuugcuuuauuuuuuuaaaggaguguuguauuuggggaaaguauguuuauacuuucauugaacaaauggccauguuucuuuugccucgacuuuuuuuuacuaucuggaauagucucucuuucccauguucuuucacuaggcuagcuugucuuucaggucugugcuuaaaugccaccauucagagaagcuuucccugaccuuuccaaauuaguuuaaguucugcauauguauguuuccaucacauucuccacugauuauucauuuauuuauuuaaauccuuuauugagcgccuucuaugagccaaguucuguucuggaagagaggauuccagcagugaacaaacagaagucucuguucuuacagagcuuauauuauguugaacagaaauaaauaaugaacaaauaagaauauaauaccagguaaagaguucuaggaagaacaaagcaggguaaaagcauaagacuaaugccuggcagauguaauuuacuuagggugaccaggaaaggccuuacugagaagaaagcauuagggcagagauuugaagauaugagggagugaguuuagcuaggggaggagcauucugugcugaaggaaccgcagcuccaaaggcucaggugggugcaugccuggcauguucaggaacaaggagggcauuaugagcagaguagaugauugaaggggacggugguaggacaugaagugccagugguuguaaugaauaggcagaucauauagggcuuucuggaccauagugaggaccuuagcuaauuacccugaguguguugagaugccauaggaggggaguaguaggggaaugaagugauaugacugugaucacuauggcuacucgguagagaauagucugcaggagagcaaaggugaaaauagggagaauaguuaggaaauuugccaucauugagaugagagcugaugguggcuuggacuagggugguugaggugagaaauguucagauucuggauauauuuuugaagacagaaccuauaguauuugcugaugaauuggguguuggguguauggacagugagaaauaagacuuuaagguuuuuggccugaacucaugucaagauauaauggggugagagaacaggagaaauagguuugggguagugcagugggaguaguacagugaaugcagugggggaaguacucaguagcucaauauuagacguguuaaguuugagaggcuuacuggaaaucugaguggagauaucaaauagccaauuguuuauaugaauguagaucucagguuagguuuaagcugacugucaaguugaagaagauuauugagggauuugagagagagagaaaggaauggaauaaucaucuaggacaguaggaaaaugaauugacagaaaaguuugaguaguauugcuacucaguuguggucaaugaucaugaaaucagguugagaucagagucagcaaaguauaugcuuuucugcuacuguagguuuuaucagacaguuaugaaagagggagggaagggcaaggcaguaauuauaaugaugggccauuuaaaguuaagauggauaagaaaguagggggccugggcacaguggcucaugccuguaauagcacuuugggagacugaggugaguggaucacuugaggucaggaguucgagaccagccugaccaacauggugaaacccugucucuacuaaagaauacaaaaaaaaaaaaaaaauagccaggugugguggcgugcgcauguuuucccagcuacuuggggaggcugaggcacaagaaucacuugaaccugggaggcggaggcugcaguaagccgagaucaugccacuacacucugggacagagugagacucugucuaaaaaaaaaaaaaaaaaggcguaaggggaugagugacaguaaaaagaugguagagugaauggauaggaggucccucuguguugaaagaauuuguggaggcagaguauuacagauuuuaagugggaauuauucucccagugaugccaccucacuuugucuccaaaucucccaagaacaacagauguccaaaaaggccagacagaagccaggauaauuuaaacaucagcuuuauuccuguuuacaggcuugagaaaacuuaacaucagcugucaugcccucugucaguauguauucauguaccaaaaaucauucauggguaccuacucagagcagccucuccuuugacuucccuguuuugcucagcauuuucaccacucuuagaaguucugaccuuucuuauuguggucuuuaucacacuaauguguagauuuuguuuuuauuguuacccuuuucauguuauugccaguuggugaaaaccuuugucuugaagggaauaugggaauugaucauaguaguuuuucaccaucuuuaaaccuugcaccuagaaguuaaucagcuucaaaaacuggauauuuaccuuaaaaagaacaaaaaagccaaccaaaccaaaaagaaaaaacaauugggaguucccuguacacguauauacacaucccucacuagacaaugagcuuguuuagggcagggucaguacauuauucauaguuuuucucagcuucucccacaaugccugguaauauaauagguuaagauauuuguugucugaauaauauguuauuacaguaacucuucacuuaucuguacuuuucaugucacuugccucuuugaaucauaucucagaguuaggaagaaagcaauuccacuucugggacuuauccgaagagaaaugaaaauaugucuacccaaagacauguucauagcagaauuuguuauucaugauagccccgaauuggaaacaauucaaaugccuauuaacugacgaaugaauaaacaaaauguaguguguacauuuaacagaauacuacucaccaauuaaaaggaacaaacuacgauaaacgcuauaacaugaauaagugaagcuagauguaaaaagcugcauauugucugauucucuuuuauaggaaaugucuagaaaaggcaagcuuauugauaaagagagcaaaucaguaguugccuagggcuugggaguaacagcaggauuaacuguaaaugggcacaaggguuuggggugauggaaauguucuaaagcuggauagagugaauaguuucacaacucuaauuuacuaaaauuauuuuucacuuauggguaaauuucaugguaaguaaacuguaccuuaauaaagcuguaaaaaaccaaaugauuuugaacaacuagaaauguauucuagaauaaaugaaguuuauucagagaaaagcauuuugguucuccuaugaccaaacuuguugaguccgguuaggcaaaauuguaacaaguauauuuucuaacacacuguacguuaaaaggaacucucaucaggagcaaaugauaauugauagagaaauaaaaacucuuaaguauagcaggcaaggaccauuuaaugucagauuaucuuguacaagucaguagcaucugaggccaucuugacauaaauaaaucuguauaauuaucaauuacaaugaugacaucuaaucaguaagaaaagcuugauuuaugccuggucuacugguuuugaaaguaaguuaaucacauauuagaaagguuuuaaaaaauuauuaaaauugaauguaaaggaacuaaccuauuuauauuucuauuuguaauggaaaauagugccauuaagugagguaaauuguguuaucauuaaugcaaugugauacccuuuauacaaaaauguuacacuugaccaaccccacuauaccacgguauauaauuagugauuuuuguaguacugaugauaaaauuaauuucaaaguuugcuuuaauuugaccaucuauagccagaaucuuaaauuuccaaaaguuuuagcugaggcacauuaaugugcucagguggugaaauagaaauuauuuuaaucuauauugcugaacuugauauuaauugugucaguuaccuauugcugcauaacaggucaccucuaaauuucauggcuuaaaacgacagcagcuuguuucuuaugauucuguggguugacuggguaguuucucugcuggucucacugguuuuagguuaccgcagugcauuccacuggugcauucugggggaugggcccagcuggaacagcagggaugcugaagugcccuuucucuaugugauacgauaucucaggcuuccucacauacagcacgucagggcaguguuccaaaagagcaaaaucagaaguuacaagaccuugcccuggacuuagaagugacucguuguuucugcugcuuucuguuggucaaagcaagucacaaggccagccaagaugggaaggguggggaaaauagacaacagugcuuaauggaggcaguagaguucuauugcaaggaggcauggacacaaauuuuaaguuuuuuucuuugccuuucaguucuuuaauagaaaacucuuugugcauuccagaauuaauuuaaacagaagacuagcagugugaacuuagagaaacauaaccuuaauuauaaagugaaacaguugaauuagauuuuuuagaaguuuaagucuguguaauugauuauaauauaauuaaauacaaauguuuucuuuagcuugucccuacgcuacuuuuaugucauuguauagcaacuugaauguugaaguguauugaagaaguguuucaaguuuuggaaucucauagacccggauuggcaucuuacccuuuucuggucuguuucuguaucuggaaaaugaggacuaaaauguauuuugauugagaagaugaaaaccaucuggagauggauggugcugaugguugcacagcagugcaaaugugcuuaaagucacugaacggcacacuuugaaaagguuaacauggcaaauuuuaugcguauuuuaccacaauaaaaaaaguaauguaccuugaaaaaguauuaagaggauucaauuuaguauacaucuuaaacacucaguaauucaguaaugcauauuuuacuaggcuaguguuaggauaaccaaccuugcuugcuugccugcuugcuugcuugcuuccuuccuuccuuccuuccuuccuuccuuccuuccuuccuuccuuccuuccuucccuucccucuuuccugucucccccucccccucccucuuuccuccuccccucccuuccccuccccuuguugcccaggcuggaguacaauggcacaaucuuggcucacugcagccuccaccucccagguucaagugauucucuuaccucagccuccagaguagcugggaccacagguggcuaaccugccaugccggcuaauuuuuguauuuuuaguagagauggaguuucaccauguuguccaggcuggucuugaacuccugaccucaggugauccgcccaccucggccucccaaagugcugggauugcaggcgugauccuccgcaccuggccuggauacauuuuccuaaaauauauuuacuacaguuuccucagaaaaaugcauuuuugaaauauuuacugccaguauaaucacuuuguauaugaaaaaagaaauacacuacaaaagauuuuaaguaggagucuaagguucuuuuaaaacaugacuauucuuuguguuaauuagaauuuuuagguaaucuuaagagauuugcuuauauuugauaugcauaugucagucucuaugguugccacucauuucuuuuaugcuuuccuuugcuggaaggacauaaugugaaguauuuuacccaacuuuggggauuuuauucaagggauuaaaucaauuuagaaacucauuugagacaugaauuuauaccuacugucaaauucauuuauggcuagcaaugaaauuuuaaaauugguaguaucuacucucccucacugaagagaagugaggugagggaguaagcugugcucagaaauguugaagagcaccccagacaugagaaagaacaaaugcaaaggcucugcgaugggaacauacuuggugaaugcaaacacagcaggaagaccaauaugauaacuauacugagugaggguggaggagcaugaaagaagaugaggucuuagagauagacaagggcuuugauuuagacuuuauucugaggcacugguaauuauuuuuuuauucuaauugugaggugaaacuguuggaauuaaaaaaugauuuuuguauugaaauaauguuagaguuauaaaaacuuugcaaaaauaguauagagaauucaccuguauucuucacgugcuguuaaacaucuugcauaacaucaguggaaucaguuuuuuuaggguaguguguugcuuuaaaauguucacuguggcugggcgugguggcucaugccuguuaucccagcacuuugggaggccgaggcgggcggaucaccugagagguugggaguucgaggccagccugaccaacauggagaaaccccaucucuacuaaaaauauaaaauuaacugggugugcuggcgcaugcguauaaucccagcuacucgggaggcugaggcaggagaauugcuugaaccugguaacaggagguugcagugagccgagauugugccauugcacuccagccugggcaacaagagccaaacuccgucucaaaaaaaaagaaaacaaaaacaaaaaacauucacugugcugcugcuauguggagaagauugaagaggcaagaggagaaauacagagaccaguuagggugcuaccguaggaguccacaugagaguugaugacuagggugguagcugggacaguuuaggcagagauuuacccaaauagcaucucagugcacucuuacuuugagcagccuggccuagaauaucauacuaagaauuugaacaaagcauuccuugaaaccaaacuucugaauuugguuuuuuuuuaagaggaacaaaugcuagcaaaacuuagauuaagaaaaauaauuuaugaauaagcaguuucaauaacaauagaagguaauaauugaaaugagugaauaaaaacuacccacguuccuuuguauucagugguuuagcucguaggcacugauuccuuaugguaauuugccauugcuuuuucuuuggaagaaugaaauacuuuaggauuuagaauacauaauaaauuucaauuuucucgauacuuauauuuguguggaaaaugcuucuuaauugaacaaagauuaauuaccaggauuuuucaguaugaagauagguucuuugccauaagcaugccugauauuuauccuguuuauuuccaguuuuuacauauuuuacuugaauauuuagaauaaugacccauagcuagaaaguuuaaggaaagcauuauacaaauucuuugcuaaaauauuugcauguaucacaugaauaugcuuuuauaaguauuagcguauugaggccggguacaguggcucaugcuuauaaucccagcacuuugggaggccgaggcgggaggaucaccuaagauuaggaauuugagaccagccugaccgacacggugaaaccccgccucuacuaaaaauacaaagaaauuagcuggauguauggugccugccuguagucccagcuacuugggagggugaggcagaagaauugcuugaacucggaaggcagagauugcagugagccgacaucacaccacuacacuccagccugggcaauagaacaagacuccaucccaaaaauaaauaaauaaaauauuaguguagugaauagaaucaauuuuuucucacaguaguacuuuucuaauguucuguuguauaacaucaaacaauguguuaccuauguucuuaggccauuuucugcuuuuuauuuccuauaaaacaaugugauugaauuaagaaaacuugguucuagauauuaauaauuuuugguaguaucuacucucccucacuuuaggaacuaaaauguagcauuuuuuguaguugaagcaagagaguuguagacacuuuuguucuucauuguuguaguugaccucuuucacccaggcuuuauggaauuuauuuucacuaaaauggggaacgugauugcauagagauauugagaggauugugugagagaccuguaaaauguuuggaacaaucgaugccugacacauaauguaugcucaguaaauaucagcucuuauuagaaauacuauggguaauaauggggaauauuaaaguuuuauuauauuuauuuugaagaagugaucugcaagcuuccuuuguuauucacuuaauauuuaauguacagcuucuggcugugaggcauugcuacauauucuuauguacauuaucuugguuaauuguccaugucagcuuccauuucgaugaggaggguauuaggcuagagauguuaagucauuuaaccaugguugcauaauaagguaugcuuucuagcaucaccuaccaaaacauaucaucugacacugguagucuuugaaguuugucauuauaaucccuuaucugauagauguuugcauuggauacuuccuuuguccagaacuguaugauauggacuggggaaauuaaaacuugaguuugguacacugucuaauugugcuggagauagcuauaauagaagauagaaagugauagcugcuguuagacauuauacauguuuagaggagggagauguuagcauuucagggaaggagugcaaucaggugcgguuuucugaaaaugggauuagcauuuaaacuaagugcuuuaggaauagugggguugggacauguuuaaauggugggauucugacauuccaguagaggaacaguaagaaagcaggagguguguauagaaaauagugaauagauuguuuuggcuaccguauguagugugugaauacauguaggggaaauguagauuggaaaaguaaguuagggccagauuguggagggccuugaaagcuagacuguuuugaauuuaggcaucuaguaguuguuugauaaauguuuguagcuaaguagagucuaguuauauauggcuuugggggaaauaaaguugaaugagaaauguagccuaugagauuguauuaaaaagggagaugaugggcauguagaaugguagaaagaacacuuucagaaguaaagagaugagauuuccaaucuuggcucugucauuaaguaguuguaacuuuaagaagguucuuuuaaggucuguaggucuuagguucuuaauauggaaaaugagguuuguauuuaagaccauuuaaggcucauaguaagauggugaccguauuauuuauuguucagacuaggacacugaaguuggaaggaaaggggacacaauuaguaaaauuauacuagggcaacuaaaauaaauugggauuauuaagcccaauauaaaccaaauuauacccuucauaucuuacuauuaugaauguacuuucaccuguuguauuuugaaacucaaguuuaaaguacugaaaagcaggaaaaaggacuaagacaucaauucuaaauguuuaauguugucgaauaagguaauaaguauucacuuuauguuuuuggaguaguaaugauuaaaaugugcauauaaacauggaaucguucugaaacagauaauguugugcaaaauagagucagcuacucucagaugaagcuaaaaauagucacuacaaguauauaucuuaauuugucugguauuuagggguaguaaugaaauauuucauuugugaauauuuucuuuuuucuuuuuuuuuuuuugagauggagucucaucucugucacccaggcuggagugcaguggcucgaucuaagcuuacugcagccuccuccucccuaguucaagcgauucuccugucucagccuccugaguagcugggauuacaggcaugcgccaccaugcccagcuaauuuuuguauuuuuaguagagacaggguuucaccauguuggucaggcuggucucgaacugcugaccucaggugauccacccaucuuggccuuccaaagugcugggauuacaggcuugagugugaauauuuucuagauagaauuacuucuuuaaaugucuucagggagugcaauauuuagggugguuuacccuauaauaguagggucuuccagacugcugugcuugcuguuuuuuuuuuuuuuuuuuugcuugcuguuuuaaauagguuuuucguaguuaaaaauauauauauauuccucugauguuaggcucacugcuguaaauuuucugacuuaccauagugguucaguacaauuauguauggaugcaucuucccccuaacguuccugaguguaauucagaacuauauggaggccucagcauuguaugggcuuugauagcaaaucugcuauuuugagccacuuauauuuuccaguuuucucauguucugaauaaacuucucacacauuuaauguguguuuacaacaccuggguaucuuguuaaagggcagauucagauucaguagaucugagguaggccugagauucugcuuuucuaacaagcuccugaaugaugugggaguggcuauucaguaaacuauacucaagagugucaagguucuagaucauuuauuggaauucugagaaucuuauagggcauuaaaaauagcuagauucuuuuagaaauuauaucaauaguugauuuuaaaagaaaaauugggacuuuuguaaauuuaauuauacaguugauuaaaauacuauuugucuuucaacauuucccucuuucaugucuuaacucuaguuuugcuucuuucucauuucuuuuuuguuguugugguuuuugcuuuuguuuaauauauuauuguguuuucuggaucuggucagggaaccguuaccguauuuuauguuuguaucuacauuuuauuuugcaugcguaacguggcuuuaccuggauguucuuuuugguaaguuccaaauuuauauagcauauuguuuuuuuguagugugaguuguaauguuuuucaccuucuuuucucccacuucuaguaaugugaucaugcucaugacuuguuuuuaauuuuuuaagaguucauuugauacuuuuuuuccuaacacuuucagauuuuccuuaauaguagcgcaauuugguacuaauaugcuuugauuuguuuuauagccucacacugucaguugcugaucacuauuagcaguugcugucucgaguacuuugguuuuuuaaaaagccguaaucaucuagaaauauucuaaaagcuugugcuuccauauagcagucauaaaagaagauaguuuguaguaaaauuaaauacuuuuguucucuaugagcaaugcauucuaauuuuguuuuuacagcaacagcuugcacaacuacagaaagaaaaaucagagauucugaaaaaucuggcauuauauuacuucacauuuguagauguuauggaauuuaagguauguauuuuaauauauaauauuuaacacuucagaaguagauuuaaauguuuauuaauugugugaauugcugugucaguuguaaauaauaaaauugaaauucuuccagaacugaaguuuaacacauaccuuauuuguuuguguuuucugaauuuaaacagauuuauacagauaaaagauuaaaauaaguauuucuuuucaggaccauguuugugaauugcugaauacuauugacguuugccaagucuucuuugauauuguaaguaucauuuucagaaaaauguccaauuauucuguuuccagaagagcucaggggaccacuugcuuuucuuuagcuagauuauguaacuagcauauaaaguuuuagcauuauuaauuuggcuuguuuuauagcuuuuuuaaaaaguaaaguguguauucuuuuuauuuguuuugauugucacugaguauaagucuuguacauauugggaaauacacguuaacuuuaguauuuuauuuaauaggcccaauuuugaaaaguuaaguggauaauauuuucucuguaaaaggcauacuugauggacucuuucuuaguaugauaauuuuuagauacaagaagucaaagugaaaauugucuccauuuacuuaauggugaacuuuaaaaaauaauuuuuuuccucuuucgugagauuggcaccaguguuccuuauuauucuggcuuuuauucuuuugaacuguuaccaguuugaauauagugaucacaagcucuuuuucuuucauccauaaaauugugucagacacaaaacuguuaucuguaacugucaaauuuuagaugugcuuuuagugaaaggaauuagcauuuuagaacagggauaaaauaaauacagaaaauuauuagcucucaauagcuucuaugaagauuuuguguguguuuaaaauuuuaagaaauaggaaguaguugaacuugauuuuuuuuucuccuagacuguaaacuuugauuuaacaaagaacuacuuagauuuaauuauaaccuauacaacacuaaugauacugcugucucgaauugaagaaaggaaggcaaucauuggauuauacaacuaugcccaugaaaugacucauggagcaagguagauuugcauuauaaaagucuuucuaaaaugcucaguuugauggauuacaacucauugaaauuugauaugucuguuuuaagugacagagaauacccacgccuuggccagaugauuguggauuaugaaaacccuuuaaagaagaugauggaagaauuuguaccccauagcaagguaagaggcaguuguuaggcauaugagagaaugggcauauaacauagcaugaggauggaugguuggauaaagggauaaucuuguuuuugaaaaauacuauaaugggauauaaguaauaguuaugugugcuuuuaucuaauuauagacagggaacuaauuaaugagauucagaauaguguauagagacucaagaauauauugauugauuucauuauaguuuuuuagauuuuaauauagcacuaaacaauaggauuuaccauaugguauuugagagggucuguucucacacuaauggguuuuaauagcaauucugcaaauuauaguauaauauuugucgaguuacuuaacuaaccucacgauaccucaguuuucuuaucaguaaaaauggaauaauaauagcacuuauuucauaugguucuuaugagaauuaaaugaauuacuucauuaaaaaguacaguguuugauaaauuuuaacuuuauuauagucucaaaaaaugacggguuuuaugaaaauaauuugaaaugacuaucuuuuaagagauauuaaaaauaguucuuaaugaaauaaguuugguuguaaguagucuugucauuauggauucucugcagaagggcugauucacagaaugguaguuucugaacacuucaaggaaauucauagguaucuuauccagucucauuauuuauagcuaaggauuaagggcuggagcaguaucaugacaagguaagucauuugguaacaauaguggcaaaacuagaacugaagcccaggauacuagaaucuuggucuacauuguucucuuugaaucauaaaaguuaaacuauuuaccuuguguaagucugugcuuuuuucuuucuuugagacagcgucucgcucugucgccccagccggaaugcaguggugcaaucucagcucacuggagcuuccgccucccgggcucgugauucuccugccccugccucgagaguagcugggauuacaggcaugcacuaccacgccuggcuaauuuuuuuguauuuuuaguagugacaggguuucaccauauuucccaggcuggucucuaacuccugagcucaggcaauccacccaccucagcuucccgaagugcuaggauuacaggcaugagccacugugccuggccacugugcuuuuuucuuggcauacaguuaacaccaauaauuuucuuugaauuuuuuuacucccaugaaaauucugaagaauucuuuccagauuugcauagcuacauuauacacaaauuuauauagguuuucugucuuggaauugguugaaucauuaguuugcaagaagcuaguagauggcaucaguuuugaaauuuaaaaaaaucagcauuuuagauggaaguaucagaauuccucaaaauacugcacauaucauggucaucuccuaucucuaauaucaguagugguuuuuccccacccggaacugucuuuucuauuccucuccucuuuucucucuggauccauuuaggauuuuucccuaaucauguauggucuuguuuuuauuuagcuauuuuauauuugguucuuucuccacuuagguguugaaaauuuccuugacaggcucuugaaaauuccaagcuaggcucucggcuuuuuaaguucuauauaggcauuagcacauuaacaaauucaguauauaguagguuauugauaauuacauaggauaauucauuugaauuuagaccacuuauuuuccaaucuugauuuuuuucuaauauuccgugauaccuuagaauuuugauaaaacacuauuuuuuauuugccaggguuuguuuuccuguuucuuguuuagauucaugggguacacuuucagguuuguuaaaugaguauauugugugaugcuggguuugggcuucuaaugauccuguugccaaaguagugaacaugguacccaauagguaguuuuucaguucuuaucccucuccuucccacuucuggaguccccagugucuguuguuucuuuguguccauguguacccaaugcuuagcuuccccuuauaagugaguacaaucaguauuugguuuuccguuugugcauuaaaucucuuuugauaauggccuccaguuccauccauguugcugcagaaagacaugauuuuguuccuuuuuauggcugcauaguguuccguggugcauauauaccacacucucuuuauccaguccaguguugaugggcaccuggguugauuccaugucuuugcuauugugaauagagcugcagugaacauacgagugcaaguguguuuuugguagaacaguuuauuuuccuuugagcaucuacccaguaaugaaauugcuggguugaaugguaauucuauuuuugguucuuucagaagucaucaaacugcuuuccacaggguuugaauuaauuugcauuaccaccaacaguguauaagcauuuccuuuucuccaguagccuugccaacaucuguuauuuuuuugacuuuuuaauauuugccauucugacugguguaagaugguaucccauuuuaccagugguuuugauuugcaucucucugaugauuagugauguugagcauuuuuucauauguuuguugggugguuauauguauucuuuugagaaguguuuauugacguccuuugcccacauuuuaguggggugguuugauuuuuucuuguugauuuaaguuccguauagauucuggauauuaguccuauguuggguacauaguuugcaauuauuuucucccauucuguaaguugucucuuuauuuugccuuugcuauucaggcuguuuuuugguuccauauauauuuuagaauagauuuuucuaauuauaugaaaaaugacaguaauuugauuggaauaguguugaaucuuuaaacugcuuugggcauuauugucauuuuaaugauauugauuccuccaucccaugagcguagaaugcuuuuccauuuauuuguguuaucugugauuucuuucagcaccguuuucuaguucuucucuuagagagguuucaccuccuugguuagguguauagguguauuccuaguuauuuuauuuuuuuguggcuauuaguaagugggauugcuugcccuuccuuccuuccccccuuuuuuuuuuuuuuuuuuuuuuuguuggagucuuacucugucacccaggcuggagugcaguggugccaucuuggcucuuggcucacugcaacccccaccuccuggguucaagcaauucuccugccuuugcccccucaguagcugggauuacaggugccugucaccacgcccagcuaauuuuuguauuuuuaguagagaugggguuucaucauguugaccaggcuugucucaaauuccagaccucagguaaucagcccgccuuggccucccaaagugcugagauuauagguaugagccaccgugcccggccaggauuuuauucuugaguccucagcuugaauguuauuaguguauagaaauacugcuaauuuuuguauguugauuuuuguauccugagacuuugccaaagucauuuaguuuucuagguauagaauuauauugucaaugaaaagagauacuuugacuuccuuuuuuucaauuuggaugccuuuuauuucuuucucuugcuugauugcucuggcuaggacuuucaguacuauguugaauagaagugguaggaguacagacaugguaggaguacagacacccuugucuuguuccaguucuuacgggaaagcuucuagcuuuugcccauuccguauauuggcuauggguuugucauagauggcacugcuuauuuugagguguguuccuuugaugccuaguuaguugaacauuuuaucgugaagggauauuggauuuuaucgaaugcuuuuucugcaucuauugagaugaucauaugguguuuuaaaaauuuuuguuuaugugguuaaucacauuuauugauuugcuuauguggaaccaaccuugcaucccaggaauaaagcccacuugaucauggugaauuaacuuuuugauguccugcuggaugugguuugugaguauuuuguugaggauuuuugugucuauguucaucagggauauuggccuguaguuuucuuuuuuuguuguuguauuuuugcgagauuuugguaccaggaugauauuggacucauagaaugaugaggagccccucccccucaacuuuuugaaauaguuucaauaggauuguaugucugguagaguucagcugugaaucuauguggccucuggcuuuuucugguugguagguauuuuauuacugauucaauuugauuacucauuggucuguucaggauuucuguuuauuccugguuucauaaagcaaaucucaauaaauuaaaaucaugccaagcaucuucucagaccauacuggaguaaaaauagaagucaauaccaagaggaauucucaaauccacacaaauacuuggaaacuaaacaauuuuauccugaaugacuuggguagauaaugaaauuaaggcagaaauaaaaaaauucuuugaaacaaaugaaaauagcgacacaacauacugaaaccucuggaauguggcaaaagcaguguuaagaggaaaguuuauggcacuaaaacgaugauaaaaauagcucaaauuaauaaccuaaccuugcacuuacaagaacuagaaaaagaagaaugaacuaaaccuaaagccugcaaugaaaauaaauaaccaaaaucacagcagagcuaaaugaaauugagacccaaaaaccauacaaaggaucagugaaacaaaaaguuaguuuuuugaaaggauugccaauaagguugacagacucuuagcuagauuaacaaggaaaaaagagagagagaagaugcaaauaaccacaauuaaaugagaaagguaauaucacaaccaaucccacagaaauacaaaauauuaucagagacuacuaggaacaucucuguacacacaaacuagaaaaucuagaggaagugguaaauucccauaacauaacaaccucccaaauuucccaggauuuaaaaaauuacauuauuuaauuuuuaaaacauucuuaguuggcuacgucagaaucacuuuguguagcuuaauaaaaugguagauugugggguucuguuuccagagguucaguuucacuaaauuucaguuacagcccuguauucuguauucagaacagacuucucuggcauucugugugcagucagauuaaagaaucacucuuacagccaggcgugguggcucacgccuguaaucccaacacuuugggaggccgaugcaggcggaucaggaggucaggagaucgagaccauccuggcuaacacggugaaaccccgucucuacuaaaaauacaaaaauuagcugagcgugguggcgggcgccuguaguuccagcuacuccggaggcugaggcaggagaauggcgugaaccugggaggcggagcuugcagugagcugagaucgcaccacugcacuccagcuugggcaaaagagcgagacuccgucucaaaaaaaaaaagaaucacucuuuacagaauuuuuaggaagcagggauuaauagcaaaagacauuuaugaaagcaagaaagaaacaguugagaugaaacguuaaauaccuugauaauaaagcuguaaucaacaaacccguugauaaagagaaguuaaguaauuuauuaagaugagguacaguguauuauuuuuauaagacauucuuuagagaaauauaaagcauguugaguuuuauuaacacuuagucauauaacccugaagucuuuuucuuuuggaacuaucagaaacuaucagaauggaaacuugcauuggcaaaaaggugacagugggcugucuaucccuuuuggaauaaaguucccaagauugccacguauuuuaaccuuuaagaaaauaacaugaguuucugaccuaagcuuuugcucaaaaacgcagaaucuguguagcuuuuauaacguuagcaaaaaaauucuagaggagaggagccacaacccaacucagauauuauaaggagcauggguauaauuaggcuguguuguuuuaugaugguauaguuagaaacacacagcaauuauagcugcaauguaaacagaaaaggaaagaaaauuauucuucagcuuuuuuuucguauuuuaauuagucucuuucagaugcacuaauuucucuucaaaugguauauccucgaaggaaucuuucagcugaccaguggagaaaugcccaguuauugagccucaucagugcaccuaguacaaugcuuaauccagcacaguccgacacuguaugguucuauuuuucucuuuugaaugaaaauaaagugacuuuuaaaaaaauaauaguucaguaaugcuguugcuguuuguuucuaauuagcauuagcuuauuaguugaaguucauuauaaaauguucacuacuuaagucauauuguucagauuuuuuagcuuuagagucuuaaugaaaacuggugauaaauuaauauggugaauaguaugaguacuuuuuucuuuaaaguuuaaaaguuuguuuugcuuuaucaugguagaaaaauuugaaguauaaagcaaaaacaaaaaucaccccaaaucucaccaaguagaaccaaguagacaaaaucauuguuauauuccauuauauuuuuuucagucuauucucuguauuuaugaacauaggugucacacauauggagaauacacacacauagcuacugauuuuggugagacagugaguauucagacacauaaaugucuuuuaacuugacuaaaauuuuaucuuuuggaauauuguaaacuuugaaauaggcuugagaaauugauaaguugucauuuaccagauuaaagauaauuagcaacaauauuuuuuuaaagagagguuugaggguaugcagaugugaaaggggcacaccucucguuguuuauugacugcaaguuucaguauagguaauaaaacuuuuauccagcucuucaaauuuguugugguaguauuugggcgaagaauuggguaguaaguuaucaggagaaagggaggagaguggcucaauauggaauauuuuuuagaauuucuuuuaacugcaaauguauauauucucuuuuuaagaugccuugugaauaccucucuuuggaugcaauggaaaaguggauuaucuguaaguaaaauggguuaguguuaugauuacuccccaggcuuuauguuuuagagaaaaauagcaggugacaugguuacuaccucugugcuuagcauugugcuaacccaucuauguccauuaccucuuucaguccucauauugauccuaucagaguagauagccuguuuguggguuuuuuuucuuuuuuuucuuuuuuuuuugagaugaggucuugcucugucauccaggguggagugcaguggcacaaucucggcucacugcaaccuccgccuccuggguucaagcaguucucgugucucagccucccgaguagccgggacaacaggcacacgcuaccaugccuggcuaauuuuuguauuuuuaguacaggcggggguuucuccauauuggucaggcuggucucgaacuccugaccucaagugaucugcccgccucggccucccacagugcugggauuaucggugugagccacugcacccggccagguagucuauuuuaaagcuggggaaucuaaagcuuaggccacacagcuagugagugacaaagacaagauaagaacccagccuaacuccaaggcucaugggcuacguuauauugccuuucaacauaaccuucaaaacuaaauuuugguuuugcuuuuaaugauuauuuaaaugucacauccguucacuuaaaguuuuugguuuuaauucacuucaguuuaauaaauuacucguauguuuggcaguuuuuuagaugcacaggagauaaaaguacuaguuucugcuucuaagaagcuuacaaacuaugagagaaauagacacaagguuuuuguuuguuuguuuguuuuccuucguuuuauugugaacaucaagaaaguugaaauaauuguagagugaacacccauaaaucuaccaccaaguuucuaugacuucuaauagcuuguuguauuugcuuuuaagcuguuuguuuaucagcuucaaaagagauuuuauuuaaacuuuuagguucaugcauacaugugcagguuuguuauauagguaaauugcaugucauggggguuugguguacagauuauuuugucacccagguaauaagcauaguaccugauaggucguuuuuuuuaucccaaccuucaaguaggcccuggugucuauuguuccuuucuuugugcccauguauacucaguguuuagcuccccuuauaaguaagaacauguaguauuugguuuucuguuccugccuuagcuuccuaaggauaaugaccuccaucuccauccguguuacugcaaaggauaugaauucauuuauuauggcuguguacuauuccauggagacacacagguuuaauacagaaugagaauuucuguaauauagauaaauuccuccuacucaccccuaggcucacugccacaggggaauaauuuugaaguguuuguguuuuuucauucuuacagguuuuguucuugauuuauuaaccuuuagagaauagaguuggcccuuuauauccugggguucugcauccagagauucagucaacagccaauuaaaauacgggaaaaaauuucacaaagguccaaaaagcaaaacuuacugcauaaugaguauuacauugaguccacgcaaaugaagugauguguagguauuguauuagguauuacaaguaaucuggaggugauuuaaauuaugcaggaggaaguguguagguuauauguaaauacuacaccauuuuauauaaggaacuucagcauccacagauuuugguaucuguugaugguccuggaaccaauccccuacauugagagaugacuguauuuguugacuuuuuauuacaguguuucucaaacuauggugaaggacuaguuuuucuucuuuaauauuuuuuggauugauccuuuaauaaaauaaagaaaaugaauuacuagaauuaccagaaaaacaaaauaauaaagacauaaaauacaagcucauaguuuuuauuacuagauucagucuaacagauuauuaaguuucuacuccaaaaucacugugaaauauuuaugaaaauuucuaaauacccuguuccaauacuuagucucauuauggacugauacuuugaguaguguguuuuuaguaugaaagaggggaaauuuaacaauacuaucuggccguagcuauuuuuauuaauuauauuauuuuuuacauugaccagguuugugauauuuauauuuucuucuauaaagauaagugaaauuaucaugcuuugucucauaguuuauuuagaaaaacagcuuucagaguuuugaucuugcucgguugugugguaauuauuaguuguuuugugcuuauggauguacagaugaauaauugaguuaauuaguagaguuagcugucauuagugacuucuggauuuugcuucccacuggucuuuauuuuaaacgggaaugcugauggcaugaguuuguguaaugagccgguaagucgaucaggaagcaggcuccccuaauggggaauauaugggcauggagaaggcagauuugggauaaccacaguugccaaaauaaggaaugaauuuugcuucuuucauguauuugaacccugaguagagcuaaucuggagguuaggaguugccucaaauucugcacuucucuuuuuggaacuacuacccagacuaggauuuuucuucaauagguagucuacuuucuuuggaccuuuguucuggauuaguucaaagugugguuccuagaccagcaacaucagcaacaccuaggaacuucuuagaugugcagaaucuuggucccuacccaagaccuacuaaacagaaacucugcagauggaucuuaacaaucuguuuaauguacuuucucagugauucuggugcaagcuaaaguuuaagaaucacugcucuagauuauagcccgaugcuaagaguugugcaggaccuagaauauugaggacccagcacuugaaguacagauguaaaauuaauuauccugauacguauuuuaggguucauuuuugggucuguugauuggacuugggagacuccuuaggaaagauuuuuuuuccuaucuccagaguuuuggauuacuaauuucugccuuguuuuuuauauugauaguccaauuuuaucuguuuucugccuucaaagauuuucuucaacuuucuugucaagacuuggucuucuguuuuaagagcuacuuuuaaauuuuuuuuuuuuuguccuuucauccuaauuuugguaaaggagauugauguguaguuuaauuaauaagucaucccccuaaucuugggcaaucuauuuuauuuuauuuuauucuuuugagacuugagucuuuucugucacccaggcuggagugcaguggcaugaucucagcucacugcacccuccaccucccaaguucaagcguuucuccugccucacccucccauauaguugggauuauaggugcccaccaccaugcuuggcuaauuuuuguauuuuuaguagagaugggguuuucaccauguuggccaaacuggucucaaacuccugaccucaagugauccaucugucuuggccucccauaguguugggauuacaggugugagccaucaugcccagccugggcaaucuauuuuaaauucauuugccuuuuuugguccaauuuaaacaaauaaauauacuuuaacucauaacacguauguuaaaaacaaacacuuuuaacuuguaagugauaaaaauuuucagagaaacuuuguauuaguaguagcaaguauuuuguaaguguuaacguacaaagguguaagacacuaagugaaaucugauuucacuugauauuaggguggaaagucaaguacauaagaggauaauguuuuauaaacaaaauuucucuugagggcucuuuaaucuuucauacauguauucuguuucuuugauugugugccagauugaauaauuggcuuguuuuaggggcccuguuguaugaaaaauauuuuuguauaguucaagucaaagaaguuaaauauguguguaugauucuacaaaauaugccuacuuagagaguuagcuugcuucucuagugacccaagaaggaagcuugagcuaagaaucaaaagauaaauggcaaguuuuauguuaaagugucaagauaguugcacagcuauaauaggaguuuaaacaugggagugauuauugagaaucauagggaagucucaaagaaaaugggauugguuucuaacuggcccacuacagaaccuuguauauauaguagacacugaguagauguucagugaaugaaagaugaggucuuacguccuaguauggaagacuagagaggauaucagucagcauguauaaaauuauacauuuauauaggauuuccagauuagauaacaaaagguaaaaaagauauuuagaauucauauaauaaagagcaacuuaauauauugaaaguauuggacuuuaaggaugaauaauuggggcuaaguccuagcuuuauuacuuuaauaguauuuuaguaaagucauugacccuucacuucuucaacuauaagaagcauauggaccaggugcaguugcucauaccuguaaucccaguucuuggggagaaugagguggaaggauggccugagaccagaagauugagaccagccuggucaacaugacaagaccccaucucuaccaaaaagagaaaaaaaaagaaagaauaccaccugucuugucuacuacacaggauaaucauuugaaauaauauauaugagaagacuuaaugaacuauaaauugcuauuaaaaaugugaggaugcuauuaaaaugugagaugcuaugauuuauucucaugauuaggaaaguagauucucuuuauguauguaugcauauuauauauauauaaauuauauauauauauuuuuugagacagagucuugcucugucacccaggccggagugcaguggcaugaucucggcucacugcaacuucggccucccggguucaagcgacuuuccugccucagccuccugaauagcugggcgcaccaacacuccugucuaauuuuuguauuuuuaguagagacgggauuucaccauguuggucaggcuggucucgaacuccuaaccucaugauccgccugccuuggccucccaaaaugcugggauuacaggcaugagcaccuggccauuaaaaaaaaauuuuuuuugagacagggucugucacccaggcuggagugcaguggcgcaaccucgacucacugcaaccucugccuccugggcucaagcaauccucccacuucaaccucccgcagugcugggauuaaaggcauaagccacagcaccgggccccaagauaagcuuuauuuuuaaguuauuauaacaacuguaaugauuacugcauuauguuaauuagaaauuucugaucuuugguugaaaauauuuuauaaauguuauuuuuauuaaaaugacuugguucauaacccagaagugacauuuuucccguuuugucaguucagguucaaauaacugguuuugcagaauacagaaaauuauaauuggaaaagaaacguauuaccaugguuuauacauauguauuguuacugucacucagaagccucaauuuagugaucgugguuacguuucuguauuuuucaaaagcuacacugucaccaaacuuuggaauacuuguacauuuacauuuguauuugcuuucuuuuuauuuaaaguuggcuuuauuuugugccaugggauccuaaauacugacgcuacagcacugaaccuuuggaaacuagcucuucaaaguagcucuugccucucucucuuucgggaugaaguuuuccacauucacaaagcugcagaagacuuauuuguaaacauacgaggguauggcauuuucauuuauuuugucuuuuuuggagaaggguggugagugaguuaucuuuacugaaguuuuggggauaaaggaguagucacacugugcaggaagauacagccuauaccaucugacuuggaucccaggaaguuguuuuuaacagucauccugauaguuaauaaucauguuuuuuacagguaacuucacauauuaaaaaaaaacugagguuaccugaccuuucaaaacauguaauauaggagaaggaagauaugucuucuuuugcaagucauauaugauuuuagaugcaaaaguaccauauacauuuuagagguuuaaaauuuuuauaaguguuauuuuagaauaggguguacuuguaaaaguauaugaagcaauaaaaaauaguuaauuggauuaauuauaaccauuacagaauucauaucacugcauguaggaaaucauguuguuuuuauuuaaauaauaguauuccacauuauuuauuuucauuuauuuccaguucagcaaauaauuaucugaaauguguuucuuugaaauuuuuaauaacuuuauuucucuccacuugagauucuguagccaauauauaaaagccaaauugaacucagacuugguggcaauuaugaaaucuuuuaaaaauaucuaggaucugcuauacuuauguugaauauauaaguugggcuuccuagcuucagauaacagugaaauuugcuuauauuuauuucacauccaguugaauaaugacuuaaugacauugaaaugaaauaaaacuucuagauauuuuaauguauguguauaugucugacgcuaaauguaagccaauauaucccacauuuuaguguacauaagaauuaccccgaaaugcaaauugaaauccagguuccugagcaucaccucuaaccuccucuaucugugucuuggagagguuaaaggaaucugcccuuuucuucccgaguacuuuuuugagagaaaauacaaacagaaaaauacauacaucuuagcuguauaacucagugacuuugcauaugaaaacuccggcaucaucaccacuuaaaucaagauguaagaacauuuccaucaucucuggagaauucuuuugugcuucuuucuggucgguacugccaugccuaguccccacuccccccccacuccuuucucaagugacuacuauucugauuucugucaccauacugauauucuuauggcagugaucugucagucauaugauaaauagugcccuauguacuuuucagcucuuauuuuagaugguggaauacccugaaauauuaugugcaagaugggcuuugucauuuucuaauugauuuagauugaaaaucaugaaacuuuuauuaauaucauguacuagcauacugacaaacucauuguagaaucauauguaaauauauguaaacauuuaaaaccaguuagccucuguauauugagugaacuuauguauggugcaaguaaauuuaauggcauagugaaaccaguugucuuuguuaugcuuuauuaauaauaaauuuaucauuugagaaucucuguauuuaaaauuaugaguuugcauuuuuaauuuaauugugaaugaucauccaguuuaaaauaugaauuaucaucaaaccauaaguauaaaaguguauuaauuauagagggugaugauuacagaauuauuauauuuuggaaauuugcucaaagaauacauaaaucuuagaccacuuaaacauagaaguuggaguccauuuuaguguaagagauuuuuauuuauuuacuuuuuuuuuuauuuguuuuugagacaagaguuucgcucugucacccaggcugaagugcaguggugugaucucagcucacugcaaccucugccucacggcaucaagugauucuccugccucagccucccaaguaguuaggauuacaggugcccgccaccaugcccgacuaauuuuuguauuuuuaguagagaugggguuucaccauguuggccaggcuggucuugaacuccugcccucaagugauccacccaccuuggccucccaaagugcugggauuacaggugugagccaccguaccuggccauaguguaagagauuuuuagagagguugucaggaagauauuuuuucuuuaacauuuuaggaauuuugaguuuuuauaucuauuauucaugaaauuauuuauuagcauuuguuuucaugguagcaucuuuaagcugauguuaauuaaauguuuuuuuauuugaaaaauaaguuuuuuuaaaaaaauacauagcuuaaaaucauauauaguucucuuaaaauaauuugaagucggcaaaugcuuuucugccucaguuuucuccuucacaaaaccuuuuuauccaaacagucauuacuuuugaucacuaauauauauccuuucagaauuuuuucaugcuuaaagauagacuugauuaaaaagucagaaaugauagcuuugucaguacuuuagacuuuuggaaaucacuucugauguuaauuacaucagaaguauaauuucagugucuccauuggggcuuaaggaaguaauaacauuuaauaaaaugaaaaucuacauugugaaguuuaauuuuauuguuggauuuaauauaauguuacuuuuuuuuuuaggaaggcuugacuggacaucuaagugcuaggaaaaaguguggguagauucuuccaugcacuuccaguuugauggccaguuucugaauugauaaugucauuuuuaauugacuucuaguauuagacuuacucauuuugacaguuauugaucaaauuaaacuaacguucuaauuuguuuuugcaccuagcuauaauaaacguauuaaugacauaagagaaugcaaggaggcagccgugucacaugcgugaguaguuuuauuuuauccgugguagcuuuaaucaagaaaaauucuuaaagcaucauuuuguugaagugaguacagauuaauaguaugcaagauaugguaguagaagagggggacuuucagucaaugagaauuauuaaguauauugccucaauauguagaaccuuggaauuagugaagucagauuuuaaauguuuuugaaguguugauaaaaugcuauaaggaaguaucacacaaaggacucuuacuuuggguauaaucucacugccacuaugcucugcauaccaauaugauuuuuguacuacuacaugaaaauuaauauauccauauaacucuuacagauaauauuuacuuuuuuuuuuuuuuuuuugagacagucucacucugucacccaggcuggagugcagugauaccaucucggcucacugcagucuccaccucccggguucaagcaauucuccugccucagccuccugcgucacugggauuacaggcacccgccguacauucccagcuaauuuuuguauuuuuaguagagacagguuuucaccauguuggcuagacuggucuugaacuccugaccucagugaucagccugccuuggccucccaaagugcuggcauuacaggcaugagccaccgugcccggcaaauauuuacuuuuaagaguacaccucuuucccaauuuuaauuucuuauauuaguaaauauauagauauccuaagugagaaauuaguguauuuuaaaucuuugaacaacuuuccaguuuucucauaaaauaauucuaaauaauuugauauuucacuuuguuacauauaugauauacuuaauauagaauauuuucuccaguuaacuuagguacuauauacagauaauauuauuugaucuaucaguauuucuauauaaggcagagagaagacaagcaacacuccauagcgaaaacuauaaaaccacaggaaguuuuaaaauuucaguuuaggcuauaagauauugggaauuuaaaccaucuuuacucaucguaucugugcuauaucauuccucaugcauauuuuauuuacuugaaugaaguacaugugcuuaauuuuucaaaaaugauuucuagugcagauaacguacuuuggaguuuguuagaauuccucucuagacuugcagaaaugcacauaauuauuauuucuucgugggauagacgcuacuauaggcagacauauaggcauagcuaucuuuuauaaagaucuuuuacaauuaagguauuuuuauuuuccuccuucuguuuauuaaauaaaauauaaguaguaagcagugguaacuucuaggacucauuaccaugugccaggcccaaguacuuuauagacauuuucucccaauaaccaucacagacuccucacaguaauccugugaaguaaaauaaucaaaauaacauuuguucauuuucuucuuggaaaugacacgaugacuuuauuauugucaguaaaaagagcuugucauugaaauuaaaguaacagaagcacuauauaucaggcaucaugaaagauugugcaucuuuugagacagaugucaucauacuuauucuacagaugaaaaacugaaacuuagaguuggaaccuaaggucauguagggagaggauggauuuuaauuugaguccucugaaacugaucuacugugucacagcgaaauuacuagugguguguauucuuuauacuuggguuuuuggcauaggcaacacacacacacacacacacacacacaccccaaucuaaauucuaaaacuuucuuggagcaguguauauuuuguguaguaugaggaguugcuuggaacauuuuaugauuuuuuuuccuucuguuaauaugugagaauguuuucuaaucuuaauuuuaaaauaaguaguauaugaauauuuaugauuaucccuuccuuuccccaucuuucuauuuuugaacaagagugccaaguagcucucaucccaauaccuuuauugacuauagcucuuguguauucaguuuuguauauuuaauaggaauauaacuuaauaagaauauagauaaccagauacuuaaguucuauuuauuaauuucuuuauggaagugacaaaaauguauacaguuagucaguuuuugccuucaaggauuuuuuuuuuuuuuugagguggagucuugcucugucacccaggcuggagugcaguggcaugaucucagcucacugcaaccucugccuccugggcucaagugauuuuccugccucagccucccaaguagcugggauuacaggcacccaccacaccuggcuaauguuuuguauuuuuaguagagacggaguuuugucauguugcccaggcuggucucgaacuccugagcucacgcagucugcccaaguuggucucccaaagugcugggauuacaggcaugggccacugugccuggucaccaucaagaacuucauagucuauaaagugcuuaaagcuacaugguacuaaaauuggauaaauuauucauaaauaaauagcuagauguugggaaaugcuucuugaaggacuggucuugaagguuggguaggauuuugauagauggagaauaacaaaagaaacauaguuuaaaaagcaacauaagaaaggcaggauaaauguaagauuagaaacucacuuaacgauagacacauagaagaugauuuuuauaggaacuuuggcuuccuaaaaaaagacuuuggaaguugcaccuauaaugcuaguuacuuuaauugccaauaauaauuuuaguagaagcagauaaacuauuauggugucuuuccccauagugguucaaugcacagagaaagacgcaaguuuuuaagaucugcacugaaggaauuggcuacuguccucucugaucaaccuggauugcuaggucccaagguaauucauuuaauuauuauuucaauaauugugccauauuaaaauuuuaaaaaacguuucuaagugaaauuuuacugaaauuugagucagggacuacauaaaaggauuuuuauauuuaguggagaaugaauuugcugacuugacauucauacaucguaccucccugcauucuucucccuuauaugcaugcucucucucauacauacuuacagguucucuuguguccucuucuguuagucucuucacucuuuugaauugauauuaucacuucuugccaaugacuuuucacauagaaagagauuaccaguuuuguuuuuaaucuuugaauaagaauaaacacuuacuuuuuuuuaaacaggcacuuuuuguuuuuauggcauuauccuuugcccgugaugaaaucaucuggcuacuucgucaugcagauaacaugccaaagaagagugcagacgacuuuauagauaaguaaguuagcaacauuuaaaaaaauauuuucuguauauagaugcuucuugauuuacaaugggguuauguccugauagaccuauuguaaguugaaaauauuguuaaguugaaauucauuuaguacaccuauuauuacugaacauuagagcuuagccuagccuaccuucaaugugcucagaacucuuuuauuagccuacaguugggcaaaauuaucuggcaacauaguacacugaagaguauagguuguuuaucuuucugaucacauaguugacugggaacuacggcagcaucaugagagaguaucauacugccuauugcuagccuggaaaaaaagucaaaauucaaaguacaauuuguacuaaauguguaucucuucugcaccauuguaaauuagaaagauaguacauccaaaucacuguaaguugugcaccaucuauauucugauuugugggcuggggaaucuggagacuuauauuugaagcaaaauuauuuugaagagcuuggaauauuuguaauauaucauuagaugauauuaauuagacugcaaagucaaauuuaguuuuaaauuagggcuuuuauuuucucguaguaugcuuuguggugauaaaguuuuuguuuucuugcuaugcucaguaauauuucuuauggaauucauuuuuuaaaacuauuuacuacacaaaacauuuaaauaaaaauccuguuuuuagaguugcaacucagugugucauuaaaaugugucuuauuuuaguucagucucucaauaagaguuagaaaaauggagcagagaaauaagagcauacagaaaaauuuuauuucuugcuaaucuucuuuuauuugagauuuuuugaugauguauuuauaacauguccuguuuauuuuuuuaauuuaaauuuuuuuuuuuuuuuuuuuuuugagacggaguuuuacucugucacccaggcuggagugcagugaugccaucuugccuuacugcaaccucaaccuccuggguucaagugauucuccugucucagccucccaaguagcugggauuacagacacccaccaccaugcccagcuaacuuuuguauuuuuaguagagaugggauuuuaccauguuggccaggcugguuuugaaccccugaccucaugugaucagcccgcuuuggccucccaaagugcuguaauuacagucgugagccacugugcccggcccugcuuauuuucaguuuggauuuucugcugucgauuuuuagcuuuaacuuuuuuucuuucuucuuuuuuucuugcuuuccaugauuucuuuauucaugaaaugauuuaaaaaggaaguaauugacauuaaguauuaaacaaugcccuuuauaagaaaaauacuuuuagaaauaagauuaagggcaucgaauauauucuuuaauaaugaugaauuuauuauuugaauauuuuucuugaaauuuuaaaaaaggcacauugcugaauuaauauuuuacauggaagaacuuagagcacaugugaggaaauacggaccuguaaugcagagguauuacgugcaguaccuuucuggcuuugaugcuguuguccucaaugaacucgugcagguaaaaacuaucucauacuauuucccuuuuguuccuuccuucccaccuuugauaguauuuuauuuguuuguucaacaagcauuuaugaaauaucaugugccaagugauaaaucauguuuauauuuuggagaucauuaccuagaagggaagaaacaguuaguuguaguccaaugugauagguguuaugcauuaaguauauauaaagcucagaaugaacacaaggaaagacacaauuauuuauccugaagauggagguguacgcuaaccaaauuacagagggccuugggaaagaggagguuaaucauaaaucagguguacuacuuaaaaagaucacccugguucaguguggaugguagauugcugggaaccaaaugaggaggcagagagaccagaagaaaaaugacugcaguaggcuagaugagaggugaugagagucugaacaugggcaguagcuauggagauucagaagagaugauagagacaauauaauugguaauuaaguauuagagggaaaguagaauaaaaaucuuuuugaagaagauuguuagaggauggccaguaaauaaagauuucauauagacauucccauuuaaauguccaauuuuuuuuccuuaauugguuuuuagccuuuuuuugcuuuccauaauuuauuuauucaauauuuuucaucuuuauuuaaauuuaaaaaacuuuuuauuccaaauaaacugacucuaaggaaauaauauuuuauuuugcuucacuuuauagaauuacauguuucaaaugacuguaagcuaauacauaguauaaagaaaacaguuaagaauccucuuuauauaaagacuucucuaaagcugcuaguuuuccagagaaauaaccauacuuugaagaucucauuuuuuucaaaucaaccuaaaaauauaauaaggaaaaaaauuguucauguaauuuuuuuuaccuugaguuacaugcuguuacaagcuaguauucuaaacucuauaguuuauuucuucuuuuauccacuagauggagcucagauacuucuuuucuauggucauuuaaaaagggaacagaaaaccugggguauuauugccuuacuauaauuuuauuugaauaguuauuacuuaacagauaagccagaagcuuuuguuacuguuuauuauuuauucauacuagcauacaguuuaaaaaguaaaccagaauuccugaauuacuuaaucuauuuuuauauaaaguggaguuuacuaauacugagaagauuaauucuuagcauuucuucuggaauuauaguaauaguauaguaucagcagcaaucauacugauauuaguaauugccagauuuauugauaguguaucuuaccaaaucuguagaaaaccucugugagaguggauauaguuaucauuauuuguugaagaagaaaugccuuauguaauuugcuccuuaucaccaauacagcucauaaguaauaaagccaguagucaaacucaaguuuugacuccaaagccugagcauuuuaccacccucuucuguugcaaaguauauucacaauguuuuucaccauuugcuagcauauaaauuuagaacuaagguuguaaaccuguuagcauaguugauugcaauagguguuaauauuuuauugugguaaaauauauguaacaaaauuuaccauuuucaugauuuuuaaguguacaguucacucgcaucauaaaguuuuaaaaauguguuuuauuuauacuguuuguaagcuaagcauccacuuuuuaaaaggaauuuauuuuuuagcauccacuuuaaauacaguuuaucaaauauucauuuuuuaagcuagauugaaaaggauuuuuaggucuuaauuuuguugaggccuaacauacagacaacaaaaaucauucauuuuuagugcauguuguaaauuuugguagcuguaugcauuugugcaacuauuaccaucaccauauucaagacagaacuuuuccaacaccuuuaaaaguuuacuuauacacccuuaugguacaccuucaucauucuugcauaagccccugacagcaacugguguuugucauuauacuuucgccuuaaaaauacuuuuucauauaaauuuuccuauauaguguaugaaaaaauuacuuuuuaacacaaaaucauuuauuuuuuauuucuuucacuuaauguaaugguuuugagauucguguuaugguguguguuaaaauuucauuucuuuuuuauuacugaaaaauauuccauaguauggguauaccaguuuguuuauccguccacuaauugauagaccugaguuguuucccaacuauagauguuuuuaacguuacuuuuuguuuguuuuucagaaucuuucuguuugcccugaagaugaaucaaucaucauguccucuuuuguuaacacuaugacuucccuaaguguaaaacaagguaauaagccuuuuaaauaaaagcauauuuucuucuaauuagauuuucaaacuugauuauuaaggagauaauuuaccaauuaauuuggcuaaugaucuauuaucuuuuaucuuaauuuuguucucugaagcaaagauuuccaaaauggguuugugaugcuauuuacaaaaauaauaauuacaguuuuauauuucuaauuauuaagcaggaaaaaaagcauuuuguaacaaaaacaauaaaacauuugcauuuuguagcaaaucauauauuugguccaagcauaccaauaacaauauuuaaugccauuuauaaaauguuuagucugugccaggcacuuuacauauauauuaucccauuuacuccacauucuuuuuucaacacuguuauuacuuuugacagauuuggaaacucuggguuugaggguuaaccucgcaguuacugaacauaauuugccaagcucuaauagcuguuaagcaaaaguaggaauuugagcucaaaucugucaaucucaaaaauugaugucauauaaucaccuugccauuauuugacacuccauucuaguggaucgauaguguguuuuaguuuuauagucuuuuaauaaaggauaucagaaaccuugaaaacuucugaguaauaaauguauaaacauuuuucuuaguucaaucuuuauugcuaccacaucuaaguaaugaaacuaaaguaauuuuuucuggugauauuugguuuauauagaguuauuuuguggaacuucagcaugcuguccaaaguuucuauucguaggaucucucaaauucuauucaaacuccuguaaauugacauguaagcacacuaagaaucagagagcuuaggagaaaagccuuuacuucccuuagcacaacugucuccuuuaucaucaucuuuacaggauuugagaauuguuucacugucuucacucuuuaauuuuaaaauguuuuuauuuuuuaauuguaaaauacacauaaaauugaccaucuuaaccauuuuugaguguauaguucaguaguguuaaguauauucauauuguuguacaaccaaucuccaaaacauuuucaucuugcaaaacaaauucuuuuaaugauuauugaacaacagugugccauuucccuuuccugcuagccccuggcaaccuccauucaacuuucuguuucugugagcaugacugcucuagauaccucauauaaguggaaucacagaguauuugucuugcugugacuggcuaauuucacuaggcuuaauguccucaaguucagccauaguagcaugugucagaauuuccuuucuuuuuuagcagaauaauagugcaugauauuuauuuauuuuauuuuugagacccagucccgcucuguugcccaggcuggagugcugugguacaaucucggcuuacuguaaccucugccucccagguucaagcaauugucccaccuuagucucccgaguagcugggacuacaggcacgcaccaccacacccagcuaauuuuuguauuuuuaguagagaugggguuucacuacguuggccaggcuagucucaaacuccugacccuuaggugacccaccugccucggccucccaaagugcugggauuauaggcaugagacacugcucccggccuccauuguauuuagauacuacauuuuguuuauucauucaucuaucaauggaaauuuaaguugcuucuaccuuugacuguuugaauaauucuucugugaacauggguguacauauaucucuuuaagaccuuggcuuuaauuguuuuagguauacucagaaguagaauugucuuagcucuuaaaauuuaaaaugugcuuauagauugugaaaacauuaauuugcuuuguaaucuuuuuuuuuuuucuauuacuacaguugaagauggggaaguauuugauuucagaggaaugagauuagauugguuuagguuacagguaagaauaaccuuuuauugucauucuguuuuguuauuuuaguuaacaugaaaaauuuuauaacaacuauaaaauauucauuguuauauaccuauugaaaauauuucuuuuguauaauuaaccauaaaagaaacauuuuguacuaauuauuaaaguuggauaaauauauuaauaacuuaagccaauaugaguuuuugaauagauuauuauaauuuuaaaauaucuaaaaauuuaaaucccaaucucucucuugauuauccugauucaaauauuuaauucuaaagugaaagcacaaaaucuuuucugagaaaauauuuaaaaucuacugugggcaucagcaaacuuuuucuaauaaagaaacagcugcuaaaaaauuuuaggcuugcagccauauagucuccgucaucaugauugcacucugccauugcagugugagagcaccuauagacaauacauaacuuaaugggcauggcuguauuccaguaaaacuauuuauaaaaacaagcagguagcccacaggccauaguuuaccaccacgaucuguacaaaaaacuuccauuuucugaaaaacaaauaaauauuauuagacuuagaguguucauuuaauauaugucucauauaaauaguuccuaaaggcauuaagaaugcaagccuaacaccuugguguauacuguaaccuuaaugauaaaaauuaguugcccuguaaauauuuuaaguaauuaugggaaaauggcccaguguucucaauaaugugcauguuuuaaaaauccauauauuuuuaaaugauaauauagucauuugacucauugugaagucaaaacauucaguuugccccuuucccaguuucauucuccagaaauacucacuuuuaauaacuggccuauauuuuuuuagauguucaaacaaguaaauuagauaguacuauguacuguuuugcuauuuauuuuugucuuuuuaaaaaaauauuuacuuauuuauuuauguuuuagaggcagggucuugcccugucacccaggcuagagugcagugguaugguuauagcucacuguaaccucaggcucguauguucaggcagugcucccacaucagccuccugaauagcugggacuauaagugcaagccaccacacccagcuaauuaaaaaaaaauuuuagagacugaaucuugcuauguuguccaggcugaucucagacuccuggccucggugaucuucucaccucagccucccaaagugcugggauuacaggcaugagccacagugccuggccuguuuugcuguuaaaaauaaauaaauaaaauuucuauuuguuuaauuaaaaagagaaaauauaagaaguauuuuuuuguggaagccauuuuuagauggauacagucucaggaaugacucucaggaugaccauacuuuucuggcggucugcuuaguacucugaggugcuuuugcuuuucuuagguucuuuccuuccaaccucaaaaugcauaagcacuuuucucuuuuuuguucuauauucucuagggagcuuauuuuuagaaaugaagacuuuuauaaauaaaagcauuaaauaccuuaccaguuagugggagaucagggaaguacacuugaaauaccaacaucccaaaauguuaaauguguauauauuauagguuauuuucuuauuacaaauaaaguuuuaaaauugacaccucuuuguuuuuaaaaaggcaaugaaacaauacaaaaguagaacuuguaaaaaaaagaaguggaauuuccucugccaaaggauauacauguuuaaaacuuugaaagucauugucauaaagcuugaacugcuucaaucuccuguucuggguuuauaggagugccuaaaccaauacuugggcucagagaauuuuagagauuuagaugcauuucagaugcacccuuacauuugaguuauucaugugagaauuuuagccuuuuucagucacugcaaaauaaaaagcauugagugaacaugaagaauguagaccugauuauuccuauguguagauuuuuaaaguuuuuuaagauuuuuauaagagcauuauuagcuagcuaucugauuuuuuuuucauguaaucuauaccuacuuguguuaguuuccuagggcugccauaacaaaguaccaacuagauggcuuaaacaauagaaauguauuauuucauaguucugaaggcuggcagucugaaagcaagguguuggcaggguugguuuguuucaaggacugcaagggagaaccucuuccaucucucucuccuagcuucuggugauuugcugguaaucuuuguuguuccuugcuuguaguugcauuacucuaaaggcauucucccuguguuucuucacuucauuuuuccucuuugcauauuucauguucaaauuuucccuuuuuauagggcuaccaguuauauuugauuaggucccauucaaaugaccucauuuuuaugugcuuagcucuggaaagacccuaauuccaaauaaggucacauucugagguacuggggguuaggauuuaggcacaucuuuucuucggggauacaauucaaugcauaacauugcuguuaaccacguuuagaacaugcagucacucagacccuuucuacugcauacagacccuuuuuuuuuuuuuuuuuuuuuuagugacaacaggacaaugcauacaaaggaaggaaagaaugggacauaacacuaagccagagaaguguucacuagaaguagagaacaaaagugcaagguagcaggcaggguccagaaucuagaagguuuacauagguauugaaaagcagcucaaaggugaaaguuccaagccuacagauuagacuguaggauacagaagauaaaauacugagcaguauuauauaaucuguagaaaaauagcacauucaucuuuugaggauuuuauaaucuagcuauggagacaaagcauaaaaaauguaaaaaauagcagcugaaaaucugaaagauuaagagaugucauagacagaauauguuuaucaguuaauuucagucuuagaagggauaaagcauuuuucaaguuaaaauugcuuugaauaggaaaaaggaaaggacaaacaaugaguaaagagcaaguaaagagacuuuugaguauaaaggauuacuguaagaaggggaaaauauucacaagaacuaugaaugaucugccuuugaucacugaccuuugguuucagguagaagugcaagaauuguuagguaaaagcacauggccagagaguggugaagaguucuauagauagccaguagugguugaguagagcagaccagaagaguaagccuuugggagaauuuuaguaguguacuuugugccuucacugguguccuauuuaguuugguucuaaggucauugcuuuuuuauaggucacuuucaucuuucucuguccuuuuccuacucuuaagaauucucuuuguauuuuugucauucuuuucuacuuccuaagugaucucauucuguuguguauuccaucagucccuuaagcauuuuuaguugcucuuucaaauaucuucucucgucugucuucuaauuuauucaaauuguuuauauucuuuuacuuaaaccuauucuuuuuuaguaacauguuucuccccccauuguugucaagcaguuaaaucauuaucuuguuuuguuaccauccauuucuucugaauuuguuuucacaauguuauuuaaauucugauuuaauuuuuuuaauuuuaaauuuuuaugaauacauaauaguuguacauauuuauggggguacaugugauauuuugauacaagcauacaguguauaaugaacaaaucuggguagugggaauauuucaucaccucaaacacauaucaucauauuggaaacauuccaaaucuacucuucugguuauuuugaaagaugcagaaaauuauuaacuauaguugccccauugugcuauacuaguucuuauuccuccuaacuguacuuuuguacccauuaaccaauccuucuuuauucccacuuccuaccuucccuacucagcuucuuauaaccaucauacuauucucugcguccaugagaucaauuuauuuagcauccacuuaggaguaagaacaugugacauuuguuuuucugugccuggcuuauuucacuuaacauaauuucuuccaguuccgucuauguuguugcaacagacaggauuucauuuuuuauggcauaauaauauuccauuguguauauauuuaccauuuaucuauugauagacacuuggguuggguuccauaucuugacgauugugaauauugcugcaauaaacaugggagugcaaauacuucuucaguauguugauuuccucucuuuuggauauauacccagcagugugauugcuggaucuauuuucaaauuuuugaggaaccucagacacuacuguuuucaauagcggcucuacuaauucacauucccaccugcaguauaugagaguuccccugucuccacauccucguuagcauuuauuuucuguuuuuugauaauagccauuuuaacuggggugagaugaugucucauugugguuuuaauuugcauuucucugauggggagcaguuuaaaaauauaucuguuggccaccuguaugucuucuuuugagaaaugucuguuuagcucuuuugcccauuuuuaaaaucaguuuuguuuuuuuuuuuuuuuuuuuuugcuauuaagcuguuugaguuccuuauauauucugauuguuaaugccuugucuguugaauaguucguagauauuuucucucauucuauagguugucucuucacugugcugauuguuuccuucuuuguugugcaggagcuuuuuagcuuaaugugauccuauuuauccauuuuuuugcuuuuguucacuguggcuuuugaggucuaacucaagaaaucuuugaccagaccaauauucuggcauguuucaccaguguuuucuucuaguagugucauaguuucaggucuuacauuuaagucuuuaauucauuuugauuugauuuuuuuuguaugaugagagauagaggucuaguuucauuccuuuacauguggauauccaguuuucucagcacaauuuauugaagagacuguccuuuccccaauguauauucuuggcacuuuuguuggaaaugagcuaauaguaaauguguggauuuauuucuggguucuguguuccguuucauugauauuuguaucugcuuuuaugccaacaccauacuguuuugauuacuauagcuuuguaguagauuuugcgaucaguaaugugauuccuccugcuuuguacuuuuuggauuguacuuuucaggauugauuuggcucuucuaguuuuuuuuuuguuguuguuuguuccauaugaauuuuaggauuuauuuuuucuguuucuguaaagaaugucauugguauuuagauagauaguuuauugaaucuguagaucacuuugggugguauguuuagcaauaucaauucuuccaauucaugaacaugagauaucuuuuuuuuuuuuuuuuuuuuuuugagacggagucucgcucugucgcccaggcuggagugcaguggugggaucucggcucacugcaagcuccgccucccggguucacgccauucuccugccucagccucccaaguagcugggacuacaggcgcccgccacuacgcccggcuaauuuuuuguauuuuuaguagagacgggguuucaccguuuuagccgggauggucucgaucuccugaccucgugauccgcccgccucggccucccaaagugcugggauuacaggcgugagccaccgcgcccggccgauaucuuuuuaucucuuugugucuucuucaguuuccuucaucaauguuuauagcuuucauuguagagaucuuucacuuuuuguuuaaguuuguucauaggcuuuuuuuuugguaguuauuguaaaugagauuucuugauuucuuuuucaguguguuugcuguugacacauggaaaugccucugauuuuuguauguugaguuuaugucaugaaacugaauugguugaucaguuuuaauagucuuuagguuuuuguaaauauaauaucauauuuucuucagauaaggacaauuugaugacuucuuuucaaguuugcaugccuuuuauuuaugucuuuugucuaauugcuuuggccaggacuuccaguccuguguugaauaaaaguguugaaagcaggcauccuuguauuguuccaaaucucaggaaaugcuuucaguuuuccccaauucaguguauugcuagcugcggguucaucaucuauggccuuuauuguuuucuuccauaccuaguuuguuaagagguauguuuuuuuccauaccuaguuuuuuaagagcuauguuuucuucccuaccuaguuuguuaagaguuuuuauuaugaagagauguugaauuuuauugaaugcauuuucagcaucuauuaaaauuauacaguuuuguccuuaugugcauauguugaaccaucuuguauuuaucuaacuggaucaugaucuguucaguguguuguugaauucugugugcuaguauuuuguucagcauuuuugcaucuauguucguaagugaugauggccuguaguuucuuuucguguaguuuugugucuuugucugguuuugguaucaggguaaugcuggccucauagaaugaguauuugaaaguauuccuuccuccucaauuauuuggaacaguuugaguagaauugguauuaguucuuuaaauauuugcuggaauucagcagugaaaccaucaggucccaggcuuuucucucaugggagacuuuuuauuacugcuucuaucucauuacuuauuacugguccuuucagguuuucuguuucuucuugguaggauguaugugucuaggaauguauccauuucaugucgguuuuccaguucuuugacauauaguugcucauaaucucuaauccuuggaaguuuuugguaucaguuguaaugucuccuuuucuauuucugauuuuuuuggggucuucuuucuuuuuuucuuaauuuagcuaaagauuugucaauuuuauuuuuccaaagaacuaacuuuuuauuuuguugaucuuuuguauucuuuuuagucugaauuuucuuuauuucugcuccgaucuuuauuacuuaucuccuucugcuaacuuuggauuugguuuauucuugcuuuucuaguucuuuaagguacauuauuagguuauuuggucuuucuacuuuauuaauauagguguuuauugcuauaaacuuuccucuuacuacugcuuuugcuguaucccauagguuuugguauaucguguuucuguuuuuauuucuuucaauaaauguuuuauuuccuuaauuucuacauuguucaggagcauauuguuuaauuuccauauguuaguuuccgaaguuaaagguacauuauuagguuauuuggucuuucuacuuuauuaauaugaguguuuauugcuauaaacuuuccucuuaacuacuguuuuugcuguauuucauagguuuugguauaucguguuucuauuuuuaauguguuucaauaaauuuuuuauuuccuuaauuucuacauuguucaggagcauauuguuuaauuuccauguguuaguuucugaaguuccucuuguugauuucuaguuuuauugcacuguggucagagaagauacuugauaugauuucaauuuuuugaauuuguugaacuuuguuuuguggccuaacauauggucucuccuggagacuaucccauguucugaugagaagaauaaauucugcuuuuuaaaaaugugggacaguuaauggaacucuuuauugaauucauggccacagcuauagcuaauuccuguuuauacucuaaagcugauaaaugguaaguaaaacuccuuaggcuuaguuugugauaaaugucaaguauauuuugucaucagaauauugacaucauucuaccucauuccuucuucuuuucugguagacaaaaacaacaaaauacaaaagucuccuuuguggugucacugucucauugaauaguaacaucauccaccuauuggucccuugccaugguaggguuugagguuuaauuuuuauccuacuuacaaggugauaauuuacucucuuacuauuucauggaugcuggcaagaagauauggagcuccugggucagugacaaaagacaaaagacuucauucacugcacagaaagcagcauaggcaucagcauauaugcauuauuucugcuauuucccuaagcucugcaggugugguacagaggagccaaaaugaauucugugcaugcagucuguuuguguugcagauaaggaacacuaaauuugaggaacccucuauuuuaucaucagcuguaagcauacuugcucuuuguuccaagggagacauuaccucaucccucaaauuugauagcugcaaauauaacccuaagaaauggccuagagaaugaguggcucaggcuuugccuucuugacauacccagcaaggugugugggagcaugagacccaugcaggaguaucucccaacagccaaaauccugaccaucaucuauaauucuguuucccacuauaucuaauuauuucccagaguaaacucuuuuaaacuaccauuacucaaaaccagaccauuguaaugccgucuuauugccacuacugccuucuaauagauuucugcuuccuuucccuucccagucaugcuucccuauuuuccucacuauacagaguaaucuuucuaaaacaaaaacuggccaccacauagaacccuuagugcuucacuaaaaaguuuaaauucuuuaacgugguauacaggcuguucaccaucugguugaaucucauguuuuacuauuucccuucucuucuuugcacucaaacucuagccguaacaaacaguacuuauucuguaggcaucccuucuauucuuauucucugcccuucugaaaugugcccuauccauggacaugaucugcuuuuugugauuugguaucccaguuguagaauuuuuuuccccacaaccuaucuuaaugauuuucguuuaguucuaucacuuuuuuggccaaacuacaccaauuuuuacuaucuucaguacuuuucuagaauuugucaaauuaauacaguguauuauaugauccaguuuuuagugaaucaguauacucuaaaaccucauugaaucaacaugugcaguacuuaguuuuaucugauugcuuccuguguguguuuugucucuuaaauuaggucgaagauuucuuuugguaugguuaauaugacaauuaauuguuuuacacuuuugauauuuuaacuucaguuccuuugagguucagugugaaugacucauauauuagacacuguuuuauggacauuaguauuucaguuuacuaaauaaauucuugauaggaauuucaagguagggucacuacagacaacuaacacaguagauguuacugucagugucacaguagauaguuuaaguaucuuucagugaugcuuuucccccuguaaaaugacaaguccgaagucauuuauguuuaccugaacuacuuuuuuuuuuuuguacuuuauaggcauauacuagugucucaaaggcuucacuuggccuugcagaucacagagaacuuggaaagaugaugaauacaauaauuuuucauacaaaaaugguagauuccuugguggaaauguugguggaaacaucagaucucuccauauuuugguauguuguaauuuucucuaaaucuggauuugaaaguuuuaguaugcgauauauguuucuugauuauuuuuguguuagcauaguccuuaagacaguucaguaauagauccuuaagaauaaagggaauaguggacuuuuauuaaaaugugccaacaaaaagaaguuuaaccaaguugggauuuuaugucuguuuuuaauucucuaaaagagcaacuuacugaugugacuuuuauuucuuacauuuuuuugaggaguugaaaacagucacuccaaauuaccuuaaggcccuucuuugcaugauuagacuaaagggaaagaaauguuguagaucaaggucaaauagagcaaguguuggaaauuaaaugccugguaacuucacuucuaugauguaaaauuaaacauuaauaugaagaugauguggugacuaccuccugcauugugcuucauucucuuuuucuguuagagucuuuuuguuauacuuaguuuauuuuucuucccucucuuccucccagaaaaugugguccuuaauggcuauaauuuguuuuguuagugucugucauaguaguuauuuaauaaaucuuugaaugaauaagucaacuuaguugugaucagauugauaaacagugugguggccaggcgcgguggcucacgccuauaaucccaacacuugggaggccgaggugggugaaucaccugaggucaggaguuugagaccagccuggucaacauagugaaaccccaucucuacugaaaauagaaaaauuagucggacgugguggugugugccuguagucccagcuacuugggaggcuugaagcaggagaaucgccugaaccugggaggcggagguugcagugagccaagaucacgccacugcacuccagucucggugacagagugagacugucucauaaauaaauaaauacauaacagugggguuaggauucaaaaucaagaauucucgccucaagcuauauaauaucaacucuauuuucugcuucuuggcccuuuauuuuccuuuagggaagaggacuggaauaaccuaguaugucucuugauuucuaaaaugcugaaaugaucucaguggauagugauaguaguuucuauguaugggauagagaucaucaugaaaagcuucucacugcauuuauuuuggaaaauaguauaaucuguguugauuuuggcaguuuguuaggaaagcuugaauuagcaguauugcagaagaaauucaaaucaccagguagagaaaccaugccucuuaaaggaaauaaugaaacacauuaggaaguauacuuuuuagauuuaggcacaucacaggucaaauuugcaagaauuuuuaagauuauguggagcccaggacuacugucugucuggcacaaagucuaccuuagguagaacaugaaacauuauauguuuagauauuuucagcuaugcaaaggauccuauuccaaaagaagaauacaacaauuagaaagucauauccccuuucuuggaacuaaaagcacuuugaauaauguuugaaauuuguaauuuucagucauaccugaauuuuauuuauauuuuuucauaguugcauucuauuuuugccugucacauccaaaauaaagaaauguuuacuacuucuguuugucuuauuacucuaagauauguaguguuuuauugacucacauucuuuuacauuuagauuuaacaucuuuaaauguggaugcaaauuaaaacugcuggcaggcugggugccauggcucacacccgcaauuucagcaccaugggaggccgagauggaggauugcuugagcccaagagguuaaggaugcagugaacugugauugugccacugcauuccagccugggcaacaaagugucccccgucuaaaaaaaguuaaaaaaaaaaauaaaauugauggcgugugauuauuuaauuggcaauguuuuuuuuuucuuagugguucauaaaauauuucucucuuuuuuuaauuuauuuuuuaaaaauagagacaggguuucaccacauugcccaggcuggucucaaacuccugggcuccagugauccaccugccuuggccucccaaagugcugagauuauaggugugagccaccacacccagccauaauaaugguauuuuuuccuauuuauagugacuuagcuuugaugaaauuugauuauguaagaggccauagauuaugguuuauuauuuuuuaaaauguuguuauuguuauauaaauaauauuuuuauuacucugggauaauuauugguguguaaaagauacuuugggggaaaaauauucucuucuuaaaucagugcuaccaguuaucauucauucacuugaaucaaauuaacuguaagguacuauaucagaaaacuuacuuuaaauguaaaaauugugauucugauuuuuguuuauauaguuuuuauagucgugcuuuugagaagauguuucaacaguguuuggaguuacccucucaaucaagauacucaauugcauuuccacuacuuugcacucauuuuaugaguugcacgcaugaacuauguccagaagagguaauuauaguguacuacugugaguuauaugguaugcaaaguaaacuagaucaaaccuguagccaaccaaauauuuacagucauaauuagcuaacuuagcuucccaucgaauacaucucuaugcagaaucagaaaagugcuugaacagauacauagguuuaauauauauauagauaaauaaacauaaguauaauaagaacauaccauaaagucacuuggaauuaccuuuuuuaagauaaauggugggucagguauuaauaucuguggaaaagauuuauauaguaauugauuuuguauacuuaauuuuccucuuaaacugucauggaaaggacucgaaaauuaaauuuauggauuacugaauaagcauaaacaagucaaagagagauucacuaacuuauuauuacuaaauuguuaauaaauauauuaagcaaaauccagauuuugugauacuugugggauacauacaugcaugugcauacacacacacaguugcagaguaauugaacugcuugguaguuuuguugaugccaaguaucugugaaaaauguacucaguguuucuucuaaucuuuaaagaagaaauauuuucuaugugauaaaaauauaaagauuaaauaauguauuucuuuauuauaauuuaacuuaguguuuagucccuuuacuuaaaauugcagaacuuguagaaaagaaacuuagagauagcaggaacauggucaguuucuuuaagcauuagacaacaucuguugcagauuguaugccaguauuccaggggaagccaacuuugagacagaaguuagcuuacaggaaguuuauuagggaauacuuucagaauuucuaccuaugaggauauuaauaccacgaauuuuaauagauuuaugaauuuuuuagauuuaauagauuuuuuucucccaaacuugacaccugagauguauuauuaacuguuugcucaccaucaaauuucuuuucauuaaauuacccauaaaauccuucuaauuuuauuuauaugucaugucuugaauccauccucuacuuuccauugcuauugucauuauuacaguucagauuuacgauacucuucauauguacucuaaauggaguucaucuuugccuggauuaccuaaguggucucuuugcuucugccauuguucuccuaaacuuuauucuuggcaccguagccaaaggcagaggucagauaauagagagauuuguaugacauguuaaaccuuaguuuuucuccaucucagcauuucugagcuguugaaacggaguagugaaaucagauuuguauuuuaaguaaguuaguaucuguaaagaacaaauuugagcagucuuaauucaguauucuuuuuucaggaagaauuaauagcagaagauuuaugucuuucagaagucagaauuugauuaaacaaaacacuguuuauuaauugaaaucuuuccuaaggugaaccaauauuuaauuauaucagguuguaaaucuuuuuuuugauuugacuuucuauuaaaguuuuacagggcauuuuaaauaaaauacguuagauauaauagaucuaggaaaaguuauuuucuaugcucaaguauuuuuauauuuuauguauuuuacacuuauuucaucauauaaauacuguauguaagcucuacauauaugauuauggaaggucagggcaggaaaacuguuaaaaauuuuauuucuuuguaaaguauuagaaauguguagugcaaaaauuuacaguguuuuauacucaacauuccaguuaccauagauaagaaaaaaacaaucaaacgauugcagcccacuaaaacuaaaaagagaauccuguagagauggaugcaugaucagcguuuuuuuuuuuuuucuuccugggagcaauaggguuugauuuuagagauuugaaugccuuggacuuucuauuaccaaauugauuucucaccauuuuauuuaaacauuugagcucuucuuuccuguuuauacaaaguuaugccacaauuuauacauuuauagagacacagauuuuaaaugaaauaagauuggaaacaguacucuaaaucuguuugcuuucacauuauauguuuaauauuuuaacauuuaagaacuggauauaggacuuuguggaauuugaaaauuaaauacauaguuuuucauguuaagcaaaauacugauuuuucaagacuccucccaguuauacauugcuuucacaaucaccaaauacuuugucauuuauguucaaauacaguauggugaguuaguuguuacaagaggcaaaagcaauuuuuaacaucucccacccucacuauugcggaauguaccuuuagccuaauuuuccaugucuauuuagaagucuuuuuaauucaacguacuuucuuuauaacuuguauuauuauuauuauucugccuucacagcgacaucauauuggagaucgcagucuuuccuuauguaauauguuccuagaugaaauggccaaacaagcucgaaaucucaucacugauauuugcacagaacaguguacccuuagugaccagguaaugauuuaaguguuuccaacagauaggaaauuuugugugaaggcaagaaaaugugcuuuuagccaguuguuguuuuacuuuccauucuuuaguucccacacuauuaguaaaccucaaaccucugcugugaaacuccauuaacagguauaauuucuuagauguaaacuuucuggcaagacuguacguacuguuuguguucuuuaaucaggagucacguguaguuuuuacauguguguaguguuagcaccugauucugcuauuucuugaaaguugcaaaagaacuggaauuaagcauauuuggugauuuucaauccacuguacuuauaauucagauugaagcucagauugccccgucauuggcuagugggaguccuuuuuuuuuucuuuccaacuuuaagcaucuauuuauuuauuuauuuauuuuuuauuauacuuuaaguuuuaggguacaugugcacaacgugcagguuaguuacauagguauacauacgccauguuggugugcugcacccauuaacucgucauuuaacauuagguauaucuccuaaugcuaucccuccccaauuuccccaccccacaacaggccccagugugugauguuccccuuccuguguccauguguucucauuguucaauucccaccuaugagugagaacauguggugguugguuuuuuguccuugcgauaguuugcugagaaugaugguuuccagcuucacccaugucccuacaaaggacaugaacucauuuuuuauggccgcauaguauuccaugguguauaugugccacauuuucuuaauccagucuaucauuguuggaccuuuggguugguuccaagucuuugcuauugugaauagugcugcaauagacauacgugugcaugugucuuuauagcagcauguuuuauaauccuuuggguauauacccaguaaugggauggcugggucaaaugguauuucuaguucuagauccuugaggaaucgccacacugacuuccacaaugguugaacuaguuuacagucccaccaacaguguaaaaguguuccuauuucuccacaucuucuccagcaccuguugcuuucugacuuuuuaaugaucgccauucuaacugguguaagaugguaucucauuguuguuuuugauuugcauuucucugauggccagugaugaugagcauuuuuucaugugucuuuuggcugcauaaaugucuucuucugagaagugucuguuuauauccuucagccacuuuuugaugggguuguuuguuuuucuuguauauuuguuugaguucauuguagauucuggauauuagcccuuugucagaugaguagauuguaaaaauuuucucccauucuuuagguugccuguucacucugaugguaguuucuuuugcugugcagaagcucuuuaguuuaauuagaucccauuugucaauuuuggcuuuuguugcuauugcuuuugguguuuuagacaugaagucuuugcccaugcuuauguccugaaugguauugccuagguuuucuucuagaguuuuuaugguuuuaggucuaacauguaagucuuuaauccaucuugaauuaacuuuuguauaagguguaaggaagggauccaguuucagcuuucuacauauggcuagccaguuuucccagcaccauuuauuaaauagggaaucauuuccccauugcuuguuuuucucagguuugucaaagaucagaugguuguagauaugcggcauuauuucugagggcuuuguucuguuccauuggucuauaucucuguuuugguaccaguaccaugcuguuuugguuacuguagccuuguaauauaguuugaagucagguagcgugaugccuccggcuuuguucuuuuggcuuaggauugacuuggcaaugcgggcucuuuuuugguuccauaugaacuuuaaaguaguuuuuuccaauucugugaagaaagucauugguagcuugauggggauggcauugaaucuauaaauuaccuugggcaguguagccauuuucacgauauugauucuuccuacccaugagcauggaauguucuuccauuuguuuguauccucuuuuauuucauugagcagugauuuguaguucuccuugaagagguccuucacgucccuuguaaguuggauuccuaggcauuuuauucucuuugaagcaauugugaaugggaguucacucaugauuuggcucucugucuguuauugguguauaagaaugcuugugauuuuugcacauugauuuuguauccugagacuuugcugaaguugccuaucagcuugagauuuugggcugagacaaugggguuuucuagauauacaaucauguccccugcaaacagugacaauuugacuuucucuuuuccuaauugaaugcgcuuuauuuccuucuccugccugauugcccuggccagaacuuccaacacuguguugaauaggaguggugagagagggcaucccugucuugugcugguuuucaaagggagugcuuccaguuuuugcccauucaguauaauauuggcuguggguuugucauagauggcuguuauuauuuugagauacauccuaucaauaccuaauuuauugagaguuuuuagcauaaagggcuguugaauuuugucaaaggccuuuugugcaucuguugagauaaucaugugguuuuugucguugguucuguuuauaugcuggauuacauuuauugauuugcauauguugaaccagccuugcaucccagggaugaagcccggcuugugggaguccuuauagucauuugagagcuuucuuguuaucuggugugacaagauguaccagccuuucuaguagcucugucucuugugaagaguguuauagagauucaacacucuggucucuuuaauauuguugaaguugcaaauguccguagaaauuuucauuuuaggaaggaacuccuuugucacaauagaaaugcaauguaauuucuuaugcauuuuuuuccccaaauaccaaucccauggcuuuaguuacuaucuagguauaaugacuaaauaacuuuccuuggcccagcucuguccaauggagauacuauguaaaccacauauguaauuuaaaauuuuguaguagccauacacaaaacuuagaaagaaacagguaaagcuaauuuuaaaaacaaugauucaacccuauauaccccaaaauguuauuaugucagcauguaaucauaugaaugaaauauuguauaguuuuuauuauacuaaaucuuugaaaucugguguuuaucuuauaacacagcugaauuuggacugggcacauuucacauguggcuacuguaauguacagugaagcucuccuucuaccuaaaauguuauuucuuauuucucauuugccugcuuuguuaccugucaagugaaaucaauuauuucugauuuguaccugugugguuuuuuuguuuuaauuauuggucuuaacaauguguuagguagaaaccucugugucauacuugauuccugcuucucucacacaucuaaguuacugaauccuuucaauuuuaucucagaagucugucucagaucugcccauuaaaauuuuuuuauuacacuugccuauuucauaucccuuuuucaugccuugucugaacuauuucuagcagcucuguuacaauuuuccuuuuucaguguuuucuucugccaauaucagaguuauccuuagaaaauuaccucuucauggccaggcaugguggcucacgcuuguaaucccagcacuuugggaggccgaggcagguggaucuccugaggucaggaguucgagaccagccuggccaacauggcgaaaccccaucucuacuaaaaauauacaaauaaaauuagcugggugugguggcagucgacuguagucccagcagcucaggaggcugaggcaggagaacccaggaggcagagguugcagugagcugagauugugccauugcauuccagccugggcaacaagagugaaacuccuucucaaaagaaaagaaaagaaaagaaaaugucuccucaugcuguggcuauuuuaaaaaauugucgcugucuuuuugccugcaguuuacaauccaaccucuagcuuggcauucaaggcccuuccuaauaguugaaaccucuguacuuuaccuuacacguuaugcuccaccacauaguaguucuaacuacagcucugaaccaucauaucuuuacacaguuuuuuuccaaaggccauuuaauccuuccagugaaauauucuuuuucauuccuugcuugccugguauguuuuuacuugucuuuuuaauaguaauuuaaauaagcgucuaugaauuuacucuaugacguguuucuucacacaagauuuacccaagaucuacccguuucuguuuucaccaagcuaugugcauuacccaagcuagcuaaguaagcucuguaucucacuuauauuucugucuuuuaauauuguugugauauuugcaacacagccuggauucagcuacuguuugcuugaauaguuaguaugcuuucagaguaauugguguaauguaagauuucauucuuuucuaaauuuaguugcuacccaagcauugugccaaaacuaucagucaagcagugaauaagaaaucaaaaaagcagacugguaagaaaggggaaccugaaagggagaaaccagguguugagagcaugaggaaaaacaggcugguugugaccaaguaaguauccacuuauauuauaccuuuuugcuccagguaaaauauuuauuucauuuuuuucuauugacauuaguacugaggaaaugcuaauaauuguauauucuucauuuuccagccauuuuaaaaaauauuucugagcuuaauuaaccuguuaguugcuuauuucaucucaaaauacagauuuuggccuuuagaagaaaauauauguaauaguugauauuugucuuuuuauacuaaguacugaaggccaauuauauguuuaaaaaauuuuguguguuacauuauaagcaaucuguaauuuuuaauuuauuuaaaguuagauaguggagacuuuauuuuggcauguuuuugauauauuagaacauacccaaugucauuauuauaaaacagaaauaacagaccagguagcauucagggaucuuugcuugcuucauuguuuggaggggagguguagguggguaauaauucgguaaauauuuuuuguuuaaaguauaguuccuacuuucuugcuaaauugagcaagccauugcccuuuuauagacaacuuuccuucucucauaacagaaaguacuucaggaauugggcgugauuaucuuuaugagugcagaauaagcucuaccuuuguauauuaagucaguauauucauuacuaccuaaagguagaaacaaaugacgccaucuuuagaauauugcucuuauguguuaguuauaaccuuaaagauuuugaacuuucucaguuuaggagaauaaaaagucgaauucucuaagcauuaucuccaaauaagguugauauauuuauaaaauuaauuuuguauugccugugaugacaugugaacauuuuaacuguuuauuaauuuuuuucagccuugauaaauugcacacugcacuuucugaguuaugcuucucuauaaauuauguaccaaacauggugguaugggaacauaccuuuaccccacgagaauauuugacuucucaucuggaaauacgcuuuaccaaguaagaaagaauauugacuguuuuuguuuguugacucaguaaugaguuuguuauuuaauuauacaguguuuuauaaggaaaagcauuaguagaacuggauuaguguuaagaauaaugaaccgggccgggcgugguggcucacgccuauaaucccagcacuuugggaggccgaggugggcagaucacgaggucaggagaucgagaccauccuggcuaacacagugaaaccccgucucuacuaaaaauacaaaaaauuagcugggcgugguggugggcaccuguagucccagcuacucgggaggcugaggcaagauaauggcgugaacccgggagacacacuugcagugagccaagaucaugccacugcacuccagccugggugacagaacaagacucugucucaagaauaaugaacugggaaaugcaaagaauagugaacugaaaauuacugaagauacccagauucuuuucucauaccuauuaguauuaacuaguaacaccaggcaaaccaguuaauaucucugagucauagcuuccuuauauacaaagugagaauauuggagcaaaucaauguauuucaucuugcagguggcaacccaguagguucaugaaaucaguuuauuagguuguagucaaaguuuagagaaaagugggagggaaagaaaggacaagaggaagaaaaaauaggaaaaaaaacccaguacacugugugcauuaaauauauauauugcuucgugaaauguuucaguuacauguaugcauguguauugacuugcaguguuaagaugcgugucaugcaguaggucacaguaaaauguuugaagaccugaggacuagaugaacccuuacauguuuucugaauucacauguugcuguuaaauaagccaauagaauucuagauucuugaauucucaauucuaauuagaauuuccuguuauauaugaauauauauuuuauguauguauaugaaauagugcauugauaagucagaaaccuuucaacuuuauauauauuguuuuaaccuuuuucugaaguuacauccuuauuuauuaauauuuauucaugaaaauuuuuauuuauuugacaauuuuuuucuucaaagccuugaagcaauuuauaaaacaaaauuuugccaaaagguuuucaaaguuucuguagucauuaacaggugguguuuguauuugcacuauaugcuuaacaauguguuaaguacucuagguaauaaugagauaaagauagaacuguagcuggugagaugacuaaaagaauuagagaacagaauaugacaguauauaaaguggcacuaaguugaguguuaaauuaucaguugacuugagaagagucuggugaugaacugucuuuuguucuccuuaguaagucaggcauccugacaguaaaacccagaaugcccuagaacuuagaccaaaggggcauugugccuugugguguuuauuauucucaaguggguuagaggugggacauugguggguggaagggagaguucaguguacagcucccuuguuuuccuuguaaacagucugcuuuguuaauccacagagaagcaguuuuuuuuuuaaccaaacaucuacuuagugauuaggaucaaggcaaggggaacagcuuguuuaccuuggaaagauuuuuuauuuuauuuaauuuauuuauuuauuuauuuugagacggaguuuuguucuuucguccaggcuggagugcaguggcacaaucucagcucacugcaaccuccaucucccaaguucaagcaauucuccugccucagccucccgaguagcugggacuacaggcgugugccacugugccugguuaauuuuuguauuuuuaguagagacgggguuucgccauauuggccagccagauagcuugugaauauuaguggguugguuuuugucaaucaacugagcacagucuuaggacuuagggauuauacacuaggauagcaguuuucaucuugcguuggcucuucuuggccuguuucuagugaugggauuugucgguugucuuuuaaggauucauccuuacaaauacaagucuaagaucuuuacagaucuaaugcucagggaguuuuaaagaaagugaaauagggguggucaguguaggauaagaucauuuagggaaguauuuucaaaauuuguguuuccuuuuuagucguauacaguuucuugagauauaaacagaacuguuuuauaugcuaugagugauuaaagaaaauaaaguuguuuguugccuuauuuuguuugacugucauacaguuuguuuagaggcagcacuaagucaggcagaucugcggucaaauccuagucauaaccacuucccaacaaaaccuuaucaauuuaugugaguccugagcuuuauuuuuuuccucugggagauauagugauaaguacauuguagguguuuauuaaaugugaggauuguagguaauuuauauaaagccucaaaaacuacuggcaccuaacagugucaaauaaauucaagcuguagacuaaauaguucacuguccuugcuacaaacaacuuaccauguuaaagcaauuuguaaaacccucuuuauacuuaaaucacuuuuguuacugguauacuuagaauguuuuuaaucauuuuauucacauuucguuguaguuuuuaaguuuucuuuuuucuuuuuuuuuuaagacagucucacucuguugcccaggcuggagugcaguggugcaaucucagcucacugcaaccucugccugcuggguucaagcgauucuccugucucaaccucccaaguagccaggauuacaggcaugugccaggcccagcuaauuuuuguauuuuuaguggagacaaggauucaccauguuggccaggauggucucgaacuccugacuucaagucaucugcccgccucguccucccaaaaugcugggauuacaauaggcgugaaccaccaugcccggccuucauucuuuuuuuacgcuguuuccugggaagauaaugacaguaauuuuacagcuuuguaauaaauuauuuuuaaaguuaauuuuauugcuuguuuaauauuagauaacaguagguugagugguuuauuuuacaugaauggaaaagucagaggcuuuucuuauucuucuaucccuucuucccaggucaauuguugggaugacuauguauaaucaagccacacaggaaauugcaaaaccuucagaacuucuaacaaguguaagagcauacaugaccguacuccagucaauagaaaacuaugugcagauugauauuacaagaguauuuaauaaugugcuucuucaacaaacacaacauuuagacagucauggagagccaaccauuacaagucuauacacaaauugguaaggaaugcauuuagaaauuuguaguagcggaaaauuuguaaugaaguacuuaggaaaauuaauuuuuuugugaauaaguacuuauucauauuaucagucaacuuaaaauuauaugcaggaauguauaucaugauacauucugaauuaagcaguuucuuccgguuauaaguuuacguuucuccuuagguauuuggaaacuuuguuacgacaagucagcaauggccauauagcauauuuuccugcaaugaaagcguuugugaacuuaccuacagaaaaugaauuaacauucaaugcagaggaauauucugacauaucaggugaauaguacuauaccacaguuuagagaaugaagaacacuuaauucuuuugcuagugucuugauucuuuagacuuuugauucuguugugacuauuucauucaauuauaugcguaacugcauauuguaucuuagaauuacuuuugcauuuuguauucucucuuucacucuagagacuuuuaucaggauuuuacauuaguuuuuauaaugagauguuguauuguguuaauguucauuuucuuaaaguauuugcucugucggaaguauaaaauuaaguauguuuucuuucagaaaugaggucauuaucagaacuacuaggcccauaugguaugaaguuucuaagugaaagccuuauguggcauauuucaucacaaguugcugaacuuaagguaauauagucuuuauuaauuuuagcuuuuaaacauuaauuccugaaaaacauuucagggauaugagcaacaagccuacaauguuaauuauuuuaauccaacaugaaaguacuaauaugaaaaugaaaauuaaauagcuagcaaggccuuuuuauggcaucuuaguuuaguuuucucuauuuuguaggugagaaaauggaaagcgaaaauaggugaauugacuugguaaaggggacagaaccucagagucuuuggcuuguggucaggccuucauaguauugaaucaugauguuuucuuugaaauaccagcuucaaaauuccagccaaaguuaacaauuuguucacacuugcgguuugaauguauuugcuuuccauagauuauaauacaaaaauuacugggcuuauugcuuuuucuuagguaaucuuuuaaauuaucuuaugcccucuaaguugaaugaaaaaugccuucagaaugcuuaauguuucaguaaagauguaaaggaacugaagcaacaacauuuuaaauaccuuuuuauuagccuuuuagaaauauccuacagcuacggugauuuauauuaaacgaaucuguauauauaauaacuauguaguuuuugaaagaauuugaacuugggccaccaaaacuuuugaacuuacaagcagaauagagaaaucauguuuuaaaauaaacauuuucuucguaaaagcuuuuuggugguuacuugagucuugauauuuuaguuuuuguuuguuuguuuuuuuuuuuuuuuugagauggagucucacuguguugcccaggcugcaguacaguggcacaaucucaacucacugcaacuuccaccuccgaaguagcugggacuacaggcacgcaccaccaagccuggcuuauuuuuguauuuuuaguagagacgguguuucaccguguuggccaggcuggucucgaacuccugaccucaagagauccacccaccucggccucccaaagugcugggauuacaggcaugagccaccgugccuggccaauuuuuaguuucuuaagaaaaugauagacgguagugguaaguagcuuacaguucagauguagcacauagaguucuaaaugugguuaaucugauuuacugaaaauugagcaaauauauagaacaaguuaauuuccacaaacuuaauaguauuuugcugagugaauaaauagcaagagucagugugacuaaaagcuuaguauaaucaaagauuuaaggagaggcaauauuacccauugguuaagaacucaagcuuucagccaggcgugguggcucaugccuguaauccagcacuuugggaggccgaggugggggauugccugaaguuaggaguucaagaccagccuggccaacauggugaaauccccccucuacugaaaauacaaaaauuagcugggugugguggugggcacuuguaaucccagcuacuagggaggcugaggcaggagaaucacuugaacccgggaggcggagguugcaguaagcugagaucacaccacugcacucaagccugcaugacagagugagacucugucucaaaaaaaagaaaaaacucaagcuuucaaguuagacuuuccugaauuucagaccugucacuuacaagcuuugauuucggacaaauguuuaagcuuguacuuugagagaauuuuaugagaucaugcaugucaagcuuuuagguacucagcauaaugucuguuauuuuaguauucauuguaucauuauccucucauuguuauuuuuaaaguuuucugcaauuauuguauaaaagucaacuuuuagauggcuuaaaauauaaaguuuauaaacuuuauaugguuguaaauauacaaacauugaaaugcuggucuugguucuuuacaagcaguaucauucuuauuuauuagacuaauucugcuguaaauacauaauuuuuuucuauccuacuguucucaaauaagaaauuucucaucuccaauuuuuuuucuuguguuccuucaguaugagauaauagaagaauuauggcucugaaauuuuacuuuagccagcuauuuuuuauuucagacugaauaaacuaggcacuucuagaauuaucuguauuauuuuuugcuuuuuuguuauuuaauuugauggauacaguaucaugguaugguaauaaaaauuagccuauuuugagucucucugaauucauuuauaugaacaguuccuuaauacugcaaggaucuggccuucugcuuuuccuuccuccuucacuuuucuagcauggcuggccugauugcuguugugucauuucaaacuacccuucacuaagacauggucauaacuugccuguucgugacauucauguauuuuucauaugucaccguaucagaauguccuuccugaccaagcuuucuaaaauagcaaacaucacuuuuuauucucuucauucagcuguauguguaucuuaauugugaccucucaugcaguguauuuguucaugucacucucacuagaguauaaaugcaguucuaaacucuguuaaaaccuugcugcagaccuaacacauauuaggcacuuaguaaauauuuguuggaugcaaaaauaaaaauagcuagcuuuguuuguuuauuuguuggagacagagucuugcugugucacccaggcuggagugcaguggugugaucaugacucacugccagcuuggccccccugggcucaggcgauucugucaccucagccuccugaguagcugggacuacaggcaugugccagcaaguacggcuaauuuuuuguagagacaggguuucgccauauugcccaagcuggucucuaacuccugggcucaaaugguccacccaccucagccucuuaaagugcugggauuacaggcacgagccacugugccuggccccagcuuucuuaacucuguuuuauucaaggacuuuucuaagaucuucacuuaucuuauuaacuccuuuacaucuuuaaaagagguguuuuccuuauuuuacaaauuaggaaagugaggccaagaaggauuaaauaacuuacgcacgcucacauuuuagucaguggugaaacugaaauuugaacucagucugucuagcaccacagauuaugcuaguaccaugcuacacugccuguagagcugagagggaucucaguagucaucuaaccuacuccuaucugaugaaggagcacauguugcauuuuucuagauguauuagcuagucuuuuugaaaaugaggccaucuuaucaauuacuguacaucucuaguuuauguugauuuaguaucuaaguaguaauuuuuuauugguccuuauucuuacaucaagaggcagggauugccuuugacgagaucacucuucacguauuuaaaaacugcuucccuucauguaucaucuuucucuuccucguguggaauauauucauauucagucucuuugccaucuuucucacuccuuccucuguacaaacucuguuuuuuuuguugucacucuuagagaauagugcccugaaccaagaaugaguuucagauaaggugugaugagugagaguacauuuaucuauucuggauacuguacuuacugacacaguuuaagauagcaugaacacauuugguagcuaugccauacuguuuucacaaucaacuugcaaucagaugaauugucucuuuuuuucacuuaugcuaaccuuaaaccauggcuuuccacaucuuauauuuugugaaauuuuuagaccugaguguaugcuuuguaguuuuucuuaguagaguuuaucuuguuagguauuguccauuauucuagggucuuuuuuugaguacagauuuuauccuagucuuuuaacaauuauuuuauaaacuuaacuauuuuagccuugucuguaaguaugaauguuaucaaauauauucucauucuugagaagaaauggaaggugcuuauguuuuaacauuucucucuuauauuuuggaguggcuguauucucgcucagauauuaaaauuuaaaguuaggggaaugcggaacgacuguaaacaauguugacuuuuuaaauauccuuaaccaagaugguuaaggauguuaaaacauuuuuucuugaaaacuuuugauguuagcuuucuaguaaucuccuaugugauucuuuucuuacuugacuuuucauuuuaccuucauaauaacuuccauauuuuauuaaugauuuaauauuguaguaauauuuuuugguauuuguuuuuacuuuuuugcuucucaaauacuaaauccugacuuauuuaaggauuauguuuuucagaaggcuuccuaugaaauauuuauauuuuuaauauugugccuucaucauuuaguucuucaaaacaagguuaauuguaaggauuccauuuucuggaauuguauaauguuuuauagugauuuuguuugaguucucuccuaauaauccagauuguuuaguauucaacuacuuguguauuauuaagaacuugagaagguguuuauuugugacuuuguuuucucagccucuguguacugaggcauacuucauacguauucuuauauuuuauuacauaagaaauccuacagaucauaaugauguuucauauagauaaauucaguguguuguauacuagucugucucauugaaauaaaucucuaaaaguuauucugucagugaugauucuaauuuuuuuagcguccuauaaaauuuccuuagaauaaccuaauuuuugaaauuauaggaacaaaagaacuuacagauuuuugcuuccaguauugguagguaauucagaccuccuuauuuccaaagaacaacuuaaaaagcuggagauauauauauaucucuauaaaauaaucuucuuuaaagaagaacuaaaaagauagugaaguauuucuaggcugacgccaaggagaaccugggaaaucagagacauaagcccagcuuuggaagccacuuuucacccaggcauguguacugaagcagaaguaacauuuguaaaacuaagcugaauucugguggccuuguggaacaagggugucaguagucaaaaaccuagaguaaagccuucucaaaguagggcaugggaaggaagucugcauaauuucuccccagcccucuuuacauagacacugucuaacuucgggguaggggugaacuggaaaugagucaccccuccccaggauuugcagcccuguuuauguuauaugcuuuaucuaaggcaucucaauccuuggaccuggauuaaugugguccuagguugguagugccccaauguacuuagcagaagcuaacacagaucuucucuggagaaagauauccucauccuaggcuucagaugauuccugcaaauaauucaucaagcacaugaccuucagcuggagaguggaagucuuuuggagauuagugcaggguggagguaggagguuuuauauaucuggcaggcugccaugauuaaauuauugucuuguuuucagccucaagccuuccuuucugugccauugccuucaauuucugaucccuuccuccuuuccucccucuugaggugugauuuaacuugcuucugcauuuuaucuccauuauaagaacuugcuaaucaaauuucucaccucuccuuauucuuugcucuaguuuccaucuuccaggaauuuguugacuuuucuccuuugaucuuguuuuuucugcuguuuccuuuuuuuuuuuuuugguagguuuaugccuuuauuuuuuuaccucugacuugaguggauuucugaaaggagcaguuuuagacauuuaaaauucucuacauuuaaucagcacuucuacauaguuuacauacuuguuugagcauuuuuuuuuucuuuccaacuucuauuuuacguucaggggugcaugugcagguuuguuauaugggcgaaugacaugucauggguuuggcacacagauuauuuugucaccuagguaguaagcauaaguacccaauagguaguguuuugacccuuaaccuccucccacccucuaccuucaaguaggcccuggugugugucgcuccuuuuuuuuuuguaaacagagucucgcucugucgcccaggcuaggagugcaguggcgugaucucggcucacugcaagcucugccucccagguucacgccauucuccuggcucagccuccugaguaguugggacuacaggcgccgaccgccacgccuggcuaauuuuuuguauuuuuuaguagagacgggguuucaccguguuagccaggauggucucgaucuccugaccucgugauccacccaccucagccucccaaaaugcugagauuacaggcgugagccacugcacuaucuauguguacuugauguuuagcucccauuuuuaagugaaaaugugagguguuugguuuucucuuucuguguuaauucccuuaggauaauggucuccagcucuauccauguugcugcaaaggacaugaucucauucuuauuuaugacuguguaguaguucaugauauauauguaccacauuuucuuuauugagucuauugucgaugggcauuuagguugauuccaugucuuuuuguuguuguugugaauagugcuucagugaacauacacaugcaugggucuuuauguuagaaugauuuauauuccuuuggguauauacccaguaaugagauugcuggguugaguaguaauucuguuuuaaguucuuugagaaaucugcaaacugcuuuucacaguggcuggacuaauuuacauucccaucagcagugcauaaagcauuucuuuuucucugcaaccucaccagcauguuugagcauuuugauaggaaacauuucuaaaaguggaucaaagaauaugaacauuaauuuuuuuugauauuaccaaauaucccucugaaaauauuguaguucacacucuccucagcagaacauugugauaucucuaauagcaucuuagucuuuuuggaguuaguauauacaguguuuuguguuuuggggggaauuguaauauuuuaaagaucauucuguaauuucuuugcugguuuuuuuuucuuucuuucuuuuuuaagagacagggucucccugucaccuggucuggagugcaguugcacguucauagcucacugcagccuccaacuccugggcccacccuccugaguagcugagaaauauaggcguguaccacugugccuacuuuuuuuuuaagcuuuuuuuuuguuuuuuauuuuuugagacagucucgcucuugucacccaggcuggagugcaauggcacaaucucagcucacuacaaccucugccucccggguucaggcgauucuccugccucagccucccgaguagcugggauuacaggugccugccaccacgccuugcuaauuuuuguauuuuuaguagaggugguguuucaccauguuggacaggcuaguuucaaacuccugaccucaggugauccgcccaccucggccucccaaagugcugagauuacaggugugagccaccacgcccagccuuuuaaaguuuuuuguagagacgaaauauugcuguguugcccaggcuggucucaaacucuuggcuucaggugauccauccaccuuggccucccaaagugcuaggaucacaggugugagucaccaugccuggccacuucuuugcuuuuauuuccauuuuuaaaauauuuaaucuaaacugauauaaacuaaguaucauuugauucaaucuuuuucuuuuuaucuuaaaggugaucuuaauuauuuuaguuccuguuuuagccgaggaccuuuuuguuuuauaggguaauuugugugcuaauuaaagaaguagagcuuuuuuauauuugaugguugugaauaaauugugugucagacauaaucaacacuauguacguguacuuauggugaaacauguuuauuccuuucaggagaagaaagcaaccgucuuuuuuucuacgaaaauucuuggguguuuuauuugggguugugcgcguugaguccauuucuccuuccagucugccaaaagaauuguuuuggcauuuuacagaucaguucuucuaguucuucaugggauccuaaaggacauuuuuucaaaugaaguaggaaauuuaaauaugaauuuugccaagaauuuaacacuuucuuuuuaacacaauaccaacuaaauuauaucaaacuuuuuuuuaaaaaaaaucuugauuuauuucacuugcuuugucuaaacuuauucuaaaccauuucauugguaauuccuauuauuacugccagcuuucaguuuauucaucagugagauuaaucaauaacuuuauagagagcaaaaauaguaagccagcaaauaauuuaggguaaugguucacaaauuuuacuucucagaccagcagaagaagcauuacuuuggagcugguuaaaaaugcagguuuuuguucucugucucagaccugcuaaaucagaaauucuggggcugggacccagcaauguguguuuguaaggaguucucuagagaauuuuuaugcgcacaaaagauggggaaccauuucuuuagggauuaagaacauggauuuuaaagugagacauacccgaauucaaauuccaaauuaacuguugaauaucacuguaacuuugggcaaguuauccaacuucucugaccuuaguuuccucagcuguaaacuuggaauauuaccuaccuuaauuggauuauaguaaauaugauuauaaguuaccuuguauaagagcuuaacaaaugguuauaauugcucuuauuauuaaacauauaucaguauuucugaaaugguauguaucuuauaguguuaguaguuggguuuuuuuuuuccuuuuagugacacauagaauaaggugcauuuuaaauucgaugguguugauucacugauaugugauacgauguuuaaagugcauggucacuaucaggcuugggcauagaguuugaguguguauugaauccaguuuuagauuuggagaguuuuguuuuggcccagagagagcaggcagccuaaucagagaccauagaaguuaaauucagcaaauaaaugugacuagagcuuaacuucugauuagcagcauaauaagaaacaaucugaaguaauaacaucaagcaaccuaaacaaaacuuauacuaauguuuucaaaaaaaguauuuuuauggauuuucuguguaguuuuuuucccuuaaaucagauguuaucaaccuuucguuuguaaaaaacaccauggcacuuuauaugcuugcugcaccuucccaaccaggucugcugaauugaaauaaccaagaaugaagcaauggauauguguauuuggaaagagcaccacaggugauugugauguguacaagggcugagaaccauuauagagaacaaaaguaaagaaaauucugauuuacaagaacuuuguagagauauagagaucagaaauuaaauuauaaacuucacuuacauugugaaagaacugggaagugugauaguggugaacuuaguggugaaagcagaccgcacagguaacugcaacaaagagcagaaugucucucucacuucucucuuuguuguuuuagaaacucgguuuauuguugucuaggcuuaucucugacagaaugaaauuaauuacauuuguguuauaauuuuuaaauuacuuuguaauguuucuuuugaggagaacauucuucaaugaguuauacuuuucuugaauaguuauccuucacacccuucccuuauuuauaucucuuccuucuuuucucuucccuuuucucaguggucugugaaagaggaguagauaguuuauacuuccauuuuauaauuuuuguugggaaacauuacuauuauauaauccccaucaagugguaccauaccauaacaagucauucucccucuacuuguauguauccaguaauacucauugucuacaggcauacucuagccugccuuuggccagguuuaacuuuagcuaguuuuuuuguuucaguuggaauuuguugcuauguccauuuuagugucuacuuuuuauuauugaugccguucagcgucuaaguaagcauaagaugauucuuuauccuacuacuuaccuuuguugcuuuuccugaacuccuuccuucuugaauuuguaaacugaagggaaacacuaagcuuauauaaauaauuuucagaugcuuuuauugaaacaacaaaaaaauauauguagcauagagcgucuggauuucaugaauuguguuuccuacuugccagauuguaauuuccaagcaugcucuuaucucauuaacacaaagaggucugugccugaccuaggaucuuucuuuuuuuuuuagaaacuugugguggagaauguugauguguuaacacaaaugaggaccagcuuugacaaaccagaccagauggcugcacuguuuaaaagauuaucauguggguaacucaugauacuuuuuauaaacauaagaagaucuugauacucaguauuuagcuuuggcucaaaauuuguaacauaaauacaaguaguaaauuaugaaaaguacucuuuagcuuaugaagagaacuagaacauuuuugcagucaaaggaucauauaaguguguguguggcuuaucuguuucacaauuuuucuuaaccauacucuuagucuacuaugugucgcuaguucaugaauauuaccaguaucaauuugguuuugaacccauuaaauuuaauacaguaaaucuacauuaauuuagacuaaaaggauuagcuucugagccuguuaacuuucuaaaaaucaacuuuauacguauaaguuacauacaauaaaauguaccauuuaagcaaacgguauuuuggauuuugacagauggaugcauucauauaaccauugccacagucuagauauagaacaguuccaucaguuugaaaaauuguuugcuaucucuuuguaguuggucuccuaccccagucucuggccccaggccaaacaaccacugaucuuauuucugucacuauagauuaaauuugugucuggccucuuucacuuagcauaauguuuuugagauuuauucauccauguuguuaagugaucaguaauuuguuucuuuuuguuauuagcuaagauugaugaaaaccugaaccuacaacuuaaaaaaaaauuguaaugucuucuugacauugauucuuugugggagguauauugugaaaucacagugaaucuuaaguauuaaaguguguucaagcagauaacuguuuuagauauacuugaucuaauguuauuuucuuuugcuuuuuuuacuugaacuguuaaaguuacaaugaaaaauuauuuuaaagucauacuucuugguuaauuuaaaagccuucucaacacuaaaaaaaaaaaaugaaaucccaaauaaaauauucuuuguauuugagaaagccagagaacaaguuuauguuccuaaacaaaaaauaauccagaagaaaacuaaagccauacauguauuuaacauacuucauauuugacauuuuucucuuaaaugcuuuagagaaucacuuuauuaggcuauuuuauccuguaaaacuuauuuaauucuuauugaauaaaaauuaaagauuaccuuauaggacagaucugugguugccaggacuauaaagggaaagcaaugagggagauuuuuagggugaugaaacuguucaccauaguggugauacaaaucuaucauaugugucauacgacacauaucacuguguguuacauagugguaacacagaucuguacaugauaacauuuggggcugggugugguggcccaggccuguaaucccagcacauugggagccaaggcaggcagaucacuugagaucaggaauuccagaccagccuggccaacauauugaaacccugucucuacuaaaaauacaaaaauuagccaggcaugguggcacaugcuuauaaucccagcuacucaggaggcugagguaggagaauugcuugaacccgggagauggagguugcagucggcugagauagcaccauugcacuacagccugggcgacaagagcaaaacucuauuucaaagaaaaaaaaaauggagcuguauaccaaaaggaaaagaaaaggucauuuuuauuauaugauacuuuaaaaaacaaaaaaauagacgugguagcauuauagggaggaguaugaauaaguaggaaauuaguuuuuaaaacucuccugaucuuucuuuuguuauuguacauugguuuacuagcuacuuauauuuucuacuccuuuauucuuauuaguuuuguuuuuuucauguuuucucccauuuuuuaauacucauuugacaaccccauuggccuuaacccuauuuacuuuccuacuaacagucuuuugacuguuccaucuaauuagaagcaaauaauccgcugcaguguucaguacuuuauuuaacucucauuuguggaauugaaacaauggaauuuguuaaaauuccaaacagaauuugcaaguuuucaaaauaaaauucauagucguuugucaagauucugcuuacuugaauuuuguguauaauaauuaauggugacucauuaccucuaacucauuggccauuuuggaauuggccaaaaccaaaaucuaaauuguugaauguuaaugacccauauaaaucaaauuugucuuuaaauagaauuuauuaaaucuuuucuauaauuuggaaaaagaaacgauucacuugagagugacucauuuaggagaguagagagaacuauuuuuucagcaauugaacuguuuuccaaaacuuucucuuuuuuuuaauucuuuugugcuuccuucuccccauguccauauccagaagucaauguguuuuugaaggaguuuuucacagucaacaagcacauucuuuuuaaaagauaaagcauuaugauuaauuaaaaguaggucugaauugggaggcaaucuggaauuuauuaguuuauuuuuauuuuauuuuaucuauuuuuauuuuuaaauuuuuugagacggagccuugcucuggugcccaggcugaaguguaaugacacagucucagcucacugcaaccuccaccuccugguucaaccaauucuccugcaucagccucccaaguaacuaggacuacaggcaugcacuaccacacucggcuaauuuuuguauuuuuaguaagaugggguuucacaguguuguccaggcuggucucgaacuccugaccucaagugauccauccuccucgaccuccuagaguguugggauuacaagcgugagccaccgugccuggccuuauuaucaguuuuaagacuucuaugugacuugggcaaaucuccuuaugucuguuuaauauuuuuuuauucucugacauucuguuucuugggacuagguucaucgcuuuacugacucccuaauuccagacuaaaaauauuucuaguuuuccuacagcaauuuuuucuuucgaaaacucauucuauucacauaccuuucugccaucaucuacaaaccuauaaguugccucugaagaucuuuacuuuagcaguacuuuggauguuauuauuuccugaaauuguuccaccaguaaaaaucuugaacuuugaaauucaacucucagaucacagccaugucuucuagcucucccauuccuuuacaccuauugaacuccuuguucuggcucauugaaacuuuuaugccucucagcuuuccugaucaccuauuccuggcuuuacauauuuuauccauucuggacuaugaaauuugguuagugcauucucccuuaugcugucauacccuugaguuuuugcuacauucauucccacaaagcaguuuuccugaucccuagaaagucuccugcacccugaaagccaaguacugcuugugaaauaacacuuuuuaagucugucguuaaacuggccucuuuuucaucuuaccaccugucuuacuuugaaacuuuuugacuaguuuguaugcacuguuugauugucccaccuguccacucuuggugugcuguaauauguccacuuuccugaaaccuuucugaaaguuuguuggugacuacucauuugcaagauuuggugcuuuuuccucaacucucauucuguuuauuucucugucguguuuaucucuuuuauucuccuuuuuauuaaagcuuuauuuucuuuauuugccaauacuuuuaucucuacucuucgucguuuuugcagguucaucuuuuauguagugucagcuugugauaucuuacucuuccauuuuuacucugcaauacuauuggaaaaauuuuaucccaaauuuucucuucccuuauccaauauuuaucuucagccuuaacucucuucuauugaucuccagauguuuaauaccaaguacuaguuugaccggggcuucucaaaguauaacccagggacauguaacagcaccaccugggaauuuguuaagcauguaaauuauugggccccaccucagaccugcugacucagaucucuggggcugaggcccagcagucuguguuuuaacaaguccucggggucauuuggaaucauacaaaaguuuagaaacauuguguuaaauauuuucagcuauaugacccacagguuuuucacaacgucccuggaaugggaaguaucucuuccauggcagguauaaguagguggggagaaaaaaccugauguuuucuuuauugacuauuuuguuaccucucucaccaucuauccauugacucacacuggaaaacuugggcauccucucugauucuuucacuccucauauuccaugugcaguagcuaugucuuauagaugagaguuuacaaauuggugugucacauuugguccaaagguauacauuguuuggcccuaugcuacauuaauuuuuuuuuuaauuugggucauuauuuuuuaaaugggaagagucauuuuuaaauagaauucuuuucguauaacucuuuauauuuugaaaacccugaacaacacccucauugcuugaaggauacaguauaaacuccuuagcaugaccuucaaaagcuauuauuuggauuaaugaaauaauugacuggcauuaccucccucucugucccccacuaccuauuuguuugccugguccaagacccacauagccucuguucuagaguuaguuccuugggaaguuaguggauguuauguggggugaagggaagugccaguggucaaaugguuuggcaaauaauccauuacacaauacauuaagcaguguuucuuacugugaaguaucuuagaacuuuuaaugugucauuauuguacacauucaagaugagguuguaggguauagucuuugagaacuugauuaauuucuggguaacauacuuuggaaaauauauggcuauaucacacugaaucuugucuguuguuauuucuagugugaaucuuuuuuuuuuuuuuuuuuuuuuuuuuuuugugagacagucuugcucuguugccuaggcucgagugcaguggcgagaucuuggcucacugcagccuccgccuccuggguucaagacauucuccugccucagucucccgaguagcugggacuacaagcacgugccaccaggcuuggcuaauuuuuguauguuuaguagaguugggguuucaccauguugcccaggcuggucuugaacuccugaccucaagugauccacccgccucagccacccaaccuagucucaucuugaauuaccauuuaauugaauaucuacuggucaucuggguaucagacacugugcugagugcuacagguagaugagaagauuaagaguaguuccugcucacauggaauuuuuaauaaauuugcgccuuauaucauuuuguuaacaugacuuuuaauucauauuuggcuuauauuaggccuauuuguaugguuuagugaaagaugcuauggucaaaguuuaaacaagcuacacagaagguagaaaguuaaaauaaaacacuucucucuauuccuacuccucaacuaguaacuuuaacaguuacuguaguauauacaucucuuuccagaaauuuguuauguauauacaaauauaggucuguauauauaucuuuuuuaguuuacauaaauggaauuauauuucuuaguuuucaugacagcccauuuagacugucugcuauucgaggucuaggucauuauucuguuuauauuucuucuuuuacuacacaguguaaggcuuuguauauggcgugcaauaaauguuuguuuuggcuuuauaaaaugugaagguauugaaccaucauauugacccuuccaauccuacuuuguuaacagaguuuuauuuuuuuuuagagauggggucuugcuccuuuacccaggcugaugugcaguggcaugaucacugcaaccucugauuccugaacucaaaggauccucccaucuuagccucccaaguacuaggaccacaggcucaugcccccacacccgauugauuuuuuuuuauuuuuuguagagacagggucuugcuauguugcccagggugcuugugaacuccugggcucaagcaaucuucccgguucagccuccuagaaugcuaggauuacagaugugaaccaccaugcucagccuugaaaaucuauuaauaauuuuuagaauaaugcucucuaaccaauauguaagugaucaaaucuguucagcuucagcaaacugguccugccaaaacugcauguguucucaacaggcauuuuuuguuucuuaacucaagaccuuaacaauuuaagaauuuagcacugcugaguuccugggccgcuugaggauuuaacuccuguucacucugaucagcuucuuucucaucuagucucgcuucccuucuuucugccccuaccuuuucugaaauaggguuucagaagguaguaauauaauuuauauaaaguuauauuauaaauauaauuuauaguuagcuacuugugaaccaucuaacucauaugaaagagcacaauauacuccauuugauggaaacuauaguuacuuaaaaguuuaaccaguuuaaauaucagcuaucaacaucuuucucucuuuaaucauuauuguaaucaaauuacuguuaauugugccuuuuaucaugggaauuuuauuacuuuaauaaauuuagauuuuuuuccaaguuuaagaaagaauccaguucacacuuuuuuauucucuucuccuucuguuucuuugaauuuagcuguugacagugucuugaagaggaugacaauaauugguguaauuuuauccuuccgaucauuggcacaagaagcacuuagagauguaagaaaccauuacaaguauauacucgguauccaaacaaucccuuuuaauuucucagaaauuuaaaguuaaguuucagauucaugcuuagcaaugauauaauuaaaauuccaguuuuaguaguuacagaaaauaacauacauaaaauuaguuauuuaagcucauuuuuuguuuugguacugcugcuugcagaguauaacuugcgugguuauugcacuacuuuuucagugaucuucauuaucaguagaguauuuucaauuuugacuauacuggcuuuaauauugaauuauuuugaauccauuuaauuuucauaugucuugaaauuuuugaaaaaucacugaaaguagauaaaguaaaauaauuuuuaugaaaacuaaaauuaaucaauugguaauauuuuguaaauuuagggguugccauuuaaaaauaauucuguauucuuauuuguuauccugccuaggucuuauccuaccacauuccuuuucuuguaaguucaauugaagauuuuaaggaucacauuccaagggaaacugauaugaagguaauaauauaauuuauaguugggguuuacagucucuaaagcgaaauauuuaaauuacauaugcaagaaaauguaauaaauccuaaacuacuguaagguuucuaguuuagagugguuaguuagcaugcuugccuuuguaauugaaucuuugagagcucagcaccaaaauacuaccuaggcauuuugaaagucagucuucuuugaucaccuauagcaaugcaaaauugacuaaaaauagauuuuuuuuuuccuuaaauggauagcuguuuauacauggugauaaagaaaauuaagaaagaugagguggccaggcacgguggcucacgccuguaaucccagcacuuugggaggccgaggcuggcagaucacgaggucaggagaucaagaccauccuggcuaacucggugaaaccccaucucuacuaaaaauacaaaaaaaaaaaaaaaauuagccaggcgugguggcgggugccuguagucccagcuacucgggaggcugagacaggagaauggugugaaccugggaggcggagcguguagcgagcugagaccuugccacuacacucuagccugggcaacagaaugagacuccgucucaaaaaaaaaagaaagaugaagcaaugaaauaauagucguuuuaaauacaaugaaauucaauaaguuuaagauagauguuaagucauuucuuauaaaaggauguaauuguaggcuguaauuuuaaaaagauuuuuaguauucuauuauauguaauauauauauaaaacagcagguuggcagacuucugugagcuuacaguuuuuguuuugaaaaucuauugagccaugaaauccaacuauugaucuaauccuaguaaugauugaccagugguuauacaucuaguaagugauauaucgggguuuacauuuguguuuucuaagcugacacauuucuuagagagauuguuucuguuucacauaucuugaaaaacaccgacugaaaaaaauagugucuaaacuccuuuguaugacaccaagacucuucugaaauuggugccacucaggcugggcaugguggcucaagacucuaaucccagcacuuugggaggccgaggugggcagaucaccugagcaagguggguggaucacuugaggucaggaguucgagaccagcccgaccaacaugaagaaaccccaucucuacuaaaaauacaaaauuagccaggcgugacagugcaugccuauaaucccagcuacucgggagggugaggcaggagaaucucuugaacccaggaggugcagguuguggugagcugagauugcgccacugcacuccagccugggcaacaggagcaaaacucccgucuccaaaaaaaaaaaaaaaaaaauguggugccacucaaacuuuuugaggcuuaucuucugccacuucuuucuuccuucucucacucucuuucuuacucugucccucuuuuuauaugguauucugugagcuaacuagaucuuucuguugcauucucacaucuaucuguuuuaccuucuaauuuauucuacuugaaaauaccaaccuuuucucuuucugccuuuugaaauccugccuguauuuuaaggcuugauucaauugccauuuucuaagaaccauuccuagauucuccaaugauaaagaacuucuucuuucuuaguguuaucagagaacuuguuuaucuccuguggaguugaauauaaucugccuuguauuauaauucuauuuuucuacuuauauuuauaccaaaugguauauaucuugaagacccagacuuuguuuuuuugguguuguugcuguuguuucucuuacaguguuuugugcagaauaaacauuugagaucagugauugucuugugauucuaugauugaaaacuauguacaaauagcucaaaaugauuuccuaaguggaaacacugcagaaaaaauaaaguuaaggagacaaaaacuaaucaguucuugagaagacacugaugugcagaauuauaagaauucuaauuaauauucugagcaaccauucacuuuucaccugacauaaucauguuuaguuuccagcaaacuuucaauagaacuuaacuuuuaaaaaaaaaaacaacaaaaaacaaaaacauguuuuuaaacagcuuuauugaguuauaacgcaccuaucagaaaauuuacucauuuaaaaugcacaauucagugguuuuuaguguagugacagaguuguucaaccaucacuaaagucaguuuuagaacauuuucaucauccccaaaaagaagccuuguacccauuagcagucacuccccauuccacuucucccccauccccagcccuaggcaacgacuaaucuacuuucuguuuaaauuagccuacuuuggacacuuacauaaaucaucauguguagucuucugauacuggcuucuuucacuuggcauauuuucaggauucauacauauuacagcauauaucaguacuuuuuuuaaugauuguugaauaauguuucauuguauggguauacaacauuuuguuuauucacaucaauugauggacaucuggguuguuuucacuucuuagcuauuagaaacacugcuacugugaacauccguguacaaguuuuuaaugugugaacguguauuauuucucuugaauauauaccaggagagaauugcagggucauaugaaaacuguauguuuagccuuuugaggaacugcuaaacuguuuucaaauugggugugucauuuugcauuccuaccagcauuguaugaggguuucauuuuuucugcaucuucacuaauacuuguaauugucuguguucuuaaucauagccaucuagugagugugaaguggcaucucauuguuuauauuugcauuuuccugauggcaaauuauguugaacauguuuucauauguuuacugguuauuucuauaucuucuuuggagaaauaaccauucaaagccuuugacauuuuaaauuggguugucuuuuucuauuugugaguucuucauauguuuuggauacaaguccauuaacagauucaugauuugcaaaucuuuucucuaauucuauagguugaugaugucuuuuaguuucaaugaaguccauuuuaucuguuuuuggggguuuguuugugcuuuuggugucagucuaagaaaccauugccuaaugcagugucaugaugauuugugccuauauuuuuuucuaagcguuuuacaguuuuagcucuuacauuuagguuuaugauuuauuuugaguuaauuuuugugugugaagugaguaauagauuacaaacauuuuaaucuagaacuuaaucccugccauguucccaguuuuucuaagcuauacuauuuuacuucguauuuuauacuaagguuuuuugucgcaauaucagagguaaccaguuauauagauagcuuucuucugagguuauugagcagucagaaugccuugaauauuugaaaucuauaugugauacagaaaaauuacuuucguuauuagaaauucccuuaucagauuuuuaaaugaauacuccuuaaaaaaacuauuauaaguaauuugcuauauuuauagauacgauaugauuagacauugaaccacuauaauuuuucauuaaaccacuauggagauaaacacaggucuaguaauauugauucacuuuguucauuuauucaucuuuucugacuugauauuuuauauucaugcuuccaagcaaagugauaacuuuagaauuauccuguuggaaugugccacagaaaguauacaaguuuuguuuggccuagcaguaggaaguuagaaccagcagcaccucacaguauucaaccuacauugaaucaguuguucaguauacuuaguuuugcuguaguuucugcuucagccaaguuuccgaaauucucugguguucuucuaggcagacucuaauaaacagugagcuuucucagaaauuuguuagacuauuuauugcucuguaauucuuuuguuuuuaucagguugcaaugaauguguaugaguuaucaucagcugccggauuaccuugugagauugauccugcauuggucguagcucuuucuucacaaaaaucggguaaaaugcauuaguaaauauuuaauacucuuaguuaaaguuaccagggcagcauagguauagguaugauauuuaaccauauauucaaaugccugcuuuguguucagcuuuuuaaauuuguuauuauuauugcugguacuuggacuauaucagugcauaaaacacaaacaucacccuucuggaacuuaagauugguugagauuacugagccauuuaguguauauagaugcagcagugaagaggauccaggucugagccuugagccauucuaagauuuaagagcucagggagaaaaggaaaaaccacgaaaaaagaaauuuagagaaauugagaagaaaggaccaaugaaguagaagaaaaaccaggaaaggguagcuuccaggaagauagaaaggaaaugaucagcuauguagaguuaauuggugguacuaacaagaucagugucagugagguuuuaugggcaaaaggcugaguagugaguaagggagauuaagggagaacaggaggaaaggauuuggagauaacuagaagacaacucaaagaguucuauuguaaagggaagcaaagaaauaaaaucucaccagcuggaggcaagagcaaagucaagagaaggauuuuuuuaagauggaggagauuacagcauuuguaugcuaaugggagaugguccaguagauagcaaaaaauugagaucuaggaaaggguauucuguuuuuauuguacuagaguuauucaccaucaagaguuuuauauaaaacauuuagaaauuuuuaagaccagcccuuagaaaugcaguacucagaauccuguagauauuucuugauuugucuacaaaguaaauauagcauuucaucucuuucuacuacuaaaaugccccuucugccuccuugaggcagcagcaugguguuugaguucaucaguuuuuuuuuuuuuuucauuuaacaaugcaauuuuguuuccucauucauacaguauguuacauuuagucacauggauaauuauaauuauuacuugauuugcuacagcuguauuuuuuguagucgaccaaaucuuuaaaacauauuucagcucuuuucuuacauucaauucuuaauuauaucuaauggugauuaguagccuaaauaacccacaauuugagugcauaucacaauaaauguuuuagaaaggguuaugucuugaaagcuuuagagcaaugcuggguauuuuuauucaugacuaguuucuucugucuucuucugucuucuuuuauucaugacuaguuucuucugucuucuaaaauagagagguugaaaacccauuccacuuuccacauuuaugucuuuuaaauaguaaauuucaaauuauauucauaucucuuucaaaaaguaauuaagauuuuuuuggugauuuugcagaauaauuuauaaguuuucuaaauuguaaauagaacugucucauaaaguaauaauuccucauuaguuuucaauuaggaaauuguaggauugcaguuauccuaacuguauuuuuuguucuauaaucuuacaauuaaaaaaaauaaaaucuuaccuuacuguuuuaucagacguccuugaaauaugccuaaguaguugauaauaguccauuguaauauaaacuguuucuacuuuauauuuuuauaacaaaauugugaccaauucuauagaaugcuaguaaaauaguuuacuauuucaaaaaaaaaaguaaaccauuuuuaaaauaaaaaucuguuuaguuuagauuaucaaaucuuaacuaaucuugaagaaauaccuugauuuuauucuuaauuuuugucucuuagaaaacauuaguccagaagaagaguauaaaauugccugccuucucaugguguuuguggcaguuucuuugccaacacuggccaguaaugugaugucucaguacagcccugcuauagaagguaauagugguuuaaaauuguuuuggcgaugaauaaaucauggguuuugguauuuuauaauaaaauaugaguuaaguucugccacuaacuggcaguggaacaugggguagucuguuucccuuuuccuaaacugcaguuuccugauauaugaaauguguguaaguaagcucaugugugccugaauguguguagaggucggugagggauuauccaacucauaggauuauuuuaaggauugaaugguaaaauguuguaaagcagcuaagcacuuccuuuuuauuuccgagcuacuauaaaacugaugugugauuucuuuuagauguuuucagaaguguuugccuguuuaacauauacacgaucguuuguuacucuccuguuaaacuaguuuuaaaaacaucaguguucaugaaagucaaaggagagcaaguccggucaugucccaacucuacucuuaauuaugccccuauuuaugcagauugugaagucauuaaagauuugccuucuauguauuauuugcuauuuuggggucuacacaacccuauuugcauuuucucagggcauugcaacaacauacauugcuuggccaaagccaucaaccagauugcugcagcuuuguuuacaauucacaaaggaagcauugaagaccgucuuaaagaauuucuggcgguauguauaaucaaauaacaaaacucaucacauuuuauaaagaaaacuaaaauucacaaccacaaaauguaagaauaaauucucuuuauuuuuacauuuuauuuaguguccucuaauggcauuuuguuuucaaauuauuuucucagguauaugaauuucagucuccuuuuauuuuuauuuguuuauuuucuuuuuuggagggagaaacaggugaagguggggcauuaaaaucgaggagccguccguuauuucccuuagacucggaagucucuuucccaacucuagagcucugcaauaugaccuuuuuuccccaagcugauguuuggacugcccuagaaauuuuccuaggcuugaaagagaaaaaaagcaaaggaaaauugaggccaagagagaagcuauucccucuaaaaagacauauuuuacuuuuuuccauuucuuuggagaaagacaauuaauggugaaaaauucaucauuaaaaauacuacucacuaccaagagagaggagugcuaaauguagccucaugaaacaugguuuuuaguuucucuaucaauguaguucuuucuuuucuuuauuaauauaaccuuuuccauauuuuauuuaaacgaaagauauaccauggcauacugaacucuagaacauuuacuucuuuuucaguuauaaauccugucagcuuuuuuaaaaaauaauuuuuaaauuacaaaugcaaauauaguacuaacuugaggagaaaauaacuucuauuucaaggaaaacacuauuaaaaauuuuaaguguuucuuuccauuugcaaauaauuccuucacucaggguuuaaugucuuaaucuuacaguguuucugugaagucaaauccagugugaaacugucuucuuccuugggaacuaagaaauauagucaguauagauaaugggaugggauaagagaaaauaauuugaaucauuuuaaaaagcagacuuguucugaaaaaaucaguuuuaaagaccaauaagaauauuugauuacauuuauuauguuagugucucuuugugccuuaauuacucucuaaauuacugcuugaauguaggcuaucuaagcucaucuuauuuaauugcucauuauuuuauauuuagcacugaaugauugaaauguguuggaaguugaaacauaccuaaaauaaguaaccgaugaaccuuuuauuaacaaacucacuuuauguguauguauacuuuuaagcuugcauccuccagucuacugaaaauuggccaggagacagauaaaacuacaacaagaaauagagaaucuguuuauuuacugcuagauaugguaagucucauuuuaauuuuuacuaacaauaaaaaaguuccagucguuccugagaaucuuuucuuggcaucuuagucauugaauacuuuuuuugaucccuuuuguucacuucacguaagccacaccuuucuaaaauuugcagagaagacugacaucacucauauuuuaucauuucgguaauaucagaagauaacaaucaaagguuagcauuaacuguggguauucuuuuaugaacaguuuuucaaccuguuggaaaacacucaggccuuguauuuuucuaguguauuggugucaccucucuuccaguuuucugaguuuucuacauucuaacucuauucugcccauuucucguaauuuucuguaauucucugugccuagucacuucccucucugcaguaucugugaaccagcucuugcuuguuucuaccacguggcucuuuccccacuuagaguuauuuuccuuaccugcagaaauuggauuuauccuaaugacuuagcacaucccacagcucaaaucuuuuuccagauagucuuucuugauuacuuuggccuacauuaaucuuucuucuguuuugaauucuuacagaauuuacagcuuuccauuucauuauagucggucuuauguuugguuuugcuuccuagcuuagucuuugauugccagguagaguugauaguacaaaaaaaaaauauuuuuguauugucuuuuauuucuaguauaucagugaggaaaaugaaagugcucaauauauuccuguugauuaaauaaauuuaauugaaaaguagcucuuuuuaaacaguuugauauacauucacuguggcacauuuacauuuuagauuaaguaaaaggaaaauaauaugugucuauugcuaauaagaacaauauagaaguuaugccuuacugguugucaauaaauguucccauuauaaauaacuuaugauuuuuguuuauaaacaaguuauaaauaacuuguuuugauggauuuuuugaauuuuacagauuguacaagaaucuccauuccuuacaauggaucuuuuggaaucuuguuuuccuuaugucuugcugagaaaugcauaccaugcugucuacaaacaaaguguuacaucuucugcauaaaauuaccuacuuaaucaagauaagcacgcauuuuuguugccuugguuuuaccuguagacuguggaacuauuuuaccuuaagaccugaaaaaguuuuguggauuauaaauuucuuucauacgguuguauuuucugaucauugguuucuuaauaugguuguacuacaguauacuugguugauuuagguugcacauucacugaauucacugagauuauuccuauaauuuuaaaguaucauuuauuugaaaaacauacauuaucaacauguuuuugauauuugauaaugaaaaaaaucuuugcuuguuuauuucugaaaaagaacuguauuuagugauuauuuuagauagugauauuauaguauucaucuguguguaaauuauuucauauagggaagaguucugaucuguaccuaugguucuuauugaaaacaacauuggaugugcauuucugugauguuaugaauacauuucuacuuuauuuugaaacauuugccaaacuaaauacuguaacacuguauaacauuuaaaaauguuaaagaacugcuuaguauuagaagcagaucauuucccaaaauucuaagagcagcagcauauguuguugcuuguauaaagccuagcgauaauuuuuagacuaacuuccauggugcccuguuggcauuagcacuaccauuguacccugcuguauaauaaacaaucuuagacauuuaucaacuguugauacaaauguuagucccuaaccacuuuuuauauauguuuuaaauuuuugaaauucaaguguaccugccauaacauaaaauaaacacuagacuguaucacacuucgauu

SEQ ID NO: 13242 - RNA, 1788 nt, Homo sapiens
ucaugggucaaugaggcuuuuuauuuugagcacaaaaucacuggggaucuugccuguggccaccccggagaugacacuggagggucacguggcuccggugauuugggccaauuacaugacugcaaggcuagagcugccaacagggcuccagggagcuuggcuucuguagaaguucuuuuuuuuuuuuuuuuuuucugggacggacucucacucugucuccagacuggugugcaguggcgcaaucucggcucacugcaaccugcuucuguagaaguucuaaggaagaggugcgaacuccacggcggugggcaaggguagcuaacuagcagcggccccuacaaauguugcucgggggucuugagcugccggaguugacacaaggggaggggucuaauuagccaccaggugacugaagggcuugccugcccacagcuuacuuggcugggggguuucugaaguuccugccggcaaacuuagccuugcugcccagcuccucuucaauucugaggagcugguuguacuuggccaagcgcucagaucagcaaggggcaccagucuugagcugcccaggucacagccccaccaccaggucagugaugaagguauuuucagucuccccagaaugaugaggcaccaugacacaccaaccauuggccugggccagcuugcacgccugaagggacucagucacagagcgaaucugguucacuuugagcaggaggcaguugcacuucuucucauucacggccgaggcuguccucuuuggguuggucacucugagaucauccuccacuaccuggauuccugcacuggccgugaacuucugccaagcuccccagucauccuggucaaagggaucuucaguagacaccacuggguaguuuuugaugaaggacuuguacaggucagccagacagucaggugagauguaccugguggggucgucgagaaacuugaauuccaggucauacuuuccagaccugaagaacucggaggccucuacguccaugcugacgaucaccuuaucaguguagccagcuuucccaaucgcagucuucagcagcuccaggccuucuuuauucuccaggauguugggagcaaacgcgccuccaucccccacaccgguggcaucuuucccauauuucuccuugaugacauucuucaggcugugguaaaccuccgcuccaaugggcauggcuucccugaaguuugcugcaccgacugggaggaccaugaacuccugcauggccagcuuggugacagcaugagaacugccauugaugacauugaacaccgggacuggcaagaugacuuuggaguugccagacaagucggcgauguggugguacaggggaacccccuucucaacagcacuagcuuugcaggcagcgagggacacucccagaauggcauuugcaccaaauuuagauuuauuuucuguuccauccaucucuaucauaaguuugucaaucuucucuuguucugugacguucaguuucuugcuaaccaggacaggugcaauaguuuuauugaugggcucaacaggcuuugagacacccuuccccauauagcgagucuuaucauuguccuggagcucuaggaccucauagauaccaguugaagcaccacugggcacagcagcucugaagagaccuucugaggugaagagaucaaccucaacagugggauucccacgagagucaaagagcucccuggcauggaucuugagaauagacauggugaauuucuagccacugggucucauugccuaggagagaaguggagggu

SEQ ID NO: 13243 - RNA, 1790 nt, Homo sapiens
ucucaugggucaaugaggcuuuuuauuuugagcacaaaaucacuggggaucuugccuguggccaccccggagaugacacuggagggucacguggcuccggugauuugggccaauuacaugacugcaaggcuagagcugccaacagggcuccagggagcuuggcuucuguagaaguucuuuuuuuuuuuuuuuuuuucugggacggacucucacucugucuccagacuggugugcaguggcgcaaucucggcucacugcaaccugcuucuguagaaguucuaaggaagaggugcgaacuccacggcggugggcaaggguagcuaacuagcagcggccccuacaaauguugcucgggggucuugagcugccggaguugacacaaggggaggggucuaauuagccaccaggugacugaagggcuugccugcccacagcuuacuuggcugggggguuucugaaguuccugccggcaaacuuagccuugcugcccagcuccucuucaauucugaggagcugguuguacuuggccaagcgcucagaucagcaaggggcaccagucuugagcugcccaggucacagccccaccaccaggucagugaugaagguauuuucagucuccccagaaugaugaggcaccaugacacaccaaccauuggccugggccagcuugcacgccugaagggacucagucacagagcgaaucugguucacuuugagcaggaggcaguugcacuucuucucauucacggccgaggcuguccucuuuggguuggucacucugagaucauccuccacuaccuggauuccugcacuggccgugaacuucugccaagcuccccagucauccuggucaaagggaucuucaguagacaccacuggguaguuuuugaugaaggacuuguacaggucagccagacagucaggugagauguaccugguggggucgucgagaaacuugaauuccaggucauacuuuccagaccugaagaacucggaggccucuacguccaugcugacgaucaccuuaucaguguagccagcuuucccaaucgcagucuucagcagcuccaggccuucuuuauucuccaggauguugggagcaaacgcgccuccaucccccacaccgguggcaucuuucccauauuucuccuugaugacauucuucaggcugugguaaaccuccgcuccaaugggcauggcuucccugaaguuugcugcaccgacugggaggaccaugaacuccugcauggccagcuuggugacagcaugagaacugccauugaugacauugaacaccgggacuggcaagaugacuuuggaguugccagacaagucggcgauguggugguacaggggaacccccuucucaacagcacuagcuuugcaggcagcgagggacacucccagaauggcauuugcaccaaauuuagauuuauuuucuguuccauccaucucuaucauaaguuugucaaucuucucuuguucugugacguucaguuucuugcuaaccaggacaggugcaauaguuuuauugaugggcucaacaggcuuugagacacccuuccccauauagcgagucuuaucauuguccuggagcucuaggaccucauagauaccaguugaagcaccacugggcacagcagcucugaagagaccuucugaggugaagagaucaaccucaacagugggauucccacgagagucaaagagcucccuggcauggaucuugagaauagacauggugaauuucuagccacugggucucauugccuaggagagaaguggagggu

SEQ ID NO: 13244 - RNA, 91264 nt, Homo sapiens
uaaaaagcuuuccucauuuuuaaacaacagucgcacggaaguucccggcgggacaagggaacgugggugcccuugcuacucccguggacgcggguagauugggacgcuggaccguaucuccccgcccccgcccccacgccuccucaggugcucagccugaggccuucguccaggagcgcugccgcugacccaggcucaggagcugggggccccugcacagacgcccaggucucgggacaggcggcgacugcacucacggaaguacgcugagcucuccccuguagaagggcgccucuccucccccacuuccuccuccagcuccacagcagccucccgggccggcuccuccuccuuccaggucuccucccagugccgccgcggcucucaggccugaggugcggcgcucaccccggcaguccccagccucagacgcugcguggagcggcggagccggagggaagcaaaggaccgucugcgcugcuguccccgccccgcgcgcucugcgccccucgucccuggcggucgcuccgaagcucagcccucuugccugccccggagcugucccgggcuagccgagaagagagcggccggcaaguuugggcgcgcgcaggcggcgggccgcgggcacugggcgccucgcuggggcggggggagguggcuaccgcucccggcuuggcgucccgcgcgcacuucggcgauggcuuuuccgccgcggcgacggcugcgccucgguccccgcggccucccgcuucuucucucgggacuccugcuaccucugugccgcgccuucaaccuagacguggacaguccugccgaguacucuggccccgagggaaguuacuucggcuucgccguggauuucuucgugcccagcgcgucuucguaaguggccgcacuuggaacuggagccggcccccucccccaccgcgcgcacccacccagcguuucuccauugggauugauuuccgagagaucccggcgucugucugucucacccauccuaccucucagagugguuuauauccuggguggaggaaauauuuggggaaaugaacucccuuugguacccaucacccaguuacaccccgcuucucaccucuuaaaauugguuaggggcagcgggagagcuuugaagcagaccugugcuuaaaaaucggggaaagugggaaaucaacaaaggcuggucuugccggacuccccgccuccugugccagugucgaggauuuggucaauaucauccccgaacuucuuuuucuccucuaccaguuaggcuucuugguagccuuuuucugcuuuacaggcuuaacgcccguccuuuucagucucccuaaacaagcccucccccacucuuuccgccucugucugauucuguuucuccuuacuccuuuugcagacauucugaugacuuaaaaugaccauacuguccuauugaauucauugugucuuaucucugggacugucagacauuugcacauuugagguugaacagaugaauugaaugugucaucuguucuuuuuauagugauucacuauuuaggucauuguucagaaggaacaaggguguuugcugaguuuucacucgcugcaggucauuugaauacugcaguauuuaauaauucaguuauguuuucaaguugccaacguuccgcguugcaagggccgucaggauuuauaacaguuauugccauuauuguguuagaaauugucuccgacuuuacugaaugcugacaucauucucaccaccccacccccauguuagcguuaggaguacuguuuuaaugaauguugacuguuuuuuuaaugauguuuaaaucuuguuuucaagagagaaacuguucuuagggugccuucuaaacgcuuagaccuuguaacaacauauuuuuguuuccauauuuucuguauaagauaucccuucggggugaaguggaggaaaauuuugacgguuaguacguggauaggaccaucuucuacuacacacaugccuaauuugaggguggucucaaugguuuucuaugacuguuaggacacucagcagaauuuagucuuaguguuuuucugaauguuacugaguaucauucauuuugguaacaaccuuugcagcaauacauagauuagaugcaguuaauggaaacuuuguuaguggagacauuauuuuauguagcaagcuuaguuuuauuuguuguuagcaguuacagugcuuucugugagaccuggagcacagauuuuccaacaugauaaaaauaaucauuauuuaggcaacauuuaccaauuucacauuccauuuagucauuuuagucagcauuaucuuuuuauuuauuguuuuuaaccacaggggugaauaccaaacguuaucuuuaaacauuuuuguuuccagauacuuucaaguguauaccuucaugagacagaacauuuuaguugcucccaaggguucaaugugagauauaauuuguagagaaauucuaaugauuuugaaaauauaugucuucagucaaaaauuagcauuuaaauacuucaggccaggcacaguggcucacaccuguaaucccagcaccuugggaggccaagaugggcagauugucugagcucaggaauuugagaccaaccugggcaacauggugaaacccugucacuacaaaaaaauacaaaaauuaaccgggcaugguggugcacaccuguaauccucgcucugcgggaggcugagaugagaggauugcuuggaaaguugagguugcagugaauggagauugugccaccacacuguggccugggcgauagagagagacugucucagaaacaaaaacaaaaucaaaaacaacaaacaauaacaacaacaaaauaaaguugauggcaguguuuuacaauguuacuguuaauucuucagcagugcucugaguuuaguguaagauaaaugagaggcugauaaacuuuaaguguuuuuuuuuuuuccaugaaaaaugcagugauguugaacucuucaugauauuugcuacugcugauuacaaaccagggugacuaaucuuuggccagucauuauaaucaaugaauguguuaugaccucacagguuuacaugacuucacucauagaccuuuaaugauaaaguaaaauugaacuuggguuugguugcauauaauauuuugaaauauucaucagcaacuuuguuaccgauagacuacagagcucuagguauagguaacuuaaaaaauggaaaccaaccuugaauuuuuuucuuuuuucuuuuuaaacaaaacguauauaaacacagguuuuuacuuacugagcuuuucagauuuaacaaaaauuuauguaaaauuuugcugaauuuucuagaagggcacuuuaaauuuaacaagcauuggaauccaagguacuugggaugccauuuccaauauuaccaguuggauuuauuguuauuugguauuaccauaaacuuuuaaaagaaaaaaagccacauaaugaaaaaguauuugucaauucaagagcgccuuucuucugaggggagaaggauuugugaggagcagugguugugacguccacuccuguugcuuuuuccaguuuugguguccacauaccuuggggaagcuguagaauuauuuuaugccuaauuuuucucuuuauagaaaauuauuauugaauuaucugcauaguucauaguuuuguugugaaaauuaaugaaucaauauuuauuaaagggaaggacaaaguacuaagcaaaauguuaaggcggccccucaaaaaaucacuccagaaaugagucagguucgaaguaaaaauucacaaauauagugauuuucaaaauuaugaaaaaacauucgcauucuguuuuuuuuucuauaagcauuuauuuaugcuauguuguaaaacuuacauaaaauuuaaagauuguaugcaggcuaauaauuagagucauacuuuucuuguggagacuaauuggaaaaauuaaaaauuacauccuagguuuaauuauaaugaugacaucuuauuuugguaaacauauuuuauaauuugcuaagcacuuauaucucauuucauucuauagcccacaccaccggggggaaguaaggggaagcagauauacucauucuuacagaugaggaggaaauggaggcagaaccguuugcagucuaguuauuugaguagguuggugugaguagaggguaaggaagggaaggauccgaagacaggguguaaaauucaaaucccacuuuuauuaauucaaauauugaauuuuuaaagaaaauaacugaacaauuuuaaaauucauucuucaaauauauguuauacaguucucauuuuauguauuucuuuauuuuaaaauaaugcuauaaugaaugacacuggauucuugccuuuccccccauuaaacgcuaauggagccuuaucuuacaguuggcaauguguagauguguaugccuuagaagcagaagguccuucaaugguucucaguccuaacuucauguuugcaauaucuggaaagccuuuuaaauaaaacucuugcccuggcuguaucuuaaaucuaaaaguagaucucugacuugauauuccaguggccuggccugugaaucauuucucguugacuagccugucuuaacucaauuugacuaaaaagucuucaccaagagauguuaguugcaccucuguuucuauuaaugcuggcaucauuuucucugucaccuuggaaauacuuucauauuccucccucucauguucuauuuuucuguguuucuccuacuucaccaccuuaauaucagucagugauuagucaacaggcagaagcuccuagaaauucuuccuuuuuaagguuuucuugauuccaucucugcuuucuacuccuuauuucaguguaguuaugacaagcauagucaguggcacucagguccucccccaucccucugcccaucauuuggcucuuaaacgugcagaacaucuugucuguuucuauucauuuuaucuuucuguaacauccuuuuucauccugguauucuguugcaaaaauuuucauaauaaagcuuccauugccagcaagaaaguccaaaccgcuuaacauggauuaaggucacuugcaaucugucccaaccuguguguauuuuuaaaacuucauguaccauuucuacucuuaccauuuuaacccuuuucacaacacuuuacaaaaugaugccagcucauuuuuuauaaacuucagaguagcucugauuauauuggcugauuuuucucaucauaaauaauauacauguauauuaggggacauaaaacuaggcuauaauuuuguuauuuagaaagcaaauccuauauuacuucugauuaaggacauaugauguuucauagagcauuaugaaagacaagggaaaauauguggaaauuguaguuacugcuucuguuuuacaguaguuguugacuggcauuuuuguuuuucuuuugauucaaaaaagcauuuuuuaaaaaaugaaaaguaaaucugaaacuggaauuguagcuuugaaauaacauucaguacuauuucauacacauuuauuucuauauacauguaugauaguuuuucagaaguuccuuuuggugaaggcucauuggucaacucagagucagcuaaauauauuaaacaugcuuuaucuuagaaaggucagugcugaaagcagacaaacaaguuaguuuauuuggaggguuugaaaaauggacuugucauuguuuggcagguugccccuccuugguugucaaggucacauuccgugaaucaacugcccuucaaguacaguuuggauagggagugcauccaaaggccauccuccugauugguuccucugagccucuugucugucucccucucacugccuccucugauaccucucccucuguaucgcucucucuuuuuucuuuuucugucucuuguccuuccucucuuuuuccuuuccucuaucucuuuucuuccuuuccauccaucuuucuguccucucucccaaacucaauccuuuauauuuuagcacuucuuggcauggauguaaaccuuaauuuugaagucccagagaguuauuuaauggcaguguuuccagucauuaaaaaaaaaaauguugaggauggggauucugaugauguucuuggacauacuuuuuggagggaaauggagucuaucaggagagaguugcgggcauaggaaauuaagucacucagcuucagauuuacacugcuaaucagugaaaacucuugucaaccuuaccucacccuguguauucuccccaccucgccaccauugauaagaaauguuuaagcuggcuuuucuacccuucuuucucuuuuucuucuucauuugaguuaaucacuugaccauuaauggcccuuugaaaacacugaggaaagaaaagcccuuuuaaagacagaauuuaaguuuuacauuuucuacucuucuagggaauaacuuauuaauggcaucaauuguuuucaggacgaagaugauaauuaaaucccaucaucuuguauuuucgugguguuucagauuuucuaaguuugcauuuauuuauuaucaccuucagaaaguuucuuuuuaaaguaauuacagugggcauuguuauugccauucgauagaagggaacagagauucaaaguuacugcuucaauugauuugcaguguuuguaaauuuuaauuccaaacuguuuccauuagauagugcugcuuagaucacaaacauuuuuuuucuggucugucaguucucuuacccuaauuaagcuguuguacacuuucauuagucauucuuagaugaaauucaaguaacaauuauuuuuauggaguguuuuauuaacuuuguuuuuuguaguauguguugcuuuuuuuuuuuuuuugagauggagucuugcucuguugcccaggcuagagugcaguggcacaaucuuggcuugcugcaaccuucgccuccuggauucaagcaauuucuggcuaacuuuuguauuuuuaguagagaugggguuucaccauguuggccaggcugguuuugaaccccugaccuuaagugauccuccugccuuggccucccaaagugcuaggauuacaggcaugagccaccgugccuggccuguguugcuuuuuauuccuuaauuuuuuuauauagcaucuuuuaucaccuuguacccaguuuucuaugcaaguauuucuuuuucacuacacagcuuccucguaagacuuuaacauaugucuaaggucauuuuacuuucucuaucucuucauuguucucuuuaaaaaacuuaaauaucuuaaugauaacuuuaauaucgagauggcauuuuggaugaaaaacuucaucagcuuuuuucccucacaaauuuagcauguagauauugacacauuccuuuuauauuauucugccauuucuguagcauuucaccaguaugcaagucugcacaugaagguaugcuuaggaaaacuuaaugaacauccauuuguacaccugauuaccaucauuucaugccuauaaugugcagauagccugaugaaaagcaacaggcuuguuccugguauuauucaaggaacucaugcuaugugcugccaauagagugguguuuucauucagagaaugcuccuacugggcucuuuuucucugucuuuguugaaggccuucuccuaauaacuuccgagcucucucugucuuauagugccaaguaaagaaaguaucugaaacccaaaauuaaguagagauguuacacaaggaaauuguuuuaaggguaauuuaaauaauuggauguuuaauagaggaugcuuucugcauucuugagggguucagacguaguggaaaugacuuauuuauauauggcuacuuuaagauugagacauagcuauugaauuuacuuuguuacuccacuguccauuuaaacuuuucuugaguucuuauaauguggcaggugcaaaagaugaauuagaguacccuacauucaaagaagcaauuuaucauaagguaggcagaauaguuuugaccaaaaaguuauaaaauauauuguaagacagggguccccaacccucgggccauggaccaguaccaguccauagccuguuagggaccaugcugcacaucaggaagugagcagcaggagagugagcauuaccaccugagcucugccuccugucagaucagugguggcauuagauucucauaggagcaaacccuauugugugaacccugcugugaagugugcaugcaagggaucuagguuacaugcuucuuaugagaaccuaauaccuggugauccgaguuggacaguuucaucccgaaagcaucccccucuauguccagggaaggaaagguuggggaccacugcugugagcuacuauuugaagacaacccagaagugauuuuugcuuguagguuuccaggcaaagcuugagaaccaguucuccuauccugauguagaaccugguaugaucuacaacacuaagaacguguacauaccugugcuuguauuacucucauuaggacuacuguggcaaugucccaagcaagcacuauucaagauauugacccucaaaagcaaacuuaccugaacuguucuuuuguucuaguaugcacucaaaaaucauuuaauucugaugaaaagggguaguugugugauuuuggggucaaauuuuagacccguagaaaaaaaauuguauauguaauaaauuuacauauuauaauuuauacacacacacacacacacacacacacacacacacagaguuucacuguguuaaccaacucugcucuagaaaaagaaccgaugggguuuugaugacgagcugcucucuuaguuaugggagguggggacucucuuacucauagcauuuuuuuuuuuuuuuuuuugagacagaguuuuccucuguugcccaggcuggacugcaguggcgcaaucuuggcucacugcaaucuccaccucccagguucaagugauucuccugccucagccucccgaguagcugggauuacaggcucaugccaccacgccuggcuaauuuuuauauuuuuaguagagaugggguuuugccauguuggucucaaacuccugaccucaagugaucugucugccucagccgcccaaaguguugggauugcaggcaugagccacugugcccaaccucuuuuuuucuuaugaaagacuuuugcugaaugaaaacuaaguucauuuucuacccagaaucauuuugccgugaugggagagagccaacauugguguuuuacugaugccagauaugacugcauggagcucuauuaaauagggcgugguuugguugggaguuacgucuuuauuuugaauuuguggauuuuuaagauaagugucagaaagcaggauucuuuguaacccugcaauucguacagccagcuuuugucuacuguagaugagauuuggcagcuacuacccagaauaagaaauugauuuuaaaaguucaagugaaugcauuccauauuuaagauguacauucguucuaauuucacaaaaaggugaaaagcaauuguaaauguuuccuuugccagaauaauuuaagugacuuaguauuuaaugaaacaaaaugauuauggugauagcauuuuaggacuguuuuugucugccuguauccugcuuuauuuccuccuauauuucaaucaguuucuugagauuaaagacaaaaaucuuuuuuacuuuaucuucuuucucuucuugacuccuaaauguuguugucccugagaacucacucauugccccuccucuuucgacgcuuccccuggcugaauaaccccaacuguguucugauacagcauacugucucaggcagggcuucagacuacaacuggaugacucacagauaucucaaacaaacauauuaauaauugaauucaugguuuuucuguaaauacuaauuuuauuuuauuucuugagacagggacucauuguuucacccaggcuguuugcuuacuuuguagcacuuguaaucacagcucacugcagccucaaccuccugggcucaagccauccuccugucucaggaccccagcuccacccccaaaguugggaccacaggcgcaugccaccacacccagugaauuguuuuauucuuuguagagaugggggucuuacuauguugccuaggcuagucuugaacuccuguaaguacuuaaucugccuucugcuucucugcucucuaggcuuuucucccaucaaugcacucaagaaggaaaucuagguggcauucuugaaugucuuuucucucauauucaggccuccagcgauugcuguuguacuccagauguuuuuuuccaucugucaccuaucuuuccacccacccucuuacugcagaucacacucaccugcucccugagcugcggccaguccuuugcuuuccuuguuccauuuuuuucucccucucccuuaaugcuuuccccauagggcauaacauuuaguuuucuuuaguagaugauuucauucuucuuaaaaaacucaguggcuucaaaugaaccuugggauaaaauacaaaguuuaaccauggccaaaaggcccuauuugacuuaguuauugccaggcuccuugaccuuaucuugugccacucccggcuuguccccuccuucagccauaccuuucuuuguagcuccuggagauucaauucuuucuugccagggucuuucuaccucugccucacauauucccuccaucucuucauuccacuucccucauccccaccccccacuccccuccauccucaauacacaaaugcuccuaggcacccuccuucugauccuguacaucuuaauguuguggugaguuccuuagaaauaacuucucugucuacuuuaucuaaaagagaacuuucuuccccauucuuuaaagaugauuuccuuagagagacuuuccuuuaccuagaggaaaucuuuccccucucauccuuagagauaacugcucugucuaaagaaggucuccucucccuauucccaaaaaucucucucagcuaauuguuugcuuacuugguaggacuuguaauaguaauuuauuuauuggcuaguuucuugccucuaagggaauguaagcuaaauuccuccauuaagagcaggaaucagccaagcacaguggcucacgccuguaaucccagcacuuugggaggccaaggcaggcagaucaccugaggucaggaguuagagaccagccugaccaauauggugaaacccugucucuacuaaaaauauaaaaauuagccaggcgugguggugggcggcuguaaucacaguuacucaggagacugaggcaggagaaucgcuugaacuggggagguggaggauacagugagccaagaucaugccauugcauucuagccuggguggcaagagcaagacucugucucaaaaaaaaaaaaaaaggcagaaaccaagguuguuuuagucaucugguaucucuagcacuuaggaccuugcuuuauguagaggaagcacucacuucauaucuuuuaugaaugaauagaaaacaacaaaagaaaacaucucuuuaaaauuaaaaauuuuacuccugauuauugugucuuugguuuauuuuaccuuaaugacaaagaaauugaauagugguccuaaucuuugaccaagaauugauuagauuaaucuugugauaagaaauuuuuuauuaaauagucaacuauuaaaaaaaauuaagccuaggcaauguggcgagaccccaccccuacagaaaauuuaaaaaaaaaauuagcuuagcaugguggcauaugccuguaguucuaccugcucaggaggcugagguaggaggaucgcuugagccaggaguuggagguugcagugaguuaugauuguaccacugcacuccagccugggugacaaagcaaaacugugucucuuaaaaaaaaaaaauagaauaaaauaaaaauuacagcaauauuucuaaugcaagauaauuuuucuaaaugggaaaaucauauuuauaauuauacuuuggaauaauuuacuuagaauauuuuuuuuuuugcucaacauucagaauauagaaaaugcauaguaauucucucacacacgcacaugcacacacacacacaccagaacaccaaaacaaaacuuuccugccucuaggcagcauacauuuuuaagagcuuuacugagauaugugacauacaauaaacuguacauauuuaaaguguaugauugaccugcauaaauuccuaaaugaauguaacccugaacuugccuuauaaaguuaucaggaaaaauaaacuauaucaaauaauguaugcaugcaagagacuaccaaaugaauaaugaagauuaugcccucagugaauagcaaaugguuuuaaaaaauauuuauagauaauaucaagagaaugauugcuccucauaaaucagaagauauugcuuacacuuuguuucauuuaaacuuuggucugccgcuuuuguauuuuagccggauguuucuucucgugggagcucccaaagcaaacaccacccagccugggauuguggaaggagggcagguccucaaaugugacuggucuucuacccgccggugccagccaauugaauuugaugcaacagguaaauuuugaugcacaauuuucuuuucauugauuucauuugauuuuuuuuuugcaauugguuuaguuuaaauguagccauuuaauacaauuauauagauaagcaccucagcuucacagggaaaauuauauaaagacaaacgauuuauuauaugauuuuuuccuacaauuuuugugguagaugaaaguauuaaaaguacguuguguuuccauugguucagaugucuucugccguaaacugauaauaucaacccacagaaauuugggguaaaccuguuaggauguuuuuguaccuuuucugagaauagggagcucauaggcacagaaaggcauucugcugcuucucugucaaccaaauugaagcaugacucacuauuguagaagaucaaaucucugaucaugaauauauccaagccuuaggcugugcuauaaaaagcaguugaggaggcugggcauaguggcucacgccuguaaucccagcacuuugggaggcugaggcaggcagaucacgaggucaggaguuccggaccagccugaccaacauggugaaaccccaucucuacuaaaaauacaaaaauuugcugggugugguggcgccugccuguaaucccagcuacuuaggaggcugaggcaggagaaucucuugaaccugggagguggagguugcagugagcugagauugcgccacugcacucuagccugggugacagagggagacuccaucuuaaaaaaaaaaaaaaaaaaagcaguggaggaaucuuuugcauucagguggacuuaggugacguaaacauuuaucaagacuuuguugggaaaauuauauauuaugguucugauaacaggagaauuuuagggauaauuuucagugucagaauugugguagcaaggagaaaaauagcauguguaagaugagaaauaagcuuuacauuuuugccagugaaauaaaauaugcagaauucuguacgcauuuauauugguauauuuauauauauuugugaaaucuuagauaguccuuaaggaaauagugugacauucuucuaguacaauagucuuacaaaauuuuuuauugauucugauuugcuggcuuugacagagugcuuuaagauaaaccugcagaaaauuaauccuuuuuuccauauuguuauuuccugccaguacuaaaauauauugauucugggaaauaugucagugaaacaggaaucaugauguggacuguuccauuugacauugugaucagugccaaaaugauuguuagucauuaagccagcuguuaaugggaaccagaucacaugcacauguuuucaggguuuuuuuuuuccauuugaaauuaucuacauuaaacucuguuguuguauuuuuccauauauggcuaauacuuggaaaacuccaagaguuuguaaaaaggcccaauuuuaccauaaauggagaaauaccugugacucagaauaugauaguuuuagggcauuuauugucuaacaaaauaugagaacuaauaaaaggaaaccacaguuuagauuuugauaggucgaacucuucagauguuucuguacuuaacacuguagguuuuugugcauugcaagauaauuuauugcuucagauaauuuuuuguuuauugaaaauaacauuugcacaugguaaaacaaauuuuaaagagucucaaaggguguacaaugaaacauacaacucacaucagucuucucagaagcaaucacuuuuuuuuuuuuuucuuuuugagauagggucucgcucugucacucgggcuggagugcagugaugugaucauggcucauugcagccuccaccucccagacucaagugaucuucccaccucagccccacgaggaguugggacuacagaggugugccaccagcccggcuaguuuuuauguauuuuuuuuuuuaaagagaugggguuuugccauauugcccaggcuggucucaaaacaucugggcucaagcagucugccccccucagucuccugaaguccugagacuacagguuuggcccacugugcccagcaugaggcaauuacucuuaacaauuucuuuuauccuucuagaauuuucuuacuucuauauauguaugcauccuugaaaaaaaggcaacucaaaaaucugaugccucccugcaccguucuaacaauagaaaucucuuguagauauuuccuuaucggcauaugaauuuaccucauuuuuuguaaaucacugauacuauucuauuguauauguguacuuaauuugcuuaaauuauauuuucuacuaguggauacuuugguuauuuccagucuuuuauuaugaacacugcuguagugaaaagguuauacacaaguauuuguacaaauaugugaauauaucuguaugauaaaggagauuuuuggaucaaaauguauguauauuuaaaguuuuguuagguauuguauacuuucccucacagaaguuuacaccccuccaguuguguuuugaaacccauggcaaccucauuuauuagcauauuuuuaaaucuucgucaguuuuauaggaggagauaguaucuguuauguuaauuugcauuucuuuaauuaacaguaagacugagugucuucauauuuguuuguaagccuucaguaucccuuuuccugugagcuacuuuuaguauauuugcacauauuuucuguuaauuugugauuuuuaaaaaaugaaucucaguuuauggcacuccauccuuucaguguuuaggccagaaucuggagcuguguuugacauugaaucugucaguaggucaaaauuuaacugcuucuuaucaguccacugcuaauauccugguccaagccaccacugucucccaccuggacuauugcccuagauuucugaauuagggcauugccaggaacgagauggcacacuuaaauugagguauuuugacuauuuacagaggucugugcagguaccuggggauugaucguauaucagcacuaguuaaaaugugaccucuaggccugaaggcagcgauuaccagaaucugaagacagaauacuagguguagagagccacgugacaggagcuguggcuuuuuucagagggcaggagccagcccaaaaugaccaggggauuaaaacaaugagcucacucugcuuccucccuuugauucucugugcugugccucauaaacaguaggcacauucccacuucacccuugccugggcuguguuuccugccuggaacauucuuucccuaaauauccacugaguaucugcuucaccaucauuuugagaauugcucagauauuaucuucucagugaugaccaucucauuuaaaauuccaacucccucuucucaccuuguacuuccauccucuucucuauuuuucccaguaauacuuacauuguuacauguuauuuauuuguuuuuagugaaugucucuuucccucaauuagaauguaaguuccaugaggaccguuuuuuaucuuuguucauugcugagacuccagggccuaaacauugucuggugcccagcacaaguuagugcugaauaaauugaagagaugaauguacgauaagagguuuuuauauaguaaggaaauaacuaaaguccuuuagugguuguagauguguauauauauauauauauauuuauauguauaauacauauauucuuauguauauguauaauauauucuuauguauauguauaauacauauauucuuauguauauguauaauacauauauucuuauguauauguauaauacauauauucuuauguauauguauaucuuuugucccuguuuaugauauuucuguaauccuuuuguauaacuucugagaccuccccaguggaaaaacaauuaagacuucauuuuuuuacauuaguauuuuuauucaaaugguguuuauuugaauguaagaggacaacauagauuuaaauaauccagucaagaaaauguauaucuaaaauagccacauuaaacuauaugguauugaguuucaaggaagaaaugcuuauagcuuaucgcauccugcuaaacuuucuuuaugucucucucccaaggaacucuucaucccaucuuagcccaaacauauaagcaucccuacaauacaaaugccuucucucuuuuuuauuaucucaagggagacagaagcugagcagauaugugggguuucugaaggcagccucccuggggcucaaacccugguucugccaguuaccagcuguugacguugcacggguuacuguuagguuacccucaucucccuagugcaguauucucaucaaccugcuccauggguguggauuacaucgcaugaguuaauuuacauauaggugaagacuucuaaagugcuuaggacagggauuggcauguugaaauggcucaguaaacaugagcuguuucaugucgcuauuccucccuuuugccuucuuagagacccucccuauuccuucauuugcuucuguaucccugcuacauucucccuuuuccuuucuuccccaacuuugaaguguguuuaaaguuuuuucccugaaaaacuaaucaaaaacuguuuucccuugaacauguaucuuuucuuagucagucacaucuuucucucuucuuuccuuuacauccaugauuuuugaauacauauugugucuucaucacuugucaugcuucaauccaauagaaucacuguuggguuguggcaccgacccaacccagcagugauucuaacugcgauuguugacagcagccuauuugccagcuucaggggaugcuuaugguuccucaucuuuuuggacugcucuuuuacaauucaccccauuggccauucccuccuuaaaguuucugcucuucgucugcuugaaaugaucacauccuuuuaucccuccuaaacuugauacuauuguuaaaccucauggugucaugaaaaggaauaggccuuguaguuagacagacaugggcucaaaucuagccucugucauuuuuucuaacauuaccuugggaaaauuaccugccauucuacauuguauaauacauuccaggggugaucacgaagaguauaaauugguuaguuuauuuacuuuauuguguuucugagcccagaacagauuuuagugcuuaaaagugcccuguccucauguuuuuaauauuugggaaguaauuuaguuuaugaaacagucucaagaaaauuagcuguaauuauaugaugugggagauauuacaacacuuugucauuauucacauuuuuuuaaacuucugggaagaccuuugguaugcccaugugacuuuuucuggcccauaaaacauaaggagaauugugucauuucuggguggcaggguuuaagagcuggggcauuauucugccccuucccagaugucacagggaguagugauaguugaaaugguagaacuucugucaaccugaggccugugguaaggaagacauaaagcuuagacucuuacucauauguguguggacaaaaaaaaaucuauuguucuuuuuaacuacuugagauuugggggaugcuuguuacuauagcauaaugggaacuaaacugaauaacacauauagggauauuaaaauggaauauuaucaauaaucaucugcuggaaaaugguuauuaaaaccacuuucuauucugcaugccaguuuggucuuccuuuaaguuucuagucugacuuacugaguaucugagugacuaagugacuagguaucauugcuuaugcuaaaaauggccccugacguuaaguugcauuuggauugggagaaacuauaaauagacuaaguaccugauagggaugucauagcuuugggguuccuugaguauagugacacaaaacuggcauguguuuuguggcgacucuggaagcuauggcuauggaguuguugcaaaagauaucauuucuggggggcaagaggcuuugaagccagaaugacuccugcgucuaccagguuuuguuucuucauaucugagccgucaccuggcggggcaaagagaaguacucuggacagcuggguggacaguuguauaggaaaguucauguaaggauucucaccaaagagguaugucugguucuguccugcuggaaagcugugguuguguccuauauccuugcaaguagauuggugcuucauauggccuuugauaguuuugugaguuugaaaguuuaguugagccuuaggaagccgcagaugauguugcaucaacauuugaagucuguaauuguaugaaauauucuaggcugguugcugcauagucuguuucuccuuugaaaaaauagaauaguaacuauauuccuuccuacaaaaaagaacaaaccucagcuagcucuagaaucacaacaaaaauuuuacaguaaagugcuuggagauacuacaaaugcuuggcauuaaguaauauuuuguaaaaugguccuuuccucucccauucaccuuuuaagucagguucugccauacugguagucuuagugcacugaguacaguucucuuucuuauuaagcugaauuuuuuguugauuuuuuuuuucuuacugauguuauaguauguuuguuuuccugaguagacuauaagcuaucuaaaggcagggaacacauuuauuuccacucaccauuuauuccacuuccauaugguggguugccuguguguauguuccaugcaaguuuugggcucuucaugaaaaguaauagaaauagacucuagcuaaauuuaacagaacaagaauuuauuggaaggauguugguaacuuaacaguuaucugaaaaaauaagcaggaaccaagagaagcuaacaaaagaacaaccaguggauuuuauuguugcugguacugcuauugcugaauguggaguaacaccaugagaauaauuucuuguccaucaugccucuuugcaucauuuuauagagauuuaaaacuuuuauaguagugucuguuugggugagucuaagucucauaucugugaaagaccuggaaagccugucuuaucuuacacaacuaagaagauuaugagcuuguagagggaacuaaaagguauaggauuaaaagggugccuuuuucuccuuuugacuggaaaacaggguaauaggaaggaaacauccuuugcaaauaacccuuuuuaucuguugggcuaauuaguaauucaugaacuaauuuuacuuuguguuuaccagugacgucccuggauguuagauaguauaucauuuauuaaaaggccauguaacuguugcuugucacgugcauuaagacauacacuaguagcuaauuaagaaaaucuggauuuugcuuuuaagguaucauaacacaacuuucuuagcuuuuaaagaagacagauggacacuuuagaugugcuuuccuauccuguaacaugauuuuggugguuugaguuggggguaagagagaggcuuucaaaaauguauuugagagaucagucuaaaaguuauuuuacuguaauucugaaaaguagacauaaauagauucauaccaaaauaaaggaggcauaacuggaaaguaucuaacuuugccuggggacuuugaagaaggcuuccuagauuaguuggugacauuugagcuagcuaaugaaaaaugagaugaaauuccuuagaugucgaagaggguucuagcuugagaaaacaguauguguaugcugaguaaaagaaguuagggacugauaaucaaguaauuccaugugcccuacauauauauauauguaugugggcauaaggguuauacgugugugguggugggguuaugguguugagggcacgaugaggaauaaaacuggaaguagcugaggaaagauauaaaugaguuuuuaaaaacauacucuaaaggucuagccaaauaaauuuaccauuaaaucuuaaugcauauagaguauuauauuagagauagaaggaucuagagccccauagggacaucuuggacuccugguuccuuguagauuucacaugaacauugcagaugaacuaauacuuucaguacccgucuuauuaauuuuccuagucacuuuuuugguaaaaugauagaaguuacaugaaauaaugaauauuaucauauacauauauucaaaauauuauagacacgacuuuaaaaaauguggaguuucaugauacaaaguuuaauuuaguagaagguacaauccaggauagaaaaguuacucgcugcuuugauuuuugaauaauauuuaugcuuuagugagccuucaggaguaaaaaggaaaccuuaguccaaaauuuagauuugcaaaaguuaucuccaaaaugugcugcccuguuaauguucuuucaagaucuugacucuggcuugucaucuuuauuuuucuuuuucccccagauuugccugauagaauguauaaacaaagccacaacuaagauguuuuaaaaaguuucuuauuuuauauguuuaugcaaugauugaaauauuacaacuugcuuuugcuuuugaaauagcaguugcccucuuggauuuguaaaccuuuucauccagugacucuucauaauuuauagauuuuaagcaaggucugcauaaugacggaauaguuuuuuuccccuaaauugaaagaauaaugugaacuuugauauguuguggaauuagugaaaaugaaacaguuauuuuggguaugauuucuuuguuuuagucuaagaugauugauagguagaaaacucacaaguggaugauuuaguuuagggauuaaugaucuauguauuuucaguaguaaaguuauuccaaacuauaauagauugcgaugcaaaacaauauugagacuauucauguagcaaaccuagacugcucauguagucuguuaucuguuuugccuucauggcugcauucguuuccuguugcuauugucguaaguuaccaaagauaacacaucuguuaucuuuaguucuggaggucagauguccaaaauggauucacugggccaaaucaaggugagaaacuguuuccuuuccauuuccagcuuguagagccauuggcauucuuugucuugugguuccuucccuuaucuucaaagccagcaauagcuaccggggucguucucaugcugcauuacucgaacauugacccuacugccccccgacccuugugauuauaaugaguccacccagcuaauccagacuuaccucuuauuucaagguccuuaauuugaucacuucugcaaaguccuuuuugccuuacaagggucacauauuuaugugucaguuucugggaauuagaaguugaauaucucagggauauuauucgccuaccacagugcccuuuuauguauuuucuuuuuuaauuauuuguuauuuuuuucuuuaaaaaagagaguuggggucuugcuauguuagaccaggcuggucucaaacuccuggccucaagugauccucccaucucagccucccaaagugcuaggaguacagguguaagccacaauugauauugguuauacugcaagcuaugcugaggcaagaaccaugcuuauauaaguaggcauugcugucucucuuguucuuuuucccuuggcagcuuugguuauaaagaaugcaaacuagauuuagaagaugcaggcucagauucagacucugauacuuauuaacugugacguugggcaagcaccauccacaauuuccccaucugucaaauaagcauaauaccuaccucucaggguugccauguagaucaaaugagguaaugucagucaggcaugguggccugguggcucaugccuguaaucccagcacuucgggaggcagaggcaggaggauugcuugaguccaggaauuugagaccagccugggcaacauaaugagaucccauaucugauuuuuuuuaaaaaagguaaugucuaugaagguauuagguuggugcaaaaguaauugcgauuuuugccauuacuuucaaugcuuuguaaacaagaaagcauuauaccggugaagaaaggauuguuuauguugugcccauacuagaacuguagggaacuaaauaaauacggaaaaggaaagaaauaaagauaauuguggauauucuuaaauugauuauagcuugauuugcauuuuaacuucuguuauugugacauuugagaaaauccucuucuuauaacauguuuuccuuuucuagggaagcagaugcuacugacagucugagccuuggccauguuucuuaguaauguguuuuuuuuuccacccaaaaagauagacugcuaauguacauugagaaaagagaccauguaucacugcccuacgaaagucucuuugcuuagaaaugaaggcuuaccuaccuguuuaauuuuuuuuuuuuuuuaaaggagaagcuccuaccuuuauauuccaaauacagugaauggaugucaccuaccacuaacuguuucugucauacagaagggcagaggucagauuacucuucuuccuacccagaacagcuugcuggaaugcuugccauuuguuccuagaagggccuggcuguagguugagagcaaaccuuggcuaugccaguucuguggucaagaaaaaugcuguggaguauuuucuggguauaacuaggcuuuguauuuaauagagaauauaaaacauuuagcuguuuucuagcuucugcaguacaauuuccaucucguugcaauuaaaacacucaggcagacccuaaacuaacuuccuuuaaguuuuacuuccuccuauugaugaauuuucugucuuccagaguugugucuagguaucucuacaguugcaacuguccuguaaacuaaaaaguuaaaaagaaaaguaguuucccuucccuuguuaauacaaaacaaauuuauacuaaggauuuuuuaaaaauaaaaauguuucuccugauauaaucuguuauccccuguuacagaauuacacagagagcugguaagcaauuuagaaaucuuuuagucuaauuccuuuacuacuaacugacugacagucauacaguuagucaguauuuuaauguuuucaguauuuuacugaaaccaaacucacaagcucuuuuaaaguuucuuccuuucccugcucacuuugaccugacucaacccauucuuuaggacuuaacaugggauuggcuuuuuuuuuuuuuuuuuaauccccaguaaagagguuuugucuuaaaauguuagaugcuuucaggaucauuuccuuuucauggcuagaaggaaacaaaccagcauugauaaagcagugaguauuuucaaaaggccuguauucuuugugcugcacuccagcaggaccacuggaauugcucauggaagaagagggagauuuugauucuuuauucgcugugguaguaauaacuaacuaacucaaugaauaccaaucccagugaaaugagcuucauuccuguuuuccucugguucugcuuuucugacucuuuuuguuuauuuuugggaaacagcuguaucuuauuuuauguaaaagauguuucuggauaguucuauauaaauuaauaacacuuuugcauguccauggauuaugguugcagaacuuauuuuuguauauauaaaugauuuauuuuucaaauacuuuggauuuagggaacuuggucucuuggccauuuuaagucaauacagguaaguuucaagagacaucugaagacacuuuggaaguuuauaaagcaaauuguccuuucguuaauaguacuaguucuaauaucuuaccacuacuuauuauuugucagaguuucuuaaaucaauuaacaaacuguauuuccuuacuaagucaacgaaaucauuaaccaccaguuuagucuucaggaguaucuagaauuuuuauuuuuuaauuaguuauuuuaugcaauauucuacucuaauaguuuaauucuauaacauagaauagagguuccuaggaaggucagugcuuaaaaaaagaaggaagagguuccuaggaacgcuaaugcuuaaagaaagaagagcuugugugauuaaaauuuuuucuugaauuuuaugaacuaaaacuccuuuacauguaagagaugaaaauguaaacaaaguuaauuaagaggggaugugggagcuucaaacuaagcuuuuguauaugaggauugaaggauauuuauccacacuacuuuuuaaaaaaccuuuaaaacauuuuauaaauaaugcauguccauugaugaaaauaugagaaaaccagaccuacuuaaaucucaccacucaggaaaccaagggccauaggauauacuuuuguguguguauuugugcauguaccuuauggccuguguauauucucugugugugugugucuguguguaaauauacaaaauacauaaaguuauaauuuacucugucuccuguuggacauucuguuugacaugcuuauuagucuuaguucauauuacaaaaaguuuuuuuaguuaauuuuuaaaaauuaaacuuagaagucauaggaauguguguuucaagauuucugauacauauuugccaaauaggaaaauacugacacaagcagucuuugaacgaaauuugauacuaucuuccuuugccugacaggugaaacauauaucuuguuuuaauuuacauuucugucauuucugguaagcuugagucuuuuuucauaugcuuauuagcucuuucuggguuuuuaaauuuuguuuucuauuauccguuuucauucuugaucuauuauauuauucauuuuuauucuuggucuauuacucuucugacacaucuauuuuuaauuaauuuugaaaaagucauuuuuuauauauauauacauuucuguucaaugcuacagcuacuuuuucuccugacaaaucuguccuuuuuaaaaacaguuuuauugagauauaauuuaccauaacauugaccuguuuuaaguguacaauucaaugaauuuuuacuauauuuauagaguuuuguaacuauuacuacagucuaauuccagagcaucuccauuuacccuaaaaagaaauguguccaacaucagucucuccccauuuguaccuccagcccuaagcagcuauuaauuuacuuucugugucuacauauuuuugguuuuggauauuuuauauaaacagaauuauaugauacauagucauuccuauuguagcauguaucagugcuacauuccauuuuuauugccuaacaguauucaacggaaugaauaaacauuuuguuuauaccaguagaugcacauuugaguguuuucugcuucuuggcuauuaugaauaaugcuacuaugaacauucaugugcaaaucuuuguggggacauauguuuuccuuucucuuguauagaugucuaggaguggaauugcugcgucauaugguaaucuauauuuaccuuuuuuaaaaacugucaaacuauuuucaaaaguggcuguaccauuuuacauuucuauuaguaauguaugaggguuucagugucuccguauccuuguggacacucauauucugucuuuuuuauauuauaauaaccauccuaaugagugugaagccauauuuuauugugguuuugauuugcauuuacccgaugaugaauaauguugaacaucuuuucuugugcuuacuggcuguuauuucuucuuuggagaaacaucuauucaaauucuuugcucauuuuucauuugguuguuugucuuacugaguuguaggaguuuuucguuuuuuuuuucauauuauuuaggauacaaguuuuuaauccaguauuugauaagcaaguaauuuccccaguuuugaggguugucuuuccacuuuuuaaaugguguuuuuguagcacaaaaguuuuuaauuuuaauuggcuaauauaucuacucuuuuaucauuaugcuuuugguuuucuaaaucauugccuaacccaaguucaugaagauuuauuuccuuguuuucuuuuaagaguuuuauaguuuuagcucuuacguguaaaaaugucugugaucuauuuugaguuaauuuucugguacaguuugagguaugguuccaaauuauuuuuuuugcauauggguaucuaguugucccagcaucauuuguugaaaagacuauuucuuugccacugaauuugcuuggcaucuuugucaaaaaucaguugacugugaauguacaggugccuuugauguuaaaauguacuguuuauguacuacuaaaaauacuaaaagugucaccauuauaaauauaucacuguugacuauuguacacauucagauuuuaggcauacuaauaucugaauauuugcagcucugagucaaugauauaccuuauuuuuuuuuuuuuuuuuuuuuuugagacggagucucgcucugucgcccaggcuggagugcaguggcacgaucucggcucacugcaagcuccgccucccggguucacgccauucuccugccucagccucccaagcagcugggacuacaggcgcccgccagcacgcccggcuaauuuuuugcauuuuuaguagagacgggguuucaccguguuagccaggauggucucgaucuccugaccucgugauccgcccgccucggccucccaaagugcugggauuacaggcgcgagccaccgcgcccggccgauauaccuuauuucaaaauagcauuggguuacaaauaaaugcaugauaacaguaguugucugaccuccaaaucauuuucucucaaauuucccuuauaguauuuauugcucucugaaaauauuuuauauaauuauauauuacuuuucuccuugaaaagcaaggacuuaucugucucguuuaaugcuauauuacuagcauauagacauaggagguacccaugauuuaugauuuauuuaaauaaauuaauggauaaucuaagauauuucuuccacuaaccuguccauuuuuaccuaauaaauaagcauacuuuauuggauauuuuuuuucaagcaaauuuguuauaggaaguacaacuaaacaagugauguuugaaguaaaaagcugcuuaagaaagucugugaauugucuaugaaugcagggugguauuguuuugauagacauuuuuucuuucuuuuuuuguuuuuuuuuuuagcaaaaaguaaguuaaggaccugaauuauuucauuauucauaaaagucauagugauaaauaggaaccaagugacuaaaaccacauuuagcuucaaaauggaaguuuacucucuugcuuuucuaaugauuuagcauucuuguucacuuuggccauuucacaaaaaggugacauaaucuuguuccaagggauauucuuuuggcaugaaaagaagaaacaaaacauuuugcuuaggguaagaagguaauuguaucuuaaaaauaagcacugcccauaauuguccagcaaguugagugccaaauguguugacaaugccuuuggaaacaccggggaaaagaguuggcugcuaauaaggaguagagucgaaagcuacgacaauccgguuuucucauuugcuucuguccucaagcaugcagucaugggaguuugauaaaaugcaaaugacaaguuuccaaaccuggcaaaauaaacaugaaauuuucaagucucuagugauuuacuugcuuauuaacuucaaguuucucuagcaaaguuuuccucuguauuuuugaaagugguagcauagagccuuauguuaauuuauauaauacagagcaauuucuucucaacuuuauuagagaaagagauuuaaagauuaugaaauaaaauaauauuuaagauuuaaguuauuuaaauacuuuauuucgauaauuaaauaaaauuauuuuauugugugagauacucuuuuuuucuuuuuuauuuaucugggugaacagagcuaaucuuccaaugggguuugugacuauggacagaaaucuuucuauucuuggcuguugccggagaaagcauuucuuccagcccuugaguuucugcaguugucuguguccuguuuccuuuucaagugugucagcauaguccaggcuaucugaggagguccaacaucauccuaaaugcugacuucagggcugugauucaaaauauuuacuucacucaugugccucaggauagcugccaguuucacccaggucaugaaugaacuucuugucaguuugucuggagagcaggcuuucuuuugcauucucuucacccagucuauuuacacuuccucugggugaaacuucuauguaauguugaaucaaagauuuuaagacuuggucuccaaaaaaacaauuuugauuaguaaagacaaacuuccuaaugagcaaacuucuuaaaaagaugguaacaugagguuguaacucuguugcaggugaaggcauugaaagcacuggaugauguuauucuuuuugaagaccauugacuaaguuuugggugccaauauacgccaaugcauuauauccaguuauacuggacuacuuugguuuccaaaaagauaugucaaauuuguacugauuuugcaugaauuuucuagcuuaagcuaacccugauguccacaaagacagauauccauaacuguuaaggcaagggauguuuuugauacuuuuuuaaagaaauaggaaacagaacaugguagcuuugcaagccuaugcugcuugacagugcccagcagcauguugugccaccguauacaaauuuaaagaaaaguaacguuuguuaagaaaaacauucauggagguaaauuuucaaagugguacggagagauuggauaaccuuucacaaagaagaaauuucacuuuucaggaauauaauaauugagaaaaaaugcuuagcauagaaggcaacucaaaaaucccaucaagcccagucuuagcauggcauaaaagcucuugacaaaagugggaauguaaauuaauacagcuacuauggaguacaguacggagguuccuccaaaacuacaaauggaacuaccauaugaucuggcaaucccacuacuaggcauuuauccaaaggaaaggaaaucaguauaucaaagagacaucuguguccccauauuuauuggaacacuauucacaaucaccaagauauggaaucaguucaggugucuaacaacagaugaauggauaaagaaaacaugguguguguauauguauguauguguauauauauauauguacaugcauuauauacauuauauauaguauauuuuauauauauauauauauuuaguguguacauauauuccugucuccugucuguguucaggaauauguauacacacuggaaaaaugugguguguguacgugucuguguucagccauaaaaagaaugaaguccugucauuuauggcaacacggauggaacuggaggauauuauguuaagugaaauaagccaggaacagaaaauuaaacacugcauguuuucagucauagguggaagcuaagaaaaaguugaugucauagaaguaaaauguagaagauacuagaggcugggaaagguagggagaaugggaaaauagagauuuguuuaaagacacaaaauuacagcuagacaggaggaguaaguucuaguguuuucuaccacuguaggguuauuauaguuaaaaauaauguauugucuaauuucaaauagguagaaggaaggaaucgaauguucccaacacaaaaaaacgugcuaaauguucaaggugaugaacgugcuuauuacccugaccugauaaguauacauuauauguauugaaacaucccuauguaccccaugaauauguaaaauuauuauauuucaauuaagaaaaaagggcucuuggccaggcaggguggcccacaccuguaaucccagcacuuugggaggcugaggugggcagaucaccugaggucacgaguucaagaccagccuggccaacauggugaaacccugucucuacugaaaguacaaaaaauuagcugggcgugguggcgugugccuguaaucccagcuacuugggaggcugaggcaggagaaucgcuugaacucgggagguggagguugcagugagcugagaucgcgccacuguacuccagccugggcgacagagcaagacuccaucucaaaaaaaaaagaaaaagaaaagaaaaggcucuugauaaccacucccuuccugaccauucucucuaguuauagugaacaacucacaauucucuuaaaaaauucaagauuacccacucuucugccucuuugcacaagguuuucuuuuggcccagaaaacauuuccucacuuguacuguacccuuacuuuccuauaacucuuuacgggugccuauacuauuuuccaccauaauugcuuguuccuaugauuaucucuuguguuagagaaauguucccauaagaggcagacuaccauuucaucauggguuagcaucaugaacagacaaacacaccugaauuuucaguuaggauuugaauccagaguggagggaauaaaguuuccgggcaagaggaccuuggacacaaaugccugcagguggaaauaagcaugacuuguuucagagacuagggacgaaggauaagagaacucuuccgcauaaaaauaaguauaucagccaggcaugguggcuuacaccuguaaucucagcacuuugggaagcugaggcagguugaucccuugagcucaggaggucaagacuagccuggacaacaugaugaaacccuguuucuacagaaaauacaaaaauuagccaggcaugguggcaugcaucuguagacccagcuacuguggcggcugaagugggaggaucgcuucaguauaggagguugaggccacagugagcugugaucacacuacugcccuccaaaaauagaaauauuccuaaauuugaaauugagggagauguaggggauugauuaaauaaaguauucuauggcuguauaaugggauacuacacaacaaugaaaaugauacuauaggucugccuuuauaagugccauauuaagggagaaaaacguacauauauuuauaaaaugauaauuuuaauguuaucuuaaauauugacuuaauaucaauuuuacauauaaaaaacaugcauguauucaugaaacaagucuuuaggauagauacuaauguguuaacagaggucauuucuuuauggugggguugugguauuuagaucugucuuuauggcuuuguuuuauguuuugguuuguuuuguaaugaauaagacaucuauaauuagaguaaauacaauaaaguguuaaaaggguaagaagguaccauuggucuuguacauauauuuuguacuuauugauugcugugucuuaaaaauuauugugaaaauuuucaaacuuauagaaaauuucaauuucaguaauacaaugaacaacgaacaacacacuuguucaccuagcuucacccauuguugcagacauuguuacacuuaucccuaaauacuugagcauguaucuccuaaaaacuaggacauuuucuuauguaaguacaauauagucaucacauguuagaaaugaaucauuauuaugaagaauauuaacaguaacaauguaauuauugcugaauuaaacauuauuacuguuaccuacucuaguucacaauucaaauuuccacauuuaucccaauaaaguccuuuguaacuuugaaaaaaaauugucuggacauaaaauucaaucaaagaucacaucuugcauucggucgacaugucuuaguggucucuuuuaaucuagaaguguuuccuacucuuuuugucuuucaugauauugacaauuuugaggacucuaucccagguguccuguaggcaaguaaacuuauauugguaagaauauagugauguucgaucuaucccaaugcaucauuuuguuuuugacacuggaauuuuaguguacagaaauaauuuucucaauagugagggcugaaguaauaaaaauaaauguuugauuguagugugccguauugaauucuuuuuucuaccaaccaaaucaaguuuccuggauucuaauucuugcauuguuaugucuuaggcacacgucucagucuugucuuuuauagcauuuuacacaaagguguuucauagcauuuaauuuucauaauuaucuuuaugccccaccgaaagaucuucugggaauaggcgaucauacguauuuguuuaauaguuaauuaucuaacaguugagcaacuggaaaacuuuauuuacaauugcuuuuucaaucauguguauuaugauaauggggcuaauaauaacacugagacacuucugggucaucauguauccuauguuucugauuacuugaaagucucuaauguauauaaacuguauaugagaaaaauaaccaguggaauauuugauuaaucaaagguguacuauuucucaaccuagcuggggauaaaaauaaacuguuauauuaagaauaguauauuuugugucuuaccacucacaauauucuuuuuuaggcaauagagauuaugccaaggaugauccauuggaauuuaagucccaucagugguuuggagcaucugugaggucgaaacaggauaaaauuuuggugagucuucuggauauuuacuuacaggugauuuuagucaguuuauguggagacacagaagguuuuauauuuucaggcugauaguaaaauucaguaugcucaagggcacaggguauaacaacauaagauagcucugaucaaaggccacucuguccaaggaggccaucucucuugcccuucuugaacaggcuuucacauuuuuucacccuuauuccuacuuuguuuuaccugccccacuugacaguuccuaucaguuuauuuccaccuagccaaguauaggaauaguguggcuuuggcuaacaagugcuuuaauacuuccucucucucucucucuuuuuuuuucuuucccugagacggagucuugcucugucacccaggcuggagugcaguggugcgaucucggcugacugcaaccuccgccucccagggucaagcaauucuccugcugcagccucccgaguagcugggauuacaggcaccugccaccaggccuggcuaauuuuuguaguuuuuaguagagacaggguuucgccauguuggccaggcuggucucuaacuccugaccucaggugagccaccgagccuggccacuuccucucuuugaaaauacgacacgauguugaaguggaauacagaacaaagaaaaaaaaauaacaaccuuccuucaccucaucucccccuaugccacuguccauuccucugcuccucuucucaguuucugaaauguuuucuaugguaaccaucguaguucuuuacuucacauucccuuuccuaugucaucauugacuuucaggucacugaaauccacuagcauuuauacauaugugcauacauacacaccauuauguuuuguuuucucugcugguauuuauuuuuaucuuucuugcacugucagcauuauucagaauggucaacaucccuuuuuuuuuuagaacuaaauuuuucuucucuugguuucugugaacuguauuuuccugguuuuucuccuaucuuacuggcugcucuuuuguagucuccuuuaauggcugcucuuaacguucaguuuccaaauauugggguauccuugaucucuauuuagcuuccuuugcuuccucuaacuacaacuuuuaccuagagguuccuagccuaacccauggcuguaaguauaauccccaaaucuauaccucuagcuuuuaauucucccuggauccuuaaaggcauauuuccaggcuaccuauuuggcuuccaaaugaacauggccaaaauaggacucuuguuuccuuccaucaaagaagaaaaacaaauaaaaaacuauuauuauauauauuucccaauuuuuuaggaggccuggguuuccacccuauucacuagugagcacucacaaucugccucaaaaauauaucucaacauuuaucaguagaucuacauguccgcuauuucuacccugcaacaagccaccaucauuacccccuuggaccacugcaacggcucuucucauccugcugcugcuucucuuacccuaacugcaagaaggaccagagugaaccagagcauuuuaccuucuugauuaaaacagucaaguggcuuucugucacucucugcauaaguaugacaagcucauacugccuuaaaaacaucuccaaaaacaagucacuggcuaugucuuuggccuccucucacuccaucucacauacuaaagccaggcuuaucuuuauuucuuauacauuccaaauuauuucaguuaguaccuuaguguuuguguuuccucugcuuguauaaguugucuuuaugauuucuacuuggcuagcccuuugucauucagauuucagcugucacucagauuucagagacugcuccgccuauuuuaauuauuuacguaguauuuauuguugccuuuauuuuuucaucuaauuaugcugcauagggaaggauuugcuuaggaggugaaguuuuagcagacuuuaaaggaugugccacauuucagcaauuggaggugaaggaugggguuaagaguggggauguucuaggcagaaggaggugcaaagaagcaggaguaaggaaaaggagcaagccacccacucuggagcgucaaguacguguagagaaguagcugcuaugaccuacuuucacuguuuucaggguauauauacaauaagucaguauugauguucugcagugcuuauguuagcacuuugcuucaaaaaguauuauagaaaaucaauuaaaccuuuuucacuaaaugaauuguuacacauuugguagauuacuauguuguuaaagcauucauuacucuacugcucuaugugguauuacagucuagaaugcugaaaacaaaaaggucaugguuuauuuggaaaguaaauaaaauaaguacugcgcauuauuuuacucucuuaauaaacuauuugcuguauaauuuaggggguauauuccauaugcaugaguguuacuuaguucaaaagcuaguuuggucucuaccuuuagcauagcauauuacaucaagaaauauacuaccugaaauaacaauuuugcuaacuauuuugaaaaaaaaaauuggacuacaaauauggccuucagaauaaugugagaaaaagacuucacuuaauaucuuuauuuaccacuaugauaagaaauuuaagguauaggauagguuugauuaauuucuaugaaugcuuugaaaguuggccaggugugguagguaugguggcucacaauuagcgcuuugggaggcugaggcaggaggauugcuugaguucaguuagagaccagccugggaaacauagugagaccccguuucuauaaaaaaauuuuuaaaaauuagccaggcaugguggcaugcgcauguggugccagcuacucaagaggguaaggccaauuauuugagcucaggaguucaaggcugcagugagccaugaucacgucacugcacuccagccugggcaacagacugagaccccaucucaaaaaagagaaagugguauuauauucugaaguaguauagagcaucugaaacacuaaauuuuuagaaaaucuucgugucguggacuaaaccuuugauuuuaggccugugccccauuguaccauuggagaacugagaugaaacaggagcgagagccuguuggaacaugcuuucuucaagauggaacaaagacuguugaguaugcuccauguagaucacguauguauaggauauuguaccagcuuuuaagaagaggggugggaagccuaguuuguuaaaaauaugugugugugggugugugugugugugugagagagagagauauuaaaagauauagacauauuaugaugauaacaaaaugaaaacaauccuacuaauguaaagauauuacaaaugugaaguaaacagguuuacuuuuucuaagaacucauuuucaucuuccuucguuaguauaauaauaguuacuaccugauuuuaagaaucuguauuuuugaugacuaacagucaaaagaugcuuaguugaacuucucuuaacagagaagauguagaccccacaacuaaagauucugauucaguaggucuaggucaggccuggguaccugcacuuuuaacagacucuacaaggcaauucugauagauaccaaaguuugagaacuccugcuuuauauuaauaaugauguugaaaauaaagaauauuaugucuuaaagagccaaaguuuauauaggaagaugaacauugaacucaggagucuugacucugaauuuuccugcucuuaaucagaauuucuuuguuaaccugcuaccaagcccaccccuuuuuggugauccagaggauuuuaugcucuuugcuaauauuacuugaaauuucaaaaggaauuaauaucauggcuaaagaugacuucaagcaauuauaauuuugauuaugcuuuuccaaaaucucuacauccucuucucuuuggagauuccaguccuuuugugccccgcuacccuuuguugaauuggcuacugcuuuagaucuuccuuguaccagaagcauaaaaauagguuacugaaaugcaguauaguguuuaugccuagagcccuuaggccauuauuuuuuguguuccacuggucaccacauaguuuauuagagaaaauuaguaacaaaagcacaacauguaagacucuuacuccuacauuuguuuuguccauguuaggugaccugugacaccaggucaaaggaacuauucuguccuccagauucuaaguaguugaaccuacaggaaacugcagauuauuucaauaaacacuuauuuucuuagcccaacacuuugauccuaccuguuauaagugggaagugaacauuaaaagagugauaccuacucagaucuguauuguguguuaggaaagagaaaaaaucagguuagaaagcauacacugcacaggaugagggaaauugaggcuuuauccucagugcuuggaugccaucuguacugccaucuuuauguugguauuuugguuaugguacugucaucuucggugguauguagagaaucugaagauuaaauuuguauuuuuaauuucuauauugcaaaaauguuccuauuugaaaagauaauuuuauagcuacgaagaaugaguuaacccuuguuugccaaguuuguuacuuauuaauuauaugauguacacacacacgcaguacacucuuauuuucauuugaugcaugugggaacugagguucacauaguugaagcaaucuuauuuccacaucucaugggguugagaguggggauauucuaggcagaaagaggugcaagaaagcaggaguaagcaaaaggagcaagccacccacucuggagcaucaaguacguguagagaaguagcugcuaugaccuacuuucacuguuuucaggauacauauagaguaagucaguguugauguucugaauggucaaaugaggauuuaaacccaaguuguucuauuccaaaagaaccuuuccucuacauuauucacaauagaaaauguuuuccauuucaguugcuucuguauuaagcacagcuuuucuacaaagaauaccuccugcuuucaugaccuagguuuggauaauuccugauauguaagaauacauggaacucuccugaaaacaugcguucuaacaaugauucccuuguucacagaaugcuuuuauuugguuuaggcacagaaauuauaaagucauuuaaagccauauuuucuaagguauuuaacauccaaaucaggucaaugaacuguggcuugugggccucuuuuugugaauaaaguuuuauuggaauacagccacacccauuuguugauguguuaucuauaaucaucuaguacaguugugagaguugaguugccacacuguguggcuccugagccuaaaauauuuacuguucggcuuuuuacagaaaaaguuugcugaacccuaaucuaaauaauaaaaccucaaaucuuaggaaaagcuuaaagaacagucucaaaaaacagaaaagcaaagugcaugccuuuguuucuaauaggccugacacuuucaguaacccuugauuauuguacaugcuuuuugauucaaccuuugaaauguuaagccaccuauaauaggccuaaauugugaggggcaucuuguucagagaagaagacucaggagcggaagucugagaaccuggguuauauucugacuuugugcugacaauccaccuauagcuauggguaauucaccuaaccacucugggccuuuguuucaucauugguaaaacaccaauucacacaaaaaacuucugagguauaaauucaguguuuuuuaucuguuucauacuucaauaaauuaugcaaacgaauaauugguuuuaugagaugaugucuguuuuguaagacuacacugcuaacuuuuuaauaacuuugcuugucuuguggguuauuuuauuuauuuguuugcuuuugaguuuuuguuguuguuguuguugguuaguuaguuugguuaauugguuuguucuguuuuuaaccugacuuauauggacaccguggacaaggaacuucacugucugucacuaacuuaccuuauuacugauuacauuugcuuucagcuuuucauaacugcaugauaaaaccucagaccuuaggagaagagcauaaaaaacaaccucaaacaacaaaaaagcaaaauuacuuggggaaauuaaguaacuugaccguggcuaaccagcuaguaaauaagagaguauagaccugacaccacaugugucuacaccacuacacugcacuaugucaaaucaacaauauacuuaucauuuccugaguaaugacaaaggacauuaugcaguagaccagauguucuucuguucuaaauugccuagccacuuuuguuccuucugucugcuuucugaugcuaauauuauuugaacauagauuuuucucaguaaugauuucuaguuggcuuuuccuuuccuuuugucauuacucagggaaugauaaagauauuauugauuugaaacaguacaguguaguguuauagacacaccuggguucagguccuacucucuuauuuacuagcugguuggccauggucaaguuaccuaauuucccuaagcaucaguuucccuaucuguacaaauuauugaguaauaauaguaucucuuauaggauugguauaaagacuuaaaaaguuaaugucauguaaaaugcuuuagcauaauaccugacucagaguaaaggcuuaauaaacccuagcugaucuuacugucagaaucaauaauauuacuauuuguaauauaauuaccagacuuaacaaaugggagaaguauuaaccaucugcaggaauaaguaccagagccugcaucaaaauaguuuauauucaacaugaagucuuuaaauuggcaaaagcacucaguuuaauauauaccuguuaagaaaauuuuaagagacagucaugguuuuuagcuggauacucugggaaaccaaauaaagcagauaauuguacaguaugauaaucaaaaaaaggaugucuuuauaaauagcuugaaauaguuccccagaugcaacuugaauaaaggaaauaaauagccgacuugcucuaacuugagguuagagcagaauuccuuagucugauucacuggaugcuggaaaccccugccccacauuuucccacucccucuugguuagaaaaauuuacauugguuuagcauuauacucuugaggcuauuuucuuucaaaaaaaaaaaacuuuaaaaaaauuuagauauuaaguguguaaucuuugggcaguuuccaggcuuuaaaaauggguucaaaauuucugaugggauuauuuagcagaaguucuuagaaguuuguccuugugacugaaaacagauauuuuugguuccuguauuuggguggcaaacaaaguaacaguacagcuuuaauguauuuguaacauuggccacagugagucuuugauaacugaaggauaguguuuuccauuguucucuguuauccucaaaguaaaauaaggggaaaguguucagauucauccuuacauguguucuagguacuguauugcucaugauuaaaauuaauuuaaauuaauuggcuaauuguucagaauuaaucccuuucuaugagaacaacuaaaaagggaacaacuacaaaagaguacaacuauugagccuacuaugguuggaaaauacuugaaaguaucauuuaaagaugguuacuuuaauuagaucuccguacuaaacgugggaggauagcuuuauauuuuacuuuuugaagagcauuaaguucuggucuguccauuuccugaaauucugagcuauguuauucaucucuguuguuggcucuauaauguauguaucuguuugcugcuauucauaauaacaaaggucuuagcgaagaccuagcaaucuuaggguaauaggaagacagaggaauuucauauuggaauuuuuaacuugcagaucacaacuuguuaguguuuuaugaaaucaguguagugggucaaaaccacuauaguuuuucuaaaaaaaaaaaagaaugaaauaaaauagaaaaugucagagaguauucuauauaauaauacaaauauuguuugguaagauuuuaaguuguaucuauauauuuuauacacacaauggguguuggguugugauauaaauuauaaucuuuuuguggauugugguuaacuaaaggguuuaaaauuuaucauuuuaguugguuucuuuguucucuggugacugguucagguauuuaaucuucguuuccguaucugaguaaauggugcugauaaacaugcauacucucuuggaaugugguaauaacuaagugcccgagugaaugaccacucucaaaaauugguacauuaucuuaugauucuagugauaucagauuuucucauguuuuguuuuguguuguuuguuuuuggguuuguguauauuuccaaucuuuuuauuuuagaagauauugaugcugauggacagggauuuugucaaggaggauucagcauugauuuuacuaaaguaaguucuuauuuaagacugaaugagauucacaucuaccuuauugacuagacugugguuaaaaauaaacuggucaauaccucaacuccuuuacagcuguuagcucuuuaaugaaaacaguuaauaaaacgauccauucauuuugacauucuuugucuuauauuauucccucccuaguaaacauugcuuauuugaaauagggagacaucccccaucacucugggaauggaggaaaguagacacucuccucaguaaaugauagguaacuauuaugacuuaauauuaaaauuuccaguuauaugaauuuauagcauauuaaaguuuucuauuuuuaauuaaaguuguuuuucuuacaaaagcuaucaaugagagcuuuauuacaaaauuagaguuacauaaaagcugggaaacauguauguuugccaucuauuaugugccuauaggcacuaagugaagcugacuucacuuauguaauguguaauaauuguaagaaaucucauaggcagggcucuauguauuuuuaacuaaauuaauauucucuucagaauugauauuuuuaaucuauuuuuugaaaauaagacuuccauuuaaauguucaaagguaaauuuucugaaguacuuuucuuuauuuacuuuucuuuuguguguuuauuuauuuugguggugggggaguaugcacauuuugaauaucaaauugagaauauucuuucuagagaagucuaaaaacuauguugauggauuauauguagaccuuccuuagaaagcuuauauguacgcuuucuuagaaaugugagcaaagaggagugccuuaaauguaugaaaacaacugaaauugaaauaauaugaugcauaagaacuaauaaagcauuuucuuauuuuuuaaaaauuuguaggcugggugcaguggcucaugccuguagucccagcacuuugggaggcugagguaggaggaucacuguagcccaggagaccagccugagcaacauagugggacaccaucucuacaaagaauuaaaaauuagccaggcaugggugacaugugcuugugguccuagcuauucgggaggcuaaggcaugaggauugcuugaacugcagugagugaggcugcauugagccauguucaugccacugcauuccagccugggcaacagagcaagacccagucucaauguuuuuuuaaaaauuuuauuuuaucuguauuuguauuuuauuaauuuuuuuucuagacuagguacugauaauuauaguuaacucuucuuacuagguaacuuguuuuuaauacucuaaauuucauacuauauuacucaaaauucagaauguaagccaaagagagauaaaguauauuaauaaauguuagguuuaaacuuguaugauacauuuccaaauagguauuauauauuuuuaaaauauauaauguccaucuuuucuguauugaugccuauacaaccauaaccccagaaguacucucauacugugaaagucauugcuaaauuagguauucacuuucuuaaacacauuucugagaaaagggugucuuuuuagggcagaugacuuagaaguucuuuuacguagccaaggcaaaagauugucuauugaaagcuuggaagggcuauauguacauuuggaggggaaaaaaaauuuaucuuaccuccagcaagaagagauuucuaaaauauugugcugaaacacaauauaccuaggauuagacacuuuuagauaguuaaauauaagaaaugcuaggcaagcauaauuuguauauguauaauacacccugaaaauuuuauucucaacuucacuucuguuuagaucugagacacuaaaaauauuuccuuuagcagaaaauucuucaaugauuauagaaagaaaauuugcuguauagucacaaauuuaauauacaaaauuaagaagugccuuaaaaaaauuguaaccugauaauacuucgcauuaguccucauuucaaauaugugaagcagccaagauccacaaaaguguguauuuucauguauugaaugaauauauuaaaauguuucuuuuaaauuuuauuuuagaaaagauacagugaaaaccacugaaacugaguuagaugaauuugagauuugacuuuguuugcuuuaauauauacuagauagauagauagauagauacauagacagauagauacauagacagacagacagauagauauaaaucucagcacuuuaagaggcugagcugggaagauagcuuaaagccaggaguuugaccagcuuaccagccuggauaagggaagacuuugucucuacaaaaaaaaaaaaaagucuuauuaaauuuuaaaaaauauaauuaaccugguaaugauauaaagauacaauacuguauuguucagucauguauacauauacauauauaucuuauguuuuucauugauuucuauuuugagagauauuuguucuuuaaauauauaucuuuuuguugugugauuucaucuaggcugacagaguacuucuuggugguccugguagcuuuuauuggcaagguagguuaauauuuuuuaaauuacaauuggugacuaugugucgcugauucaccuggcuaauuguaugccuaugacauuuuacaaauuauuuuaaagaaagaaauggaaauacaauuaaaguauauaaacacuccauuuuacacaguguuuuuuaaaagaauauauauaauauauauuaaauauguguauauuccuagaagaaaauaaacugaauauuuaaaaaguaaauacauacuuuuauguuaaauauauuuuaaaaguaauuauauaaaguaauuuauuuuuauugugugugauauauacuucuccaugucuguacucuaggggccaugacauagucauuaggcagugugcgaaaccaaucuguauaggccaacuguggcauucuaaaaguugaagguuuugaaaguauuuugaaguugcucauuaggauauuuaagucauuauuuuauuauuacugauauugagaaugaucucuaaguguuuggggacuucuuaaaaauugaagcugggcaugguggcgugggccuguaaucccagcuacucgggagguugaggcaggagaaucacuugaacccaggaggaggaaguuguagugagccaagaucauacgacuguacuccagucuggguagcagagugacacucucucucaaaaaauauauauaaaauaaaauaaaauuggaggaucuuaauagguuuuuaaaaaauauuaaacuggcauugauauaaagaugcauuauuauauuauucagucauucugggaggccuaauuaaauuaccauuugaacauauguacaauagauuauuguugacagugugaauauagauaacuaaaacuuuauuugcuuuauguuucuuuauguaucauuagagauacacaauuauuuaucucaucaauauauugacauguuuaguuucugcuaaaaagugccauuuaugaggugaacuauuuuguauuagcauucugauauucaagcauugucaguguuuggaagaauuagaaaaccuuugacuggauugauuugaaaguuucaaauuuuacucuauuuucuacacuaugcuuuccugacuugcuucuuuguagaaaacaugcuugcuuuugccuuguggagagggaagcuaaagaaagagauuugcuggaggaugacaggauggaaggagaauaagaagaaaagaaaacuaggaauaagugaaauauugaaagggaaggcaaaggagggaauaaaaaaauagaaaauucaggcaucacagacagggaucagaaugugagacauagcaaagcugaaaaauuggaauuucuaugcauuauacaucuauugggaaauaaaaugauuuagaaaaauuauaauugaguuuuacuguuuuaaaacaaaaauagcaguucuaaaguacauaugagaaaauaggggauauuaacacuuuauaguuagauauagaaauauggauuuauuuuucuucuuuauugcugauuaugucauucaguggaggggaaggaaguaucugaugagcaugccugggaaccaaaacugucaaggaagcuaaauuuugugauucucaguuaggacuacuuguuaacucugucuuuuuaagagauacagcugugaaaauguaugaccuuuuuuuuuaaugccauggguauugcauaaauaggaauaauaauaaauaggaauguguaauaauuaggacacaguaauaaauuaggacagagagguacuauuaauauuauauuuauuagaauuuuauuacaaguugucuguaauauauagcuagcagacucagugaauuggcaaauaguauuuuguuuuaauaagauuaaaaucagcagaugucacccuggauaaguacguuagaaugaauuuuuucacagaucucagaauugucguuguuagaauggagaaaagaauaauguuuuauucagaagaaauaaugaauuuuccucuguucuucaauucaggaaauguuuauugaauuucauauguucuugguaccgcugaagcccagaugauaaaguagugaccuggacagagaaagugcuucugugcuguagauccagucucugugacugaacagaugggaacaggacugaaaauguuagcuguuacacauuucuuucuaaaacagcagaaaugauaagagauuacuguguccauauuguggagacaacacuugauaaaccagcuauccuuucuuggcauggagggcaggcugauuuuuguguagucaucuagauuucuugucugcuuaauaacaagguugugaacaaaggugaacucauccauucagguuguuuccuaaagauguuuaaauuacuaguuaaaaaauaucaauugaaccaauuauucugauuauaaaaguaacaguauuguuucaguaaauuuuucauguuuuaauggauuaguugggugauagccuuugauuuuauuauuccguguauuuaacauugcuuucuagugauuuaagacaaguccuguuuucuuaaauuuuuauuagcagagacuacuuuuaaguacuggcuuaaacagaaauaauuuuaaguuaagaauauccauuuucaaauugaguaugaucaaggagaguuauguacggcuaauaauuagaaguacuaauaucuaauauuguuuuccuucaugcagguaccauacauuaucuguaucauaaaguuuccauuugaagguuauuuauuuuauauauacacccuuuuuuaggucagcuuauuucggaucaaguggcagaaaucguaucuaaauacgaccccaauguuuacagcaucaaguauaauaaccaauuagcaacucggacugcacaagcuauuuuugaugacagcuauuuggguagguaaaaccaaaauuuacucauuuuuggaacugugguacauauaucuuauaucugaguauggucuuuuaaguagaaaaauauuuuaugugaaauagauuaggauuuuuugaaacauacagaauauacaauuucaaauuguuaaugaguacuuugguuauguuacguuucaguaauugaaauugaagacagugauuauuugugcagugauaauaauaauagcuagccuuuaagauaugcuuacuguguucugggcauuguucaaggugacuugguuuguauucacucauuuaauccucacaagucaagcauacuguauuauucucauuuuguaggugaaaacacugaggcacugagacgcaaaauaacuugcccaaagucacucgcuuguaacuugcuguucagagauucaaauggagacagucuaacuccugaaguuuucuucaugauguuaaauaaaaguuuuggucuuuaggacuuauuaacauguguucucucuuucaauuucuuuaugauauauuaaaacaagucauauaugacagaaauaguacuugcugauugagagaauuuauuuguucuuuaugaugaguuguaaauuugguguuuuuaacagacuccuuuguaaaguuaauaagacaauuguaguuuuguaauaaaaauagacuauuugaguauuuaacucaguuucauuuaaaauucauaugucauauauauaugaaucuguuaugacuaggggacaaaauauugcauaaguaaaggaguuucuugaaaauauuuucaaggaaugcuuacucagcaagccugcugaagauaacguccuuguccugaugguucuccccuuugguuuccuguuuagguuauucuguggcugucggagauuucaauggugauggcauagaugguaugaaguacuugaacuauaucuaaucuuuaaaaaaauuagauuaaguauuugaaacauguggcauugaaaauuuuaagcaguuugaguggcugggugcuguggcugcagccuguaaucucagcacuuugggaggcugaggcggguggaucccuugagcccuggaguucaagaacagucuggacaacauggcaaaacccugccucuagaaaaaacacaaaaauuagccgggcgcggugaugcacaccagugucuagcuucucaggaggcugaggugggaggaucuccagagcccagggagguugaggcugcugugaguugugauugcgccacugcacucccgcccgggcgacagagccgagacccugucucaaaaaaaaaaaaaaaaaaggaaaagaaaauaaaauuuuaagcaauuuuaaaccauuguuauggaauauaacagaagaaaugaggaagauguuagcacacuggugagaguccaggcuaggucugugcugaacuuccucuaguggcugcugaaauugagacagcuacacuuggcuucagugccuuuccuuucugcuucuuuuuagcccccaacacuguuagugauuuccuuagcauuuuccuccuugucuucagcaaauucauuccucugggaggaagaauuagugucuucuuucuuuaggcauccuuuguuaccuucugggccaucucuguacgguuauuaccccauccucucauuguccauccaucuuccuucagagcuccguuuaggaaucacagucuuuaccugauuuugaucacauuuuugugccacagccacuucuaccccacuucaguuugcucuguauuauuuuucauuacuguacuacuaaacuaaauguaguuuuucuucauucuuagguuacuuuaucuugucuauucuuguuuaacaauauuacaaaugacuugagggcuuauuugcauauguuugagagcccuccagaauuuguauuuuguaaauuuugauuuuauaguuuaaaaaugcugggcuauuuauuacggaguaccaauuuuucuaaauugauuguuuguuuugaacugaaguaguaaaacuuaaagcuugcugacauagucacuucuggucugcaacuuccaguguuguccuaaaaaaugaauaauuuguuuguuuguuuguuucagacuuuguuucaggaguuccaagagcagcaaggacuuugggaaugguaggacaguuaaaagguauuuuuuaaaaaaucucuaaguuaucuucuauuuuaccagauuucacauacuucuauuuuuccuucacagguuuauauuuaugaugggaagaacauguccuccuuauacaauuuuacuggcgagcagguaugcuuccaaaauaugaucguccucucccacuauaaaagcaguauguacucauuggagaaaauuugcgaaauaaaacuguaaaaaugaacuauaaucucaucaaauagauaauucuuccaacucuuaccauuuuggucaaacuauuaucauuucucuuuugagcguguguguguguguguguguguguguguguguguguguguaguauauaaacaaaaauugguuuacucuguauuuuucauuuugucuugccuuuuucacucaauauuuuaucaucagaguuucuaauuucuuaaaacuuuccuuggcaguaucagaaugguuuaaugauuccauaauauucaauauucuagauauaagaugggcuuuaaauauuucaucuuuguuuuaaccaaaguaauuuggauauuuuggcuuguuuuuguuuccuuuuuuuuuuuuuuuuaggaaaugcaaaaucacaugcauacaaaaccacaaagacuuccuuuuucuuuacugaaaagaaaaaagagaaaagaauucuuuaaauucuuuuuuaaggaugaucaaugccuuauaauuuuauuagaugcaacagaaagcauggcacagauauguguauuauagauauuauaagcgaacuucauuuuuacuacaugaaauaagauauuucucagcuaaaaaaaugcuaguacuuuuuaaguauuagacauuucucugcgaguacaggcauuuuauaauauucucuguuguaugucucaaagaauuauaccauaaguugguaaugaugaauaaacauuuaaacaguagguagagaaaaaucuuucucaaaguuugcagaucugggauucaagccuuuuuguucaguugagauuguugggcuuugggauaggauugacaggcugacugacuagacucaugguccccagaaaccuccucccauuuguauggcagucaagauugaugcacaaccuggagggcccugcaguugacaggcaguuaggguugcugcagggguggucccuuuguuccguuuugacuucuccagcucaagcagcuucuccugucuggugaccauguaugagucuggauccuacugcaugcacucaaugauacuugcuuuauuccuccuuccacuauugggaaguggggguggcuagagaggagugggaagcguggcuuuuagaugaggacaaaccuggguuuuccaugcucaaucuguuauugcauuggauaagguauuugcugcugaaaaucuguuucuuauuuauaaaaauagggaugcugacaacuuccucaugggacaguugugagaaucaaaagaaaacauucgaaucauagugcccgggacaaagugugucucaguaaaugccauccuuucuuuacacuuccaagccaaacaccauaggugacuaaggcccaugaauauuauucuguuacauagucggcacaucaaccuuguaccccaaacacaguauauuuuauuucacaagcucugaacuuguuauuuaauacagaacacaccuuucauuuucccaauuacacuguaucaacccaaaauagauaaugcaggaaucucccuuaucauucucccuugauaucugagccaaucaaauuugagaagcauugcuaacuuuccuuuuuugguuuguugacucauuuuucaccuuacuuuauauuuaaucugucaucucuuuuaguuuuguuuugcacuuucagcucucuuuagagcuuuccuuuuucacauuuauuuacagcuaagcugcucauccuaugcaagccuguggucuccugugguagggaagaggacauuucugcucccugugcauuauaagcucauaauaaacccaaacacauuuguacugugugugauucaaaagcaaaaucauguggcaaguaaucuauagagauaugacacaaaaaugagcuccuuuccauaucuuuccaaacaguaauuuuuaaacaguaguaguaguuacacauaggggagccaauuauuaucuguuauuaauaauuauuaucuauuauccucaugacauaggcauccauauaaaacuuguuggguucaaucacaacauuugucugugacuauauaucuuuguuagugugcuugugucugguauguuuugggaaguggagagaaagggagauaguaggguaggccugagaaggagaauugauaguccuuagacuuaaaugucauauaucaacaacacuggaaggauauacauguaauauauuguguauauacauguaauauauuguguccaugaucuaggaaaacaacaagccucauuaccugauugucauuguguugguagaauaaacaaaagacaagacauuuagauugaagcacuauaugcagagaaaaaaaauaacccuauuugguacauauauuacaaauguuaauugucuaaacuaauuggaugaaauauaaacauuucauuuucaucuuuuuauccagauggcugcauauuucggauuuucuguagcugccacugacauuaauggagaugaguaaguuuaaaaaaaaauguuuccagaaaguuaucuucucauguuuacgaauacuuuacucaaacuaaacauuuuuuucuucuguuuuuguauuccuuuucugcuaaucuuucuguuuaaggaaacaauuugaagcaaccuuaaucaugaauucuagaaaaccucauauguuuguucuguuuuuuuucaguagcuuuuauaacaugaacaaauaaaguaauuuuaugaauuauucauaguuucuuaaaagaauuaaaggaaguuucaaauuugaaaugagugcucugguaaucauuuuguguuucacugugggugugagagaugcagaaagaggaaaagugaguuguaguaagaaagaaaaugccuacuaagacaugaaauuuguucuugcuuuggugagaaguuucuguucuucuaguuaugcagauguguuuauuggagcaccucucuucauggaucguggcucugauggcaaacuccaagagguggggcaggucucagugucucuacagagagcuucaggagacuuccagacgacaaagcugaauggauuugaggucuuugcacgguuuggcagugccauagcuccuuugggagaucuggaccaggaugguuucaaugguaagaucaaaguuuagcagcuacaggucccugauuaucuguguccaccuggaaaaguucuguaaguccaucuguagaagucuacacgagcaaaucuccuuccuggaaagguggauuguguguaagugaguaacacaccaaauuuaaagacaguuugcuauuuuucuuuaaaaaucagagcaaagauuucaauaauggacucucaugaguuauuauucacuuggccucaaauuagaaggucagaaugauuacuuucugaaaggaaccuucauuacccuggugccuacugcuagcugguauguguuucugcauccugcuuagcagcagugcccucuucuguucauuuggcuacaaguguuaaaaaaaaaugcuuccaggcacauugucaaggcaaugcugacuaaugcauaccucaaagguaugauuugccauuaauauuuuuaaagccauaacuuuguuguagcuguccaaaauguucuaagggauguuauaucucccuuuaugguggcauauuaaaaguauaagccuauucguuuauaauaguaccauuuuaauaguugucgauaucuuuaaaaagcaaaguuagcuuuuacuuuagaacucuuuucagaaaccugaaauauagguuacaaauuaccaagauuuuuuuuuuaaucuguuaaaaaccuuucuagagaucacagaauggauaguugaacuaguuuguguaaucaacaguauaguaagccuaugcccccuuaaaaccuaaaggaaagguauacauuaagaagaaaacuuuaaaaauacagaugacuuguuguaugucucaaacaguaguggaaagguaaauguuguuugcccucaagauuucacaccugucuuguggguaggugcugucauuuacuagaugugucaucuggaagauuaaccguagucauuucuuuuucuuuguuucuuucuuuuuuuucuuuuuuuuuuuuuuuuugaggcagggucucacucugucacccaggcuagaaugcaguggugcaaucauggcucacugcagccucaaccucccagggucaagagauccucccacuucagccuccugaguagcugggacuacaggcucccaccaccuagcccagcuuauuuuuuuuaguagagcugaggucuucccauguuacccaggcuggucucuaacuccugagcucaagugauccuccugccuuggcugugcgaagugcuggaauuacagaugugagccacugugccuggccaacaggagaaguuucagugguagggaacaucuacucagagguacaucugcuaccuaaaauagaggcuuaaagauuuuuaccacaaagagaacuuagcauaaaucaaauggagcuaugguaugaaguucauaauaaaaugugaaaagaacacuauauaacagaccaaaucauuacuuaaucauaacaaaagcuacauaggaaauacagggcuaaguuugagguuccaucaugaauaaaguuaaugaauucuuugcuauguagcugggccucugucucccagguuuucugggaagccuggucaugugugaucuucaccuugucuugauguuauuccaguuacuuuaaagaaaguuuucucauuacugugaucuagccaacaucucuuccagcuuucuaaguuuuuguuauaaugugucgucugucaguagaacaaauauagacaacagcuuuaaaaaaugugaaguuuuacaaugauuuuacaaagggcuaaaauauagauaaaaucauccauagaggaugauuauggucucccaagguuucuccuugggucuuacuguagcaaauaguagauugugaaugauaaugucuuuagugaaaaauuaucugagcuguauuuauguauaguauuuaguacauaugugcaaauauaguuacauuauacauguauauguucuauuaguuauguuagaucuuuuguuguuguucauacaugaagacauuaagugucauuguuccuguauuccuauauuccucucuuuccaccuacccccacccuaggcaucaucaagagggauauugaaaacaaaacaauaaaguuauguuccaaaauuuuauauagccccaagguaauuaugugcaguuuuuuaucaguacuuuuccagaaaaagcagaggaaaaaaaagaaaagcaggaaagagcaucuaaaaugaucaaaggaagaaaucaauugcaugaauguguaggauuuuccagacucgacagaugauagcgaagagagaagaugauuaacauguauaaaauaaugaaacguuuaggaaaguuacagauaauuuuuauuaaacagucacucaacguuggagccaucuuuuguugcaaaauuauguuuuaaugaauacuuuauuuauuauuuguugagacaggguauugcucugucacccaggcuggagugcagugguacaaucacagcucacugcagacucgacuucccaggcucaagcaauucucauaccucacccucccaaguagcugggacuaccaaugugcaccucugugcauggcugauuuuuguauuuuuuguagagauggggcuuugccauguugccaaaacuggucucaaacuccugggcuuaagugaucugccugccucggccuccaaaggugauaggauuacaagcaugagcuaccguggccagccuguuuuaauaacuacuuuauuaaugcauaugucaguagagaaguuaugcuuaucuuugguuuuuuuguuuguuuguuuuguuuuguuuuuuguuuuuuuuuuagacugagucucauucugucgccaggcuggagugcaguggcacgauaucggcucacugcaaccuccgccuccuggguucaagcgauuccccugccucagccuccugaguagcugggacuacaggcacccaccaccaugccuggcuaauuuuuguauuuuuaguagagauggaguuucaccauguuggccaggauggucucaaucucuugaccucgugacccacccgccucggccucugaaagugcugggaauacaggcgugagccaccgugcccagccgauuuaccuuuaaggcuuaaaaaaggauaaaaagaauacuuuuacauaaguuagguacucauuuuuaaggauaacaaauucuuaguugguguuuacugcaggccaggcacucuucuagguggugaaaaugagcauaaaucagagucuacucaugucuuuaagaaacucagcauccaaugggggcagcauauauguuuaaaaaaaaaaaaguaccucaaugugaucaucacaguguuugagaucccaggcuuaauggucucauauaaaggaugagugaucaaggcaucguugauguuucaggggagccaggagaugaugaggcauggcuuauuaaggagcuaugagacagcucguguacauuaaggaaauugaggcaauuuguuaugacugguacguagggucugugauaggcaagauacgacauguccuuggucucaugaagcuuauguucuauagcuuacuuacuuuguguagucauagaauaaguaaacaauggggaaauccagauagugauaaagaugauggauuuuuuagaaggcaagguaauauaauagaguuucgggauagagagggugauagagaaaguagggggucgagagggguggugcacugcugcguaggguggcuagggaauagcuugcugacagaaugacagcugaucuaaugacagaacgacauugaucuaucauuuggacaaauagaaggaauagaguuguaaaagcucuggagcaaaaggcagagagaauagcaaauacaagcccauaguuggaagcuagcuugguguguuuaauaaacagaaaaaaaggccaggauugcuggaaagaguaaauaaggguaaaaaacuggauggcguggggguggggauggggagaggaaugagauuugcaugguaaacaauggaaauaccagguaggguuuagaacuuacucuaaaugcuuugggaacuaauugaaggauuuuaagauggggaugggugugacaugauauggugaauguuuggcccuuuugaagagaaaguuacaggcaagaguagaagugggaggccacuuaaaaggcuguuuaaggccgggcgcgugguucacgccuguaauccccccacuuugggaggccgagguguguggaucacgaggucaggagaucgagaccauccuggcuaacaccgugaaaccccgucucuacugaaaaaaaaacaaaaaaaauuagccgggcaugguggcgggcgccuguaguccuagcuaaucgggaggcuaaggcaggagaauggugugaacccaggagguggagcuugcagugagccaagauugugccacugcacuccagccuggggaaaagagcgggacucugucucaaacaaacaaaaauuaaaaagaaaagaaaaaaaggcuguuuaagugcaaaaugcggcaaugacuugucuaggguggcagcagcagagagagaagugggcagauugguaauacauuuuagagguagaaaagauaauuugguguuugggguuuuuuaaagauuuaaaauguuauucauuuaucuucuuucaguguaaguugagcaagaucaagaugaagucacaacuuacgaauuucugagcagauuggcuucuguucagaaaaaacaauaccauccauaaauaaauuaucuagaauuuugagagugaaaauaaacuuuagaugaaucuuuugauguguccuccuccauccccuaccccuaguuuuaaugaggaagcauuugugguccagaaaguuuaagugauugguuuaaggucagagccagauuaucuggcccuaaauuaaugucuuuucuguacaguuuugcuugaguuuccuugaauuagauuauugcuuauggauaaagaguacccuacugaacuuugaauuaguauuuaucaugaugaauggguucuauaaauauuaagaucuguacaaauaauuacaaguacugaaacuuucuucucuucauccuugcccucuuccccccuucucucguuccuuccucauucuucccuuucuuuuccuccuccuuacuucugucauucuccuucccccuccucuuuuuuuccccacagauauugcaauugcugcuccauaugggggugaagauaaaaaaggaauuguuuauaucuucaauggaagaucaacaggcuugaacgcagucccaucucaaauccuugaagggcagugggcugcucgaagcaugccaccaagcuuuggcuauucaaugaaaggagccacagauauagacaaaaauggauauccaggugcuuucuuaucaacacauagagcccuuagauuuuucaguccuaauagcaaauaguauuaguuacuguucuugauuuauguuauaaauuauugcaauucaguauuucauauguugaucaaaccucuaaaauauucaaggcaucauucccgucaccuaaggguauaugaagaaaagucagcucucuuuccugggaguguacaguguacucugaguuucuccuguagucuuuaaugaaaugagaagaguauuacagaaguuauaaacaaaaguuaaaugcucauucuaagcuguuuuaauguuagcuaucuuuuuuauuuuuuuaauuauguagaauauauguacuugacuaauaguugugauuuuuuuuuuuuuuuaagacaagguaugucucuauugcccaggcuggaguacaguggcacaaucuuggcucauugcagccuccaccuccugggcucaagccauccucccaccucagccuccuuaguagcugggacuacaggcaagcaccaccaugccuggcuaauuuuugcaugguuuguaaagagugguuuuugccauguugcccaggcuggucuugaacucaugagcucaagcgauccaacugccguggccucccaaaguguugggaauacaggcgugagccaccgcacccggccuucauugugauuuuuuuuucaaguauauuauuuuauuuaauucucccauuaauacaugaguuaauauaagcucauuuuuauagcucauuauuauaccauuucugaauguaaaaagagacugagaaaggcaguuuacccaagguugcccacugcauagguccaguagagcaagcaagaccuuuuucugguucuuauacacuuuggagcauuauaaauggaucuaggaucaaaacagaucuuuucuuuaaaugaaauacaguguagaaaauuuagaugaccuuuguguugaaacacuuaauaugagcucaauauacaaguguguuggucuguuuccagaaauaagacaugaaguggauucucauaaauuaguaguauuuuagaguuuuuuuguuauaaaugcaauauauuuguuauagaacuuuuagaaaauacaucaaagcauaucuuuucaauguuuuuccugugcagucacacacauuuuuuuaaaaaggaaaucaugcuuuuauaugcuauucauaguguuuuauucaacguuucagaaacauuucuuuauuauucuucuaaaacaugaauuuucuguuucccuuuguaacaaauagcugcaucauaucuuauuuaccuuuuuuuguggcauuuuuaucuuucuuuauaauucuuuugcauaucucugauuaugucauuaggacaaaauucaagaaucacugugucaagugugugcacuucuuuuuuuaagguuauuaauacacauggucaaguuaccaucccacucccuccacaggaagguuuuugucaacuuuuuaaagcacucaccagcaguaaaugagucauuguuuucccauacuugugcuucuuuuaaaauaauuuuuaacuguauaacagguggacaguguauuuuaacuaacaguuugugauucuagaaauaaggcaugaguuugauucuuuuuuuugagaugaagucucgcucuguuacccaggcuggagugcaguggcgugaucucagcucacugcaaacuucaccgcccggguucaagagagucuccugccucagccuccugaguagcugggauuacaggcaggcaccaccacgcacagcuaauuuuuguauuuuuaguagagaugggguuucaccauguugaucaggcuggucuuggucaggcuggucucagucaggcuggucucgaacuccugacuucgugaucugccugccucaaccucccaaagugcugggauuacaggcaugagccaccacacccggccaucagguugauucuuaacuauacauaaauaaaaaugauuauuuuuacuaauaaucuaauguauaguuaugagguugauucuuaacuauagauuauuaguaaaaauaaucauuuucauuuguguguauauauauauacauuuguauauauauacauuuguguguauauauauauacauuuguauauauauacauuuguguguauauauauacacauuuguguguauauauauacacauuuguguguauauauauacacacauuuacuucugugaauuuccuuuuugugucucuuuuuucuucuuugcuacugggauuguauuuugcuuuucuuucauucauucauuuuuuuuaaacuuucacagugccuuaaauguugcaaauauuaacuucuuaacucuuuuauguauuuucuaguuugucagauuugcauuuugagcauaaaguuuuaaacuuuuauguuauuuaaucuguuuuuauuuuuuuuuucaugugauuuucuguuuagaaaagacuuccucaaauuuagcuuggguauacugugagauagagcucucauuugacuuuuucugaaucgugaaccaguugaaccuguggcauaugaaaacuaaugcauuucauucuugcugauucgagugcuaucugcuauaguauuuuauauauauacacacacacacauuauauauagaaaauagaaaggaaauuuuacaguaagauuguaaaauccacaggcgucuauaaagcuuuuuccuuuggcaguauguauguuuggcagguguaugauuaucauugcuacuuuuuacuaaauauucauuuaaaagauuuauauccaccuagaugaaagucuacuuuaugauaagcauuuuccacuggugguaguuuguuuacaguuuucauauauuuuagccuuuuauaugaugucuuacaaccucuuaauaguuuugagaauuuguucaaaccuuuuuauauucauugaaaauuuuauagaaugguauauacauuuuaaaaaccauuaucauuauuaacauguuuuuccacucuuucuuaagacuuaauuguaggagcuuuugguguagaucgagcuaucuuauacaggugagcauuuucuguauccugcgguauaggaauauucugaauuauuugaacguuuuuuaauuaagugucaguguuugaauuuuaguuuaauuuucuugaaauaaugauaaaauuugcucuuucuauucaugauuugcuaugggcaaauaguauuauuuuuauugguacauaauaauuguacauauuuaugggguacaugugauauuuugauauauucauacaauguaauuaucaaaucagaguaauuaggauauucaucaucucaaacauugaucauuuauuuguguugggaacauucagaauccugucuuccagccucucuucuaguuauuuugaucuuuuguuuucuuuggagacagaguuucagugcagugggaccaucucggcucccugaaaccucugcccccuggguucaaacaauucucaugccucagccucccaaguaggugggguuacaggcacaugcuaccacaccggcuaauuuuuguauuuuuaguagagacaggguuuugccauguuggccaagcugguccugaacuccuggccugaagugauacacccgucucagccucccaaaaugcugggauuacuguuaugagccacugugcccagccagcuauuuugaaauguacaauaaauuauuauuaacuauagucaaucuacgguguuauugaacacuagaacuucuuuuuuuuuuuugcccaaucuggaguacaguggugcaaucuuggcucauugcaaccuuugcuucccagguccuagugauucucgugccucagccucccgaguagcugggacuacaggcaugugccacuaccacaccuggcuaauuuuauguauuuuugguagagacagggucuugccauguuaucugggcuggucuugagcuccugggcucaagugauccaccagccucagccucccaaagugcugggauuacaggugugagccacuaugcccgccccuucuuugucuuuuaaauuauguucagagguauucuccuguaguuuuaaucucucuaaaaauugucuggguuuacauuuuccuauaagaagcaggaaauuaaccucaugcuuaugucuugguauucucugaccacaaggucaguauguaaugaaaccccaaaugaauauuuuuauuagagcaauauguaugaauuuauauauuucuauuucccaauuucuuauauauccccaguuauucucuguauuucaucaauuccucaugacguagaauaucaguuggcaucccaaguaguuaagauguuuauauaucuaugaucugaguuuauacauggcaggaacacuaacauuagugcuauguagcggaguuugcgaugggucaauuuaauuguagcuauacaauacuuaacagauuucagaucuuuaucauuuugagacaggcacauugacuugagccagcuguauuuuuguauaggauuuaaaccuguguaucugaacucaggaaaacuguauuuauuuuaauuuauuguuuuuaguuuuuaaaauugcuguuaauuguauaauguacgugguaaaaaugcaaacacuauaagaaggguauauaaaaaaaaguuuucccucacaccagcuaauaauuuauuuguuucuucuauuagaaauauucuaugcauuaaaaaaucauauuauguauguauguauguauaucaguagacauucuuuguacuuuuuggguuuuuuuuucucucccacuaaaacuauauguugguuaugucuuagaggucaucccacucauuuucuccacgguagugcagcgaauucgguagauaucucacaacuuauuuagccauucugcuuuagugacugaauucauauaggccagccauugucccacuuugucuggaacugagcgauuucccaggaugcaggaguuucugugcuaaaauuaggacaguucugggcaacuaagacaguugaucaccuacgguuauguuguuccuguuccuuuuacuauuacaaacaaugcuuuuaguagacaugguacuauauauguagugaauaugaaccaaaaauauuucaaucaaccuaacuuuuuaaauaauuuuuuacuucaucuucuuuucccucccccgcuagggccagaccaguuaucacuguaaaugcuggucuugaaguguacccuagcauuuuaaaucaagacaauaaaaccugcucacugccuggaacagcucucaaaguuuccugguaaggguauuuguuuaauaauaguuauuauugugauuauuguucaggcauuguaagaacaauugaaaaugaaggugguagggcugaaauauugcuaaaacaguuucugugaguauacuguuuuuucuauucuuuuuuuauuugaagcaaggucugccucuguugcccaggcuggugugcaguggcacaaccauggcuuaagugauccuuccaccuuggccuuuauaguagcugggacuacagguguguggcaccauacccagcuaauuuuuuaaauuuuuuuagagauggggucucccuauauugcucagguuggucucgaagaccgcugugcucaagcagucauccugccucagccuccuaaagugcuaggauuuacaggcaugagccauugcaccuggccuuauacucuauuuucauguuauaaauuggauuauagaaauagugcuccaaaaaggauaucuaaaggcuguaaagauacucuauaaauuaguaugaaauuaauuuuuaaagaauuaugcguggucaaugaauauuuucaaaaagaaagaaaagcuaauaagaucucaguucauuuauauguaauuccaaacaggcccaugaacacuuacauuuuuaaaagauaucuuguuuuucugauuuaauaucuaugaacaguuguaugaaaaaaauuauuuugcucuaauauauuaauuuucugcuuauuccuuuacuaguuuccaaagaaaaauauaauaauuuuucauaaguuaaaugucugaauucuucucuacuccauucuuucucucaucuuugucauuuguaugcuacuucaguaauuuuugcucuauuuucauuauagauuuuuuuuuuuuuuuuuuuuuuuuugagacggagucucgcucugucgcccaggccggacugcagacugcaguggcgcaaucucggcucacugcaagcuccgcuucccggguucacgccauucuccugccucagccucccgaguagcugggacuacaggcgcccaccaacacgcccggcuaauuuuuuguauuuuuaguagagacgggguuucaccuuguuagccaggauggucucgaucuccugaccucaugauccacccgccucggccucccaaagugcucauuauagauauuuuuuuaaguugucucgugcuuuacuucacaguauuuaaaagcaaaauguagaaaccaguaucuuucucauacauaucaauauaaauauaaaacuaaugaaaaaucuugacccauauacuaccaaaaucaccaugaguagucauucaugaguucccacuuugggaaacacuauucauguuccuuacuuacacagacgaguugcagagaacuuaugaucaaggagaaaaugauuggugccuaaaaaaguuuuacuucaaaagagccaauuaaagauauuguuccugaauuuguuuuugaauauuuuugaauuauuguuauaguuauuaaaauuuugaaacuuucauuucuuuaauuggauuacauuuaaaaauucaguaauauuuggucuucauuuuuauugaacuggcaaugaaguuguuuucaagauuuugcuguaaguuuuacugcuuuucuacccugcauaccucugugaaguugccaauaaucugcuucuaauuauguuaguaauucaaaggcuucaaaugcacuaacuagagcaguaacaucauaugauuuuugaguauggcacauagaaauacauuuugcauuauaaacacauaaaaguaauuaaaucaagcauuucagaaaaucguacuuaccuuugauaccuaaaucaguuuuauuuauuuauuaaaaaauuuuucuuaagaugcugaacacaacccauuaaacugguuucacaaccugcuaauaaauugugaagaacacugcuguaaaggagguugcuaauuaaagaaaguuuugguggguccuuuuaucaaugagacaguuuuuaaaaucugaaccguuggcuaggcacaguggcucacuguaaucccagcacuuugggagaccaaggcgggcgaaucaccagaggucaggaguuugagaccagccuggccaacguggugaaacacugucucuacuaaaaauacaaaaauuagccgggugugguggugcaugccuguaaucccagcuacuugggaggcugaggcaggagaauugcuugaauccaggaggcagagguugcagugagccgagaucgugccacuguacuccagccugggcaacagagugagacucugucucaaaaaaaaaaaaaaaaaucugaacugucauaccccucauuuagauuuaucaauagguucuauaagcuugagagaaaguuaggacauuauuuuucuuuuuuucaucaagguaccaugaaaggaaaugugcuuaaauuacugaaggaugaguuagguuaguguauauaguuucauguuuuuagaauaauauuaagacaugaagaaagauguaaggcuucacaauacaaacuauguaguagaaagaugagaugugggugauaauaaaaauaugucuaaacugaauuauagaauuuauguauguuuuuuauuuuuccacaguuuuaauguuagguucugcuuaaaggcagauggcaaaggaguacuucccaggaaacuuaguaaguguucuaugaaaaaucauauuauuuuaaugauacugcauacacagcacuuaaaaaauauuuuaagauauucaaauaguuacuugaauuguuauuauaauuuuuuauuugaauguuuaugcuuaaagacauuuaagauuucaacauaauuauauucuuugguaacccuuaagcuaauucaaaaauaauacacuuauuuauggacauuaugagcuaaauagcccacagaaugguaaauaugaccuuuagaaguuuaagcaguuacgaaugugacauaaugaacucuggggaaauaugaauauuaugguuuauaaguagaugaucugcugagaagucuguauuuuaugucuuugagcagccccaagcaaucucaggaguagaggugguuuagaaauagugagaaggaggagaaaaaguuuuggucaugcaauuuaauucacacagcaaacucuacucuucuuuuccuaaaaugguugaugugguccugagagcaagauaggcaagauaggaguguuaaauaauuauugccaggguuugucaguauguuaauggcaagugguaaggaauaauaguaaagcagagaagaaacugaaacuguuggguguguguuugugugugaaaguuuacauagggcagccaaguaaggucucccuaggagaaaacuuuucaguagagaccugaaggaaauaagggagcuaugggauguguggaggaguguuugccacagaggaacuggcaguuucagcaggccugaagcggaaaaugugcucagugguugagaaacggcauggaggucaauauggccuaguagaacagaacaugaagcaaaauaaccccggguauucacccaaauuugaaauaaaggucaccuuuuagagaaacuugcgacgcgaauucugguuuuaaagauuugcacucucuuaaacuauuuaaagaacugaaucuuacaaggcaguaauccuaauugcuacauccuuuuacaaugauucuugaugcauuuaacucuguuugaucacuugcuuccugaaggcauauucaucugacaguuugauaugauagcuucacuggaagcaggaguuucaaguggggcaaacuguucauucaucauaguguuuaauaugaugguaugaguacauaugagcaaauacuucuuaaucaaaaucagcaagacucuugcuacuugaauuuaugauggaagucuuaauucacauguuucauccucuggauuuccuccucucagcuuaaauuaaaagauagcauuucuccugucugauaauuggcuuacuacuaucauuuuuuugggaauuauuuaugacauuacuuuagggaaaguuuaauuaauuauuuaauuauuauuaaauauuuuuucagaauuaauauguuguagucucauuacaauguaaugacauuuuaaauuaauuagaagcaauuuacuucuuaaggaauaaagaucucuguuuacaugaaaacucuagaguaggauagauagauguccauaaagaauauguugguuauaaauccuuugguuuacauagauuuccagguggaacuucuuuuggauaaacucaagcaaaagggagcaauucgacgagcacuguuucucuacagcagguccccaagucacuccaagaacaugacuauuucaagggggggacugaugcagugugaggaauugauagcguaucugcggguaagagcuaacuuuucugcuaccuuguuguuccuuuuuagucauuaguuuuuuaucuaaaugauuuucacuuucuguaaauuaguguuagaucaaaaggaaaaacagaaaaauacacaaaggaaauuuagcuuuguaaagugucauaccugaaugauggacuucuacuucuggcagauuggauauuccaaauggccuuuccacaacaauacuacugaacaaauuaugauaaacauauuucuuaaaugcaacugaacuuucaagacaguaaaagaaaucaccagaguccaaaaaaaaaaugagcaaucaacuaaaaaacuccaguggcaaaaaucugaauugugaguuauaagcaaauauaugagcgagaguugcuggcaaaggaugaagccuaaggagagggcaggugguaauugcagacaccagcacaggaauuccgacaguuguauaaggcuaaguguucuuacgacagaggugcauucugauuccagcaagagccaaauguaaaaccuugcugaaggggagcaauccaguaugggccccaggauuuccauagguuaaguuugaucaaauaugaauucauuaaacacacacacacacacacacacacacacacacacacagaagccacuagaagaagcaucagauuuuagacccacaaagaccagcuacagagcacaaauuuguauaaaauguuuaaagaaauaaagggccugggcacaguggcucaagcuuauaaucuuggcacuuugggaggccaaagcaggaggaucacuugaggccaagaguuugagaccagccugggugagacucuauuuuauuuaaaggaaaaaacaaaacaagacaaaaacaucaguaaauauuuagacaacaacauaauuaaugaacuugauuuaacagacuuauauagaaccuacaccuaacaacuaaagaauaugaaaacugaccaugcauaggccauaaaggaagucuaaacaaauuucaaaaaguaauuuuauagaauacauacuaucacagugcaguuguuagaaauccauaacaaaaagaucaacugggaauugggaagugugauuuuuaaauaacuuaugggucaaaaacaagaucauaauggaaauuuacuugcaaccguauuacaaugaaaaugugacaucaaaauguauaggcuaucacaacaguagaauguaaagauaaauguauagccuuaaaugcuauuuaauuuaaaugaaaguuaagaaaaaaugaagguaagaaagaaacaccacaaaauuaagaauugagaugggacauuacagauaagggaggaauuaacagaauauuuugaauaaccuugggccaguacauaggaaaacuuuuagacaaaucauggaaauucuuagaaaaacaauacaacugucaaaagaagaaacagaaaaccugaauaauccucuaaacacuuaacaaauagaauuggccauuaaucuuuacaaaacgacaaagcccagaugguuuuauaggcaauaucuaucaaacauucaagaacaagacuucucaauuuuaaauagcucuuugaaagaaaaaaaaaaccaaaauauuucaaagucaaucugugaaacuaguguaauugguuccuggaguggucaaggauaguaccagaagggagaauuucauucuagucuuacaauagauguaaaaugacuaagccauuauaagcaaauaagucuuagcaguuuguaaaaaaagauacauaaaccaaguuggauuuauccuagaguggguuaauauuaagucuaaaaauguaauuuaccacaugaauagauuaaagaagaaauaugugacugucuuuuuuaagugcaaaaaagguuuuagaguaaauuuuaaaaacuucaagauuuaagaagcaagacaaauaccccaaguuaugacuaugaagaaauagaaucuuacauuuaaacaaaguccaccaauaccuauuaauuggucaagaugugaauuaagaauucuuauacauugcggacggcagugugaauuguuuugaagacuggaaaauaaugugguacuacagaacugacaaauauacuugucacuauauauaagaauaaucacagcaauuucuguaauagcaaaaacaaaacccauaaacaaucaaaauagccuuugacagaauggauaacugaauguauauuuacaugaugaaauaguacucaacaguacaaaauuaacguaggcuacaugcaauagaauggauggaucuuaagaguguaggacagaaagcaagucacagaagacuacauguaauccuauugagaaggaaugcagagggaggaagagaaagaaguauuuggguagcuuaagcaguaucaauaauguucuuauuauguuggguguguguguuugagugcucauguuguuaacaugucucguacuuucgugugaaucaaauaguacauuguaaaacaaaaauugacuaaaggcucuuacuugauaaggauaaucuucuuuuggauauucuauuucuacauaaguauaauuuuccagagaauguuguuagaauugaaggcucagggaugaauacagcuggcuuuguaaugugcacuuauggauuucuccagauaauuuagguugacguuaucauuaauucaaagcguuuccauuucuaggaugaaucugaauuuagagacaaacucacuccaauuacuauuuuuauggaauaucgguuggauuauagaacagcugcugauacaacaggcuugcaacccauucuuaaccaguucacgccugcuaacauuagucgacagguacuguacucaguuuaccacuaaugugauauuuuguuauuuuuuuuuacaauucauauuuuuaaauauuagaggagauuuccuuuaucauauugauagauguuuagucaaagucagaaguuuaggaaucugaauuuucuauuuuuuuuucuuuuugguuuuuauuuuuuugggaaucugaauuuucaagucagagauauuuaaagccacucaacauggagauauacagagaaagacauuucauauacaugaaauaggaaaauaauucaagaacagcaaagugccaguuuguuuacauaguauuuuaguauuuugcuaaauauauuugauaucuguuauuuuugauauuuuaauuuuaaaaagugcauauauaguaaauaaauaauucuuuucagaaaaccaaagaaagcaacaaaauuugauaggugguauucuaguuuuagaaaaucuuauguguaauguauuuaaauauuguuaauucuaguuacuauuucuccuuuuuaaauuacauguucauguuuuuacauuaauauuucuuccuucauaacucuuugcccuaaauuuaguuuaucauuuuuuuuuugucuuucugagaucccauaagcucuuuuuuuuuugguuuguuuucuguauaugugacaguagcaaaaggcaaauuaaaauauuuuuaaaagucuuuucuaauuuuuauauuuuaacaauuucauauuucauccuguacauuaauaaucauaguauaugugccauuuucuaguauucauuaacauagaacuuauaaccauacuucuguguuuauauucuuuacauuuuuuauuuuuaaugaaugcacaauauuauguugauuaauaguuuaauaaugaccaucugagccucuuaaugucugucauucaguauuauacuuucuuugaaaguuaauuguuacuugucacuuuauauuaugugcuuucauauauggguuaugguuauuuucuguuuauaguuuuauaauuuuuuagaaaucuuuuauuaucauuguuaucacuacuuuugauuaauuuuccaaacuccccauccaauuucuuuaaugccaauaccauguuaaaaccagcuaaucaaguaggcuaacuuuugaaacccuuggagggcaagaauaacugcaguaauauuugacuuccuuuuuuucccaccuauucucauucuucauuguuugaaaaaaauuuguuuuggucuccucuguguccuacauuuguuccaucagugacauuauuaaguuuuagguauguuucuuucugcguucuuagcuuuguuauucgcucuuguuuuuauguuaauuacuuaccccaccauuuucaucauuuccuuuucucuaaaauggaugcuucauuucacugguuacguuacaaacucuuccaugcacucucucuuugcugucaaauagaaauacaaaguuuuaauuguaauuuuuaauuuguaauuuuuaauuugcugguuagcaacauuuuuuuaaaagguagaaaagguauaggugaaauuuauuuuaaaaauauaucuauauuaguuuucuagggcugucauaacaaaguaccacagaauggguggcuuaaacaacagaaauugauucucuccuaauuuuggagccuagaagucugagauccagagucagcagggcuaauuucuucugaggccucucuucuuggcuuguagacagucaccagucaccuucuugugucuucacauggucuuccuuuugugugugugucuguguccuaaucucuuuuuaagcaucagucauuggauuagggcccaccuuaaagacguuuuaacuuaauaacuucuugaaagaccauauugccaaauacaguuccauucuaagauacuggggauuaaggcuucaacuuauacauuuuggggggacacaguucagcccuuaaugauauuuaaaauauugucauuuuuacauggaaucacuuaaaaauuaucaguggaauauuuugcauucuguuuuuuacugucuucaaaauccagaauguauuauauacuuuuaacacaucuaaauucaaauauuuagguuuuauuagaaauuuuuuuuguauuuagaauccauguaauucacaguugaaaaaguagauucaaauacucaaguuguucuaaacauacuaaaaguuuuguaguaagagaauuaagcaucagcuuuuaacauuaaacuaauuuaaauuaaauaaaauuuaaaaaucaguuccucagugacacuaagcccauuucaagugcucagaagccacaugaggcuugcgagcgguuacuauauuggacaaugcaguucuaguguuucccuuucugcucccuaauccuuugguguuagagauuuagugcuuucugcagaaagaguuggguuuuuuucucucauuuuuuucauucaaauacacauuaaguuuuuuuuguuuuuguuuuuuuuuuuuuuuuugagacggaaucuugcucuguugccaggcugaagugcaguggcgcaaucuuggcucacugcaaccuccgccuccuguguucaagcgauuacccugccucagccuccugaguagcugggacuacaggaacccaccaccacgcccggcuaauuuuuuguauuucaggagagaugagauuucaccauguuguccaggacagucuugaucuccugaccucgugauccacccaccuuggccucccaaagugcugagauuacaggcaugagccaccguacccagccucaaauacauacuaauuucuuacuuugugcaagauguaauauauauaacuguagagacuugguuuucugagcauggaagacauugcuuuuccauuucugaaacuaucuuuccugacagcauauuuuaauacuauggcugcuucaaugccagcuaaguccuuuuuuuccccuauagagugauaucagccaaauaucucuauauuacaguuuuauuaauauuuuauacauaugucucauugcaaacuuaagauacucaucuaacauucuaacugggaauguuauacauaccuuaucacuaguuaauuuguuaucuguaaaguccacacuuugaucuaaucaagcguugauuuauauuuggcaugauguaaagaaucaccauauaguucuucuaauaguccuuuuuuaaaaaggcuuauagcaacugcuuauaucuagguaauugaauuaauucacguauauuuuuguguuuccuucaaauuaaaacgacaguuacgaaucuuuguccaauauauagccacuugcaagccucauguggcuucugagcacuugaaaugggcuuagugucacugaggaacugauuuuuaaauuuuauuuaauuuuaauuaauuuaacguuaaaagcugaugcuuaauucucuuacugcaaaacuuuuaguaaguuuagaacaacuugaguauuugaaucuacauuuucaacugugaauuauaugaauuguaaaugcaaagaaaauuucuaauaaaaccuaaguauuugaauuuagaugugcuaaaaguauauaauacauucuggauuuugaagacaguaagaaacagaaugcaaaauauuccacugauaauuuuuaagugauuccauguaaaaaugacaauauuuuaaauauuguuaagggcugaacugaguucccccaaaauguguauguugaagccuuaauuccggacauuccuugugacuuggaaguuuacaaucaucauccuuuuuuuaaaggacucuaucuuucuuuuccuuuaaauccuuuucucucuucuuuuugucugcuucugugcuugaagcccuuuggauguuaccaguaggcaaagcaaaaauggccucaucuuuauuuuccauucuuuucuuaauuuuuauguuucuucuuucacauccuauccagcuccucugcuuuuuucccacuguuucucucuuuuggguguuuccauuuugcucuagcuggaacauucuccuggccagaucuaguggggaaaaaguucaggucuuuguuuuuuucaccuacccugauugguuaacuauaaugcuucaaguuccuuuuccuucaucuuuuuccaaaugaccaugcaaugcuggacucauuuuauccaguuucuuuugccccuuggucucucugccugucugaauugcugcugaauaucuacagcuccuuauucuuuuauccucugcagcccuauuuccugauauugguagaggcacaguccauaaugagaaacucuagaagggagucuauuuugcccaacaucucacaacuuaacuagcagcaggguaaaaaugaagccucauuucuuggcuauuacuuucuuuucuacaccagucuucauucaaauaugauaacagcuuaaucugagauaaaacugaaagguuccaaggaacuguaucauauccuaugaaucuuuuucuucuuucucuuucuugacuggcuacacugaccugcuuaaaaauaaguggccauggucucuuuugcauucagguauacaacaaacaagcugaugaguaucugaaaauauauacauguguacauauaggcuuaaccacauagauauugauaaacacugcuuaugccaccugcauugguauuuuucauguagaaaaauaaaauguuuuuuucuaggcucacauucuacuugacuguggugaagacaaugucuguaaacccaagcuggaaguuucuguagauagguaaguuuugcuugaaauaauaauguaguaagaaauuuaaauggaagggcacauuuuucuauucaaaggacuaacauauuuuaacgagaauuaguuauccuggaggguaaugccugauuuucuauaacacuaaaacuaucaauauugagcuucuaaagaaaauauccacuguguuuucacuaguugccuagguugaaagaguuauuaccauucaacuuuggguaauaucacaaaauaauauuguaucauuuuaaagauacacuucaucauaaacauucuuugaacucaaggaauauccuuaccauuuuguaaggcauaugaauuauaaagaauauugugagaauuaugacacgugauuaauuuagcuuuuagaaaaauauuggggaauuacaaaguacauguaauucacuucaguaauagauaugaaugauagugauauauuaguggcaucaauguuuauuuuuauugagagaagcauucgauuugcacccagugugcuauuuucuguuuucuaucaagcugugaaguagucuuaaaauaccuugagacacuguugaacaugucagugcuguguauuuaucucuucuuucuuugaacagucauacuuuccccauguagucuuuuuuucucagucuggauuuguauuguuaacuuguagugaucaaaagaagaucuauauuggggaugacaacccucugacauugauuguuaaggcucagaaucaaggagaaggugccuacgaagcugagcucaucguuuccauuccacugcaggcugauuucaucgggguuguccgaaacaaugaaguaagcaggcugccucuuuaaaaauugaaaugcacucacggaucuuauuaacauuaaugagcuguuccccuauuuagugaagcacaagcuuagcuauucuaccuaaggcuaaauugauagacaauggagugccuaucuuacauaauuccuuuuaagccuaauacuuugcauaaugcauugauaugacauuuuuagaauugcaagcuaagugccuggaaacaagguuagauagauaaagugucuaagccuguccaucaaauuauuugucagaggcuguaugguuuuguaugguaguccucuagggaucuuucagaaacacuucugcauuuccauguggcaauuguacccaauucuggcuuuuuccuuaccuccugguuugcucaacuagauuuauuugcuuaggacaagaaacugaaauauccaacugcgugauacuuuauuuccuuucauauccauuuuuuuuuuuuuuuuuggucuaucaaaggccuuagcaagacuuuccugugcauuuaagacagaaaaccaaacucgccaggugguaugugaccuuggaaacccaaugaaggcuggaacucaaguaagacaauuuaauuaaacggauuuuucucccuggcaaauagaaaagcauauuguugucugggcucauaguaauuuuuaaaaauaaacacuucaaaacaauguccuuaaauugguuucgauauaauaguuaaaugauuagcagaguuuugcuuaguuuuaacuaagauacgaaaacaauugguugugcuccuacacgguuugcaaucagcugcucuuuaugccuccuucacuuuagugaauggaugagaacgugguuuaaacuaaggacugaaauaauaauuuuugcuauuuuacacugaugccuuaauggauccugaaaagcuacucuggcaacuaccaagacugucaauccuaggugagcuagauuccaucacaggccccacacagaggaucaaagugaaggucaguuaaaucaggcuccccuucagaugguggagcagggugcccaggagcuugaaaagaagcagccaauggcuugcuuuccgaauccucuaaaaaguaaacaaaauauaccuuguagaauuucuaguagcaaggacaaaauggcagcauaugcugugugacuuuuucaauagaauuuauuuaaugacuuauugauacugguacuuugaagaucugugguaauacaggucuaaauauuccauauuucuuuaguauguuuucuauuacaagucauuaguauuucuagauguaugguaucuuagggaugagaacuugaacaaauuacccuaaguucaguuuuucacguguauucaauguuuuauuaacaaugagcaugccuuuuauuuucucauauucucauucucucuaacuuucugguuauuauauaguuucugcuuauuacaaguagccagcuccagguuuuguggagugggaggcagaacccaggaaguacuguuuuuauaugucauuugugugauccccaagaagccuucuuuuuuguaccuggugguucaauuguuuuauuuaaaaucuaccaauuuucugccugcaggaauuaggauauuugguguugggaguguuaugagagguguguggagaaauucugguuguggcccuacucaugccuucuuuagccauguucccuuacucuaguaaaccauccauuucuucuuuccuggccuaugaacacagcacauacuuuggugguuagcuucguguuaucaaauuauuguacccaguugcuagacuuucacuggaucaacaaacauuuacuuuugcacuuuuuagaaagaugguuaguauuauaaggagguauaauuaugauuaauaauuguuguuaaauaggcucucuuauggauugguccagguauauuaaguaaaauagguuugauagaaaauaagauuuaguuaucuuuguucaguuuuauuguaagcucagaaaaaccccauuuuagaacauuauuuuuuauuuagacauuggauuugaaauuuugcuaauuagacauugacuagcauuacuaucuuuuccucucuccuuuagcucuuagcuggucuucguuucagugugcaccagcagucagagauggauacuucugugaaauuugacuuacaaauccaaagguaugaaaacaacuuauauucacuuauaacuaucaaauaaauauuauuuguuguaaauauacuauguaauauacuuuaaauauaaaguagcagauuaaauuuuauugcuugacuauagcauuuuaaaaucaauauuuacauuauaagaauaauuuuauugucagauuugaguuuguaaaacaaaauuuaaaauccagaaagaaaauguucaucuucuuggaauuaaguguuaaugaaaauaacuauuuugagguauaagcuuuacacuuguuucguuuguuaauuuuuaguuucacuggguuugccucuguauguucuugguuguuaugcauaauucauuuuuaaguuuuuuuuuuucuuuuucagcucaaaucuauuugacaaaguaagcccaguuguaucucacaaaguugaucuugcuguuuuagcugcaguugagauaagagggucaguaugaauacuuaguugaguaucucauucucaugauugcuuuuuaaagguaacugucaggccuuagccuuuucuggacaauagacccugcauguuuaguggugguuuuacuagggcauuagcuucuguagaaauaaaauccuagguauguuccaaacccccaauacugggugauccucaaaaggaacaagacauggcaacaacaugcacaaaauaauuuuguugaacuuuuacacaaauugucaauucaccuguuacguguacauuucauaagagcaguuuuugugcauguguguguucauuaguuuucuuuuaaaguauuuuuuaaaauuaaaucuaauuuuauuuauuugaguaaugaauaugggguacuuuugaaaaugaacugacuauaucauuuugauauucaugguagguuuucuuuggucauuguuuagagucucgaguccugaucaugucuuucuuccgauuccaaacugggagcacaaggagaacccugagacugaagaagauguugggccaguuguucagcacaucuaugagguuugcaguuguuagauuuuacucaaaccucgugagcaagccaacgaagagaggaacaacuaagcuacuuuaaaaaaaaaauucuauguaauuuuuauguaaacucuacauugguuaaguaugugucagagauuucuuugaauauuuucccuauacauaaauucauuuuuauuugacaaauagacuuguuuaaauaaagcaguuuauauaauuuguuguuuaaaauaaauuaguucuacuugaauaaagaaaugucauugguacuuucucaugggcauuuuguaguucuggcuaaaaauugaaaauaccuauggcaaauaaucaaaacuauuucuauaggaagaaauuuucuuugucauccuucauuaauaacuuuuaaauauuuugccuuuuguuuauacauacauacauauauauauauauauauauauauauauauauuuuuuuuuuuuuuuuuuuuuuuuuuugaggugaagucuugcucugucgcccaggcuggagugcaguggcgcgaucucagcucacugcaaacuccaccucccggguucaagcgauucuccugccucagcuugcugaguagcugggauuacacgugugcaccaccaugcccggcuaauuuuuguauuuuuaguagggacaggguuucaccgacagguuucaccacguuggccaggcuggacaugaacuccugaccucaagagauccgcccgccucggccucccaaagugcugggauuacaggcaugagccacugugcccaaccuuguuuauauuuuuauccugacacauauuacucuguguuagagacaaauguugaguuugaucauuuuugcauaaaaauggucacauuguaauuagagguuaacuguggaaauugcuguuauuuaaaaccuauugcuaacaugauuucuaaaguugauguaggggaaggauuauggaacagauuuuugcccaagguguagauacauuuucuuuuuucuccuuagcugagaaacaaugguccaaguucauucagcaaggcaaugcuccaucuucaguggccuuacaaauauaauaauaacacucuguuguauauccuucauuaugauauugauggaccaaugaacugcacuucagauauggagaucaacccuuugagaauuaagguaauaugcuuaauagcagcucuucauuacaaugauauuucauugccuucuuucuaaaccuguaaaagaaauucauaaaauaaaacaacuauuuuaauauaaaacccacucugcaaaaaaugguuuaguucauaagcaguacacuuaggauaaguucauuuguauaauggguaagaauugauucugugaugucuagugaaccacaucuucauagagugcuuacugagccucaugagauguguccuucagugacucaguuugaccuuggcuccaucacguuguuguuucuucagggcauaauaucacaucaaggguguuuuguuguuaaaauuucuaccuuugggauaagcuauaccauuuuacucaugauuaucuugacuuuuggauauagucaucuccaucauagauuugcacuagaaacuauuacacaauaugaucuaaggaaaggugaagaaacaaaauaaaagauauacccaugauugacaucacaaauguacuguggaauuucaggccauuucuguauguuucaucaguuuccacucuagcuaagcaagggcugaaaauaaugguuagggagagcuaacuuuuuugguacauauuaaagacucuaaucuuuauuuucuguccuuacugcucacuauauacugagugguaaauauucugucauacuaaauuuucauucacuauuuuuuaaucauaucuaagaguuuauaucaaaaugcugauguaaaauguuuuucauuaucauuuaccaccauuuuauuaaugugauugcauuagaucucaucuuugcaaacaacugaaaagaaugacacgguugccgggcaaggugagcgggaccaucucaucacuaagcgggaucuugcccucagugaaggagauauucacacuuugguaagugccauuucaaauaugugcaccauagacauuuaaaaauaugugacuauagaacugacgccaaagaacauuucaaaaauaacaacagcugugcuugaacaacuacauuuauuuuuauaccaugcauuccucucacuuuccuuuuuccuagucagauuaaugccauauuuucuucaaaugagcuauuuuuguagauggcuaauaaaacuaguuuaugucccaacuuugauucuccuacucuaguucuuuaacuguccucuuucugggccuccuccuaaucucugaggcuuuaguacgauacuaaaaaauccagaaggucccaacaaaaauacauuggaauaauaauuagcacuugauuaaccuuuguugaguuagccuauauaauggcuauaauguuuuuaaaggcaauuguuuuucuuuuuucuuuuaauuaacaaaucuccagaucucuaguagagaaccugguauaguguuuuuuguuuguuuguuuguuuguuuuuugacacagagccucacuuugucacccaggcuggagugcaaugacacaaacacagcucacugaggccuugaccucccaggcucaagcaauccuccccuaucagucccccaaguagcuaggacuauaggcgcucucccccaugcccagcuaaguuuuguauuuuuuguugagaugagguuucaccauguugcccaggcuggucucaaauuccugagcucaagcgaucugcccaccucagccuccuaaagugcugggaugacaggcaugaaccaccaugcccagcacuguuuauguucaauagugaucacuaguuacuuuuacaucaccaaauucugugguucuuguuaguccucaaccauucaauugccuaguggcuuugguucacuuaaucacuuccuucuguugacucucauggcuguaaauaccaugugguguagaugcuuugauuuauauuuccagucugaucuucugcauugaacuucagauuccaauauccaacugccuacuagaaacugcuuuuaaauaucuaauaggaaucucaaacaauucuaaauauauacccuuggguuuucccaagucugcucuuuccauaaaguucuuaguugauuuuaguaaauaccaacuucauucucuaacaccuggaccucaugcuugacuccucucuuucucucaaaucucacgucuuguauuucagcaaauugcaucaguauuuucuuucaaaauaccuagaaucuggccccuucucaccaguuucaucacuaacacaaccuaacccaggcuccuuucccuucucgauuggacuauugccagaccccugguuggccucuguauuucugccuuucuccccacuauacuuuguaugcuauagaagccccagugauccuuuuaaauauaggucagguugugucacuccagugccuucccaucuaacucaaugagaaagcaagaggcuacaaugaccuuuaagcccaacaucaacaggcccuuccugccucucugcuugcaucuccucuccuuacuauucucuuucucaaauuuuccaccuugcuuucauugaacagauagccccaagcauguuuauuccuccaugcuuugaaaauugcucuuccaucugccuggaauucuuuguccagauauccuuguggcuuauuuucccauauccuucucauguccuuaaaaguaaaauuaugucagagaucuucccugaccaacccaugugaaauagaaacugccuucuaccucccaaccccacuuuugaucuugcacuuucuguccuccuucagaaucuguuuucuuuaauugagacaaaacuuacacaaaauuaaccauuuuaaugauuuuaaagugcauaauuuaguguuuuuuaguauaauuacaacauugaaccaccauuaccacuauaauuguaaacauuuuugucaccccaaaaagaaaugcuguacccauuaagcaguuuauccauucuccccuaucaccagccccuggugaccacuaaucugcauuccuacugauuugccuauucuggacauuucauacauauaguaucauacaacauauggccuuuugugucuagccuucuuucauguagcauguuuucaagaucuauguuguggugugccuuaguacuccuuuuuuuuuuuuuuuucuuuuuuugagacagagucucgcucugucacccaggcuggaguccaguggcgaaaucucggaucacugcaagcuccaccucccggguucacgccauucuccugccucagccucccgaguagcugggacuacaggcacccaccaccacacccggcuaauuuuuuuguguuuuuaguagagacgggguuucaccauguuagccaggaugcuugaucuccugaccucgugauccgcccgccucggccucccaaaguguugggauuacaggcgugaacuaccaugcccagccaguacuucauuuuuaugccugaauaauacuccauuguguggacauaccaccuuuuguuuaucuauuuaucaguugaucaacauuucgauuauuucuacuuuuugucuguuuugaauguguugcuaugaacauugaugcauaaauuuccauguaaacauguuuuucaguuuuauugagaauaaacauaagagugcaauugcuaggucauguggaaacucuauguuuaacuuuuggaggaacugccaaacuauuuuccaaaguugcugcagcauuuugcaaucccaaccagcaauauaugaggguccuauuuucuccacaucuuugucaacacuuauuauuuucugcuuuuguuuguuuuaaaauuuuuauaaucauccugguuggugugaagaaguaacucauugugguuuugauaugcauuucccuguagacugaugauauucagcaucuuuucaguuguguaucuuuuuuagacaaaugucuauucaaauuuuuugcccauuuuuaaauuggguuauuugccuuuuauuguugaguugcaaagaguuauuuauauauucuggauacuaccuucauuagauauaugauugcacagguuuugucucauucugugugaacugucuuuuuacuuucuugaugguguccuuuaaugcacaaaaauuuuuaaaucugaaguucaauuuaucuaugucuucuuuuguugcuuguaauuuugucaucauauuuuuaaaaccauugcccaauacaaggucaugaagauucauaccuaggcuuuuugguuuuauaaguuuuacacuuacagcucuuacauuuacaucccugauucauuuuggguuaauuuauguguauggugugagguagggguccagauugauucuuuuguguguggcuauccaccugucugagcaacauuuguugaagaaauuauucuuuccccuuaaauggucuuggcagucuuguuggagaugaauugauuauaaauauauggauuuauuucuagacauucaguucuauucaguugaccuauauguauauccuuaauacaaguaacaaauuguuuugauuaccauagcucuggaguucagguuuugaaauagggaaauaugaauacauuuuauuccuuuuaagauuauuuugguuagagucccuugcgauuccauguggauuuuaggaucagcuuguccauuucugcagacaagguaguuggaauuuugguagcaauuuucuugagcaaccuagggaguauugcuaucuuaacauuacauaguucaguucaugaacaugguaugucuuucuguuuauuuauucuaccauuuuuucaacaauauuuugucacuuuuaguguacuugucuugcacauccuugauuaugugauuucuguguauucuuuucaaugcuuuuuauuauuauuauuauuuuauuuuauuucuuuuucagaaggaguuuuugcucuuguuguccaggcuggagugcaauggugugaucucgacucauugcaaccuccaccucccaggcucaagcaauucuucugccuuggccuaccgaguagcugggauuacaggugcccacgaccaggacuggcuaauuuuuuguauuuuuuuaguagagacagguuucaccauguuggucagucuggucucgaacuccugaccucaggugauccacccaccuuggccucccgaaaguucuagaauuacaaaugugagccacugugccuggucuauuuuuauuuuuauuuuguagagacagggucuuauucucucauccaugcuggaggacaguagcauaguuauagcuuacugcaaccucgaaauccugggcucaagcaauccuccugccucagccuccugaguagcuaggauuauaggugcacccaccacaccuggcuaauuuuuaaauuucauuuuguagaaauagaaucucacuacguugccuaggcuggucuugaacuacuggccucaagugacuuucccacuuugguuuccuaaaguguugaaguuacaggugugagccacugcucuugaccucagugcuguuuuaaaggaaguuguuuucuuaauuucuuuuuuggauuucuuauugauaguauacugaaauaugacucauauuugcauauugaucuuguguccuguaccucuucuguacuuguuuuuuuagcuuaaauaguuuuaauuuggauuauuuaguguuuucuauauguaagauccugucaucuacaaagagauagcuuuacuuuaucauuucuaaucuggauaccuuuuacuuuuuuuuuucuuuuugaagaaagagucuagcucugucaccgaggcuggagugcagugacaugaucuuggcuuacugcaacuucugccccccagguucaagcgauucuccugccuuagccucccaaguagcugggauuacaggugcccaccaucacgccuggcuaauuuuuguauuuugaguagagauggcauuucaccauguuggccaggcuggucucgaacuccugaccucaagcgauacgccugccucagccucccaaagugcuuugauuacaggagugagccacugcaccuggccuuaauuuuucuuaccuaauugcacuggcuagaaccuuccguacaauauugaguagaaauggcuugauugcuauugucuuauuucugacauuagggagaaagaaggaugaaguaugauauuagcugugggcuuuuuaucaaugcccuuucucaggucaaggaaacucuuuucuacuccuaaucgucaacaaaugguaccacuacuggauaacauugucaugagguguauauaugugauaugucuaauacagugugaucagcauauagaagguggugaauauuuauuucuuuuggcugccaaccucgaaguuacugauuaaaacauuaaaugugucagaggccaucagcaugcgauuugauuucuguaggcccuccauggaaaaaccauuaaaaauucuguuuucuuuuccauggggauguugagaucugguuauuauaucuuacaaauaucaccauguuauggguuugccuaaagaauauugaguucuagucauagagugaaucuuuuaauauuauggaucuuaucuuucuauaacaaaucacgauaaaaccaacccuuucauuuacaaggaacuacauguguggcaaaagaagaaaaagaaaagaaacauaccaaccccuucacaauaaaaagcauucauagacucaacuauuagccuguuuauuuucaagacagaagaaucuggauaaucucuuuggccaucacacaaaaagaaaaaaaauggcaaauuuucaaauguugaagagaugauagaaugaccuuuucuuauaaguaaaggauuuguuuuggcaggguuguggaguugcucagugcuugaagauugucugccaaguugggagauuagacagaggaaagagugcaaucuuguacguaaagucauuacuguggacugagacuuuuaugaauguaaguagacaggugcagcauuuagcaaacauacccaguguuuucaaauaaauauaaaaggccugauaucugggaaaucaucuaauuguuauuuccaaacagaaagaaaaucagaaucauuccuauucucugaagucgucugcuucauuuaaugucauagaguuuccuuauaagaaucuuccaauugaggauaucaccaacuccacauugguaagucauugguuuaggcaaauagaauaaauuuacucaauucaaaugcuguacauguuuuuauuuuguuuuuuaaagaacgacagcuuaacuuuuuugauaauuuaaacuaaugaaguuauaugauagcauuauaaccuaguuuaauauuaucauuuuacuccuuaccccgaagugauuaaagcuagaccuuuuaguuuagcaucuuguccaguguaagagauuucuuaguauauacuaaauuauauuggagaaauuuuaggaauuuucguuuacaaaguuagaaaguuggaaauuaacugcaacaagugaggcauuuugaagauauuuaaggaguaaaaaugggaucagcacauaguaaacuggauuggauuauuuaaaaaucauuucaagcugggugugguugccucacaccuguaaucccagcauuuugggaggcugagacagguggaucauuugaggccaggauuucaagaccagccuggccaacauggugaaaccccuucucuacgaaaaauacagaaaaauuagcuggguauaguggcgcaggccuguaauuccaacuacuggggaggcugaagcauggagguugcagugagccgaguucaugccccugcauuccagcuuggccuacauacugggcgagacucugucaaaaaaaaggaaaacaaaucaugucagaugcaaucagaagucagccuaucauugggaguuucauguguguaugugcaugcucuugauaucaaaugugaaaccacuaaauuaucauaugcaggaaaagaauauacugugaauuccauuaaaauaaaauauaauauuuacucagauauuuguugauuaagucaauggacuguuuuuaaaacuaaaagcuuuuuuccucgauagguuaccacuaaugucaccuggggcauucagccagcgcccaugccugugccugugugggugaucauuuuagcaguucuagcaggauuguugcuacuggcuguuuugguauuuguaauguacaggguaaguaacggacuuagaaagaaggagagagggaaagcagaagaaaagggaaagggaagaaggaaaagaagaaugaaaaguaagggaaggaagaaagggacuguaaugaugauacuugaugagcauuacuuauuauaugagggaagauaaauuuuaugaaauacaauuuaaauguucuuagugguaauauagucacccaaaaaauacuuuucguauucuacacugaugugacaguaauaaugguuuuucuucaacugacagaugggcuuuuuuaaacggguccggccaccucaagaagaacaagaaagggagcagcuucaaccucaugaaaauggugaaggaaacucagaaacuuaacugcaguuuuuaaguuaugcuacaucuugacccacuagaauuagcaacuuuauuauagauuuaaacuuucuucaugaggaguaaaaauccaaggcuuuacugcugauagugcuaauuggcauuaaccacaaaaugagaauuauauuugucaaccuucuccuuauaaauaaguucagacauacauuuaauaacauagggugacuuguguuuuuagguauuuaaauaauaaaauuucaagggauaguuuuuauucaauguauauaagacagguagugccugauuuacuacuuuauauaaaauaguaccuccuucaguuacuguuucugauuuaauguacggaacuuuauuuguuguuguuguuguuguuguuguuguuguuuuaaagcaguccaaauuuggaccuuagcaaucaugucuuuuguauagguacuuaauguuaauacauauuacacuacaguuuacuuuucagaauacuaaagacuuuauaacugcaugaacuuggauuuuuuuaaucacucauaugguagaauuuuauaaacacauacaugauaccauccaaauucuugcuuuuaauaacaaagguacaauauuuuguuuuaguaugaaaaucugguagauccuauuacacuucuguuuauauuaaauccacaauauuuuauuacauuuuuaacuuguauaaauuuuaggucaaauccuucaagccaaccuauacuaaaaauuaguuccauaaucacaaauggcucuuuuguguaauuguuuaauuucaccugaauaucauaaugcuuaaagccauauggaguuggaaauuauuuccaaagcauauuuauuccauuguuuuagucuggcuauuuacaguauaaaaaaagcauuuuuauuaaaauacuguguaguucuuugagauaguugcuuaugcauauaguaaguauuacauucuuagaguagagcagaguuuuuaguuaguauuaauuuauuuuccuccauucauguacuuuuccuuauauuuccaaaacuguuacugagaaugggucaagaucagugagaaaucuuuacaguugacaggaaccuggaccccuuaccccaacuuuaugaguaaugcuuggaauaaaaacucuuaaggcaacucacugauuuacuucuagcaauagcaugauguuacaggaauauuaccucuguuuaagcaagguaauguguaaaaucagucucggcugucagaauaacuucuaaaagguauuuuuauaagcaguucaaguuacugaaaaccuuuuaaaccuuucugaaguucguuaguauaaauuacuuuucuaggauuauuaauaaaagccacauagguggcaaguuguaguuuuauauggcucuguagaguggugaaccuucuagaggaauauaugauuuauucacaguuccucaaggccuggggaugaugaucaguuauaccuauuuuugugcaauuacaucauguuguacauuagaaauggagaguuuaauagcucuuuaacugcuguccucauuagguaaugauaaauauuucccuuaaauaauugacuauuuugcuguguuuuaaaaaugauugaaauuuaucuugccauaucucauaauuucaugcacaaguugacugagcuaaucuugagaauauauucguaaaauaggagcacauuuaguugagguauacaagguaggacucuagacaaaaccuucuauuuuagcuuuagugaauuucaaaaguaaugggucuuggaguauagauuuuuauuaguagcuugaaagagcuuaaucauaugcaguaaguauuuuuauuaccaauaaauuuaaaauuuuuuaagaaaaauauuuuuauccuagggccaaguguugccugccaccaaucaguaaguuagucuauaacaaauuuuacccuaacaguuuuaccaccuaguaacagucauuucugaaaauauguuggauagaaagucacucuuuggcaaaaguguuagaauuugcuuuugugccaucuauuccuuuuauggcaucuaucuugaaaguaaucuuguauuggagauugaaagaugcuguaauuuagaaauuaacaugauaucuuaaauuaccuuuaugaaauauaguuuuguauaauagcauagauuuuccuucaaaaaaugaacauuuauauaucuacaaaaauauggagaagaguaauuugaaagccuacuuucugaagaaaauggugggauuuuuuuuuaucaugauuaaauaucaaaaaauugcccuaugaaaacuuuaaaucucuaaaacauuugaaauacuaccauauuugugauuuauugagaauaaaaauccauuuugaaauguaaaauuuuuaugaucugauucaguuuuaagaaaacaugaaugaacuagaagauauuaaaaacauuugacauugguaagaaauauugauacugauauugauuuuuauauagguauuuauuucagaauugauauuuugagaaaaauacaugugagucauuuuuucuguuucucuuuucucuuaacgauuaucacuguaauucugaaucugaaagguaaaacaauuagucaaaauauuauugccaucauucuaccuguguuaugaaacuacuuauucauaguuaauucucauuaacacuuacauuuccauaaagaaaacucaaguauuaauaaaagagacuuuacuggcuuaagagggcugugaaagauuuuugauagugaaucaugacccuaagggagagauuugugugauaaaaguauuguauauaauagaucagcgauuuuuguaaggcaaacagaauuuguaaguuggcagaucuuccuaaguugcaaaauguaaugaugagcuugguggagaagaaugagucguucuuggaauaccuaugugcagccacuacccaucucaaugucaccuuguuugcauucuuggauagcuuguauauguaguaguuugaugaauaauuuaaagaaaaacaccuaaaauuugaaaaaugauuguaggaucaaaaaaggcagaugaaauuacuuaauacucaguguuuuggagaguauuccuuuuaguuuguugguuggcugguuugaacgauagaaauaugcagcaugcaauauaugcuuauauuucauuuuaauuucugauauauaaugaacuucuugggagagguacugaaucuuugauguuuuuugucauuguucucaagugcaauauaacaauguaaccaaaucuagauaauuucaaaguugucauuaauuuaguaagccuaauauaaacaaauauuuguauuauuuuuguuagcaggaaagagugauuaagugagguuauuuaccccuaaaugguccauucugcauuguauuucaggcuggaaaugaauuauucuuuaccaguuuugaaacacuuugaaauauccuaagguaacuuggaagcuguguaguauaucaaauuaauuugcuaccuaauaacauagaaaguaaauaucuuuguggucacccacauugggugagacagaaaaugaaucuguucuaaaauuuguaauuugcuaacuugauuugaguuagugaaaacugguacaguguucugcuugauuuacaacauguaacuugugacuguacaauaaacauaagcauaugguaccacuuu

SEQ ID NO: 13245 - RNA, 78635 nt, Homo sapiens
aauuuccugagcuucaguuuuuguauuuaaaaaaucuggauauuucagauacuuauuucuaugauuguuuuuagcucuagcaguguauaaaugugugaccucaucuccauuuuagcuuuaaaauuauuuaaauaaauaguuugcauaugcuauaugcuauuguguuguaacauaaaaauauauacucauuuugccugguauugcuauuuccucuccaagggauuuucuuuuaauacuaugaauaacaaaaauauuaauucuauacagugaacaguuuuauucuuggaagagacuucccuccuuuaaaaaacuauguacaauuacuuuuguacuuaaaagagugaaacaauuauuuuucuuuuucuuuuuucuuuuuuuugaaacagggucucccucugucacccaggcuggagcgcaguggcacgaucacggcucacugcaaccuccgccucccggguucaagcgauucuccugccucagccuccgaggagcugugauuacaggcgcacaccacaaccggcuuauuuuuguguuuuuagaagagucaggguuucgccauguuggccaggcuggucuuaaacuccugaccugaggugauccgcccgccuuggccucccaaagugcugguuuuauagaugugagucacugcaccuggccaagagaaacaauuauuuuuucuuaucagugagauuuucacaaucuaaaauguagaaagaguugugauuugauucaugaaguaagguuaagaaauuuuucaucaaguaguucuccagaaaaguaugacuuccuguaaaaagagccaaauccaaaaagaaauuucccuuuagcgagucuuuuuuuuuuuuuuuccagaugaagucuugcucuguugcccaggcuggagcgcaguggcacaaucucagcucacugaaaccuucgcccccugggcucaagcuagccagucuuuuaguaaacauuuagucaacaaaucugcaauuauaacggagguuugauuuuuguuguuuuuguuuguuuuuaagucacucuguguuuguaauaucaauuuacuuuucaaguuuagaauguuuugcuucauuguuucccauauuuuauuuuaaucuguguaaauauuauacacuuuaaaauuauaaguguaauuuaaguguaaauauuuuacacuuuaaaauuauaaucccaaaauuucacucuuaugguaaaaaauuaagcauugcuuuaaugucaggucaguuuuaaugauaagaaauggggauuuggcaugggcuuauauuguugauauccucucauccccuaagcauccuucaaucaaaaaacauuuuuaaguugguuaauagcucuuuugugaaagcaaaaacagcaaaacaacugugagguuauauuuggcugcugauaggaaaccaccacagcacagguagcauaaauaauuagcuuaaauuuauuagccugcauuagagguacaaaauacagagguaagcugcuucaagacugguuccuucaacaaggaaccagguuuuuccuauauuuuuauuuccaucauacacagcagauaaauuuuauuuuuaguuugucugccucaauguuacaagauugcagcuucaguaacaagugucacuuacagacaggacaaauagaaggaggagauaccuugugguucuucccauauagcugcauucacagcaaggagaauuuucaaaaucaccccauccccaaccaugcagcuacauccccucucaacuuguuagccagaguucauauagagauaucuaaaccaaacacuauaaaguuaauggaaucaccaugauuaauguggguuaauggugauuuauucuuuagguggguguaggcuaaccuucucugagagcuggauuuaugaacauauuaaagagucuucucacucucuaauguagcagagaauguuucaugagcaaacaaaccagaugacuaaacuucuuuuaaguagaagagaaacuaugaaaaugaauucauaaucucauugaccuaaaguauuuucuguuaccaaaccaucuuuuucuccaugaacaccaguuuuuuacuugguugaucuuaaauuaugcaucuauuuuuguguacagcauuucaaauucguaucauguggauuauucccaaauuaucuucuagucauuaucacugccaguuuaacuuaguguauauuaaauucgguagauggaugugccaccauaucuaauaacuuuaauuauguuggaaaucuacauuguuuaaaauguaauuuuauuuucucuaguaaaauaaauaugaacgugcacauagccauuuuaauauuuuuaauucccaagugugauauuacuaauuugaaguauuaucuacauuucuaaacauugaaagaacacauguagaaaaaaugauuaguugaugauuaaguaauaaaccauuuaaaccauuuauauauuuccucuuaccagcaccugucaaagucuugcuucuuuuguucuuuaucucuguccaguuaacaaaauccaaauauaaucauucaaauauuaaauuccuguaucuggaggggagaaaugcugaauuuuuaaggcagcagaaguuacuauuaauuuauaguugggauuccagcagcccagauuuuuuuuuuuuuuuuuuugagacuaagucucacccugucacccaggcuggagugcaguggcacaaucucagcucacugcagccuccaucucccggguucaagcaauucuccugccucagccuccugaguaccuggguuuacaggcacacgccaccacgcccagcuaauucuuguauuuuuaguagagagagguuucaccauguuggucaggcuugucucaaacuccugacuucgugaccagccacuuuggccucccaaagugcugggauuacaggcaugagccgcagcguccagccccagaaaucuuuuaaugcuaaauuauuaaugcuccauuuuauuuuaccuagagagaacaucaaaccuucacauuuuuaaaagucuacugcuucuugucauucugaaagacaaucucaaucucuuucuuguacacaaaauuuaaucacagcaagaaauuuuucgucuuccuaucugcucuucagcaacuuucucaucucucucucuguuucuguuucuuuguuuccccuggcaaaacacacacacacacacacaaacacacauucauuacacacacuuuaaaaauguauuuguaucccccaccaagaaaaccuaucauuuuaaugggaaauacaucuuuuauucagcccacaguuaaacucuuuucaccugugccuggguucgcaucugcuauuuauuuuacuuuucuuacagcuuuugacucucccuuuuuaaccauauacaacuauaaccuucauaaaauuuuucucuucaaauucugucuguuacuuuucagcacagauuuauaaaauagcauccuaaauuucuguuuucauagccucuguuccuguuccuaccccaucucacuugcugcugcccccucacgcuaaaauauuuuagaagguuacuugugaugccauugucauuaaaucccaugcauguguuuaccccuugcccucuggaacacucugugcguuagacauuguugacucaugacaauuucuggcaauaaucacuuccccuaguguuuguguaacugcggcuucccaaguuuucuccugcuuugcuggccauuuccucucaguuuucucauacuuguuuuucuccugguuguucagaguucacuucuaggauauuccuucccaaucuucacagucaccucauagucacuaugaggauuacaugaguuaauauuuguaaaagcguucaggagagugcuugcuucacaucaaauacuauauauacuuguuaaauaaauagaucucauucaccccacgaaacaaugaucguuugucuccugauucucaaguuuuugucuccagcagagaccucuauucugagcuccauagcuacauauggggcuuuuuauuucauaguuccacuggagguuucacaaauccuucaaacucaaacugccucaccuugaauuaaucaccuuccuagggcuacguucuuuuuuauuuuaggcucccaagucagugccaggaaccaucaauugacuccuuugcuaaagucagaugcucacuguagguggccuugauuccucucucuuccucacuugccuuaucauuuuaaucauaaaagucucuugaauuuacuuuugaauuuucucaaaaauuagaccacuauuuccaauauuguguuacaaaucauagauaauucuuauccccaaacuucuggcuuucugauauuccagaauauauuucaaauugcucugugaaaacuuucaaguauacauguuaggauaacuuuuuaguuuuaugucuuacaguuuuugagugugugugguaaguauuugugauguuaugaaauauggagaagauauaugaaaaugugucugaauauuuuuacauaauauauugcuuguggucacuugugcuucagaaucugaagcaucuugaaugaucuguuauuauuuaauccuaucucuuaaguugccucuuuaauuaaagguuuauuauuuucucuuuuuuuucuuuuuucuuuuuuuuuuuuuuuuugagauggagucucacucugucacccaggcuggagugcagugacacaaucucagcucacuacaaccuccaccuccugggaucaaauuauucuccugccucagccucccaaguagcugagacuacaggugcacaucaccacaccaggcuaguuuucguauuuuuaguagagaugggguuucacaacauugggcaagcuggucucggaacugcuaaccucaagugaucugcccgcuuuggccucccaaagcguugggauuacaagcgugagccaccccuccuggcugguuuauuauuuucuuuuaagaaaauguauuacauaaaagaagucaucucuuuauaugacuuacaucuauaaaauuucucacagauuuugcucauucuuuguccuaauuuaucgagcuuucuuuccaaguuuucagaaguuuuugauauuucacuuuaccaaggaucuaucuucaaaauacuauuuccuuccaguucacagcugucauauuauuaacagcauuaaucccccuauacugaauaugcaguggggcuucugugauuuugaucauaguaugauaugauuuauugacacacuauguuuuuuccaucuuauuuugcaauuuuuugcagcaagguaaggaucuuacucuuucuguuuaggaucaagcucaaauaguuaaggguuauaaaugaggaugacguggccggggcgcggugacucacgccuguaauccuagcacuuugggaggccaaggcagguggauugccugagcucaggaguuucagaccagccugggccacauggugaaaccccgucuauacuaaaauacgacaacaaaaaaaauuagccaggcgugguggugggcgccuguagucccagcuugaggcuugaggcaggagaacugcuugaacccgggaggcggaaguugcagugagccgagaucgagccacugcacuccagccuggugacagagcgaggcuccgucucaaaaaaaaaaaaaaaaaagaagaugacguaauggguggugguugugauguuaaagaugucaggaauucucugaauaagcauguugaauacaaaacauguuuauucaguuugaggauaaacuagacacugcuuucacauuaacaaucccuccucuccuccaccauuucuuuuuuguuguugucugauuuggaauaagucacaucuagccuuuugaaaacaaauggaccaauuuuuuuucuagcucucuaucuacuuucaucaaacuuuaucugaagggauuuucuacuucuagaaaaaaaucacaaauguuggaguuuccaaucguggauuaaauuuugcugaggaaaaugcacuaagguuacacacuaucugcuguauuuacacauuaucuucacucguaaacacaaauaggcuuaauagccucauuuaacaaauggaaaacugaaucuuauagaugguuaguguguuuuuccauuaaaaaguugguaaacuucgaucuuuuuuuaugccuuuccuauguccauucuauccaucucauuuuuucacacuaccuuguccuacauauaaaauaacaucaauauauuuauuugcuccaucucauuuuaauucuuaaguuauuuugaaagaaaaaaagaguguacaagggcacaccuagaacuuuauuaucacugguccuuacuuugcauucucacacucuguaaaauauuucucuaauguacucacagacauuauacuguccacaguagcagccccuuaauguuuauugaaauccauaugaacaauugauaaaguuugaaagaacauacacauacacacacacacacacacacacucuauuuaggcaaagguacaaauaaauaaacacuuucauaugcucauaagaaaaguguauguugauauuauaucucugaaugacaauuuucaauauauauuaauauuauucaaauguuuaaauauuagacccaauaauucuucuccugugaauuuaccauaaauaaguaacuuucaaaguuuugaaauauuagacuacaaacacacuuuugcaugaauacuuacaauugcaaaaauagauauugcccaaaaauaugagaaugguaacauaaauuuuuaaauauccaaaaaauauuaugcagccauuaaauaagguuaugcaagucaguuuggaaaguuauuaauuuuuuaauuuuacuuuaaguucugggguacaugugcagaauauacagguuuguaacauagguauacaagugccauggugguuugcugcacccaucaacccaucaucuacauuagguauuucuccuaaugcuaucccuccccuagucccacgaaccccugacaggccagggugugugauguuccccuccuuguguccacguguucucauuguucaacucccacuuaugagagagaacaugcaguguuugguuuucuguuccuguguuaguuugcugagaaugaugguuuccagcuucaucuauuucccugcaaaggacaugaacacauccuuuuuuauggcuguauaguauuccaugguguauaugugccacauuuucuuuauccagucuaucauugucaggcauuuggguugguuccaagucuuugcuacugugaauagugcugcaauaaacauacuugugcauaugucuuuauaguagaaugauuuauaauccuuuggguguauacccaguaauaggauugcugagucaaaugguauuuuugguucuagauacuugaggaaucaccacauugucuuccacagugguugaauuaauuuacacucccaccaacagugcaaaagcauuccuauuacuccacaucuucuccagcaucuguuguuucuuggcuuuuuaaugauugcuauucuaaugggugugagaugguaucucacuguggauuugauuugcauuucucuaaugaccagugauaaugagcuuuuauucauauguuuguugauugcauaaaugucuucuuuugagaagugucuguucauauccuuuguccacuuuuugaugggguuguuuuuuucuuguaaauuuguuuaaguucuuuguagauucugaauauuagcccuuugucagauggauagauugcaaaaauuuucucccauucuguagguugccuguucacucugaagauaguuucuuuugcugugcagaaacucuuuaguuuaauuagaucccauuugucaauuuuggcuuuuguugccauugcuuuugguguuuuagugaugaagucuucggccaugccuauguccugaaugguauugccuagguuuuauucuaggguuuuaugguuuuaggacuuacauuuaaguauuuaaugcaucuugaguuaauuuuuguguaagguauaaggaagggguccaguuccuguuuucugcauauggcuagccaguuuucccaacacgauuuauuaaauagggaauccuuuccccauugcugguuuuugucaggugugucaaagaucagauggauguagauguguggcguuaucucugaggccucuguucuguuccauuggucuuuauaucugcuuuuguaccaguaccgugcuguuuugguuacuguagccuuguaguauaguuugaagucagguagcgugaugccuccagcuuuguucuuuuugcuuaggauugucuuggcuauauagacuguuuuuugguuccauaugaaauuuaaaguaguuugcuuuuucuaauaugugaagaaaguaaaugguagcuugauggggauagcauugaaucuauaaauuacuuaggacaguauggcuauuuucaugauauugauuuuucuuauccaugagcaugaacuguuuuuccauuuguuuguguccucucuuauuuccuugagcagugguuuguagaucuccuugaagagguccuucacaucucuugugaguuguauuccuaggucuuuuauucucuuuguagcaacugugaaugggaguucacucaugauuuggcugucuguuugucuguuauugguguacaagaaugcuugugguuuuuucacauugauuuuguauccugagacuuugcugaaguugcuuuucagcuuaaggagauuuuggacugagaugaugguguuuucuaaauauacaaucaugucaucugcaaacagagaaaauuugacuuccucuuuuccuauuugaauacccuuuauuucuuucucuuaccugauugcccuugccugaacuuccaauacuauguugaauaggaguggugagagagggcauccuugucuugugucaguuuucaaagggaaugugucuagcuuuugcccauucaguaugauauuggcagugaguuugucauaaauagcucuuauuauuuugagaugcauucuaucaauaccaaguuuauugagaguuuuuagcauaaagccaugcugaauuuuaucaaaggccucuucugcauguauugagauaaucaugugguuuuugucauugauucuguuuaugugauggauuaaguuuauugauuugcauauguugaaccagccuugcaucccagggaugaagccaacuuaauggugggggauaagcuuuuugaugugcugcuggauucaguuugccaguauuuuauugaggauuuuugcaucgauauucaucagggauauuggccugaauuuuucuuuuugugcaugugucucugccagguuuugguaucaggaugaugcuggccucauaaaaugaguuagggaggagucccucuuuuucuauuguuuggaauaguuucagaaggaauaguaccagcuacucuuuguacuucugguagaauucggcugugaauuucuuugguccugggcuuuuuuugguugguauucuauugauuacugccucaauuucaggacuuguuauuggucuauucaggcguuugacuucuuccugguuuagucuugggagguuguauguguccaggaauuuauccauuucuucuagauuuucuaguuuauuugcuuagagguuuuuauaguauucucugaugguaguuuguauuucugugggaucaguugugauauccacuuuaucauuuuguauugugucuauuugauucuucucucuuuucuucuucauuagucugguuaacggucugucuauuuuguuaaucuuuuuaaaaaaccagcuccuggauucagugauuuuuugaaguuuuuccugucucuaucucccucuuuucugcucugaucuuaguuauuucuugucuucuguuagcuuuucaauuuguuugcucuagcuucucuaguucuuuuaauugcaauguuugguugucaacuuuagaucuuucccacuuucuccugucggcauuuagugcuauaaauuucccucuaaacacugcuuuagcugugucccagaaauuuugguauguugugucuuuauucucauugguuucaaauaacuuauuuauuucugccuugauuuuguuauuuacccaguaguccuucaggagcugguugaucaguuuccauguaguuguaugguuuugagugaguuucuuaauccugaguucuaauuugauugcacuguggucugagagacuguuauaauuuccguucuuuugcauuugcugaggaguguuuugcuuccaauuaugcggucaauuuuagaauaagugugauguggugcugagaagaauauauauucuguugauuugggguucagaguucuguagaugucuauuaggucugcuuguugcagagcugaguucagcuccuggauauccuuuuuaacuuucugucucauugaucuguguaauauugacagugggguguuaaagucucccacuauuauugugugggagucuaaaucucuucguaggucucuaauaacuugcuuuaugaaucugggugcuccuguauuuggugcauauguauuuaggauuguuagcucuucuuguugcauugauuccuuuaccauuauguaaugcccaucuuuggcucuuucgaucuuuguugguuuaaagucugcuuuaucagagacuagcauugcaaccccugauuuuuuuuauuuuuuuauuuuuuuuuuugcuuuccauuugcuuggucaauauuccucuaucccuuuacuuugagucaauguguguuuuugcacgugacaugggacuccugaauacagcacaccaauggguuuugacucuaucuaauuugccagucuaugucuuuuaacuggggcauuuaacccauuuacauuuaagguuaauauugcuaugugugaauuugauccugucauuaugaugcuagcugguuauuuugccuguuaguugaugcaguugcuucauaguguugacggucuuuacaaucuguuauguuuuugcaguggcugguaccgauuguuucuuuccauauuuagugccuccuucaggagcucuuguaaggcaagcuugguggugacaaaaucucucagcauuugcuugucuguaaaauauuuuauuuauacuucacuuaugaagcuuaguuuugcuugauaugaaauucuggcuugaaaauuauuuucuuuaagaauguggaauauuggcccccacucucuucuggcuuguaaaguuucugcagagagauccacuguuaaucugaugggcuucccuuuaugggaaacccaacauuucucucuggcugcccuuaacauuuuuuccuucauuucaaccuuguugaaucugaugauuauguguuuuuggguugcuuuucuugaggaguaccuuugugguguucucuguauuuccugaauuugaauguuggccugucuugcuagguuggggaaguucuccuggauaauauccugaagaguguucuccaacuucuuuccauucucccugucacuuucaaguacaccaaucaaauguggguuuggucuuuucauucagucucauauuucuuggaggcuuucuucauuccuuuucauucuuuuuuuucucuaaucuugucuucaugcuuuauuuccuuaaguugaucuucaaucucugauauccuuucuuccacuagauugauucagcuauugauacuuguguaugcuucacgaaguucucaugcuggguuuuucagcuccaucaggucauuuauguucuuuccuaaacugguuauucuaguuagcaauuucuccauacuuuuuucaagguucuuagcuuccuugcauuggguuagaacaugcucccuuagcuuggaggaguuuguuauuacccaccuucugaagccacuucugucaauucaucaaacucauucuucaucaaguuuuguucccuugcuggcaaggaguugugauccuuuggaggagaagagauguucugguuuuuggaauuuccagccuuuuugugcugguuuuuccucaucuuucuggauuuauguaccuuucgucuuugauguuggugacguuugugugggguuucuguguggauguccucuuuguugauguuaauacuauuccuuucuguuuguuaguuuuccuuuuaacagucaggucccuccgcugcaggucugcuggaguuugcuugagguccacuccagacccuguuugccuggguaucaccaguggaggcuguagaacagcuaagauuacugcuauuccuuccucuggaagccucaucccagaggggaacccaccauaugccagcuggagcucuccuguaugaggugucuguugaccuuugcugggaggugucucccagucaggaggcacgggggucaggaacccacuugaagaggcagucugucucuuagcagagcucgaacacugugcugggauauccgcugcucgcuccauagcuggcagacacgaauguuuaagucugcugaagcuguguccacauccaccccuuccccaggugcucugucccagggagaugggaguuugaucuauaagccccugacuggggcugcuguuuuucuuucugagaugcccugcccagagaggaagaaucuagagaggcagucuggcuacaguggguuugaggagcugugcuggaacuucccuggggcuuuguuuacacugugaggggaaaaccggcuacucaagccucuguaauggcggaugccccuccccugacaaagcuggaguaucccaggucgacuuaaggcugcugugcuaggagcaagaauuucaaaccaguggaucuuagcuugcugggcuccauggggcugagauccacucagcuagaccacuugccucccuggcuuaagcccccuuuccaggggaugaugguucugucucacuggcauuccagacgccacugggguaugaaaaaaaaaacucccgcagcuugguaggugacugcccaaaggcuguccaauuuuuuucuugaaacccagggccucaauggcguaagcacgcgauggaaucuccuggucugcggguugcaaagaccauggggaaagcguuguaucugggccagaaugcacuguucuucauggcacagccccucacggcuucccuuggcuaggggagggaguucccugaccccuugugcuucccaggugaggcaacgcagcacccugcuucggcuugcccuccaugggcuacacccaaugucuaaccagucccaaugagaugagcuggguaccucaguuggaaaugcagaaaucacgcaccuucugcauugaucucacuggaagcugcagaccagagcuguuucuauucagccaucuugccugcaacucaaaaguuaucaauauuaucucauucaaugacaaaggagguuaccaaacaauauaugugcaaugaucauucacauaugcucauauaaauauaaucacacauauacacacacuuauacauauuaacaugcauaagaaaucauauacaaccagagguugcuucugaauaggcagauugaugguuauucuguauuuucuuuauucugcuuuauguuuuaugauuuggaaaaauacacauguauuacuuuuccaguguaaaaagacaguuuuaauauuuuaaauacuaaaagaauagaacaguuaguuaaauauguagcuaaaaauaaauagaauccuccaauuuugaaaaaaaaauuuuaaauaaaagcaguugguaagaaaucuucauucucucaauccuuucuaccuuuggaagaaaguauuuaaguguauuauaaaaggucauagaaaaauuuuauuuaacuauaaugaauacaauuuuaauaauaucaaauagaaugcugucuuuagacaugucaauguaucacuuacaugaaaaauaaacuauuuuuguaaauggcaucaaacauaaauaaaauggucaauuucuaggugacugcauugguaaaccuuuuuuaauuuuucccauugcagagaugaggaaaaauaaaauuuuugguugacauagaacuuguacgauuaucaugaucauauaaaucauaucaaaagaggaauaugcuaucgauauuuuuaaauagaaaaauugauaugaaaauuuauuuauaaucaaaugguugcaaaaaaacagaaaaauuucugugaauauuuuucuguuauugacacuuguaauaacuguaaaaagaaacgaauuauuacaucaauaaggugcugauaaaauacaucacauuuuaaugauucauugucggacugaauucauucagacacaauaaacauuuuauauaauaagaccuugaaagcacaauuuggaauucuuugguagaauauagaguauauuagagacucuacagucaugagcuaagccagaaacuaaaauauaaacaacuaaguuuacugcagcagccucucuaguacuggcccucuguagaacucuauaccacacaccuuucuacagacaguaguuagccugagucuguaaagguauugacuccuuggcaagucaguuguggccagaugcugcugugacuccauuacuguccauuuaauagaaguuuugagaauacauuuuaugaguacagaauauggacagguuuugugagaaacaaagguggaagaaaggaaaaaugauuaguuaaguaauaauugucuucccuaauaaaggauuaguuuauacucgaggcccauuacccauuauauucacuuuuauucauaccauuuaaaauaauuuuagcuuauauauuuguuuuaaauuucuccagugaccuuuuacuuucuguaaaaaaaauacaaaauaaaacaauuuuuaccgaauuuuuaauucauaaaagauuuauuucacaaauauccauugaguuccagaggguaccagaaagaacaaacaugauucccauauuuaaagagcuuacauuugagagaaaagacagaguaagcaaauaaauauauaauguguaacacaggaagagguacagugauuuaaaaagcauaggaaggaagagaacguaaccaucaaguuauuuuacgcucugaaagacaccacuugaguagagauuuuauauagaagcaauauuuccauuccauucaugugauuaagucaggggacgaugccaaaagugaagagauaauguugacaauauggguaggauuuaccagguuuucucucugcugccauugggaaugucuuuccaacuuuuuucauauucaugauaauaacugaucauuuuccuaaaaucuugugguaaauauuacauauuuagauuagggcccuuagaauguuuaguaugcgaauuuuauugugcgcaauuuugaaaaagaucuccaauuucaaaacaagccuucuggguacuuucauaguuagucugcacaacuaacugaaucagaaaacaaauauauuacucaauuucagguuacaagaauugaccuccagggcagugccuucugcucucuuacaugugauuugcaauuacaguugagaaauaaggguagagaaggaauucgaaggugaggaucuguuuucccugccaagucuuuccuucuuauugugagcaaaaaauacacuuucucauuggagaacacuuacagaaaacagucacuuucccagaccaguacuucacucuuaaggaacaaccaaaaacaaacgaauaaacaaacaccauaguuugggcaaauuaucauaaaauguacaacauaagaaguuggcgauugcuguauuuucaauagaaaugugauugauaugaccaguccugccuaaagguuaguaaugccgcaagaaacagagaaucaaagucuauagcuauguggaaaggaaagaauugaauugcacauuagaaagugcacucuagggcugauguaucuucagcuccagccuacugauagaaaggcagugacccccacuuccaagacaaacuugcaaccaaguuagagacacuuucuugaaacacuaggaauguuccugcucugaguuguguuuccccaaaauguuggauaccuaacccccaaugugacugcauuugaagguaagguuuuaggggguaauuaacauaaaugagauaauaaauguucaauccuaauucaguaggauugauggccuuaaagaaggccuuagagaaaagauaucuuucuuucucuccaugugcacacaggacaggaaaggccaugugaggacauagggagaaagcagccaccauuggcaagccaagagagagcccucaccaggaacgauuggaccagcaccuugaucuuggauuuucuagccuccagaacugugagauacaaauuucuguuguuuaagccacacagucugugauauuuuguuacagcaacccuaauagacugagagagcuccugagagcuucacucacagaaucaauuguauucuuaccuggugaagauccauucuaagacuuauuggcuguuuggaagugauagcaaauaaaagccaccuugaacugggucugaugcagcauucuuaccaaacuucaaaccuggacuaguucauccuuaugcauugaggcuuuuuuauucguguucguuuguuuuuaccaguuaacuaucaacauaaauuucauuuauaauauuguauguucaguguuccaaaaaacugguccuaccaacauaguuuggaaugacuccauuauaagauggugacugccuguaucaaaucuuuacugccuuuuucaaauucuuaccauuuuuauaaaaaggagucacacuacucaaucuauacaucaguguuaaauaugauuuuuacuaauuuuuuuuuuuuuuuaccaacacuaucuuaaaaaaucugacagcauagagcagugauuaaaggcauuugcuucagggucaaauauaguuacacugcuguuuuuuggacaauuuguuauuuugaaccauuguuucuuaccuuuauaaaaugagcauaagauaauguucuuuuaaggugaguaugagauacaaaugagaaaagcaauaauaauaaagauucaacaauggaaacugcuauuuacauuaugauuguuauaauuagaaggacaaacuguaauuuaacguuccuauaguaauaaaauggcaucuacagagcaaaucuaaacagacuuaaucuucauauaacaauucaucccagauaauuugaauugaccauaauaacauguuugaaaggaggcugaaauaaaacaggguuugcucuuuucaacucuuuagccaagacuuuuuuuaaaaaaaacugguauauaaaugcuuuguauuuccuuucaaguuugaagggaaaauaaauauaauacuuaauagauuuucaaguaucucuuuagacauucucuuguuuaggcuuguacuaauccauucauucaggguuugacuguugggugaacuucuuugcccuauucccagcugugagaggcaauucuccagguuucuaagcuuuagaccuacgcccuucucugaugagguuaauuaggguuugggcugaaacccagauuccuauauauguggauagagugauguagaaguacuuuaugauaauaaauauaaaugaaauuuagauuuuaauuuagaaauagaaaacauuuaggcaacucacugaaucaaaaauaaauauagacaaauuuaauuaauauauuuauuuauuauauuuuccuggguugggcuuuggccucuauuucauauauuuuguuuauuuuucaggauguucugggauaauguaguccagguucuaguucugccuuugucacuuacuagccaucuagucauauaaugcugaaaaauauauuauguagcucuaagauaaauucaacguaccugcauagcacuauucaacauacuugcacaguauuauugucaauauguagucuaacagauaagaaaccacugugaaaauaguaaaccauuauaaaaaaugauguuuuauaaugauacaucuuugcacuucuaauauuauugcuuuaaauaaaugugguauauauucagcauacagccaaauuuacaaaauuuuaucuuuuuaauuuuaugucauauauaaagaaccuuaaugccaaaauaaucuuuauagugaugacucgacaucccaaaaaugugggacccaacagggacauuaauaaagagauaaagcaggcucugugccgacuuguuagaauuugguacguggcaaaugugcagucacacggccuuaaaccuccccugggaaacugcucaaacauuugcauucccacaauguauuuauucaggaaauacucuuuuccugagaaaaaucuggcucucaaaccucucccugagauuaugcaaguucuccauuggggaaauacaguuggaaaucuaguaaagaauguuuauuaacaaaaauccauuugcagauccuaguuauucucaauauuuuguggauuuacaauugagaauacuacuugcaaaaaguaaacuucaaaaaaaggaaauagaaagcuaucagaauuccuguagaguuuguuguuccccuucuccuccaacauaguuuuauucuaauguuuucuuuauucauuuucuuugguauuagugugcuguaaacucacccaaaaugaaaaacaaucaaaauagaauaaaacaaaaugaaagcacaucaguuaaagauaaaacaaaacaaaaaacaggcugccagguuuuaguggacagaaggguaggcccccuggagaucagccaaauugaguggauggaaguaaucaacaacaagaggacaacaacauuagccacugcugagcagaaaauuagaaagauucuucaauuuauuuuuuuuucuuuucugguugucagguuuugucucuccugucuuccacugguacaccauaaaucagcagcuaaaaugaaauuuccuucuuuuagacauggcaaaguacucauugagcuuagagauuaauaguaaaacuuuaaaaaagaaaaaaauucaacaauauguaauaaagagaaaaaucugaacuagaaacuuuagauaaguaccaugcuuuuaguauacauguuagcaccauaaauuuuuuucuagauucacuuaaagaugauaaaauaauguguauaccccaaaacuaaugauaaaacagaucaauaacugccugcuaguuguaucaugcuuuucccaaaauaaugaacuggaaauuuaauguuaugauuuaauccuauuacucucuuuaauucuaugugagcuucuugcucuuuuuuuucaucccauaaauuucauuuuugucaauaucuguugcuauuccuuucgagguuuuuucuucuggccaccaaagccaaauugccaaaauauuuuagcuccaauggaucugaaucuuuagaacaugucuuuuacauugagaccuguacugcuucaccuuaccacuuguagucuuucaaaucuaagcucccaugcuuaaccaaauucaaacaaaaaugucucucgguuugauccuaaacucuuuccaaaucagugcuauuuuucaguuauauuuuuagaccuucaaaaagucugagaugacauucucaaugcagaauaagaucuauaaauacugagcuucuguuucuacaguguacccaagagguuuucaaggauugcuuauaaaaauuauaauagcuaacauuaucaagcuagucacuauucuaauucuuuuauauuuaauccucauaauacuauguaguagguucuaguaaaauacucauuuuauagauaaguaaauagagacaaauaggaaguaaauauaguaucaaauucauauaauuaguaaguuacggaacugauauuugaagcuuuauagucuguuuuaguuggcuagggcugccauaacaaagugcuaaaaaugaauaguuuguuauuuccucaugguccuggaggcuauaaguuugagaucaaggugaucaguaagauugguuucuucugagccuucuguccuugauuuauagauguucagucuuuccucuauguguccuaaucuccuguuuuuauaaggauaccagucauauuggauuaggacucaacaacaaugacaucauuuauucuuaguaaccucuuuagaggccuuguuuucaaauacaguugaauucugaaguacugggaguuaaaacuuuaacauauaaauuugaaaggggacacaauucagccccuaaaacagucuuacuacaaacccccucuucuuaaccacuaaacgaacuuaaaaaagaaaggaagagcugagaaagagagagggaaagagggaggaaggagaaaaaaaggaagggaggaagggagaaagaaaggagcuacuugccaagcaaaccagaauaauuaugaagacaacuggaggcagaaugcuuuccagaugaugcuggagacaaaguaauuauugggaagucagcuuuguauggugaaguguccaugaauucuggacucacagaguuaugagugcaaauauuacucuguuuuaugcuacuuggaagguuauauucccuuuaugaaccucaguuuucuuaagaugcacaucauacuucuuauagguuagggcuauuagggggauuauaguucauaugaaguucauagaagaguucauaaaaagugaaagucucaaaggucuuccuuuuuucuuuccuuuccuuucuuguguccucucuuaguagauucaauacagaacauugaccucucuuucacauauucucucauaaauauuaauauuauaaagaaagaguaaaauagcaaauuaugcauuucuucuaccuaauuaucucuuuucuaagcccaccuuucuuuagucaucuuucccacagacucacauuucucuuuugcuggaauuucagcaaucauucuuaucuguuuucuuugacuugaaaaauaccuaucauuucagcaaaauuuaaaaaauguuaaaucuaugucauuuguuucauuuucauuacagauucuuuaaaacaauuuuaauugaaguauuucauaccuuuaaaaaaugaaaagcaauacaagacacaauuuuaaaaauauuuauggcaccauuucacaauacuuguuucugaucucuuuauuuuuugguggaauugguaguaauaaaacaccaugcauauauccaaagaucuguacugccgccuaauuuuaacucacaaaguuuauucuaauuuauuaauuauucaucaaguauuacuuguaucagucauuguuugggguauugaacacagaguugugaauccuauguaaagugccugugcuaagaauagaaaacauuuuagugguggagacagcacacauaaauauauaaaugcacauaaauauauaaauggugaugagugucauucaaaaaagaaaggaagacauuacugguaugaaaggaaaauggugcagcuacuuuggaaagcagucuggaaauuccucaaaugguuaaacauagaauugccaugugauucaagaauuuuaccccgaguuauauacccaagagaaaugcaaaccuauguucacaccaaaacuuguauacaaauguucauagcagcauuauucauaauaagcaaaaaguagaaacagcaaaaauuuucauuaacugaugaaugaauaaauaaauuuugguauauuuauacuauaaaauauuuucagcaauaaaaagaaagcaaucauauaugcuacagcaugaauggagccugaaaacaguaugcuaagugaaagaagccagacauaguaggccagauauuauauuauuccauuuaacuaaagcuuucaguauuggcaauacauagagacagaagccaaauaauuguuuccuacuaauguagagauggagaacuuuaagggaagagggugaagccuaaaggguggagaauuuccuuaugggggaaugaaaauauucuaaaauugacuguaauaauauuuguacaaaauugugaaugauugaauuacuuaaaaacuauagauacaguaaaaagaucaguaacuucaaagggaauagaggagggaaggaggaggaugaauggaugaagcacagagaauuuuuagaggaaaauauucuguaugauacuacaacuauucuguggauaugugucacuaugcaauuguugaaacccauagacagcuacagcacaaagagugaaccuuaauuuauacaauuuaaaaaaaauaaauuaaaaggucaggaauuuggaaggaaugcagacugugacaagaaaaucucacucugcuaugaauguuuaaggcaaccucacugaaggaguuuggggguggaggagggcugaacuaaauaacauugaaaauaaguggagccuauaagucuaaagguaaaaggaacugcacacagacacugcccucuaguuaauaaagcuguauuccauggacauauggguuaacaauauuccuauugcuauacauguauauuuuaauugaacaauuaauuaaagaguugguggauagugauaguugaguuucaagggcuaaaauaauucauguguugaacacaugcauaagaacucauguuucacuuaaacaaaguugguuccuuauuuauuuauguauuuauuuauuucacugaaguuuuuaaacaacuucauugagauauaaucacuauuuaaaaacugcacaaacucaucaaauuuuagacaguaauaugugcaguuccuuguauagugauuguaucucagugaaacaugcacauuuuuuguuauguaaaauuugaugaguuuguacauaugcaaauaaauacccaucaacacaaucaaaauaauagacauauucaacaccuuccaaaguuuuguugugucucuguuuuuuauuauuuauuuauuuauuuauuuauuuauuuauuuauuuauuuugagacacagucucgcucugucacccaggcuggagugcagcggcacgaucucggcucacugcaaucucuaccucccggguucacgccauucuccugccucagccucccgaguaguugggacuacaggcgcccaccaccgugccuggguuuuuuuuuuuuuuuuuguauuuuuaguagagacgggguuucaccauguuagccaggauggucuugaucuccugaccucgugauccacccaccuccgccucccaaagugcugggauuacagguaugagccaccacaccccgccuuuuuauuuuguuuucguuuucuguuuguuuugugauaggaagacaaaauagaucugcccucuuaagaaauuuugaaacacaaaauaccauguuguuaacaauaaacaauauguuguacagcagaucucuagaauuuacuauucuagcauaacuaaaacuuuguacccauugaacaacaagcacucuauuuuccccacucuccaggcccuagcaaccacuauuguauucucuucuucuaucaguuuaacuauuauaguuacuaccugaaaauguaaaacuucuagacaaaagcauaggggaaaaucuugacauuggucuuggcaaugauuuuuugaauaugagaccaaaaguacaagcaacaaaagcaaaaauagacaagauuacaucaaauuaaaaagcucugcguggcaaaagaaacaaucaacagaauaaaaagacaaacugaaaugagagaacauauuuucaagucauauaucugauaauuuccaagauacauaaggaacuccuucaacucaauagcagaaauuuuuaaaaaaugggcaaaggaguuaaacacauuuuucuccgaagaagacguacaaauaagauauauaaagaugcucagcagcauuauuuaccaaggaaaugaaaaucaaauaauaaugagauaucaguuuaugccuguuaaaauggcuauuuuucuaaaaacucgaaauguaacauguuggcaaggauguguggaaauuggaaugcugggccuggugcaguggcucacgcuuguaaucccagcacucuggaaggcagaggcagguggaucaugagguccgcaguuggagaccagccuggccaacauggugaaacccugucucuacuaaaaauacaaaaauuagccaggcaugguggcaggcgccuguaaucccagcuacucgggaugcugaggcaggagaaucacuugaacccgggagguggagguugcagugagccgagacugcaccuuugcccucuaccaugggugacagagugagacucugucucaaaaaaaagaaauugaaaugcuggcaaauuguuggcggggauguaaaaugguagaguagcuauggguauuaauaugaagguuucucaaaaauuaaaaauaaaacugccauacaacccagcaguucuaccucuggguacauauaaaaaaagaauuaaaaucagagucuugaaaagauaucuguauucccauguucacugagguauuacucacaauaaccaagauauggaaacaauucaaguaucuuuuuaaaaaugaaugaagaaaugugguauauacauauauacagugaaauauuauucugccuuaaaauaggagauucugcuauuugugacaacauggaugguauacuaaguaaaauaagccagucacagaacauauugauguauuuaaagauaguauaccuuuacagauaggauagaauauacacauauauuccuuuaaucugccaaaaagaaggccuaaaagaaaugacaucccaauaacaaugagcaugccuagugcccagaucuggguuucuaauaccaaucucuaguagaaggaaucagggcuucuuggagaaaugucugugauuauaagaguggggcauaaaauauacaauaugagacuggggcaucuaguagugacaaaaaguaaggcacucagaaaaaauuaaaaacucauauugauggagcuaucucaaagaaguacaggagccaacugaaugcucucucaaauuugccaaagccaggagaccauuugagcaacaauguaaguaaagucauagugaauuauaacauaaaguauagaauauauauccaugaguccauacuuauauaaauaaaggauuaaauaauuuaauacagagagacaaauaucuggugcaaaaguauuccgaacaauuuauauagauacucucaccuuaaggauagggaccauaauucuccauucuuuuaaagugcuggcuauauguagugacuuucuuccaaaguacaguacggguggcuggcaagauggccgaauaggaagagcuccagucuacagcucccgcagagaucaacgcagaaggugggugauuucugcauuuccagcugagguaucuggcucaucucaucgggacugguuagacagggggugcagcccauagagggcaagccaaggcaggguggggcauuguuucaccagggaagugccagggauuggggaacucccuccccuagccaggggaagccaagaggaacugugcccugaggaauggugcacucuagccuagauacgaugcuuuucccauggucuucacaacccacagacccggagauuuccucaggugccuaccccaccagggcccuggguuucaagcacaaaacaggaagccauuugugcagacaccaaguuagcugcaggaguuuuuuucauaccccaguggugccuggaaugccaguggacagaucuguucacuccccuggaaagggggcugaagccagggagccaaguggucuagcucaacggaucccaccaccuacagagcccaguaagcuaacauucauuggcuugaaauucuugcugcuagcauagcagucugaagucgcccugggacgcacuagcuugguagggggaggggcguccaccauuacugaggcuugaguagcugguuuuccccucacaguguaaacaaagccccagggaaguuccaacugggcgaagcccacaacagcucagcaaagccucuguaaacagacugccucccuagauuccuccucucuaggcagggcaucucuggaaaaaaaggcagcagccccagucaggggcuuauagaucaaacucccaucucccugggacagaacaccuggggaaaggggaggcugugggcucagcuucagcagacuuaaauguaccugccugccagcucugaagagagcagaggaucucucagcacaccacucgagcucugguaagagacagacugccuccucaaguggaucccugacaccugugucuccugacugggagacaacucccagcaggggcggauggacaccucauacaggacaauuccagcuggcaucugccaggugcccucugggacaaagcuuccagaggaaguaacaggcagcaaacuuugcuguucugcagccucugcuggugauacccaggcaaacagggucuggaguggaccucaggcaaacuccagcagaccugcacugcagcagaggagccugacuuucagaaggaaaacuaacgaacagaaaggaauagcaucaacaucaacgaaaaggacauccagacagaaaccccaucugaaggucaccaacaucaaagaccaaagguagguaaauccaugcagaugaggaaaaaccagcgcaaaaaggcugaaaauucccaaaaccagaacacuucuccuccaacagaucacacuccuugccagcaagggaacagaacuggacggagaaugaguuugaugaauugacagaaguaggcuucagaagguggauaauaaacuccuccaagcuaagggagcauguucuaacccaaugcaaggaagcuaaaaaucuuaaaaaaaagauuauagaaauugcuaacuagaauaaccaguuuagagaagaacauaaaugaccugauggagcuaaaaaacacagcaugagaacuucgugaagcauacacaaguaucaauagcugaaucaaucuagcagaaaaaaggauaucagagguagaagauugacuuaaugaaaugaagugucaagacaagauuagagaaaaaagaaugaaaaaggagaaugaacaaagccucuaagaaacaugagacuauaugaaaagaccaaaucuacguuugauugguguaccugaaagugacugggagaauggaaaggagcuggaaaacacucuucgggauauuauccaggagaacuuccccaaccuagcaagacaggccaacacucaaauucaggaaauacagagaacaccacagcgaugcuccucaagaagagcaacccaaagacacauaaucgucagauucaccaaaguugaaauaaaggaaaaaauguuaagggcagccagagggaaagguuggguuacccacaaagcaaagccuaucagacuaacagcagaucucucugcagaaacucuacaagccagaagagaguggggccaauauucuacauucuuaaagaaaagaauuuucaaccuagaauuucguauccagccaaauuaagcuucauaagggaaagagaaauaaaauauuuuacagacaagcaaaugcugagaaauuuugucaccaccaggccugccuuaaaagagcuccucuaggagcacuaaacauggaaaagaacaaucuguaucagccacugcaaaaacauaccaaauuguaaaaaccaacaacacucugaagaaacugcaucaacuaaaagucaagauaaccagcuagcauuauaaugacaggaucaaauucacacauagcaauauuaaccuuaaauguaaaugggcuaaaugccccaauuaaaagacagagacuggcaaauuggauacagagucaagacccauugguaugcucuauucaggagacccaugucaagugcaaagacacacauaggcucaaaauaaaaggauggaggaauauugaccaagcaaauggaaaccaaaacaaagcagggguugcauucccagucucugauaaaacaggcuuuaaaccaacaaagaucaaaagagccaaagaaaggcguuauauaaugguaaagggaucaaugaaacaagaauaguuaacuguccuaauauauaugcacccaauacaggagcacccagauucauaaaucaaguucuuagagaccuacaaagagauuuagacucugacacaauaauaguaggagacuuaaacaccccacugucaauauuagacagaucaaugagacagaaaauuaacaaggauauuuagcacuugaacucagcucuggaccgaguggaucuaacaggcaucuacagaacucucaaccccaaaucaacagaauauacauucuucucagcaccacaucacacuuauuuuaaaauuagccacauaauuggauguaaaacacuccucagcaaaugcaaaauaauggaaaucauaacaaacaguuugucugaccacagugcaaucaaauuagaacucaggauuaagaaacucaaaacugcacaacuacauggaaacuaaacaaccuucuccuaaaugacuacuggguaaauauaaaaauuaaggcagaaauaaauaaguuauuucaaaccaaugagagcaaagacacaacauacaagaaucucugggacacagcuaaagcaguguuuagagggaaauuuauagcacuaaaugcccacaagagaaagcaggaaagaucuaaaauugacacccuaauaccacaauuuaaagaacuagagaagcaagagcaaacaaauucaaaagcuagcagaagccaagaaauaacuaagguuagaaacaagugcuuggugcugcgaagaaaacgugugcucaauaaaagauuacuuaguaaggcaauuuuacuuuuguaguguagcaggacgagccacagacaaaacuccuccucagacaccagguuaaagaaggaaggagcuuuauucagccuggaacuucagcagacuugcaucucaaaagccgagcuccccgagugagcaauuccagucccuuuuaggggcuuacaacucuaaggggguccgcgugagagggucgugauggauugagcaagcaagggguacgugacugggggcugugugcacugauaaucacaacggaacagaacaggaaagggauuuucacaaugcuuuuccauacaacgucuggaaucuauagauaacguaaccgguuaggucagggguggaucuuuaacuaccaggcccagggcguggcacugggcugucugucggugaauuucauuucugccuuuuaguuuuuacuuuuuccuucuuuggaggcagaaaugggcauaagacaauaugagagguggucuccucccuuaucccccucucuuugagaaccucucucauuagugggaguucucacuuucauccucacuacccaugucuucuugcaagacagaucaauagugauucauauaguauacuugugcugaagcauuuuggugaacuaagguagugaugaaguuuuuuauuacuugaaggaguacagguagcaaacaagggaguaguaagcagguuccuauuacuauuauaauuuuuauuauaagaguuuuaaauccuuuuagugcuggaaaccauuuccaaccauggccccaggauuaaauccaugccacacuugcaagggcacaugugccaguuuugucauaucuuuaacuaugucuucaacuacuugcccuugaucauuuaugugcaaacagcaauuguuuagguuaaauuuuccacagacuacuucuucagcugcuagcaaguagucuagggcuagucuauuuugauagauagcauuucucaucuggguuuuugcugggcuaaaacaguuaaagcucuaccaguuuuauuaguuauuauuuuuaagacagcuuuuaacuguaugauucgguugagcauauaaauggggguuugguauccccacuagccgucuugugccuaaguggcaggcccauaguacugcaugauuuuuuucagggggccacucaucaucuuuccagcugccuauagcuaugcuucucuuuucucgggaagcacagacugggaagccuagaagugugccuguuuuuaugggcacuaggaaaaaggauggguuauagcacacaucaggcuggucacuuccagggcuauauaccuuguauagaauagcauuaaacaaacaagcuccuuuuagaguccugguacacuuauaauaaccauaaaauaauagaacuguagcaaccuuuuguccuaccgcagugacuugacguauauacugggaacaguccucagucugggaaaggucaguugaaguccuuacuguacaaguccaaauuuuaaggaaaaugagucccaugaugaguuuccucaugcuucggcugugcguggaccagucagcuucugggugugacuggagcagcgcuugucaucuucuucagagucacuuugcagggguuggugaagcugcucccguccacgugcagcuaccagucuacugauguucaaggauggucucagagguugggccugcuagaauaaacugaguccaacaccucuacacaguuauguuuaacugggcucucugauacggggagcaagguggugggguuuaggguguugcaaacuucaaugguuaugcagggauuuucacagagcaagcuuugguaucuaguuagucuaguauucuuuagccaaugauguccuuugguauuuauuaaagucaccacaguauggggggccuuuaucuuuagguuuugcccaagaguuagcuuauccacuucuuaugcuagcagggcuguugcugccaaagcccucaaacaugggggccaacucuuagaaacgccaucuaguuguuuagagagguaggccacuggccccagccagggccccauggucugggucaaaacucuaaccgccauuuuuuuuucucugucugacacauauaguguaaaagguuuugucuggucagguagccccagggcuagggccgacaugaguuuuucuuuuaacucaugaaaagcucguugcuguugguuguaauagauguaguuuauccaaucuacauuuuuauuaacugucacccaccaaaauauugacucaaauccugcagcuauuugauuuugggcuuuaaauugaucugguauucccuuuuggauuccaauugcaucuaaauagaugugagaguugaaaggcccauaaggggcuucucucacuuuacaaugucuuauuuuuccucccucugguugaugaaaugccagggugaaagggauagccaacuggacuaaagcacaaaugccacuccaguuauuuggcagagugcccaguaaagguccaccacaauaccaccacacaucugcuuggggaugaaccagggcugacugauugauaagcucuugaaaauucuuaagcucacugcaucccuucaggucuccaaggaaugcuaaguuuucucccugucaugagagacacgaagugaaccuaguguuggaagacggaagcgggauggcccucgagggcugacccacagggugcucgacuuccggauauagcagaaagagcuuggcaugacuuaauacuccaggcuguagaauccuggaaaagagcuaccaugcagcccaugccugguugacuggaggaccaccuuaguggaaaggggacaaucugggccucuggccugccaugugcacaagcauaacaauugcuuuuguuuaacauguggagggaauauuugauccauuccaaccaggcauuugcaucuugguaaccugcuuaauugccaaaguuuguauuaagucuuuaacuucuaugauccucuaguaaaaugaacauaugguuuuaggaaauuacaaaaaccgguuggggaaguccauccuugcucuguagugguccacggaauguuggaccaacuauggcauaaaagcucuacaucggggggcaagacuccuaguuggcacuggggucuuuauggaaaucucccuggauuaaauggucccaauuuacuaaugcccagucugaggagagucaggaaggucagagguacuuuucugaaguagagggcugucuuugacuugguaaguccccacaggguauaacaaggcaagcauuaaaugcaauaguuugaggcaaaauugacuugguuauguuaauaacuagauggucagcaauagagugaggaaagaagaaagaguaauagaauagaugaaagaguuaaauuuuucuuagcuuaguuugguaggguuuuccccugggacuauggccuaugacucuggaggggguggugcuuucuugacuugggugugaugaauccauccccuuuccauuguaggaacagcagucucagcgguuagcagcacaagguaagcuccuucacaggauggcucaaguuuuccuucuuaugugaucuuuaggcuggagcugguuuaccagaaauucuaggggugguacgugugcuaaaagacuuuuaguuuugagggaaaggaaaguguauauaauuuuuaagaaauuagacaaugcuucuugugugauuuuuauaccagauaaguaaauuucaccuuuauauuaguguguuauuaauguuaaacuuaguuuucauaaaacuucguagacauauuuauucaauuuuuaauguuggaccauaagguaagauuuuuauagacucuuuuuaaccuuuuauaguuuuuguuaaagagcagguuagugauuuaagaaaaaacccguuguguuuuuauuuuaauguuuaguucacagaaaaacuggaugauaccucuuuaacuuuagcuaauauguuuacacacagaauuuucuuuaugauuaauguuuuaaaacuugcuuaagccuucaaaagaaaacuuuuuuuuaaccuuuuaauguagguaaaaauccacauucuuaugccuccuuauaaucccuuuaccaaagguauauuuuacuuuccuuauacaccuugcacauaaacuguuucuucaauaguuuuacauucaggaggcccaauuacuuuuaaauuauacaacauuucuugcauaaauucuuuuuuauaacuuuuuuuucucuuucaugacuuucacagacaauucuuugacaugcguuaacuuucugacuuauuacaaacauuucuuucuuuaaacaaccaguuaauuuauuucaggauaagaauuuaccauauaacauucuuuuuacauaaauuucgcggccccccccaacuuuuuuucccuuuuuuuugaagaugauaaccauucuuuuccaaaguggacuuccuuuaugucuguggacuagacugucuaaggccacaagauuagaaguuacuauaauauauguuacacuguuaacuuuuagcacacuuuacuuuugcugaaaaccuuguaaguuugggauuucaauuauccuuugcuauuaauaagaacuuguuuaguucaaauuaacuuagaauugguauagauggcuuuuuuuuuuuuccuucaauuacccaggaggaaccaucuaucauccuguccugaagggaguuccucuuaggucugguugaaccuuuguauaguaauuaagauuuaaauccccuguuaggaaaccugcuggguuaagggaauuuucaguaguuaauguuaaaucaucuuuuuucuuuuuuuucuaacagaauacccuuauacuuuaagauuuuuaaguuaguaagcuaccuuuuugucuuuuuuuuuuuuuuuuuuaacuuaggauacuucugaacugguaaggugugcucacaaugagguuuccccuaaaaguuauuuuucuacuuucuucuguuagcaaagcaguugccgcuacagagugaaugcauuugggccauccgcagguuacugggucaaggauuuuugauaggaagucuagggguuaucagcggccucaaugcuuuugggguauucccuuguuuacacugacaacaagaaaguguuauuggaguguuauaggguuauggauaauaccuuuaauuaucaauuauagguuuuaaauuuaccuuggcuuuuaaaggaauaggguacacuguuuuuuuucuuaacuacuuguauaucucucucucucucucuuuccuugacucccucuuugucuuucugucucuuccugucacuuucucucucucuuugccucuuucccucucugucucuuuccucuaucucucucucucugcuggucuuuccuugccucugucagcugcuuaugcugcuguucucucaaccacugugaggcggaucuaaaaccagcuguaaccaagugucuauguacaggaacugguuugcgugcccuggcuuacagguuaccuugugccauaccuuugaaacaacggacccgucaaggcuuacuucugaugggaaauccaccucuaaugcuggccagucuauuucacauaaaguucuaacuuuuccuggugucagaguaacaccauaaucucccuuaaauccuuucuugaaauuuuucaacauaguuccugguggggugggcuuacuuugugccugacccaugcuuccucgagacaaaacaccacaugcacaccgcaaaacaaagaacaaguaaaaagggcacacagacacuuucacaguuuacaccaaaccagagucaaaaccaaaucagaguaucaagaaauccaagccaggucaaaaccaaaaccaaaguaucaagccauccaagucaagucaaaaacaaaaaccaaagugcugguacagacacgccgugggugaucaggccacgcuuccacucaaauggaguggucaaguuccaaagaccagucuuaccaaguuucagauguccagacugcaagugccaguucuuucccgguguucagccacugcguugacccucugcgggggccugccgugcacugcucugaggaggcguuccacuggggcaaaugccuacccaggagcgcucucaggaucugcaucgcucaagcuggcuggaguccccacagggaugcuccacaaggcaggccuaagcugccuaaggggcugccuuggccucuguuaaucaccucgcuuccuggucaggguaccaagaaauguagcagaacaagccacagacaaaacuccucagacaccggguuaaagaagugaggagcuuuauucagcuggaaauuucagcagacuugcaucucaaaagccgagcuccccaagugagcaauuccugucccuuuuaagggccuacaacucuaaggaggucugugugagagggucgugauugauugagcaagcaggggguacgugacugggggcugcaugcaccaguaaucagaauggaacagaacaggacagagauugucacagugcuuuuccauacaaugucuggaaucuauagaugacauaacugguuaggucaggggucgaucuuuaacuaccaggcccagggcacagcgccgggcugccugccuguggauuucauuucugccuuuuaguuuuuacuucuucuuucuuuggaggcagaaguugggcauaagacaauaugagggguggucuccucucuuaguagaaggguguuauuugcauuugucauuuugaaagcacaccaagaggggugggcaggguuuuuuauuuuuaacacaaggggcuuuuacuguugugucuuuuuuuuacugacugaguuggacuguauaauugaagcuaauuuugauuggcuaaucugaauagagcaaggauguggguuacagugguaggacaaguaguuucagcaggaagaauaguuguagagugcguaacuaagggaacagaacagauguaaguuauagauuaggacuggugggaaggguuguuuauagcacaguuaacuauagaaacuggagaaacaaagaacaggaagaacacagaacuaaaacuuuuugaagaugaauuuaucaucucugacaugugucuagucucuguuagcuggaguuggacuguacaaaucgacacugaacuugauuggcuaacuugaaaggggcaggggugugauuacacugguggacaaugggaggggugauuuacagaaugauuagcagaugugggcucuguagauaaggaaugauaggaaaguuguuuacugaaacuaaaacggggaggcauaaaggauaaggaauguaguuuggcuuugggaguagggaacaaagagcaaggacgcuaaacaagccaaacuuuuaaagaggaacucuuuuuauaucugacaacuaagaucaaagcagaacugaaggagauagagacaggaaaaaccuuucaaaaaucaaugaguacaggagcugguuauuugaaaagaucagcaaauagauagauugcuagccagacuaaugaagaagaaaaaagagaagaagcaaauagacacaauaaaaaaugauaaaggggauaucaccacugaucccacagaaauagacuaccaucagagaauacuauaaacaccucuacacaaauaaacuagaaaauuuagaagaaauggauaaguuccuggacauauacacccucccaagucuaaaccaggaagaaguugaaucccugaauagaccaauaacaaguucugaaauugaggcaguaacuaauagccuagcaaccaaaaaaagcccaggaucagacagauucacagccgaauucuaccagagauaugaagaggagaugguaccauuccuucugaaacuauuccaaacaacagaaaaagagggacaccucccuaacucauuuuaugaggccagcaucauccugauaccaaaaccuggaagacacacaacaacaaaaaagaacauuucaggccaauaucccugaugaacauuaaugugaaaauccucaagaaaauacuggcaaaccaaauccagcaguaccucaaaaagcuuauccaccacgaucaagucggcuucaucccugggaugcaacccugguucaacauacacaaaucaauaaacuuaaucuaucacauaaagagaaccaaugacaaaaaccucaugaguaucucgauagaugcagaaaagucccucgauaaaauucaacaccucuucaugcuaaaaauucucaauaaacuagguauugauggaacguaucucaaaauaauaauaacuauuuaugacaaacucacagccaauaucauauggaaugggcaaaaccuggaagcauucccuuugaaagccaguacaagacaaagaugcccucucucaccgcucuuacucaacauaguauuggaaguucuggccggggcacucaggcaagagaaagaaauaaaguuuauucaaauaggaagagaggaagucaaauugucucuguuugcagaugacaugauuuuauauuuaaaaaaccagucuucucagccccaaaucuccuuaagcugauaagcaacuucagcaaagucucaggauacaaaaaucacaagcauuccuauacaccaauaacagacaaacagagagcaaaaucaugagugaacucccauucacaauugcgacaaagagaauaaaauaccuaggaauaaaacucacaagggaugugagggaccucuucaaggagaucuagaaacaacugcucaaggaaauaaaagaggacacaaacaaauggaaaaacauuucaugcucauggauaggaagaaucaauauugaaaaauggccauacugcccaauuuauagauucaaugcuaucccaauuaagcuaccauugacuuucuucacaaaauuagaaaaaacaaacuacuuuaaacuucacauggaaccaaaaaacagcccauauagccaaggcaauccuaagcaaaaagagcaaagcuggaggcaucacgcuaccugacuuccaacuauacuaugaggcuacaguaaccaaaacagcaugguacagguagcaaaacagauauauagaccaauggaacagaacagaggccucagaaauaacagcacacaucuaaaaucaucugaucuuugacaaaccugacaaauauaagcaauggggaaaggauuuccuauuuaauaaaucauguugggaaaacugacuagccaugugcagaaaacagaaacuggaccucuucuuuacaccuaaugcaaaaauuaacucaagauggauuaaagacuuaaacauaagaccuaaaaccauaaaaacccuagaagaaaacccaggcaauaccauucaggacauagguaugggcaaagacuucaugacuaaaacaccaaaagcaauggcaacaaaagccaaaauugacaaaugggaucuaauuaaacuaaagaguuucugcaaagcaaaagaaacaaucaucagagugaacaggcaaccuacagaaugggagaaaauuuuugcaauauauccaucugacagaaggcuaauaucuaggaucuacaaagaacuuaaacaaauguacaagaaaaaaacaaucccaucaaaaaguggacgaaggauauuaacaggcacuucucaaaagaagacauuuacucagccaacaaacauaugaaaaaaagcccaucaucacuggucaguuagaauggugaucauuaaaaagucaggaaauaacagaugcuggagaaauaaaaacucuuuuauacuguuguugggaguguaaauuaguucaaccauuguggaaggugguguggcaauuccucaaggaucuagaaccagaaauaccguuugacccaguauaaaucauucuacauaaagacgcuuucacacguuugucacggcacuauucacaauggaaaagacuuggaacccacccaaaugccuaucaaugauagacuguauaaagaaaauguggcacauauacaccauggaauacuaugcagacauaaaaaaggauguguucauguccuuugcagagacauggaugaagcuggaaaccaucauucucagcaaacuaacacaggaacagaaaaccaaacaccacauguucucacucauaaguggaaguugagcaaugauaacacauggacacagggaagggaacaucacauaccggggucugucagggggugggaggcuaggggagggauagcauuaggagaaauaccuaauguagaugauggguugaugggugcagcaaaccaacaugccaugugcauaccuauguaacaaaccugcauguucugcacauauaucccagaacuuaaaguauaaaaaaauaaauaaauaaacaguauggaaagguagggguagaaaguaacuucauaguggagaaaucuaacaaucauuaccccagucagguguuuaagaucaauaucagcagucauaaauuauguugguaguauguauccuugucauaaugugacaaaaauggcacuuuaacucuguuaucuucuuucccaaaccccauaacccuggucuaauuaugaguaaaaacaucagauaaauucuauuaaggggauacccugcaaaauaccugaccaguauuauucaaaacugucaagaucaucaaaaauaagaaaaaucugagaaacugucacagccaagggaacuuaaggagagaugacaacuagagcaauuugguauucuggauggguugcuagaacagaaacgugcuggggaaaagauaaggauauuugauuaacauauggacuuuaguuaguaacaauguaucaauuuugguauauuaacgauaagugcaccauacuaacguaacauguuaauagggaaacugggugugagguguaugagaagucucuguacauucuucucuauuuuuuuuuaaaucuaaaacuauuuuaaauaauggggucaauuuuuuuaaaagaagauguuucuauuagaaagccaggauuaugggcuuaucaagcagauguuuacagcaaauucucugcugaacuauggggggaggagaucugcaaaugguguuuuauaaaucucuguuuucuaauuuuaagaaagcuggauuuuuccaaaaggaaaaagauuuugcaugguauauagaaguuggugcauggauucaucccuacauuaaaucuguuaucacccagaaccagacagcauuuuugaguaaaaauuuagauauuugauuccuccugcaauucauguacuuuauuugccuuuugcuuuucuuuuuuuuaaaaaaaaaauuacauacgcuacuauuuagcuauggcuugcugugguauauagucauauagucauauagucauuuaucugucuaacacccuucccuucugaaagcaacaauuuccuccuucugggaguuacacuuguccguuuccaccacccaaaccauaugguuccauuaauauuugccaugcuauuacauuuucuuauuccugaccccagacugguuuuggguccaccaaaucuaugauggucuccuacaauucccaacucaaauggauugguccaaaaggugucccuuguuucaugcuaaaacuaucagagcuagucucaagcuauuuaagccuggaccauaaagagaaguagucacacuauuuugauugaaaaacucuuaagguuuaaaacccaggacaguucauuguucaugcaucaugcuaugcagagaagauugggucacacugagagaaaauaaagcugucuaaggaguguagccacaaugagaaauaccugguggugcucagcucaccagcucuagcuguuucugagaacuaaugcaagccugcccuugucaucucagauuguuccacauauucuagaauaaauaaacugaugauccaaauuugucagagcugguuucuaauccuagcacccaacgaaagucuaaaguacuaaguuuaggcaauacccuaggcugccauuuuuuaagacaggaacuugcugaauuuagagcccucucucucaagggcuucagcaggcccccaaccucagccugcuuccugaacugugugaugcagaguacacucuguauuuuauacucaaaguauagcaggauaguauauuucaaagaaucaaauggaaauaaaugaaucucugaaaaacguguucaaaaaugcgauaaggauuagaaguuuaguuucaagauucuucaaaaucauguaucuauauaaauauauauauauauuugugaauucaaaugguuuaugguaugauuuacaagauauaugagaucucuacugacuaaaaaucaaauguauguuaacacuugcaaaguguugugagaaaaaaagguuauguaucucacuagugauuuuaaugaaacuuaaagcauaauaacauuuauuacuuaauuauuauauggcuacccacaaugguguauauugcagcugugaucugcuacagacaaaaccagauaauucucuagauuguuuuugauggaguaucugucccugcauuugugaauguuugcugauaagaucucgcuuuccuuccugacuggaagggcacugguggcugagaacaggaaggaagcaaguguucucuucuuuuauuuuucuguguugcaugaucauuacacuuuuccuuccaccuuuaaauccaaagaagaagucgucuuuaaaaaaauaaaggugacuuacuucuuucuuuucuuuuuuuuuuuuuuccuuuuuggcgauagaucuuuaaacaacguugaaacaggaaaagucucacucuccuauugaaaucugauuccuuuagaguguaagagugauggcuuaucacuuagagucacuuuucugugaaacuuuuugaaucagauaacucccuaaacugcggaauaaugaacugggaaagaggacuaacucgaaugucagacacuucuuuuguccucuguuuuggcugucugcuaucucacagaaaaccugguuaggaaauugauguaaauaauguauuuuuuaaaggaaacaaagaugaaaauucugaaaauguguuuccuuuuuaaaagaagaacuagagcagagggaaagauaaaucaggaauuaaaaguugcauuaaagaaauaauagaaaaaugccuaaauaauuauugguucugacugagaaagaauagcugugcgaaagauguggaaaguaaaauugcacauggaaauggacuuuaauacauacuucgccauauugaucagcguuuacccaugucucucaauuacuguccuuuuuauuuauauuuucaaaguugaaauaugaccuguuugcuugaauauuaauaaauauaugcacugaauguguuugcccauaauucugaauacuacauauacauuuuaaguaugacucauugaguaugcacagagaaauguauguguauacacauaaaauggcauagaaauuugcauaugagguacacauaugauguuuacuagucuguaaaugagugcauauuaacacuuuauuuauuagauauguauggguucuguauuucagagaugauuuacacaaugaagaaaguacaugcacuuugggcuucuguaugccugcugcuuaaucuugccccugccccucuuaaugcugauucugaggaagaugaagaacacacaauuaucacagguaaaauauuagaagcaauuaucuuuuuaagcuaguuaaagcucucaauuuuaaucuaaaaaaucuaccauaguuuuccauuguggagggaaauuaguuguuauugaagugauauuuuucuuuggaaauuuauuauaccuaauguauguguguguguguguguguguguguguguguguguguguacaugcacauguguguuuuaaacaguccgaaaccaaguaacuuuagcugaaacacuucucucuuuuuuuucagcauacaauauuaaacacuggaguagcuccgggcuauugcaaggagcaaaauguuguaaaaacaacucccuaugacauuugaugcuacccuuuggcuaggaaaagugugaggaggaaagggaacuucagacaucugagguuucagcuauucucucuuucuuccccauauuuccaaaaucaaaacuucccaguugagacuaauauaaaaaucuagucaaccaggacaccaaaggaucuaguaauauaaguuagaucuaaucccauaaaacucugugucuaaaaaugagaauauuaacaauaaaaaauagagcaaggagaagacuguauggugaugguuauuguggauauauaccuuucuuaaaguaacauuuuguggcaaauuaguaaauuguugacagaaaucucaagcauugguauuaaugagagaauauuaacaaaaugauagcuuauuuuuguauagugguuuaagauguaaaaaagauuuccauaaaugcauucuuauuugauagcuuuaauagcuuuuuaaaaugacuguguucaguguacuuuaauaaaguuugaauaaauacaucuucugggccugaaucuguggaaggugcuagagaaacagguauggcugagaugaggugcucaagaaucucacuguuuccuaggggagugugaaggguggacaguuuauuuccguauaaaguaguacacaaagugacagaagcauggagagugcugcuguugaugggaagaggaaggagauucaaucaagcuuggcucucugagggcuccacaaggggaagucauguuauaaaaauuuccuagagaugaagcauuauuuaguaaaaacccuaauguaccuuuuugaaaauaagaauuugaacauuaugaguuucaaucccucauucggcuuuuuucucaaaaggugguggguuaaaauucuaacauucuggagguuacagaaacaaggaagguggaggauaaaauaagucuuaacagggaaaaaacaggcaaucucacuugugggaagugagaagcaaauagauccaaguguucccuguauuugucccaguccaauuuuccucaacuggacugagaaaaugaauauugguuaaccaggaaguuccugaaauuguggcugcugccacugucaaucaauaauccagaauuaaguuaucaguaauuaagccagaauuuaaaauuacuauaagguagcuuccaaaccuaggugguaacaaagaauuuugauauuuaagcuagacuuaaagaccucuucaccaacuaguugcaguuuuaucuaguuuuauuuuguuuuuguuuaaaauuaauuuuuauaauaaccuuaucucacaucugaaaaaauucuauuuaggagauacaauuuaucacaugaugcuaagaucauaacaucauuuuauagaaguauauuauuuaauugaaauaagguacucuuauuaauagaaaaauacaucaaauuuuauugcuucucucacaagcaaauaguagaugauuuuuuuaacagucaaaucagcagggaggauaaucuagaauuaacgucuagauaaggcaaaaaugauaauaaaaagaguagugauaagcuuuuuaaaacaauuccauugggcuaggagagagaaaauuaagagugaacauuuagugaaaggcaaguaucuuuuguaggauuuagaaucagacagaccugaguuugcagguguaguuugccaccuaguaccuuugugagacugaauaaguuaaacuuucugacuaccaguguccuaagcuguaaaugaauaauguaaauaacuaauuuccuaugauuuuuauauaaaaaguggaaaagcaucuggcacauuuucugacacagagaaggcaaaagguacauguguuuguucuucccugccagaaaauaaaauaaaauaaaauaaaauccuuuaauuagagucuagcagcauguggauucuuagaugguaaguuaccugaaagcccuagauuugcaaauaaguuccaagaggaugaguauucuuacagucaagggcaugauauguuuucaggcagcaaauauuauaguaagcuucuauccaacaucccaggacauggggcggggggagggaaggggaaggcaggauuguaaccuuuagacuaugagacauaaaauucaugacaucaaaggcaaaugauucaauauaaaccauaauucuauuuauaugacuggaucagauuaaauuccuuuuagauugcccucuauguguuuugcuuucucauggccgcuggcagauaauuauuaccucuguaaacauuuccuucaagucucaauuucaagucucaggaaaguuaucgcugaccccuucaggcuaauuuagguauccuacuguucacucgcacagcacccaggacuuucugaauguuuauguaaguccuuagugucuauaugcuccaugaacgagggguugcugucaucuaauuuacugucauaucuguagugacagcacagugcuugacgcauggucaauacccaauuauuaacauucaaaaggguuuauucaaaauaagaaaugaaaaccgaggcagauuuccaucccuuuugggugaaguggcauggcacugugggucacacagcacaccuggccauugcuugaguccagggaugcugugcuuaggugugggcugcaagaucacugcacaaagaauauucuaauacaggauuucuauaagaaauacauuaaagugugaauaaagacaaauaaucaccuaauaauuaacaaaauauaauucauaaaaguuaauacuuaguguuucuccuagaaaauuucuauaaaauuaucaccuacuuccauuauugaaaccauuuuuaguuucauaaaggugaauguuugaaaaaaaauguuguugauugaguggaaauuauauaauuaaaaccguaugcuugauccaaaugcuacuuuaggaaucucagucacaugucugugacaauaucauguaguuauuaagaaugugugagauagcuguuguaaaaccauaugaggaucaauuuuaaacccaucauuuaugguaugaauuuaaguuauuuacuuaauuucugaaagcuauuuuauaauuuauaaaaugaagauaauaaugccuaacucaguaggugguuaugaucauuaaaggguacaauuacaaaaaugucaaggguauuguaauuacucagugagcaacauuagcuauuguugcuagguacaacuacuacagcgaguuuaucagcuuuugccuuuguggugcacugccaccaccugcuggcaaaauuacucaauagcagauugaacuagaggugauuauaucuuuaaugcagaaaauggaaaaaagauuuagcuugauaauaaauacuaucaaauauauuaagaauaaaaaguagaaaaaucaucaauuaguaucugauaaaauuauugauuuaugaaaaaugauuuuucugaauauacauggcaaugcagguauuagguaaaguucccuguguucugcagauacagaucuuuauucaaguuuucuaucugaaacacuaccucaauaacuugucucuaaaguucuaaagucauguuaacuugggaaugaauaacaucacauuauaugagaauuucuacagcaauuugagauaaugguauauagcuguaaaauuaaaaaugccagaauauuuuuauuccugcuuuguuaugugaauucuggggucccauauuuaaggagcugauaggucacauuuuuauugguuucaaaacaaacaugucuagaguucagaaacucacgauacguaauuugaugauacuuacugugggccugcuguaagucagacacaccacuuagggucuucacaccaaauuuucugguuucucauaaaaacucaaaaugucagcuuggcauucuaaaauccuuaaguaaagacaaaaagauauaaacagcauuuacaauuauucauaaaugugccacucagaaaaaaaaauucaaugauuuuuaaaacugacaauuauaacuucagugauagagaaaauguguuuuaacaagucauuuugguucauacauuuuucgauuuuuagaaaguauuuuuagcaauccucaauuauauuuguuaugaauuucuauuaaaaaguacuuguguaucuaauuuaagaaaaauggaaaauuuuaccaugaagugcucauauuuauagguaccagaaacucucuauaugccugagagaccuucuaaagcaaauuaucguauuuuagauauguucaucaacaugaaauguuagauaaaggauuugaaaaaaaaaagaaaugacauuuaaacuugucaauguucaccaauauuucuuaacucacuuugauacaauuauuuguauauauacuauagauauuuauuggauuuagugacacuguuauugguuuaaaauuauuuuaaaaaucauguugguaaacacaaacauuauauuuugucaauugaauauaacuccagaaaaauuugaagacacacaaaugcauaugugcauaaaacucaacuuuaguuaaagauuugaucaacauucuuacuugcuaauuagcuauuuuaugacaauuguguuuggugcugaaacuauccccguaucauaauaauucucugucauauguuauucuaaguuaacaaauucuggaccugaaaaacauacucuucuaucaguucugucagcucaauuuauuucaauugaaaaaaauaaucaauuaacuuaucaaauagaucaaaauaaugagaugguauuauguaaauuuaacuaguauuuuuaaaaauugaaagcaguguuaguaguugagauaaaauuuacguguucaaaaauaauuagugucacaugaaucaaacagcaugaaaaugccaacuuauguauagaaagcuguaucuuuaauccuuccaagauuguaaaggcuacuuacaauuuuaugacucauauaaaaaauuaacaauaucauuucaaucauuuuguuacaaaaaguuuuaacauuacuaaaauaagacuaauacuugcuauuaauucaaaauugauuauuagaauaauaauauauuauggguggagugcaauuaauaaaauuaucuaauuuaacuuuuauuacacacauauuuucuguuucaaaaaauucacauuuugaaauuacaggaaauuuaaaacugauuucuuuugagacaaucauacuccaaaaacuuauccuguauuuuaugcuuuaaaaauauuuuaugugaaaauauuaaagucucauucuuuuuuuguuguuguucaaaguaaacuauuuuagaaugcaugaaaacacuuuuuuucaagauauuuauacucaucuguuuaauucaauauaauacugcugcccucuagaggcaaaauugguuucggucauuuauagguuucaauauuccccauaagagauuaauaaaucaauugccaaagacauagaaaauacauagacucaauaugcagaaaauauucaagaaguauuauauggcauuuuugucauuauucuuuugguugcaccacccacaauuuucagugucuaucuuuacugguaaacaaauagacuuuacuuaacauuaggcuucuauuaauuuuauuggacuugaaaaaaauaaaauguuuaaaaaaucuaguugaguuuccccuauuucuauguccauucccaggauagaaaauucuguuaugaaaauuaggaguuaaauauuuaaagaaaaaauauauaacgugaagucaaaagaauugccucauucuauuuaaaacauagaaagcauuauuuacauuauuucaacauuauuaaaacccaagcaugguaugguaaguuaaaauaaaaagcaccaugaaguauauuuuucagaacaucaaacacauaaauuuuuauaauuagggaaaaugguuuaauauaguguuauauacauauguguguguauauauauaugugaaugugaauaugcuguugcuuuuaaaggguuguuuuauguguaaaaagugacacaaguguggguuagggagagaaauucaaagaacuguccauuagcugaguuaaaagaggucuauuguggacacauccacuugaaugaaguugccuuacaacuacuacucaauucccucccaguucgguugguacgauuuaagcaauaccucccuaacaagagucuagaaguuguguuucauuuggugaauuuauuaacuuuaucuaccauuuugauaacugaauaacuuuuuauaguuucuuaguauguuuuauuguacuuuuccuuaaaaucaggacauauuaaaaaggaaauaaagaacauuauuacaguguugauggagauuacauguuauaucuuuuauuuuuacuuuauagauacggaguugccaccacugaaacuuaugcauucauuuugugcauucaaggcggaugauggcccauguaaagcaaucaugaaaagauuuuucuucaauauuuucacucgacagugcgaagaauuuauauaugggggaugugaaggaaaucagaaucgauuugaaagucuggaagagugcaaaaaaauguguacaagagguagguuucugggaacccuuauuacucaagacccuuuagggcuauugagucuaauuauggauuugauaauuuagggagaaaaguaauuucaugcuguuuuaauauuuccaaggaaucuuuuauuuccacauuuuuagacuuucagggaauccuaaaaacauuuaaggaaaaugauaauucugaauuguaccaugaaauacccacauuuauagguaccagaaacucucuauaugcccgagagacauuuuaaagcaaauuaucaaauuuuagguacggucaacuugcauguucaacuaucauuuuucauuuucuucauaucagugaauuauaaaauaugaggccccauuuauugucuuauacucuuauccauaauaaagacagaagaaaaaaaccucaacucauguucaaagaauugugaaguauuuuuaaaauaaaguggguguaauucggccucccagacuuguaaucucaguuggcagaagaaaaacuguuagucacauugacuuagucuuuccuuugucaacacaauggucucaucgcuauacucucucaagaucaugaaucuggaaauugaagcucuauggcucuuaauuacaaaauuguaagcugcauaaaauaguagaacuauauaugaaauuuaagauuuuuuuauuauuggaaccuuaaaauacuacaggaaauaaaaauagaauaccauagaaaagaaaaaucaucccugaugacccuuguggacuuuacuaaacccaauguuuuauauuaauauuacuaaguuauaaauuucaaaaguacgucauauuauauuaaacuuuuacucugcauuaauccuacuaaaauuuaacauuuuugcaaauuuugcuaauuacuuuauuguaugggauuuuauaucuucucacuaagauaaauuacaaauaauuacugaccaaaauuuugaauguuuuuuuuuuaaugucaggcuauucuuccaaauuguaaguuacucaagggauagaauaaguugaguugcuuuuauuucccuaguuucuagaccaauauucuaccauagcauguucguagagcugguuggauacaauugaggugauacagaaaugauaucucugguuaguaacacuagaugucuuguuuuuugcaaaucaggcagcucugcauucucacucuguuacugcuuucuaaauagcuuuuacuaaacagccuuggcaucauggugcucuuggccugugggaaaacuuccauguggugaaaagagugaacuucucuccucuguggcucuguaagauguuuaguuguaugcucccaagcugaaagaagagaauagacacgaauauauuucuuuaaccucacagcacugauuucucuguuuccucuccauagaugcccuaggaauguuacuaacacaguuuaggcagcucagugguccucaguggugcuuuugguuuuugugauugcuuggucuuuucccauucaucacagauuucuauaccccauuuucuuccauacauauugggccaaguauccuuuuguguugaguugaaaaucauucuuaguugucaguaccuuggcuagaagccugguugccucauucuuuguaauccccacucuuucauuuagcaggcuauuuauuuucaucaacuggccucuuuccugaaauauauaccuguucuuuuuauauauguguauaguucaagucuuaugguuuaucauugugcaaaacuuacucuuuucuuuaaagguuagggaaauguaaucauuuugcucaucagugauagccuugcuuaucaucauuuaaaauaucauuucuggcuagcauguaaauguaacucucuuacccccaucuccucauuaucuaucaaaauucacuugaggcugggugcaguggcucacaccuguaaucccagcacuuugggaggcugagguggguggaucaccuaaggucaggaauuuuagaccagccucaccaauauggugaaacuccgucccuacuaaaaauacaaaaauuagcuggguaugguggcaugugccuguagucccagcuacucaggaggcugagacaggagaauugcuuaaaaccaggagccagacguugcagugagccaagauugcaccacugcacucuagcugugcaacagaggaagacuccaugaaaaaaaaagaaaagucacuugcaauuauuguaugaaugucugaguguuuuauacagcagacuacugauaaggauauaacugguauauggaaaaaauauggcuagacuuuuaaaaacgcaccuaaggagagaauuuaaucggcagccaugauggauaaauagaacaagacuuucucuccccaacauaaagaacuauaaaacuggacaaaauguaaaaaacuacuguuugcaagcauugaacaaaaggcagugcaggauugugaccucugggagaagguaaauacauaagaugagcccugcagucuccccugcuuccugugugaaggcauucagaaccaccauuacaugaaagaaacccaaguacagcaugguggucucucugaaaagaggagauggcuauuagagauuagaaagcagaagugguugugguuuuucuaacaauguguguuauaugguuucacucugugucccuacccaaauaucaucuuguagcucccauaauucccauauguugugggagggacuggugggaaaugauugaaucaugggggauggggcgggggggaagguggucuuucccaugcuauuaucgugguagugaaugggucucacaugaucuuaugguuuuaacaaacaggaguuucucugcauaagcucucucuuugccugccgcuauccauguaagaugugacuugcucacaguaaauugguaccaguagaaugggguguugcuggaaagauaccugaaaauguggaagugacuuuggaacuggguaacaggcagagguugcaacaguuuggagggcucagaagaagacaggaaaauguuggaaaguuuggaacuuccaagagacuuguugaaaggcuuugacaaaaaugcugauagugauaugaacgauaagguccagccugagguggucucagauagagaugaggaacuuuuugggaaguugagcaaagcugacucucauuauguuuuagcaaagagacuggcagcauuuugccccugcccuagagauucguggaauguugaacuugaagaaaugauguagaguaauugacagaauaaauuucuaagcaccaaagcauucaagggggguuuaggugcuguuaaaggcauucaguuucaaaagagaaacagagcauaaaaguauggaaaauuugcagcuugacaaugcaagugaaaagaaaauuacauucucugaggaaaaauucaagccagcugcagaaauuugcauaaguaacaaggaucugaauguuaaucaccaggaaaauggggaaaauaucucuagggcaugugagacauuugugccagcucuucccaucacaggccuggaggcuuaggaggaaaaagugguuuccuggacccggcccaggguccucaugcugugugcagucuagggacuucgugcccugugucccagccacuccagccaugauugaaaggggucaacguagagcuagggccagagcuucagagggugcaagccucgagccuuggcaacuuccacaugguauugagccugagaguauaccgaagucaagaauugagguuugggaaccuacaucuagauuucagaagauguauggaaaugccuggaugcgcagauaaaaguuugcugcauggguggggcucucauggagaaccucugcuagagcagugcagaagggaaauguagagucagacccccgacacagauucccuacuggggcacugccuaguggagcugugagaagaaagccaccauacuccaggccacagaaugguagauccauugacagcuugcaccaugcacuugcacauuucaaaacugaucaugccuucccaauagucccccaaauucuuaacucauuucagcauuaacucagaaguccacaguccaaugucucaucugagacaaggcaagucccuucugccuaggagcuuguaaaaucaaaagcaaguuaguuacuuccuagauacaauggggguacaggcauuggguaaauacagcuguuccaaaugggagaaacuggccaaaacaaagggucuacaggccccauggaaguccaaaauccagcagggcagucaaauccuaaagcuccaaaaugaucuccuuugacuccaugucucauauccaggucacgcugaugcaagaggugggcucccauggucuugggcagcucugcccuugugacuuugcaggguacagccucccuccugguuguaacacuuauuuacagccaacuguucuuugacaaaaucaacaaaaacacacaguggugaaugggcacucuauucaauaaaugguguugagaaauuggauaaucauaugcagaagaauaaaacuggaauaaugucucuugccuuauacaaaaaugaacucaaaauagauuaaugacuuaaauguaaaaccugaaacuauaauaauucuagaggaaaaucugggaaaaacccuccuacauauugaccuaggcaaagaauuuaugacuaaauccucaaaagcaaaugcaagagaaacaaaaauagccaaaugagaguuaaauugaaguugauccacaaguaacuuaaauuaaaaauguucugcacagccaaagaaguaucagagugaacagauaaccuaaggaaugagaaaaauauuugcaaacuguguauuggacaaaagacuaauaucuaaaauguacauguaacucaaacaauucaacaagaaaauaacaaaccauuuaaaaaauggacaaaggacaugaaaagguauuuuucaaaagaaacauauacacaaccaacaagcauaugaaaaaaugcugaaaaucacuaaucaucagacaaaugcaaauuaaaaccacaaugagauaccauauuauaccagucagaauggcuacuauuaaaaagucaaaaaauaacagauguugaagauuaggagaaaaaagaaugcuuauaaauuguugcuggaaauguaaauuaguauaaccuguauggaaaacaguauggagauuucccaaagaccuaaaaaauagaacuaccauuuguuccagcaaucccacuacuggcugucuacccaaaagcaaauacaucauuauaucagaaagauaacuguacuuguauguuuagcacagcacuauuuacaguagcaaagauauaaaaucaacguaagugucuauuaacagaugauuggguaaauaaaaugugauauuuauauauacacauauacuccauggaguacuacucagccauuaaaaauaaaaucaugucuuuuauagcagcauggauggaacuggaggcuauuaucuuaagugaaauaacucagaaacagaaauucaaauaccacauguucuaauuuauaagugggggguaaauagugcauacaugugggcauaguagaauaauagacaauggacacucaggaagaugggaggaugaaagggaacuggggaaugagaaacuaucuaauggguacaauggacacuauuuggguuaugguuacacuaaaauccacuucaccacuaugcaauauaaccacauaacaaaaucguacuucuagccccuaaaucuaugaaaauaaaaaagaaauaaauuuuuaaaaagaaaaaacaaagaacugaaagagaaaaaaagugccaaucaguaaucuacuucuuaaaauaagggcuuuucaaaucagcauuaucuggggaaauuuauuccugguagagcagcaguacaauuaguauuaaaggauuuagaauuaaagcacacaggaaggaaggagaaaaauaugagauuauuguuguaaaguucugagguuucuacaggugacaaugacauacauuacuuggcacuagacuguaauggauuaguacauuauaauccuuaaagcaaccauuaaaaaaaugaaacaagcagaaauaacaaauaggcccauaaugaagaugaaauuauuauuaaaauauucaauuacaguaauucuaaagaagacaugaacagagggaaacagaaacaaagaagaaaugagaaacagaaaucaaauugcuagugauauuuauacucaacuuuaaugauaauuagauuaaauuaaaauuuaaugguccagucacgccaguuaaaagguagauauuaucacucuguaugcaaaaauaaaucaagaacuaacuacauguugucuauaggaaaggcccuuuaaaaauaaggacagagagauuaaaagugaaaggauagaaaaagauauaauauguaagcacuaaucauaagaaugauuaguaaaaguagacuacaggauaaaaaauacuaccugguggaaagaaagauauuuauaauggggguccauuaauaaaaaagacacaacaauccuuaauuccuaugugcaugguccuaauuacaaaacuccaaaauuuuuaaagaaaaaguuggcagaagugagaguauacaauuauucaguucaguuuacauacuucaagacaccuuuuuucaguaacugacagaaaaaguaaacaacaaucacuaaggauauaaaagauuugaacaacacucucuaccaacuucacacaauugguauuuaucuaacacucuccuugcacacccagaagaaaauaucauuauuuacaucuggcacacuuuugaauggauuuagaagcaaaaauaaauaagucaguuugagguauaaauaucauaugccaaugugugucaaccaaaugcaaauuuugggauauuuuugcuugucagucuuacaucuuaauauucauaaugaaauauuaaaacaaauucauauaaauugaaauucaaaagaguacuagaauggaaauuagucuaacauucucucauugcuccuuaaaaagcauugauaaaugcuucguccugucuaaaucuaagaaaacuugauaauuugcuguaaaucuuuucuaacuauuaaucgcuuucauacugcuauugccauacaaauuaucguguccaagguuauuauuauuaguccucaaagacaauuauugguaauauaaauacacuuaaaauucuagugugcuaaaccacauugaguuaauuggcauguauauuaccugaauuaauccuauuuacaauguaacaguaaacaaacaaaauagauguucuuuuaaaaauuguauuaaucaagcauuuauauauucccaucuuaugacuauugucaauagguaaaucaggaaugaaaauugcuuaguguucuagucuuauguacucauuauauguauacauuucuuucuucuuaucaauuaaaucauauuaguuuuauaucuaaauauuuuaaugucagguuauaugacagucuacaaucuaguugaaaacauuaauaugaaguugguuaguugcagugaaaacaaaguaaaccaaaaaacuuaccucaauagauacagcuauacauauacacacacacacacaccucuuuuuuuaaaaggcuauugaauaaaacauaguacaauuagaaaagaaguuuggguccguuaguuucacuuucauagacauuuuacucuccauagaagaauuaacuauuucaagaaaaaaaggaugaugcaguugcugaaagaggcuuauaacccaauucauauuauuucucucauucuuucuucccuucucucucucgcucccuuucuaucucucuggucauauaacgaaugcuaaccugcuuugaccaaagauuuucucugcaaaacaaauaauuccacaacaaaauaaauaccacucaacuuuccuaaugucuaugcgagcaaauuaaaacuucauagauuuauuuugucaauuuaaauuucauuaccuaucauuuaaauuagaacuuagaauucauacuuggaauaugguaggacaaagacaacuaacauuccaguuuuagagggaaaugauuccguuaaucaaauguuaaaccaaacaacgugucccagaugccuuuuguuucauuucuucucuacauugguaauaauaaugaaacuugcaauuggauugagacaacgaagcaggggaaagaauaaggaaaggaaauaauucugguuaauuucacuuuuauucccaguuaucuaacaaauuauuuuuauauguaauguaggcugcuugaauuacuuucauauuucacauuuuuaaaauaauuguuuuaaguauagauauccugaacaguaaacauagucacuaugaauucucagcuuuguaaguguguuagaaaguuuuaucauaguuucuaaaacauuacucuauugaaaugaaguggcuucaugguuacaauaaauagaaaagauuaauuuuuagagaaaagaaaaagaaauucaauuuuuauuaagacauucuguauaagaauaauuuuaaugguaauaaauaugucacucuuguuuguuaaauucaaauucauaguauuacuuuauaaauugugacaauugauaugcauauauucuuuugauuacagauaaugcaaacaggauuauaaagacaacauugcaacaaggugaacauuuauuugucuguaaauuugaagcauuuauguaaggcauuuagauauucaauuuuuuguuuguuugcuuguuuguuuuuucuggucccugauucaguauagauauucaauucuuaaguuucucugagauugauuuaaaaaaauccauaaaagagauugaucauaaacccauaugacagauugaucaugucauuuuugaaaugauuuguugcaugauucaauggacauaaucaaaaauuaggaaaauauauacauuauauuugucagaggaggcuccaaacaccguauuuacucuaauucuaauguaguaugauauuuaguuuuaguucaaucauaguccagagccacacaugcuauuuuaacaccuuccagauagagauuuagauauuuugagucuuaacuuuauuucucugaucucuaaucacuuguuaaucuaaucaacauuguguggcuuuagcaaguuucaccaaauauucccuugaauggauguaugucucugaguugucagcaguuauacaugcaaaaguaaguagagauauuuaaaaauaaauaucuagcauguauguguauguuuaauuguguaauuuaaaucauaucauuuauuguuuuuagcuaaaaauaauuacuuuuucacaaauauaucagcacaagaaaaaauguuaucaauggaucagggaaaccaacguccuuuuaauaaaggccuggaaacugauuugguccaauugucaguuauggcauuuacauuucaaugagaaaauauugaacaaagagauuaaauuguuuaacucaggacaugaaagaccgcaacaugaaagaccacaaaauucaaagugcauuuuaauuuuauuuauuuugauuuauuuaugugggaaagaguugaaaauuucugugacacauugauaaucuuuaggcucaauucacugaccagaauuggaaucaaaauguauaaaauaaagauaauagcaaaguuuguacaagaaacauaacuaaauguacuuacaauuuuaaaaaauagauuccuauaaauauuaaaauaaucuugaccaaaauguuuaguacuuuaauuaaaugaaggccuuaucuguaauaucaaaauggcauauuuauaauaaagaaguuuuugucuacaaaggagaauaaauauuuuugugaaagaaaauaccaaccuuuaaauauuaggaccuuuuaccaaaaacauaaaauuagagaaaaauuaaauacagguacuauuuuuagguaaaauuaugcuauaaaguguauauuuauaauucagaauucaaucauucuuaucucauauuauauaugaaaguuagagaauaaagcuguguucacaugaauguuaaaaaugcuuacauguuaacaccuauuuguaacaaagacuugaucaauuucgagugaacuuuguauuaugcuuccuagcauuggaccauuauaaagagauuugagauuuaauacaaucccuuagaaagaaaguuugguccaagacaauucccaaguauucaggcccaaacaaaaguugacagugauaaugcuuuagcuuauccagucugcauucuguguuacucaagugcaacugagcaccaacuuagagcaaggguuauguaugcaaauucaauaagaagguuaauuuauuuaccugaagaaaaugggaaauuaauuuuuugauuugcaacuguaguuuaaacugcaggccaaaaaaagaauuauuuuacauguguccauuuucaacuuugucuucacauaaguucauguuucccaauguaguuucauaugaaaaauaacaacuuucaguuguacaguuuauuguuuguugugguuuuguuuguuuauuuuuaauuuuuguggguacauauuagguguauauauuuauguacauguauaauuucuuaauuauacuuaucagcauaauuuuuuauaccuuuauguuuuuuauaugcaauauuuuuccuccauccacuuuuggcaaacauaaaguucuuguauccucuguucagaucauuuaaaauuucauaaaaaguacacauuaagacuaaaacaaaucauaugauaguaauucaauguauuuuuaccuuauaaaauguuauaacauuuuaaagaauuguuuuauuccuuucccccacauauuauuacaauuaacuaaaaaucauaaaaacauucauuugaaagaucaagaggcaauacagaagaaacaaaguuaacuuucaaauuaauacauugaaaaguuacagaaaauagacuuuuaaaacuauauuauaguaggaaguuuuacuuaauaaaauaacuuuucaauaaggaguuuguucuuuugcagaucugcaacuguugcagaaaucauuaacauuauuaaauacauguucuuuuuuauuguaaaauacuuguggguauugcuucccugacauagaagaacaaguugcuuuaagaugaaaaaagguuaccacaguucaguuuugccaauaugguaauauacuugcaggaaaaaaauugagaaauuggaauuuuguucuaaaaauucaagcccaauacgccugugagcauaauaauuuugaaaauuagcucacuucuuuucacagugcaugcauguagacagagcuggugauguagaucacaguggcacaacuuuuaugacagcuguguuuagccugcuuuggagcacuaucaaagaagaaguauuagucuuuugcaaaagccucuccaauccuugaacauguauuuccuuucugccucugcauuauugaagucauuccaaugacaagaagaaggaaaaaauaaaaaugacacagcaguaaaggauguccuaccuaguacagauauuaauucccgcauaagaauucaggaacuucuaaggcuagccaugaaaacuuccuaccccucaaauauucuuuuucaacuuuuaaaaauuuaaaccauucuuaauggagcaacgcacuacaaugcuuuuccugagaagccacccucaauagcuugaaauguucauagaccuucccuaaauguuaauacacaugaacauauuaaaaauaauuaaaccacauuuuugccauaauguuuuguaauuucaaagcaagagugguacaugguaaaauaaucuuuuauuccuuaaauuuguaaaaaaaugacaguuaauucccuauuaauuuacuaugagaaauuuagaauuugaaaugccaaucccaaaauaugguagauaauuuuaauaguguauauuuauggauaaaguuagauuuuuacuuuuuaauuuuuaugcuuacuccuucaauaacuuagccagguauuuauaaauuuuauuaaaaucaguaauuuauuuacacaaaagaauauugcuuucugacauuuuuauaauuucuagaaaagccagauuucugcuuuuuggaagaagauccuggaauaugucgagguuauauuaccagguauuuuuauaacaaucagacaaaacagugugaacguuucaaguaugguggaugccugggcaauaugaacaauuuugagacacuggaagaaugcaagaacauuugugaagauggucguaaguuuauuucuuauuucauuuuaguucauuuauaggcauccuuuuaaaacuaaggcaucucagauggcauucuauacucagguuuuguuugagccaugcaaaugaagauauauuugugugcauucaaugugagauuugugacuguaguuuuuuaaaaagcacagaaaauuaagaaauuauuuucauagaucuaauacuuuuuauguugcauuauuuaauucuucuuccugagaauacugcaguacaauuuuggcacaauagaauugcugaaaucuuucacauuuauacaaauaugagagcaaacaguuacugaaaaccaccaccuaaagucacucaguuuuaucugccuauaacauuuauuaaagggaugacuuaaacauuaacugcuacgcuuuuuugaccaagaacuacaguuacucauggaaauauuaccuuacaauuauauuuaaagauucacuguuugcuaauuuaacauagcaaugugaaugaaauugccagaagucugcuuuuuuaacuguuguacgcuucaugaguccaaauaugagauugugacaauguuuaucuauuuuaauuggcuguauuuuuuuccagcgaaugguuuccagguggauaauuauggaacccagcucaaugcugugaauaacucccugacuccgcaaucaaccaagguucccagccuuuuugguaagaaucuuguggauuuuauugcuuccaggaaacuauuaucaugcuaacaaugaaguggauuguguauuagaaguaugucuuuaaauauauauauauaccugcguuguugcuuaauaauguguuuguugaaauacugagauucaaauuguuuaagacauuuaaucucauaaaagcaacaauuuuccuaaucuauuuuaaaguaugcuuugaaguaagcuuuugauuauguaucacaugaaaaacuuucauaugauauuuaacucuaugccaaauuuauuuuguaaaauggugcuaggaauuaucagccucaguguaagaugguaaaucauuguacuggcacagcagugcaucaaacgcagucuaaagugcuuuuaaagucaguaugacacuaggcaaggucucugguguuacucacaggacagauuagaaauugauugaauaaccaugccuaaauguuaugucacucuggagggaauuuucuuuugaauucugcaggacucuuuuuuauguucuugucuguuaaccuauuuaucagauuuaaacgaauauacaggaaauauuuccacaaaaugcagagcugagaaaauagugaaaauacuggaaaacauaaucaggaaccacaaauaucugggcaguuagaaauaacauaaacagcuaaaaauuaccaguguaaaauuguuagauccuagcuaaauuauaaaaaucacauauucuuauucagauauugaagauuuuguuuagaaguaguccaugugaacaugucaaagguaaacuuggcauguuuauauauaaacuuagccugagugugaagaauucuguaacuauuaaaauugcaaucuuaggauuaaaauaauaauaaaaaaaaaagaaacaguguuugggccaggaauucucuaccuuggccauuuaucagaaucagauuggcuuugagcuacuccucuuuacaacaaacaaacaaacgaacaacuaagcaagcaagccaacagaacgcaaacaaaaucccugcccacguggauuugaagcauuaaaauguugacuccgacuuuucuagaaagagucugugaauguucagcugagucccacagugaucuaaucauuugugggucuugcuucagcacugaaugucacaccuuggaaaucacaaggaggauuugaaacaugauuaaagaggaaaugaaaaguguaaagagacaugagaucuacgagggagcauaauaugugcuuuuaauaacugaaacacuauuaugugaaaggagaauuaaguucucuacaugacuuacccuuuaguccugccuauuucacacccuccccagacccccauccccauccucccuuaucccccucaacccagccuaagcaugaggauuaaugugugagaacuaaaguauaaaugccuuucuauaauauguuucuuucuuaugugagaucuuaaaaaauugauggcugucucagguauuaauaaauucccuaaauuguaggcauucaauaagugugcaauuaacacuuaagaggucauuaaggggaugcaaacuuucagugggaguuggaaaauacgauauauucaaaaugacuucagguccuuacauucaauagguagagcagugaauugaaugccagaugaacuugagucuaauuuuuaaauacuacuucguucguaaaaauuaauacuuuugugauucugacuuaucugaaaaauuaaguacuaucguugcauuauuucuuuaugucuuuccagcuuuguauuuuucacucguauuuuguuuuauucaguuauuauauuuucaaaagcacguuaaaucuuacugcuguaaaagaaaauuuagaaugacuaaauuaacagguuuaaauauacaugugacacaguauaucaguaaguacaagaaauguaugaaaucaguuugcaacaugcuugaauacuuuuguuugaauuauuuuaccaauucaaguggagaucugcagucauuuaucauuaaagugaguagaguagguuagggaauaauuuugccuuaaguuuuuuugaaguauaaaauuuaaaauuuuugguaagcauacuaccaaguuagaaagggcaaaauaaaaauuagugugagaaaguaauauuaaugaguuuuaaauggccucugauaugucuucuuuaguuuauuguguagaugcacauugaaaauuguaacaaauaaauaaaugcuuguaaaaguaaauuauuaacuaagcaguaagaauugacaacaugaauuuaaaagaaaacaauauuaacaauaauuuauucagaauaauagacauuuaaggaauaauguuaucguaacugcauuuaaaauuagggcaaaugucuccuuuauuugucuaaaaaacuguuuuauuuuugauuguauauauuggccucaaaaucaacauuccuccggccaauuugaccccuuuuccuuuuucuaagagcauuuccuucccuucccuuccccgccccuccccucccuucccucccuuucuuccuuccuaaucuaaaacaugaaacaauguugcaguaacuaggagacauuugauauuaaggauggcauaagguggauugucaaugaagcuauguugccauucuucuuaaaaccuacgugauuucgaaucugccccagccaagaugcggaagugggaaugcagaugucccuguacucuguucuaaaaccuagaugaccccuugucacuucugucugagggguuugcugagaucuacagacaccucuuaauuuccccaaucaaauauaauuacaucugucacugcuuacaauuauauuaauacauucuauuguaguuuaagaaaaugcaauucuuuguuuacauaaaacuuuguuuuucaaggguuuuaucaaacguguaaaguucucugugguaucagguuauuuugaaaagcuguaaauccuuuaaaguuucaauucaauguacaggaauaauaaucugccccacaacauaaauggaauaccagucuuuaaauucuuuccacuaaauaacaaucuuuaaguagaguauuugaauauucuaaaauucaauuauuauuaagugaaauauuuauaaauauaauuuuaauguuuuucuucaugauauuauggaagcauuuuagaaguuuaguuaaacauuaucauaauaugacuuuuuaaaaauugcuauuuauuuuuaauuacuggaauguuguaaauggcuuucaagauauauuuuuccaguaagcuuucuugauucgagauacuugaauacuuacuaagcacaauuccgguguaauuuuucuuuuuauuuccacauuucaauauuaacaaguuauuuagguaaucucaaagacagucuuacucuuccuuaaagagauuuuaaauaaugauuuguaagcauaucccugagcgugagugcauuauuucaguuugauuggcuguguugaguauauccauguaguuaaaauaaauguguguucucuccaccugaaauauuucuaaagcaauuucccuaaaugugugcaauuuugcgcauaaacgcuagaacugaaagccaucacaacugguucuucuugauuucccccaugauugaaauaaugauauagcagauaaaaaaccuuugagccugaagacaugcguuaaauucccaacucuucaacuaauagcugugugacccuaagauauuucuuaaccugaguuucaucuuuccaauguaaaaugaggaugguaauauuauaguacuaaguugauagguuguguugugagguuaaaucagucaaaauacauaacuuucuuaggacagugccugauaucuagucaguucguguaggguuacucauuauuauuauccaugugauucagaguaauacacuuaauucaccaggccuuagauucucauuuguuaaacaacuucuuuguaaguucccauuugcagaagaaauuuauauuucagacacucauaaagucucugguuauucagauaaaugcaucaguaaauauacagucucaaaaucaugacuaauauuuuaagaagaauucauacuagaauuaaauuaaugcauauauggaaacucgaagaguuugaauguguucauuagaaacaaguugagauuauugucacagaggaguaucauggggcuucaaggucaaaagauguuuauuuguauaauuguucuuuaucuuuucgacauuuccaacuuuccgaacuuuuugaguucuucuacuguuuuucugguuauuccaauuugaaugauuaguaauuuucuuuguaucacuuauauucuuccagucauucauuaaauuucauugcuuuuuaugaaauguuuauuucucucucuuccauuuucauuccuauuuauuucauucagaucaucaauccuucaugguuagauucccuaaacaaucaugucauccaauuuggaacacuaaugauaguuaaagagggugcuaaaaaauuaagguauaugucuauuuuaaauauauguaugcauugacuuaaaaauggaauugucguuuuggugacucuacaaaaauaguuuuauauuuaaaaguauuucaguauuuuuaaaucauauauauauauauauauauauauauauauauauauauauauaugaacgugauauccccccaaaauaagcauaaacuaauaggggcuuaggcaaaccaggcuguauagacaugagacaaauagauaaauaaauagauaucagaaagcucagauaugacucagauauuguauauaacacauaauguaauuauauaucuaacauaaguaaacuaaagcauauuagagagagagagacaaaaaggaacagucauauguaacaaauuauacaugaccuuuuugacaucacuguccuauuucuagucaucgaucaugugguaauuuagcuucauccacuugccuaaaauuugucugcauuguccacuaguccucuaucuauugcagauauuuucugucccuuaaauauaacuuuuuuccguccauucaaauuggccuuuucauuaucauuaaacacaaauuacucacucuuauucuaaaggauguuuuauguuauuuuccccaccuaaaauugacugacccuccuaaucuucuuaaccaaucugccuuuucacuaccauaaggaggccuucuuucugucucucuccccuggcuucuuacuaugauuccuucaauacuuguacuauuagauauuguguuugcucugccucacugucuagauuacaagauuuuuuugaagaaaaacauaauguacuauacaguuuauagacuucccccacccucagcauugaccacaguguuaaacauauaaagaugacucacauuuuuuauuuaucaauuuugugauccacaguuacaaaagaaggaacaaaugaugguuggaagaaugcggcucauauuuaccaagucuuucugaacgccuucugcauucaugcauccauguucuuucuaggauuggauagcauuucaugccuauguuaauauuugugcuuuuggcauuuccuuaauauuuauauguauacgugaugccuuugauagcauacugcuaauaaaguuuuaauauuuacaugcauaguaaacauagucuucucacugcaccucacuuguaaaugucuaacuagcaaagaaaaaugaauauucucaggaguucgugcuaguugugagucuuuugaccggaccuaacuauucauggaaaaaaagucauuuuuuuccugauuuuuauacaucccuuugcuuccauacaucaacuauuuguuuuuguuuuguucuguuuuguuuuuuguuguugcuguuuuugagauggaguuucacucuuauugcccaggcuggagugcaauggcgcgaucucggcucacugcaaucuccgccucccagguucaagggauucuccugccucagccucccgaguagcugggauuacaggcaugugccaccacgccccgcuaauauuuguauuuucaguagagacaggguuucaucauguuggccaggcuagucucgaacuccugacccaaagugcugggauuacaggcaugagcuacucugccuggccccauacaucaacucuugagaggggccuuggaacuacaucagcuuuaugauauucuggggggaagaaaauucagguagacuuaaaaagcuacugccaacccaauucuaguauuuggccacugacugagaaagggaacuccuauauaccugacccaguuccacauugccuccugccagccuccagguccagggaaaguaauuggaugacauccugaagauccuuuugcuacuugaaacucuaucccucuccugaauguauucaauguaugaccuccagacauacauuccauuuauguggaaaaaauagaaaauaaaaucuaugcauacauaaauacauuuuuaaaagauuuuuguuaucacuagccuucugaaacagguguuauguucacaaagggccuaauggacagccaaacacaaucacugauauaaucaauuuauaaaucugcaugagauuguuauuaucuccuuguuauuaucucgccucuuguugaacgugugauugcauguagaggaauacugaaaccaugagaacuuucuggagagaaacucucccucaccggcuaaagaguuccacauccagcugcauaccacaggccaucacaagcacuguuuacaguucuuaaaaaacgaacaaacaaacaaaaaaaacccacuucauccacaguccacuuucauaguucuaaagaaguaucuugacuuucauaauguguucuaagaccaagaagcacaggaacaucccucauaaucuaaagaugccugcauaguaaaucuggagccucauauucugauuuucugacaaguuggcuuuccaaaaauagauaacaaguuuuggacagcacccagcaaguuuucuacuuccugacaggaaugcugaugagaaacaaaaauguggcacuucaucucugccaaaaucacugccaucaaaaugcagucacccuagaugaccacugucuacuuuucuaaucccuuucuuccuggaccaucuuuagucuuaacacaagauaauuuguugccccagucauaaaaguccuccagagaaguguuucucaagcuugaauaauauauagauaucuuuaaaaggaaaaaaaaucacagacuuccaauuuguaagccaaauuacuuaaaauaacuuucauuuuguaugaaccaguaacauaguaggaauaaauucauuaugaucauuauacaacuauaaaccaaaaauuguuuacaaguuaauacuaugcaagcuacaaacuaauaaauaauacuaauuugauaagacuucuuuugcuuaaaaaaaagaaaaauccuuauuguaauaugaauuuaauagugacugguguagggcagcuuaguaaugugguagaaauagcuuagacaaacuugagcuacucuaaguuguguguaauucucuaccuuuuuucuauuugaguaauggaaaaucuuugcagaaaugaaauuaagaaguauuaauacaaaaugguggcugggugcaguggcucacuccuguaauaccagcgcuuuggaaggcuggggugggaagauagcuugagcccaggaguucaagaccagccugggugacaugcagagacccucucucuacaaaagauaaaauaauuagcucaguaugguggccugugaucguagacccacuuauucuggaggcugaggugggaggauugcuugagccagggagguugaggcugcagugagcuguaauugugccacugcacuccagccuggaugacagcaagacucucucauaaauaaauaaauaaaaucuguugaucaggaaaauuccaacucugccucuucuagggacacaguggagugggguuuccaguuuuugauuauaucuaaucaaaagugggguuuccaguuuugauuauaucuaauaccacuacauggaucugauugaccagugcauuacauggaucugagugaccagugcagauaugaucacauggaugcaagacuggaacuuuggugugguuguuucuagaaucagucccuguugaccaugccaacucaauacuuguuacuuucaaauguucaagcucucuaaauacuguuugaaucagcacuguugcaccaagauuuguuucuagccuccuuguaugaugacauauuuugauuagaacucuuucuccuguucaaacuuaggaaacuucaacuucauguuuguaacuguggacuaugguacauuuagcauguucugaaccugagcuucagaaaagagggaauuuggacaucaguucuaaaggagaaguugugacaauuuuauuuuuaucugauaaaauuauuaaaauaguuuugcucagguauuauuuucuuaauuuucuaguuaguuuucagaaugacauaucuuagugguugagagcauugacguuauagaaagaaagaugugguuuuuaauuccaguucugcuauuugcugacucagucuguggccuugaaaaaaagaucacaaaauuucgcuuggcuucagguuccucauuuguucuauguggcaagaaguaucucaaaacuuuuggaaaacuguaaugagacauaaaauucuuaacccaguuguugagcacacaauuaaagcacaaaguauuaauuuuugagguuguuuucaaugaugaugaugacgaccuauuuucauccgagguuuauagucaaaaaaugaguacuauuuguauacauuuuguuauugaucauuuuuaaugaagcuaaagucuguaaccuugaucugacauaucuucauuuaacaaauuuuauucuaaguuucuuugaaauaacauauauagcacuugaaaauucaaacauaauuauacauauuuuuugucuuuggaucuuauaacuaauugaaggacauauacaccuauauuuucaacuuuaucuuaugaccuaagguacagaucuguguacuuccuaauuucaguucauuucagcaaacauugagugucuccuacacgggacuaccauagguacugggaguaugagaauaauaaaaguguaaguuuguccuuuauagguguuuuugucaaauagggaagaagauaaauaaauaggugacuucaaugccuguguuacgugcuaagacagagaccugcacaaggguuacgggagaacagagucacaauaacauuuuacauucauuaaacaaugucauaauuaaaauauucuaucuucucaaaacuugagcucuaucuucaucuuccacuucaaacucguuugccuggaugcuggcuaacccauggacauagucuacaauuuccucuuuauauucagauauuuuucuaaguaaagccacaaugaauaaaagccaccaaaauuuacaaaaauuacaacuauuauaaguagaauuuauucuauaauguuucauaacauguuagacaaguauuacaucuucugaauguagaaacacuagaauuauuucaucucuagcucucuaccugcccaaauucaaucuggugcuuaauuuuagcuacucccaugguaacugcuucgguugugguaauuuuauauucuucucuauuagaaguuacuggauucaaccuaagcaugccugguugaguuugcuucauguauucaacaagaucagaacuuguauuuucauuauucaauaauuucaguggcucuuuaaugucugcauuauaaaaaucuaaauauaauaguauucaagaaucuucuuaauuugaccuaaauguaauuuuccagccuuguaucccacuauacucuuuuuuguguuauguucuccagauagccuggaguuugcgaaguacccccaagcaaaccagaaacauucugaccuuuguguuuucacuuuccuucacccauaugcuucucuguauucucugcuuacuaaaaucccauucuuccuaaaaagcugaucaacagacuaaauguuaauuuuuuacuuuuacuaaaauuuuguagggcuuaaaauuuuacauauaugucaugaagaaaguuuuucuaaugcauuauaagauauaauuaucuuagaauaaaguauacucaauagcuguauaaucuauaauuuuaccauggcuuucuuucuuuguggccuugcuuagacaaaucccugaagaaacaugacuuuauggacucuguccauggauuacgcaguaucuaggcaaugaaauccaacccagagaacaucuacccaauuuauuuccuucccucuuaauauguggagggaguuucugucugggcagguuuucacucagucuauucuuuaugaccuuucaauuuuaaguucacuggcaacccuccuucuauacuuuauccucagguaaguggcccaguauacacaugcggggggaaaaaaaaaagcuccacagugcuuguuuuuccauucccuuccccguuuuuuuuuucuuuauagaauaucacuuuccaccaauuuaauaccacuucuccugauuaaugaauagagauacauacucuuucuuuuuuacagagagagggacaaguuuaccacacauuccuacucagaaacagauuccaaucucuaaucucuaggcuuuuaucuauuaccucaggacacuggacucacucuaacauauuauuucuaucauauaucuugagcauuaugauugcaaagaauuugaauaaaaaagaaaauaaaagaagaaaaacuggccauauccacauuaugcagaaacaaucacuguuggcauucuagcauaucucauuuacuauuuucuuguauuuuuuuucaacuuaccacaaaguaaauaaaguucaagacuggaaguagcugcuggaggagcccgaacaauauagaauaagcucagcauaaaaguaucuuuuuguaaaauuuaaccuagcaaaucucuaagcucccuaccuaauaaagcuaucucuauaguaaucauccucccaacugauugcauguccucuuaaauauuugcccaauggauacauauauaaauucuauucucauuuauaugugcuuguauauauauguauguauuguguguugguacaaaauauaaauuauuauauuuucuugauucuaacaugcagguuuuucuaccuuuuaacaugauucuaaugaugaugaaacuuauaacugauaguguauaacaguguaauuauguuuuucuuucuuuuuuuuucgagauggagucuuguucuguuacccaggcugaagugcaguggcucaaucucagcucacuugcaaccuccaccuccggaguucaagugauucuccugccucagccucccuaguagcugggaccacaugcgugugccaccacgcccagcuaauuuuuguauucuuaguagagacaggguuucaccuaguuggucaggcuggucucaaacucuggaccucaggugauccacucaccucggccucccaaagugcugggauuacaggugugagccaccacgccuggccgugucuuucuuuguuuaugaauaguacauaaaauaauagugcaucuucaaauuaaugacauuuggauuucauauaaaugauauuucauauaacauuuggcaagcuauaagcaguuucuugucccacauaguacucuucuacuuuuguuggcauggggaagaaaaaaguguugaauaggagauaaauucauagcaguaagguccaugguuugcuaaaugguuuaggcacuuuaaaugucguuguaggcauauaaauuugugaaaaguuucaguggaaaauucagcaacaucuaccaaguuauaaauugaauauagauuuugcauaauucuaauuuuagaaguauguccucuggaagcaccugaaccaguguacauggguguucaugagccacugucugguacugaaaaaaauaaauuauaauaauccauauguccauuugacuaaauauacuguagucaacucauaaaaugaaauacuguaccuacauuaaaaagagugaggccuauauaaaaauguggagacacagccacaaaauauuaucaaguauaguaauauagaauauuauauuaauacauuugaauaugcaaacaauuuggagauauguaaaccauugguagugguuaaagggcaagaaucaaauuauggauaaauuuuguuuuacauuuguuauacuuuuauauuauuucaaaguuuuacaaagauaauuugcaguaaauaauuuauauuucucuuuacuacaaaauuauagagaaaaaaacuuuaaaaaagauuuguuauucaauucccuaaaaagucuuagaagaauaaaauaaauguacuuaacaaguuguaagauauuucuuaaaaccuaguuuguuuaguaaaacaaaagccuaaguaggcaagccaaaugggaaucauaaaaaagauaccacaguaaagauucaaagugaauauaugauucaaaguuuacuguacaaaucucaaagcaaauuuacauuaacaacuuuaccuguaaaacugaguuuagagcaccaucuuacaguucagcagucacacuagaucaugauaguuccugauuuaaaaaaaaaaguguacccugaauucugaaaccuaucaaaaacccuguagacagaagguacacaacugguuauuaauggcagaaucaagacagaaugcauuugauuauuaaauucccuuuggaaaaacaacaaaagucagguuagugucuuuuuauucuaucuuaacuuucugucaauaauuauaaucucaacuaaaaaaauuacauuucgcaaaaccuuuauauuuucuuucauuguagauagcaaauucuggauuuugaauagaugagugcugaucuauauguagaauaaauuugcuauuuggaaacaaugaaguuuuucucuucaagaagugaaaaaaauucaaauggaacuaaaauguucuuaagaaaccauuugcuucauuacuuuaauuuuacugucauuuaugguauaguaacccaaugauagucuuacugcucagaguuaaaaugaucuuaagauaaaugaauuaguuuacguauuagguaaaauuuauguucugaagaauaaccgccuuauaaugauuccuuaacugacaauaauuuauugcaucuuuaaaaaccucuaaaaguuaauuacacauaauacaauauccuuagugauuaacuucacauuuuaaugcacuaucgaaauauugccauuucuaguguuaggaaccucacuguugaucugggucaaaacucuguuguguugaaugaucugcguaagcagugguugaaaucagggcaaaguaagauagauaaacaacugacauugcaucagucauggacaaguaggagcaaguaucugauuauaggugcaucugcauaccaaaucccaggcugucagaagcagcaugccagacacccucugauucagaagucauaaagagugucaguagaggcaaucugaugccuuggauaauuuagugaaguuuucucugcuggcaucuaugcuggucaacugucuguuugcucucaaaccaauccccugcucaugugguuuuauggggaacuuucuccucuggcuucugaaaggauuugguaaauggcaggccuuguuggaugacuggauagucaaaggaagacugaagcuagcauaugucucuccaccacaucugugguguaucuuccaugguuucagcuucaauggaaaggcccaaaugguucuaggauucaccugcuguucuuggucuaugauaacagaggcuccucuucucauacguccaaucuagggacuguagccccauauguacuagccuagcuuuuucccauuuugaaauaaccuugauuuuaugauugggccauguuuacuauagguuguaugugggaaaagagaagaaguuugcucccugucaucagaaaauuuucucuguucuggaauaagggggcuugaugucuggcauugcuauuuagacguaacaacuaacauuugcaaagaaggauacaacuuacaaccacauucacacauauuaucugcaacuuacugugggcagauauaucuuacauacaaaaugcuaaagugaaauugauguauaagucauauaucauuuuaucauacacaucuauuucgaaguuacuguggguguuuaaacaggaaaaaaagcgauaguaauuuccuguuuucucuguuucucaaauuagguuaauugcaucuagugcaucucuuuuguuucugaacauaggugauaacuggaagcucaugagaucaaagugguggcaauuaauaaucauuuuauauucuacacugugcaaggaugaugauaauacacaucccacacauuggaaaaguguguacaauaguacaaaucaauuacaauauaacucuccuagacugcuagaaaauuccucuaauauaaaugauucuuagugacaggaaaugucaacauuuucuagaaugucuagcacacauucucaccauucaacuuugauuuaugauggcauaucaucaugucaaaggauacaaaauacaggcauguaggauaaauaagccuagagaucuaauguacaacaugaagaugacaguuaguaaaacaguauuguguuagggauuucuguuauauaaguagauuuuagcuacccuugucacacacacaaaaauguaacugugagaagauggguauguuaaucugcuucacuacagcaacuauuuuacuaucuauauguaucccauaacaucauuuuguaaaccucacauauacacaauaaaaauuauuuuaaaaaucacgcacuauaauccccacauaggagaagguaaaacauaaagggcuacauaugauuuaaaacgauguuuucauuuuacaaauccuagaaggucuucuuaaaaucacugcauauauaccuagucaaagaccuaaguaaaacuaaauacucuuuauuugauuauaguucugauaucuuauugauauaguuuggcacaaaaauaucaccugucucaaauuucuucucauaaauuauucucacaguauucauucccucucauauuucccagaauauuuuuuauuaccugaguuacuauaucaagacacucuaguccuuauuuaaauaucuagaaggcaggaggugguaaaaaauguuuauaucaauuugagauuuuuuuucauuuuuuucucacuuuguuuuauuucuuuucuuuuacagucuguucaucugggguuuauuugccaaaagacugcuucuugcuuaaagcacaaucuauucaccuucauuaacuacuggauuccucaaaguucuauuuucugcuaauauuggacauuuagcaaaucuuccuccucuguauuugcuuguaucacaucucaccauuugacaaagccauuaaaguuuucuuguauugauuccuugccauacaacuuaccuguaguacugguuuauuaacaucaagcaguuuagcugugcuaccgaagaguacucggugccccucacugacaguaauucccagagagcuaaaaacuaacauucagcugaaacuaauuucucuuuugauuuggcaaaugagugcuccuuuuauuacccuaauuguauuuuucucuucuguuuuugaaaaccauugauugaucccauugacaaaccagcuuaucugucugauccaaaucaauuugcuuccuuugcaaaaacauuuaacucaucuagaacuaagcuucaaauaugagaaaaaaaaugcuaccaagacaaacaacucaucuggacucauuccuugaaacuuaaaacuugccauaccugaauuccuccacuuuaaacugugcuuguauuacaucagucagcaugugcuuagucaagagaaguaacucuuccucagcuucaguguuuuuguuacaucacaaauaaaaacuuugcucauuagaauuuuuuaaagccaaauauuugugaacaaaugauauguaaauuaauauauaugugugaugugugugugugugugugugugugugugugugucuguaagaaauuuucagcaguuacauuguugaagagugguuuuuauuauguacaaauaguuuguucauauaaagaguaaucauaacacuucucuuuagcaaaugagauuuuuuaauucauuggagaaagaucucaauauacuggacacaugguuuuguuaagcauuuuccuagaauugaaaugcacgaauuuuauuaaauaccccuuuauucagauuacuguuuuacauacacaugcaacaacauuaaucuauaaacaauauacaauacgaaaaccugaaauccacuaucacauauggcuuaccauguuuuccugauuguuuuuagaauuucacggucccucauggugucucacuccagcagacagaggauugugucgugccaaugagaacagauucuacuacaauucagucauugggaaaugccgcccauuuaaguacaguggaugugggggaaaugaaaacaauuuuacuuccaaacaagaaugucugagggcauguaaaaaagguauagaagauacucuucccauuaauugacuaguguuuaagauagcaauugaauugaaaugauaaucuauuaagauaugaaauuaauuaucuuuauuauaagaaaguauaaucuagcuaauaaauguccucuucaauuacauuuagauaauauugcuagauauguaacuguaauuucuuuuaauguccucauagaaaaagaaucaauuuaaaacaaauuaaacauguuauucuuuuaguguucaaauacuaagcauucacuuuaaaagacuauaccaaaauuguuuuaagcuuucuuguaaugcacaaaauuuuaacauauuuauuaaugucuucugaauauaaaaguaaugcauguuuauaaaagacuaagaagaguauaaaaaugcaaauaaaaacuaucuguaacuuaaucaaccacauacaaccacauuucuacuauuuaaaaauaaagcaagcauggauuuguaacagaagaggaacuaauaauaaaaaugaacggcaugcuuauccauuuuuauuaacucauauaugcaaaguaacguccuuaaaaauaaauuguucuacacgaauacauggacaaauuaaaggcuuuuaaaucaauaacaucuuuuggauuuaaauauuaaaaguuacuuugagaagauuuuagauaaaacauuucauuguguuauuuuaucacacauuaauuuauuccucuuccucuuauagguuucauccaaagaauaucaaaaggaggccuaauuaaaaccaaaagaaaaagaaagaagcagagagugaaaauagcauaugaagaaauuuuuguuaaaaauaugugaauuuguuauagcaauguaacauuaauucuacuaaauauuuuauaugaaauguuucacuaugauuuucuauuuuucuucuaa

SEQ ID NO: 13246 - RNA, 9320 nt, Homo sapiens
gcuucaccagcagcuuucaccuccccgccuggaagcuucucucuacugcguggggagcugugacuacaggcucccaccucucugguccuggaaggucaucugagaguguugccuugaggccuagagcucugcuuuaucuaaauuuaaaaggagauggaaacuuagagaagaguagaggguucuguagucuugggcagcaagcuccucucuagaagguaagcuagcggaaaugcaaauccagaugaacacagccucauacgagugaccuccagacuuuggggauugcuaauagccguuuucuuugaggacugagcaucaagcccgaaguaucccugcagcugcuuuaguggguccuguccucccaugccaaaaccuccaagaaaaagguggucucugugcugggggucaggggguuggugaagaaggcggcaaaaggaagaguggugaaaaaauagaaugaacacuaagaauggaauaaaagggaaaaaagcuguauugaagcaaagaaggggcagagggagcccgugagcugagugggccagggacugggagaaggagugaggaggcagggccggcaugccucugcugcuggccagagcucuuuucacauugugcuacugucugcaccugucacuagcagugcaauguuaaaagggcauuggccguguagugcuacccagcgcuggcugccuccucagcauugcaauuccucucccaucugggcaccagucagcuacccuggugggaaucuggguagccucacuuguuaguuauacuaauagcucucauuuauggaacuacuucuguaugcagugcuugugauagacacugccuccguuacugugaaaccuaauaacuucugggagguaacagccccauuuuauggaugaaaaacugagggucagaaagguuuaaacaguuuggcuaagauuguguagcucuuagguugcaaagccuagauacaacccuguguuaagucuugacagcucacucaucuuuuuguagacccaucuggagagaucugaauagguucuucaaacugggagauuuccugagcugagggguggaagguuuugaugccaucugcugguuguaugaggauaucuuccaaagccucaaaccuuuaaggaccagaagugguggcaacuccuuaggcuaagaaggauaagcauucccagacucagcccggaauggagagugaguggaaaaagauuaggagaaucacuauuagguacagaguaggccuccuugagaaaaaaaggaaugcaccagaaaggaaaggggguuaacucgagaggauugcuccccaaagaaaaggaccugugugcugcuggcaucccauaccuacagcuccuucccuggcucaugaggcauggaaagaccucacuccuucccugaauccacuuaccuuucucagcaccacucccucuuggucacgggguguuugaugguaaugcugcuugagggcacaccugucugggcauccaagauuuggacagcguugcccaugacuuaaucuuaaagauuaauaggaucccuugaaucaacccacagaaugauucucccaggaccaauuacaaggaaauugaggccgggugcgguggcucacgccuguaaucccaacacuuugggaggccgaggcgggcggaucaccugaggucagggguucaagaccagccuggccaacauggugaaaccucgucucuacuaaaaauacaaaaauuagccaggcgugguaaugcacgccuguagucucagcuacuuggguggcugaggcaggagacucuugaaugaaucuuggaggcagaaguugaagugagccgagauugcgccacugcacuccagccugggcaacagagcgagacuccaucucaaaaaaaaaaaaaaagaaagaaaaauuugagagcaaugacucagccauuuacuucucugucucccacagugccuaguaggcuuaauuaaaacuuguuaaaauaaauugaaugagaggaauauuuggggagcuucuuuaagaaggcagcuaguauuccuggucuuuuggcuaagaucaagugaagaaggcagcuaguuugugccugguuuucaacagcagaguuugggacuugagaaaucuucccuaaacuuuggugcaagaaauggguccaagaggaauaggguuuugagguccucugcuggacccugagagggaucuuggcaucaugaggcauguagaaacugaaagaugggucagacuccccugaggccuuaguugagggauguuggacaucucuccauggcuugccuuuuucccuugcccuuuuacuucugugccuuccaguucuaguccuccuuucuccugcccagacagccucuccauucugaucacaacaacaguauuugagauaguacaguuagcuuuauuucccuuuuuuuuuuuuuuuuaagacagaaucucacugucgcccaggcuggagugcaguggcgcgaucucggcccacugcaaccucugccuaccagguucaagugauucuccugccucaaccuccugaguagcugggauuacaggcgugcaccaccaugccuggcuaauuuuuguuguccaagcuggucugaaacucuuggccucaagugaucgcccaccucagccucccaaagugcugggauuacgggugugagccaccgcacccuaccauauguuccuuacuuucuccagucuauuaaaacuucuauuugagccucuugucugggcacaaauagccauuugauacugccacuccacucuaaaaaacaauaauuuucccauauuucccuaauaccauugggauuaaaucuagauucccuaaauaguuuauggcuccugcuucucuuuccuuucauguccucucacccacuuuuuaaggagacaaaguuuugcuccagcccaggcuggagugcaguggcgugaucauggcucacugcaaccucagccuccugggcucaagugauccuccugcucagccuccugaguagucgagacuacaggugcagguauggcuuuuuuuuuuuugagacaagaucuugcuauauugcccaggcuaaccucaaaguuuggccucaagcaagccuccagccuuggcuuccuaaagugcuggaauuaaggcgugagccacugcuuucagcccacaagcaacuuuuauuuccuucaauuaacuaaacuuaaguuacuugacacauacucugucugaaauacuuccaucacuuuugccuuugccuaccuaacuucuuaucuuucaaaugccaucguagucaucgcuuuugugaagccuuccuugacuccuuacaucuaagcugaguuccuuuccuaugagcucccaagcuuccuccacgucccugcuuagaucccuuauuaucaucuucuacugggauuuccugguuauugcaucuccuacuggacagaaagcuccaggaagucaggucacagcugccuuaucuucaccaugugcuuaacaucuagugcuuaacacaaugccuggcaaguaauagaugcuuuauaaauauuuggaauauuaaugaaugaaucuggaaagaauauuauagcuuaccaaaaaaugaucuuuaugauguauauggucuccccuguaacuguugggcacccaacaacaguagggauuucauaccacugccaauaaaaugucccuugggucauaugguggcauugauguugcgauuuugagcuuuuuuuuuuuuuuuuuuuuuuuuuuuuugagacggagucuugcccugucgccaggcuggagugcagcagcacgaucuuggcucacugcaaccucugccuccuggguucaagugauucuccugccucagccucccaaguagcugggauuacaggcacgugccaucaugccuggcuaauuuuugaauuuuuaguagagacgggguuuugccauguuggucaggcuggucucaaacuccugacaucaggugauccaccagccucggccucucaaagugcuggaacugcaggcgugagccaucgcgcccggccuaauuuuugagcuauuuuguuucacuucccaucaacugccagagcagcacuuuggcugacugauuuuccuuuuagccuuaagugugcccaugaacugaccagagcauuacagaaccaggcugaaaagccacgggacucaagaaaauccuuauucugagaugagccucuuucagagcccgauccuggaucuaggcaaaauggacuuacugucaggggugccagcagacacaagcgguuuuggaugcucucgccgaguagcuaacaaaacccaccccucuuacuaaggcaaaacuucaccugaacgcuuauuccccgguaaaagcucaagcaguagucuugccauagacagggcaacugcugcccccuagugguauaaagggacaggcccgggugggugggggugugugugugugacggggacaguuuauggguacaugcacagggaaagaaagucagaggacagguugccucaaguugcuuuuucccuuuuuauuaaaaauagacucaagcacuuuauguaucauacaaaaguuucauucgcugguggcagccacgggaaagacuggccccguagcacugauuuuccaccuccccuccaggggacugggucccaggagcagugacugggccucagagaaagcccauaaagacugcuuacucuggaagcagccgacuaggggcuguuccgcgagcagcuguccccaccccacccaauggcaaaaguuagauacucgaaagugccucuucagugccaagauaaacuaacaaguggagugaaauggaaaacccuuugauuauuuuacuauuucccagggccugggauuugaguuuucccugcacucaaguccuuuucccuacaaauagggguaggaaacuucauccucagagacucuggucuccuggugucugagaccagaauuucacuccaacccaagucuuuucucaucugcuguucugugguccaugaucuacuugcccugugacccaagguuuguccucuguucacucaaaaagagguggagcaaaaacggauuccucccacaauccucucugccugagucuaugcccugccaucgcuuccauguucaggaucuugggaacagaaagacccacaaccaucccuuucccccaguucugucucucccugacugcugcccacuccugagccuuaacaccccugggguacccccagaccccuguucuaaagggugccugguaguggauaugguggaggcaggggagggguugguuggagccagguuucccccagggguggggcaguacucaugcugguauagacugcuuggcagggccguggggagggaggggcaugcggaggaagggcacacccugccugagccccucagucccagccguuguccuucaccaugugugacauuucaaugauguauuucccuuccuuguacuucuggcucgucucaaaagcuugcuccuggugaaggagaaagcagugauuguaggacaaagcaguuuccuuccaggccccacugucaccuguauggcccccaccccaagggucauccaccuagcccaacccagugacuaguucuuucuuuccucuuuggaccaugcaaggaaggaccugacauggucacuggugcuugaagggccauggggacugccacuuuagagggugacccucuuccucagguacuuacauauuuccagcccagugugguuuugcagcucucacagaaaaugucagcuaccgaguggagccccgugagcaagaggcgcuguucagcuggcccgcaacccacguugacccugucucaggaaacaggaaggacccagcacccagugggguugcacugucaguccaguccccagacagcccaagggaacuuccaucuggagagaacuggacagccccugccuuugauaauccaccccuuuaagacuagagccugggccuucuuuuuccaccguuaugauuucaauucucccccggcuccccaugugagaacuucagauugagacccucuuugcaaaaggggaggcaaagacugaaggcacaagaucaccugauggauuccccccuuucuccacagaggaaaauuacucacucacacacaagcacaagcacacgcacaaggaaagagguagacucacacggaguuaaacagguaggcucggccauggcucccuuggaaggacuguggagacauaggacagacaaugacuaccaagcagccuucagccccacugccugaauccccgcagggguguguaggagagaggaagagcuuugcugccucaccccugggugauguucaggcuagccuggugcgcgagaggaggggaauggcagguccccgcuucgcguaccuuggaaauaagcucaucguguuuggccaggugugcacggcaguggacacagcuguaagugcggugacagcggggcagauagcugcggaaagucuugguggggaggcaggcagggcccggaccggggucacagcugggcaugacgggcuggaggacaaugcccuggugggcuggaggggcuggcgccgugcagcccccgcagagacggucgcaggugaagcagcggagcagguuggcuagagccguguuucagggcaggagaaguguuggggggcugcccggccagggcccccccagacgagaaccagauagaaauagaagucaccugggaagaggggaaaggacaucaggggagcugcgaccucaggaggaccccuccugagggaauggaggaaaagggaaucagcucacccauaccucuacuuuccccaucaccaucgacccccccacagcauccaguugcauugucgcccuguccccuggauccccauucugcucuggcaaaccuggcagccgauccaggcuucuggcgccaaagccagggagucgguguuucucccuccuggggcagaagcagccuccaccauuuuccacagagagaagcccacgggcacagacgcugccaugggagcaacgucaucugcaagugcccucuccuugguuuucaguucuucgugaggcucugcaucgcacaggcacugugucucaggggaucagagccuuuuaagaguuggggaugccugaaggucuuucuuuuacauggucuuuguuugcaauacaauugguccuuuauacauuuuggggaggggggcaggagguguaaggugaggggagggagagcaugcaggcagguauacaaacccugauucgguucucuccugaggucaggguccugugcucugggacucuucacuagaacuuuauagauguuuccaacaguaccaaagcccucacguguggccgcccauucucgcaccuugguucacucauucuggcccagaauaagcaccugccugucuucccagccugugggccccuuggucuuucucucuccuagucuuuacuaacuguugccuuagcccuugguuaaagacuuaggcagaaaauacauuuucuucaggcaaucugacagcuggagccaaugggaaauggguagcaugucagaggagccugauuccugggcugggcagggcugugugguagggugagagcaacggccacaacgaacagcagaagggggacucuuauuuuuaacagcugugcuuuggggcacaaggcagaaaauguuucuuucuaccuucucccaggggcagggacaaacagcagugacucugugggugacugaagaugaaguaauugcuggguucugauuaggaauagaggaagauugccuucugcccacgcgccagccuccgaguggcugaaggugcuggaggcagaggauaagaagggagguggccccuguuggcuccgauaagcaggugagcugcugcuuucuccuucauagggcuucccagcccacugugggugguuagccuaagucugguucagagaugccagcugggcacucuggcaaugcuagagcacuaagcagagaagaggcaguguuggcucugguuagccagggcauacaggcucuccucguccuguccuccgcaguggccacaggcacccagcuguuccacucucucugaaggccgccaggcagucucuccgcaaaaccuccauagagacuaucuucaguuucagguccucuccuccgggcugggucccaggaagacaccuugggcugaguucagggugacauugggcuccggcugcaggaaacgggcccuccuugccaagagaccaccuuucagucucugcuucacagguuugccuucaacuuugccagcgaguuccccucugacaugcaccaccuugaaacaccuucuucaaggggcauggagaauggggcagcuuggguccccaauccugagcuccuucuccagccuccggccgucacgccucccucccucuccccuaauucccagucaagccaaggaaaggcugcacagaaggccagagaaucacaaaggggaguaggggucauuuuuucacccaucucggaucacagggagaagcaaguugggcaaaugacuggagaaaaaacaaaggcaagccgagugcuggggagagauguuccccugaagugagacggggcuggaccguaggagaaaggggagagggagggcuggcgggggcaacugacagcugacagcagaggcgccgaggcggaggcuggaggaaccaggugcgaaucucgugcuucucaggggggaaaagaaaaggggggggacaccugcucacaauggauuuucucaucugcucugagguuuuggcaccccccaggcugguauucucaguaugguaugguccaaauaauuagcagcaccgccagcucccagggcaggcuuugggggucugcaccagcagcaaaacaauaaacagugaugccugaugcugcagccaaaguugccgggaaauaagugcgggaaucgucagagcuuggagagggauggaggaaccgagagagaggagcggaggcagcggggagggggaagggaggacaaaggguggaugaauaaugcuuuugcaaaggggagaaagcaacacgcagcaggaggaggaaauuugcaaagagaaaaaaauucauuuggagaagggcugcccccucaccuugaggucugcuccagagaucuccgucuaucucucucucucucucucaaucucucaaucucucugcucacucuucucucuucucuuuccgcuccuucaauugggaaggggauggggguggguggggggaggguaguugggggcucaagacuggggcugcaaagcuggccagcugcugggggggcagagguugucucucguucuguaccucggucugugggugaauguggcuguguguuguggaacugca

SEQ ID NO: 13247 - RNA, 26063 nt, Homo sapiens
acaugguuuccaaagucaguucccuuuauuaaaucauuuucacagaccagaaauacaaaaugaaaguagaaauaggccccagguaggagcuacaggccuggccucacaugaccccugcuccagcaacuugaacaggacaagcagcagcuacauccuuaaggucgggaaaguaagaugaggauuuggauccugcauugcccugccucccacccuaucucuccccaaauuauaaacagccauccuugggaagcagcagaguuaagacgucuccccacugcccuagugacauacacaccaacaggagagcauguucagauggcacagaauccagggacugcauuucaugaggagaaacugguaccaaaauauggguggggagucggggggugugagaaggcaagcgcaaagagaaccuuccuccguuucuacucaucggauccugacgcugaguccucugagcuggggggaguacuggcuaguucuucuucuucagaguccugaaaaccaaaggugucuuaagggaaaagcuggaguccugggugccccacccacucuucagugaagggcccgcaauucccuaccgcccccaacuacagcaccccccuucagaaccucagaauuccaccauccacuccaacucauuacucuuacagaccaaccccacacagacacacaugccccucacccugcccagcccacaggccccacauuccugccgcaccucgcuccuccuccucuucuuuuugcucuuguucucucccgaagagcucucaucacuagacacaaacucuuugcucuugaagcucucgcuuagcugccuugaggacgacuuggaugaugagccccuagagggcguggauuucuuuuccaucuuuaccuuuacuuucuucuucuucuuugacuugucccuguauuggcaagagggaagaggagcugggccuucagguccccugucaccaugaccaaaccucucccagcuuuaacaaggccuuucccaaucccagccacacagcccauuucacucugaacguaaauagcugcgucagccuggagggcaccaagggagaguaucaugaguacaccagaagaaucagagggcacagccuaaagcagcccaaugugcaaaaccuacuugauauuucuugcuuuaucuuuuagaguucaugcaaacugugcacugcacuccauaauaguauuuuuuucguucccccauaccuucaaauaaaaugguccaggaaaagaggccauauuuccccagugacuugaaugcccuauugugucacccauacuugggcaauggccuacccagguuugagaagcacuacccuacugcagucagaagcaucucugcugucuuuaacuuuccaaugcucaacuucggccuguuaaaaaaaaaaaagucugccacaaaaaucagugacugggccauguucucgacacucaccucuuagaagacucgccucggcccccuucauauucuuucauggcuuuuucauagucccuccuggcauccucagccuugcgaucccacuccugucucacacacagaaaaaaacaguuaagaauaagaccucucccaucuccccucuccccugaugcaggcaaaaucgauacagaaagucccaccaauggcucauacugcuccccuaucagucaugagacucgccaccccaagacagcaccucucgccagcccaugagaggcaucaccccuccucugcugcuacucaccucuuucuucucuuuggacauucccuuccagaucucgccugccuucuuggaaagauccgugaugcugaugccaggauggucugacuugaucuucucucggcuggcauugagccacagcauguaugcagacaugggccucuugggggcauuggggucuuugcccuucuucaccuacauaagaacccaaaugccuucagcuauuucccacagaacccauacauuuucccaaauaaauuauuuagaucacuuaacuuggagaaaaaguggaggacuaaauagcaucaggcgagacgagagcucccuaagggcaaggauaguaucuccuuccccucugcaauucagugccuagcuuaccaggacagaagcccaucuccuaauucagaccuuccagaagcuuauuaaucucagggcuagugagaaaaauuuccaagaagauaacccucaaggcuauaaucacuggcuauaaaaaacagccccaaggaagaacagguccuacuggugguggacaggagaagguaaagagaaugccucccacgccccccacccacugcaccacacacaggcccucccaucuacagucugcaccuccacaggcuucuugcggcucuugcgguccuuggccaucuuggccuuuuugagcuguuuccgcuucuucucaucccggucacugucacccucauuacuggaggagcuggcagaggcguugcugucaaaccugccagagaacaagccaggcuuagacuugaggagggaagacaggaccccacggccucaggacaggaggaagacaaauccaaagauacccacccaaaaggggcaagggaggaagaccagaggacaguauccaccaccaauccccaacacugcuuucucccauucacugugguggcuucagccaugcccucuccagacccagccacagcaauugguuacuugauuggaauuaaugaaugaaaaacaaaucaaugagcuucagcggaucucccugggcauggccaaaccagguccuaguccauccccaggacaccacuggcagaaacacugccucauucaugccuggaacauggcccaaauccacuucaccacuucccucggaguaaucaccuuaaucuacccuauagucuuuuuugucuucuuuuuuuuuccaugucagauggguaaugugucaacaucguaacaaggcuggaggguggcacauuucacacacgcacguaacacccaaccauuauguuuaugaacuacaaaaggauuggccccuacagucuucugaugaaaagauaaucaguuacuacaaaaagaggaaaaccaacuucaguccaacccagugccuaccccuguaauugacagucuugucugauauaugugaaacuccucaaacaaugcaacuaccuuacaccuguaugcugcuggacagucuucaaggcacuuucacaaguauuugcucauuaaaccuucauaaaccuucauaagcauguggcaggcugaacuagaggacuccuguuggguguuuuuuuugcugcccgacauucuuuuacaauccuucuggauuaagagagcagagucccaauuuucuguugggaaccaccuugcccccacucaggaagggcuuaccccaaccacaggcucuaagggugggcacuuggccuauuucuggcccaucagaccccagcccauucuaauaacucaggcuagaaaggggcagguaaccacuguguucacuaugcuguucaccaaaagaggcacuucugguguuguuuuaaaccaguaggauuaagccugcccugagcuucugagagucacugggcaccccaugggguaaaccuauuuuuaauuaaggaaaucggaagaaauagauuugagcgccugaauccaguagugucugaagccaauuaaauccccagacuccgcaguaauaugaacuuaugaaauucccuuuuauauguucccuuuuaaagugagagugaaucacauuucugacacugcuaacaaaaagucuuaaccaauuuagcagggguacuacugcauuucuacugaugaggaaauugagauucaaugacuuacucgacaacccccagcaaguaaguggcaagcaccagcucauucccauucucuccucauccaacuacgaaccagccccaacuggcacauucagggcgguauggccauagaucccacuauacuuuuccgacuucaaaauaugucuugcacuuacaaagcccuugacaauuuccaaaacauuuucguauaucaccucauuggaggucacucucccauucugggucaguagcuaaugcugggaccugagaaauguccagaaaucuucuggucccuuaagcuuaugggucaccaucuuauccccacaagguaccaccaaaacucacuccucugccacaucuuccuccucuucaccuggguugaaugacucaucugaaaaagggcacaggaugcaucagcuucugccccaauggaaauccccccaccucacccaggcacccagcucuggcccaagggugaguccagcccgggccacagcgaggagcgucugaccauccucgugcucagcacggaggcuaacccaccgguuucuucuccugagucaucgcugcugucauuggcauucuccucccggaucuugccuuccuccuucauccucuccaaguaggcaucaugcugguccucaucagagucagcauauucaucguagcuuggguucaugcccuagccagggaagaguucacgguggggccaacucacccucgagccagaaucccugcacacucaaaagcacacccccaugccugucaagucagagcagcagcucccagaagaccuggggcuggauuguccacacacagccaacgugcagggccuaugcccaaguacuuccugccaacuggguuaguccaagccccaagccccucccucucccagccccacugggggcuccugaggggcugcauagacuggucuaaggucaugcagaggaaaccugcaccaggagggggaaagggucacacgcaccucuuuuuucuauaaggguaagaagagaagaaagagugaaaaagaagccggaaaaaaucuccaccccuuucuccccuauagaaagaccaggagagggucucauccuccccacacagaaguaccucuuucaauccucgguuuuugauguugagcuuuuucgcguugacaaaaucaaacaguuucccguacuccucccugugaggggacaugcaccauguuaccagagagguagugccaacacaggggcacacuaaacaauguucugauuccaugagcugggguagacuguggagccuggagcucuugacuaugcuacccaacccaacagcuuagaaacccccagaggacagcaguaaggcagagccagagccagacauuaguccugaaagaacugcauggcuuugaagaacucugggaaaggaaaggcagggaggggugcgcaucuguuuacaaaauaagcucagaggggaguaaguguggggcaggggacguggucaucuuuuuucauacuucacaagguugauaugaggauuacacgugaagaugcuuauaaaacguuuaguccacagugagcacucaauaagcauuagccgcuauguucucaggcacaaagcucauuccaggaaagaaagagauagcauuuccaucaugguggggaguggaggagaaaaaagaccaguagcgaagacauauagcuuucagaauacggaaaaaguuuuuuuuguuuuguuuuguuuuguuuuuuuaaugaccagaaagaaagcaauggagagguuucuaaagucugagcacuccagggaaaaggaccaaauccugauguagcaaaagaaaaauucugcucuaggguuggagagugccccaggccacgccagccuuccuagacaaagcuggcucgggaccaggaugcccaggaagugacagguggagguucucaccucucaaugcugcugaagguauacugagugcccugcuuggucucaauuucaaagucaaaggaacgaguaguagugguaccacgagcaaaguugacaaaggagaucucaucgaagcggaugugcacagguggcuuguggacguagaugaagccccgcuccagcggguagagcaguccugagcuugccuuguaggaacagguaaugcacugggccccugagugccugacagagggugcagggagccugguuagugccaaccucagcagaggcaaagggcguaucuagcagcagcgacacgagugcucauguccucgacuaaguaaaccucacugagcuguucugacagaggcgcuggcaccuauugugacacaaggucccauccaggccucuaggaggccgcauucccaucucaggaaggguuuaccaaggagacacggcauuucccauacccaggcagggcaggaucccaggcccacacucucacccuuggaaguugccuggcacugugaucuugcgguuuaccagugcuuucaugacccggcugaccaucucauagagggauccugacauguucuuggugagccgacccucaaagcgcuucuccacuucuucccuacaaagaaagcaaggugaggucacaacacuacugccuucuaauggcacaccugucuccugccuggacagugguaggaaacgaguccagggagacacucacucguucauguucagagucaacgaaauguccucguccuuggagaagaggaggaucaggaagugguagcgaguuuggccuugcuugauugggggauccaggcugaucuaguaaggaagaguacuaauugacacucuacaacaacuugcaauuaaccaacguagaauucugcacaccagugagauccaucuacuuaacacuuaggcaaaaaccaggauuauccggccauagggguuucugcuuaccacaaagaacaucuggcgcugguccuugugggguaacaaaaacagacgcaguacugugguguaggggaucuuguagucaaaggucuugccaugcaggugcagaaaggugggguagauccgaaugucauaacgaccacgaggagucagacacugcagcucccggaagaugcagauggcaucucccguggccuggauuacauccgccuuugacaacacauucugggcaaaggccugcaaaagcacauauugguagccaagcagcaggcccugcucccaggccagccaaugccugcucagcaccaucugcugccaaggcaaccaggggaagccucaccucaacaggguccacaccauccuccugggugggugggacguagaagcgcaccuccaugagagacaccucugcgucaucguuuugguggaauuccagugucaccucauucuugccuguggugcacugggacacauugcugagggguaucucaaagacuggcuggucaccaaugucaaaggaaagcagcugcccugugaggaaagggcuuauccagccacaagcuccuccccuuaagucugcauaagcaauauucccaccaaacugaguuccacagagacaggauacugcgguuagucuguuuagacuauaaccccaaccccaggcaguauacuguagguacucaauaaacacaugaugaacaugcaaauagauaggaaaccagagacaguggcagagggaaaagagcaaaacaaguaaaaggcugaaacccuucacccuaucuuccuccccaaaccucagucuuccccaggacucaccaccaaauuucacugucccccaguuccagcccuucacacaaagguccuucuccauuagcucaaggcgauagugaguuuugaagaaaucagagaguuucucaaacuccuguggguggagggaagaaagcacaaucccaguaaaccuugguggccuuaacaccgacuugaauguccugggauuaucuauuucugagaaacugccccaaauaggcuuuauaagaaauccaugcugacuuagcaacccagcucaugguaagauuguugaaagagauugcuucuagccacuggaucugacauuccugguuacgggccaucugacuuuauaaacuuuguauagguauuacuuuaaugaaaguggaaauuaaaaucaaauaaagccuuuaacucaagcaguucaaaaaggaaaacaaaacccacacuuuaagauaucaagcuagccaggcgcaauggcucacgccuguaaucucaacccuuugggaggccaaggugggcgaucccuugagucugagagcucaagaccagacuggguaauguggcaaaacgccguuucuaccaaaaauuauuaaaaaucagcugggcaugguggcaugugccugugguaccagauacucaggaggcugagauggaaggauuacuugagcccaggaggcggaggcugcaguaauccgagauugcgccacugcacuccagccugggugacagagcaaggcccuguccccaaaaaaaaccaaaaacacacauacacacaaagaaaucaagcuaagauucugaaccuugauaaaagccacaggcagaaacuacuaucuaaaucaagacagaagaaaaucuucuggagucaaggcacacagaaauucacaagacuucaacgcucaaagccaaacacugauugccugauggccucacagcccugcucuaaggagcccaaacuagcaaucacaggguuacaugaggaaggaaccucgagucucuagaagauuaaaauaagaagaugcaguaaaaaggaggcuuauagccaugggacaucucaccgauucucggaagccaucauacuuguagacauggccauucuuuguaagcaguuuaaguccauggcccagagcaacacggcgccagauaccuucuguuaacuccccagccuggauguuguccacuuugccugucuugcuauucuugaagaugaugcccugacggcucaaccucagucgaccaucauucuguaagaaaagcaggcccagaugcauggagacaguacacagcauguccuggguucuacagcucuaccuaacacacauuccugcugcaaguggacuggccagauuaucaaugcaggagcaacagcugagggugccaaggagucuagauucuaaaccagacucugguaucuagaacccuuaacagauucucaguuuccucauuuguaaaacaggaauugggaacugaacagcauauacggucccuauaacucugagacuaucucucaguauugccuugaguugguggagacacuagguacacauuauacugagucuucuuuuuccaaaauaacguuaccaaagcaagcucucauuaauggacaaaaacucuacccuccuuccuucucucuacuuguaucaccuguccaagccauucucaccauggaaccuuucaccuccugauagacgucguugaacuccagugucucugccaugucgaccccugccugugguggccugggcagagccccaggcugcacaagggaaaccaaguaaacugggagcugggccccaacuccugagugggugugcggaugcucagcagguugggaaucugaauucaagaggaagacagauaagcaugaaagacagcaccucgcugugcucacggauggagccagguagcaacucccagcugcgccuggaugucucaggauuuccucugccuggaaaccuacagacggacgcugcagugcccgaggguccagguccaggccuggguggagaaccgggcccggaauaccgcugacacccaacccgacgcccgcucuggccgcuccggcgggagccauggcaacgagcagcggaaccccagggucugccaggagcccgcacaucgcacgcgacccaauccagcucagagugcaggguuucccucgcaccgcucccaccaccccgcggccccagacccacgguucacccccgccccacauaauggauucgcccgcuccccgcgguugcgaacgcggaaugguccaugucgagggucccgugggggagcggggccccugccuuccugggaccggggacgaccaccaccuaccuccucaggcugcggccucgcgagggccccggcgcgagaggugggcgcgcuggggggacgcggggggggcgcggggagggggauggggggacaccggggaagcuuuucccgcgugcgcggccccgcgucccgccaccggaagccguacacaggccacagagaggaugagcuggcuagagagacgcgagucgggcccgccugcgagacagucgcauagagcgucagcgacucuggaggaccugagggaagggugguugccgugaagccucucucacccagggggaauccggccuagaaaauguguguagggcucuuuagaaacuacagacacuucuucagucgagacuagauacuaaagagaaauuguguaguuuuauuguaucagacuuaguacaggggugggguggggguguguauuggaaugaugcgugcccguuucucugcaaaauaguuucuaugucauggaaaggagucgaugggacaagaagagaaguauuugaacaguugugggaggaaacgaccucucccacuggcugcggagaguaugcggguguuggugucaucgugggugcacugcuuucuggcugaacugucaaguucacugucuacacccaaaauuuucacauccuuaaccgaaaauuauagguaccuccaagaggcuggcaaacggccuuauccaguucaaguccuggugucagauucaccuuggagccagaacugauuugaaaccacaucauccugugguugcggaagccaggucucccccguauaaucccagagugcauuuugcaacaucagagaccagaccuggaaaagauguuuuaguuuuucuaccccaaccuccuuuuacugaugggaaaacugagacccaaaggggagugaguugcccagggucucagugcguuggcaacaaggcuagguaggacccagaccuccuuaacaccaccaguccaguuaucuucugucauaaucacagugacuguauguucagaaugacuauugauauguguccuacaugaagacauuaguacagaauauguaagcucaagauuucccugacaaucaauacaccagcuugcuaaaucaauccugggguaagagacaacaggaaugcacccuucuccccugaacucauagcuuuaaccucugaguaguggcuauuccagcauuaucuagcaaaauaaauucaacuggguuuaauaaauagauauugagggccuauuacuacuuuagcacacuucucagauuugaggaaacuugaacaaggugaaaacauccccggccaggcacgguggcucacaccuguaauccuagcacuuggggaggccaaggcagggagaucacuugaggucaggaguuugagaccagacuggccaacguggugaagccccgucucuauuaaaaauacaaaaauuagccaggcgugguggcgggugccuauaaucccagcuacucaggaggcugaggcaugagaauugcuugaacccaggaggcagagguugcagugagcugagauugugccacugcacuccagcccgggugacagagcgagacucugucaaaaaaaaaaaaaaaaagaaagaaagaaaaagaaaaaaaaaaggaagggaaggaaagaaagaaaaaaaaaaaaaacagaaaaaaaaacccagccccaaccuuucaggaaaacauaaucuaacaaaugacuuuaauaaauaaagugacaguuaaaaaaaaaagaaguuggcacauauacaccguggaauacuaugcagcuguaaaacaggaugaguucauguccuuugcagggacauggaugaagcuggacuccaucauucugagcaaauuaucacaaggacagaaaaccaaacaccgcauauucucacucauaggugggaauugaacaaugagaacacuuggacacaggguggggaacaucacacacaccagggccugucgcggggugggcggaguggggagggauagcauuaggagauauaccuaauguaaaugacggguauauuuacaguuaacgggugcaacacaccaacauggcacacguauacauauguaacaaaccugcacguugugcagguuuaccauagaacuuagaguauaagaauaauaauaaaaagaaaacaaaacaaaaaagacgugcuaacugcuaugcuacagguagagcgaagcucauuaccagcuggaguuagaaauaugugacucuuuacucaucacaccccagaagacccagaaaaacuuucaagagaccuuuucccccugacccaugccacugggggcaacucaggaaaggaggggacggcgcagaacuggguggaauuuggcagacacucaggaaugaagaggguccuuagcucaggcaggcuauuaggugacugggggaugggaaauugcaaggggcuuuagggagagugugagcagcuggugagcugggaugaggaugcugcagaagagaacagaacagaaacaguagacagagugcagauaaaacauuagucccagagggcuccagccagcuacaucccaggcaaucaggagcccaggauuggagaccccaccccugcugugacaucacaggggaguggaguggagacgaacaaaaagggggucccccgcccugguccuggccucuuggaagccagaguaucaagagcagagaaucucacuaggauugcauggcuuaaagggacaggcuccccauuccuccaaccccucuaagcugcccccuccaggucgugaucucgucucccuguccuguaggaccucccucuccugaggccaccacugggcccccuucugaguguccccugagcacucucucagcaugaacugcauauccgacuucuucaccuaugagaccaccaagucggugguugugaagagcuggaccaucgggaucaucaaccgaguaguucagcuucugaucaucuccuacuuuguagggugagucuguggccuuucagguuccuggcggggugggcugccugguaucccgucuucacccuccugccucggugcuaccauccagcuuccugagcuccucugcuccugggggaaacaguuucuucuguggagccgagucuuaaagacuggccucugccacccccaccuagggccuaaauucacccaggugaauucuuuucccaguucguccuccaggguugagauugguuucaagacacacgcucggaguaguagggucccugccccggcacugcccuccaccgagggagggcucaggagcuccaucuccacccucccugcucucaucuccccaacaagagaacaggcagacccccucccacaucuucgaauuccccucagucaagucuucggggucucaaaaagacaagacagcacaggaauagggaagggaaggcacugagacaagggggugguggcagguugaucaaguugguggccgggagggaaagagagaacuggaucuguuuuagaaugaggaauuuccuucuggcauggaugggugagauggugagagagagaagggcaagggagaagcccucugcucuugaaggggaggacaaagagggaacugccccuugaugaggaaacaaacagaggcccaagggaagaguggccaaggagaaaaggagcuuuucugaacauagugccgcucccuccccaggaauccagaaaugcuccccuuugucaaaaaguguaaguucccuaccucucccugacccugugccauguaacccauccuaggaguugcuuaagagccaggaaggugcaaccauccccucagcccccaccgccugcaagcacacaccuacacacacacacacacacgcacacaaagggcuguggagcagacaauggcuggggaagaaugcagguccuguccuucuuguggucauuuccacacacuggugggcaccaggaaauacaggcagaaaccucgaagguuuucuuuccuggcaugcgggucuccaaucuuaugcuguucuuucagacaaugggucuuugcauuugaggcagcaauccacugacugucaggaguuaguucaagcaggucaaaggagaauccugugugccugugggcugaagcugcaugcaaaccugcuugcuugaaauguugaaguuuaugcgaggguguggagggaaagguggcuagaugugacuuuuuaggugauuuuuugcucugugugcugggcaagcccugguaggcuucagugggcagguauuguaaaaaggcuguaccauccagugcuccuuugggagauuuuagaaaagggauucaagcuuuggaauagcauuaaauggccacaaaguucccuuccaauguugagguuuugugagauacgagguuugcaaauguucgcugucugcaucucuagagcuuggcucaaaguugguuccuaaauguucuguguucacguguauauucaaugcugugguuguuuauagccacaagaugguauguuggcccaggugagugcaaaaucuggcucagcacauuccccuucuggccuggcuccacuggcuccaggcagagauugaugggggagagagugggcuccuagaccagcccgcucagcccccacugcccuugucucugucucaucaugaucagauagaauccuccaguccucagggcuggagcccagccugcuggagcgagugugcgaagcucuuuagcaucuuaauuuccaaccccauccaucuccuagccugacagcuccccacgggacacugccuuccaguuacaucagcgcccucugcagcccagcccccugaccugagucccaucuccguguaugugaacccaugcacguugugacuucaugaguccaccgucauuaauuuagcaaaaauguaccagcaucucugcaugccaggcacuguggauugaggacggaauggugggcaaaagcagacaggguccucgcccuccuggggcuuacagcggaaggcaagagauggcauucaucugaugaucuccacaaacgugaaaugucaacuguggcuuagaggugcacaguuauagagagccgcuucugugaagguguuuggcccagucagggaguaagggaagguuuucuggagaugugacauuuuagccaagacccgaaggaugaguaagagcagcccaggugaaagagggaaggaagagaguucagggcagagaaacccaccucugcaaagggaaggaggcuggcaaacaggggaaagaaaagaaggucauuguggcuggagccgagggagcagagaugagugagggugguguacgguggaugggaacacacacagaggccggaccucagacacccuuagagagcuuuuguuuuuacaggagaugaauaaacagaagccauggaagcauuuuaacccgugugucugugugcacuuuugugugugugugcacgugaguuugagagagagagagacagacacgaugagaucugaguugggaagagcaccugggcugauucccuggaaguggaaggaguaggagugggugcaggaaaaccugcuaagaggcaguuuaugcagagaggugacaguggcuuggacccaaucgaauuugaagggauuuuuaaggcuauaguguuaauauuucacugauacuucaaucucuuccccaucaucccaaccaggucaacaaccuagacucugccuaacaugaguccaucauuucucugagaacuucucagcaacacaccaccuggucaucucacauacgcucucacccccgccccuggccucagcugcuugucugugguugacaccauuucaucacuauuuuccuuuacccacuccagggcacacagagaggccuggacuuaccugauguuucucacaucuuuucuggguccacgugguaauccccacucaccucuguggagugggacuucccgagagcccauccccguucuggauccuuuggggaccugagaaguugaaggaaaucccuaggaucugagucccuggaagcaauagccugugcuuggccugagguugauuuccagggccuuccuggaggaagcugccuccuugcaaacuaggaggccagggacuucccaggccuuugaugccccauugugcugaagggucacugguggcugcuggagccucugaccccaccacagcccugcccuaccugcccuguuccucccccauacaagacccaguccacaaacuugccaucuguacagccccaugcuuugguucauaaaauucagccucauuucagaucuuaggugggaguucaauacauaaagcaggugaaagggaggagcugcucugguuuaaagagaagggucuagaauccugccuucuuggcucuccacuccauccucucagcccaggguaucacugugaggcaccuugucagcacaauuaagugacagauaugguggaaagagcuguuauggugggaagaacuguugggcugccccaucuuuuuuuuuuuuuuuuuuuuuuuuuuuuugagacggagccuugcucugucccucaggccggagugcaguggugcaaucucgacucacugcaaccuccgccuccuggguugaagcgacucuccugccucagccuccccgguagcugggauuacaggccugugccacgacgcccggcuaauuuuuguauuuuuaguagagaugggguuucaccauguuggccaggcuggucucgaacuccugaccucaagugauccaccugccucggccucccaaagugcagggauuacaacaugagucaccaugccuggcuggaugccccaucuggaccagucauccugguccagagagaggagugacucucauuccugccugcccucucccccaauauggaacguagagcacuugguuagaagccuggcucugacaccaacuaggagagggccuccuaagagugacuuuacaucucuaagucucaguccccauaucuggaaaauggauuuaggaauaccuccucccugggaguuauagggaggggagguaacauaugucaagugccuugcggagauggugacucaguaauagauggcaacugcgacuacuucacaaagacccccccaucaccccucccccuuucccucugcccagcucacaccuuccuaagagaccccucuccuccucccacacacacagcgugcacucuucacacccacuccccagccuccuccuuggcucccugggggcggaugggagggugcuggggcgcggcucuggccucucuccugcacaucccaccugccaaggagcugccacacgccuuccgcucuauaaauaauaaaccaugaaugcgagaagaaaauagucagagcagcagaguaaaugccaagaaucgaaggcucaggccugcccuagcuccugagcccuggccuccagagacagccucagccccuccguucuggaaaugaagcauccccuucuuucuagcugccuugaugacaucccgaggcccugugaggccauugaaauucuuccacuuguuauuuaagucagagagagaauucuaauguggccucuccaccccacugggcacaagaaggagccuugaaggaggaggaggaggagguaggagauugguugauuguuccuuggaguccucggcccuuuccuccugagacuuuccuaagccaggagaugcuuucacuggugauggagcaggagcugguaggaaaagcacaggguccgguucagggggccagcauggccuggcuuugagcugggacacagcuagagaccuucgagugaagaggcugugaguggucuggagcacguugucugguuagagcugacauaccagcuuugcaauccugggcaaguuagcacccucucugugccucaguuuccucauucaugacaugaagguaauaacgaagcugucucaguaagaauguagugaaagauucggcuuagcaagugccgcauugguuauauaauacuagucugaacucugcaucuccaaauguuccuggacuuuaaggacgcagggcaggggccucagaaaaccauuuccuuaggucgacacugagaaauaugucuauucuguggcuaggcacauugaagcucgguuccagaaggguguguuuagaccacaguuugcacucugcgaauguacagccaacagccaucuuagcuggaagcagagagccuaggccccagaccucacucccuucacucugcagggccccaggcugugagcuaauaaugcucauuuggguuuccugugacagggaggcucccuucucuucuucaaggacguaauuuggcagaugggauuucuacgugaggcauacuuccuugugaaaucugaaugaaaccccuccccuuccaaaaaaagaagaaaagaaaagugcugggagauaaagcagcaccacaaagccccauagaaggcgguaugcaugagagcauuuuacaagcacgcaagucacucuaaguggugcguuaaucaggaugccgccugccugcucuaaaggagcaauaggaaagcagguaacggguuugaagccauaugcuggugcuuugacuacacccuuucucuccugcucaagaaaucauucagaauucaagccaguaauacuacugaaaaaaugauaaauaugugagguaguaaauaugaucauuagcaugacauaaucauuccacaagguauaggcauaucaaaacacccacauugugccccaugaauacguacaauuauuacuuaucaauaauaaauagggcugggcaugguggaucccgccuguaaucccagcacuuugggaggccaaggcaggcagaucacuugaggccaggaguuugagaccagccuggccaacaugggaaaaccccgucucuacuaaaaacaaaaaaguuagccaggcgugguugugcaugccuguagucccagcuacucaggaggcugaggcacgagaaucacuugagcccgggaggcagagguugcagugagccgagauggcgccagugccuggguaacagagugacacucugucucaaauaauaauaauaaauaguauuuauuuaucaaaaauuuaaacuuaaauuagaauaaaaagaaaaaaagauuccagugagcaaaggaagacccaugauggggauaacaccaaacccucucacugaaaaccgaacgaagagccacuugcaaauauccgcugggguuugcaguaaauaggauugugguguccaaacuauaaguggcugggacccccgguacguucugggagcugcugcuguuugcauguuccaacaguaggugaccccagagaucauucaguccagccuccaccugaggaaggggccuccucucagcacaccugccaggugagcaacaugcuguccuggagucuucccagacguguggcacgcguguggugacuuuccgcagcaggcgguucugggauugaaguccucgcccaccuccuuauagaauccucaggucagcccagcuccuggcucugcagcuucccagccucuaacuccuacggcuuugucuucucugggcuacacagucucaaauuccuuccacucaccuucaucuggugugguuuuccaaccucgugccacccugguuagaagcagaaaaugcccucacccagcauuuccaaaagugugcuccucuguuccaugagacgucaccaguauuucuccaagacuggcuucuguggucaaauaagauugggagacagugagguuaacaaaauguaacagauguauuuguuuguuuacaucguauguuucucggggagggaggaggguugcauggcauuuucuaaacguauuugaugagguuuucucaucugucgaaugggaaugguggcagcaucuaccucccagugugccaucaggaauaaaggcaaucuugccaaaggcuggaagugugggauuaagugaggcugagcggggacuucagccuugagggcugugauuggcgauuucaaauggaaaggcaggcacuuuauaggaaagcagaggcacgaguugccagcagguauuugcaggcccuuuugcucgaggccaggaaagucugagaaggaagauagggauggaaaaagggaaggccucauccacguggucccauuauggcuuaaagcuguaggaaggcgccaguacagguaaaugaccacuggguggcagcacaauccagggaauaagaucagacucuucccucccuccucccccagcccccccaccuucaaccgagcuccuuuaccugccagguaaaagcucagccgcugucccccgcuuccuccucuguucucaucugacaccugggcagauagauucugccaagcaccgagcucccaaggaccuuuauugauuuguuuacugagcuacuuuguguuggacacuuaggguacagccgugggccaaggcuggaaugcaugggagcagaggccugggauccucuguccuucugucuccugggugccugccagagaaguggcccccaucagcagcauggaaugacuuugagccaugcauucucaauggggccauauggcccccaaggaggugaaaauugguucucacucuuuuuaugcauaaagcacaaauuugcauacaguacauaaacagauaucugugauaucaaaguuucauggagggggggaccacuaggggagaaaaugucuagaaaggcaccugaggggcaguaaugggacaaaagguggagaaacgcuauucuaagucaaccaagggcucacucuaggucucacgccucuggaaggaaccauccgcacacccugccaggcauggccaaguguuggcaggaaggugaccucucccagcuucugucugcugggucuauggacuccucucuuucucuucauuuaugcucuccugccccagguggguuuucuugcacgagaaggcuuaccagguacgggacacagccauugaguccucggugguaaccaaggugaagggcuccggacucuacgccaacagagucauggaugugucugauuacgugacgccaccucagguaugguaccccuacccagagaggcauguggauguccagacacugggcagguuggaagggagaaagcgagcaaagagugccaaugggauucccaaacuagaauccaugaugucacugauccagaggaccucucccccagcagcugagagcugugugagagcuugggccugcggugcugggcaucaggaaagcuggguuccucuccaggcucugccacaacuuguaaugcaaucaaggacaacacacaugggagaagggggccauguggguggcugcaaagagccagcucugccccucaccagcccugugaccuuggccaagucacuagacacaagccuugcuuuccucaucuguagaguggggauaaucaguuauagucccugucucacugauugggacuguuggauguuuuucucucccuucuucuccucccaagggcaccucggucuuugucaucaucaccaagaugauuguuacugaaaaucagaugcaaggauucugcccagaggugaggggaggacagagguugggugaagcaggucaaggcugaaaauguuggugggagugggagcaguggcagggagguaugagcagaggccccaagucugaccuugcaacugggaccugggaccuccacccuccugaggcuguugguuauggggaggucgagggagucgcggagcucaccaggccaggacaguguccuucaccaaccugugacccgucugcccacagagugaggagaaauaccgcuguguaucagacagccagugcgggccugagcgcuugccaggugggggugaguccagccccuuacccaccccacaaucccaaguguuagugggacccaugggggagagcccgucguuggagagggagugggaaccagccuguuccaugucauucugcuggcauuuacaguugcucccugggugccacacccagugggugcuacaaagguggcauggccccugcccccagaggaguucccagucuaggaugguggugacagacaggggugcuugaaguggccugugcuguccaggagguacaaaagacuguugagccugggggagggggagagauugcuucugggugagcaguacccaaaggcuuccuugagguggugacauuugggauggucccugaagaugaauaggauuuggcaggacagagggggcuucaaaaaguucauuccagacagaaggaacagcugcagcacagacucagaggcaaggaaggaagcacaagaagaagagguguccucaggguugcuggggcucggagcacaugaaaggaaggcugucaccucccuuuggcugggucuggggcucaggagaagcagcaggagagaagucagcucccuuuucccugccugcucuuuucccccacuugccagggucccugauggggggaagggaagagggaggaaggaaagggagaggagcaaagggcaggcagccacccagcagcuguggcucucacuuuagggauccucacuggccgcugcgugaacuacagcucugugcuccggaccugugagauccagggcuggugccccacggagguggacacaguggaaacguaaggcuccaagccagacaggaggagacaggcccccaccucagcuccccuuugcccaugugggagccgugcgucucugagcuugaggagggucuguggcuuucuccaguguugucccuuccuggugugggggguggccucaggcccaggguaucaucuuccccagcccacccaccugccuccuccuccugcugugacacucaggcacagacagccccuuccuauagcccacucucaaagugcccuuuaucuauaagaggucucccuuuggaggcauccaccaggaaaggucgcccucaggugaaagccuucauuucccccucuucuuccuggaaagcuaaggccuccugugcucacccacaggcccaucaugauggaagcugagaacuucacuauuuucaucaagaacagcauccguuucccccucuucaacuuugagaagugaguccccacuccuucccuaaagccaagaugcaggcacccccggcccugccaaccuguuuucagggaaguggagaugcccccucgccacaguucuucccacuuucgcuccacugacccaucucccugggccuaccauucccaaucucccagcgggccuuggccacugaggaucaggugaacuuuggggucaguuucucugccagccuccccaccuuggggcucagacccaaacgggaguuuugcuugggguaggagagggacaacuuaggccuagucgugggucaaggaugccuucaacgguugaaacccuuucggucucgucccauucuuuuuccccacaucuagcccauguguggaaaucccuuuucucuuagucaguucagccccccuucauugacuuacucauuccacagcuacucagugggcauuggccaugugcagagggcaaugccagucacuacagaagugcacuaggccaggcgcagugacaaaugccuguaaucccugcacuuugggaggccgagaaggguggaucacgaggucaggaguuugcgaccagccuggccaacauggugaaacccugucuguaccaaaaaaaaaaaaaaaaaauuagccaggcgccguggcacaccccuguaaucccagcuacuugggagacugaggcaggagaaucgcuugaaccugggaggcagagguugcagugagccgagaucaugccaccgcgcuccagccugggcaacagaccgagacuccgucucaaaaaaaaaaaaaugcacagaguaaccaagaaugauuccugcccucucgaacucccagccuggcagcuggagauuagucaccgacauacaucacccugauacacagggaaggcggugauggggcaccagaaagaugcagggaaaggaaagaggggagggagauggcgagguccagaugaaggcugagggcucagauccccccuaggccugggcuccggaaggcggggagagauugcacaagacgaucuucccaugaacccugggcugaccucucucucugcuccuccccaggggaaaccuccuucccaaccugacagccagggacaugaagaccugccgcuuccacccggacaaggacccuuucugccccaucuugcggguaggggacguggucaaguuugcggggcaggauuuugccaaacuggcgcgcacggugaggaccuagccauucuuccgcgaccccaaacuccccaccuucagcccuuucccagauuucagggcccuuuggccggcacuggccaggagccgccgcgagacagcgccaccugguggaagcaucccaggccgccacuggcuuugugccugaauccuuucugcuuuccccgcgcagagcgaucuugccccccgccuccgccgaguccaccuuccucaagccucaguuucccacucccaucuucacacuucaccucaggcaaaggccuuagaucuguaauaagccccaaacgacgggaaaguagaccuguggccacuuucuccuguguuguagcuaaagcacugaagaucccaaaauuaggacucagaggcuccaauguucgcauccgagccacaaccuuuuuuuuuuuuuuuuuuuuugagacagagucucgaucugucucccaggcuagagugcauggcgcgauuucggcucacugcaaccuccgccucccagguucacgccauucuccugccucagcuuccggaguagcugggaccaagcccggcuaauuuuugguauuuuuaguagagucagggguucgccguguuagccaggauggucucgaucuccugaccucgugauccgcccgccucggccucccaaagugcugggauuacaggcgugaaucaccgcacccggccaccacagcacuucuuuacugagcaguauaugacaugucacuuuccguucucccugccuccgucucccaccuggaggaugggaggaaaucauuugucaccaccuccaccccacccccacccuggcccagagcagggagucagagggcgaggggaaagcucauacccggcccguuucuucaggggggaguucugggcauuaagaucggcugggugugcgacuuggacaaggccugggaccagugcauccccaaauacuccuucacccggcucgacagcguuucugagaaaagcagcguguccccaggcuacaacuucagguaauucccugucuccugggacaccaggagaagaaggugcgggcuguuaacggcaauguuuauuggggagacaagaucccacauccauccacccaccccuggccccaagucccaccucagguuucauuucaaaucaggaaggacucucuaacagccauuaggaucuagcugguuguccugggagacagugucuccuuaucacugaaggggaccacgccaaggauuccugcugcaggucaguaguuagaagagagggccaaggucucuugaaaugcuaggguucugcgauucuuugccuguuccuaacacuggccugaaacugugacgugcuuaagugacuuccagauaggcccauucccugcccugggccugaauuuucuaagguuucucgcucuacaaaguaagggugauaacugguaucauuuuacauuuuacaagauggcaacuuugcauuucucuccgcaaacgugugucaccaguagcaauuauaauugucucugguucuucaaugccucuccaaacaagaacucagaccagucuuuaaauaucaucccaauggcuuugagacuucagggaucuuuucggguuuuguuuuguuuuguuuuuccauuuugaagaaagggagagaggaauuagaggacaaacuguuuggaagcaacugaaagcgcuugaacaagccauuugucuucucccauccuaauuuccccaccuaugaaauugugauaguaccacugugaucuucaggauucaauuaaccaaugugugaaaagcuucagcuuucuguuuuguuucucucuucuuuuuuuucugaaucauucauuuauugauucauccauuaaacacauaccaauugucuacuacgugcugaggaccguacucaguuaucuuagguuagcaguucucaaaguguagacuacaaggucaacacuacuuauuaaagguuuuguuuucuuuuuaauugauaaauaacaauugcauauauaugggauacaaugugauguuuugauacauguauacauuguggauuucccccaguuuuugaagauccugaaguuucuggcagggcccuguuuaaguacacagcauuauacacuaaacagcuuaaauagaacaaauagggagugaccaggggaaaaaaauacauaa

SEQ ID NO: 13248 - RNA, 948 nt, Homo sapiens
cuuguaacagguugaaucagagaaauggacuauagaaaucaaacuuugguuacugaauuuuuuuccgugggauuaacaaaucucuuucagcacaagauugcucucuuucugguauuucucuuuguuuaucuugucacuguuccgggaaacuugggaaugaucacucuuauuuggauggauucucgacuccagacccccauguacuuuucucucugccacuuguccuuuguggaugucugcuccucuucugccaucggucccaagauguugacugauaucuucguggagaaaaaaguaaucucuuugguuguguugcccaguuaugguuuuuuggccauuuuguaguaacugaauguuuccuucuggcugccauggcauaugaccgguauaggcuaucuauaagccuuuguuguauacacucauuaugucccaacaggucugugugcagcugguggugggccuuaugcugugggccuuauaagcaccaugacccauaugacuuucaccuuucgccuacucuacugugguccaaacaucaucaaucacuucuucugugaccuucucccuguccucucccuggcauaugcagauacccauauuaauaaauguuuacuuuuuaucuuggugggugcccugggaguacucaguggugugaucaucuuggucuccuacauuuacauugucauugccauccugagaauucgcucugcugacgcgagacgcaaagacuucuccacuugcucuucacaccugauggcugucuccauccuguaugggacacucuucuuuaucuguguauguccaagcucuaguuucucuaucaacaucaauaaagugguuucccuguucuacacagcagugauccccauguugaauccccuuaucuacagccugagaaacaaggagguaaaagauucauucagcaagaaguuugaaagaaagaaguuu

SEQ ID NO: 13249 - RNA, 963 nt, Homo sapiens
ugaagaaugucacugaaguuaccuuauuuguacugaagggcuucacagacaaucuugaacugcagacuaucuucuucuuccuguuucuagcaaucuaccucuucacucucaugggaaauuuaggacugauuuuaguggucauuagggauucccagcuccacaaacccauguacuauuuucugaguauguugucuucuguggaugccugcuauuccucaguuauuaccccaaauauguuaguagauuuuacgacaaagaauaaagucauuucauuccuuggauguguagcacagguguuucuugcuuguaguuuuggaaccacagaaugcuuucucuuggcugcaauggcuuaugaucgcuauguagccaucuacaacccucuccuguauucagugagcaugucacccagagucuacaugccacucaucaaugcuuccuauguugcuggcauuuuacaugcuacuauacauacaguggcuacauuuagccuauccuucuguggagccaaugaaauuaggcgugucuuuugugauaucccuccucuccuugcuauuucuuauucugacacucacacaaaccagcuucuacucuucuacuuugugggcucuaucgagcuggucacuauccugauuguucugaucuccuaugguuugauucuguuggccauucugaagauguauucugcugaagggaggagaaaagucuucuccacauguggagcucaccuaacuggagugucaauuuauuaugggacaauccucuucauguaugugagaccaaguuccagcuaugcuucggaccaugacaugauagugucaauauuuuacaccauugugauucccuugcugaaucccgucaucuacaguuugaggaacaaagauguaaaagacucaaugaaaaaaauguuugggaaaaaucagguuaucaauaaaguauauuuucauacuaaaaaauaaauuauaa

SEQ ID NO: 13250 - RNA, 1116 nt, Homo sapiens
guucuggauacuggaucaugaaggaaucauuccuuuuccaucagaguaauaucuuguucugcaacuaaggaauuauauauaccugaguaaaaacgagaggcuggaaucauacaggugcaaaggaauuccuccugguaggguuaacugaaaauccuaauuugcagaucccacucuuuuugcuugucacucugauuuauuucaucacuuuguuggauaauuuggguauaauuauuuuaaucugguuaaaugcccaacuucauacuccaauguacuucuuccuuggcaaccucuccuuuugugauaucugcuacucuacugucuuugcuccuaagaugcuagucaauuuccuaucaaaacauaaguccaguacauuuucuggcuguguucuacagaguuucccuuuugcaguauauguaaccacaaaggacauucuccuguccaugauggcuuaugaccauuacguggccauagcuaaucccuuguuguauacagucauuauggcccaaaaaguuuguauucagaugguccuugcuucuuacuuaggugggcucauuaauucccugacacacacaauagguuugcucaaauuagacuucugugguccuaauauugugaaucauuauuucugugauguuccuccucuucugaggcuuucuugcucugaugcucauaucaaugaaaugcugcccuuggucuucucugggcucauugcaauguucacuuucauugucauuauggugucuuauaucugcaucaucauugccauccagagaauccaugcagcugagggaagguacaaagccuucuccacuugugucucccaccuaaccacggugaccuuauucuaugggucuguuucuuuuaguuauauccagccaaguucucaguauuccuuggaacaggagaaggucuuggcuguguuuuauacacuggugauccccaugcuaaacccacuuauuuauagccugagaaauaaggauguaaaagaugcagccaaaagguugauauggugggggaaaaaccccacuugacucaguccugcauauagcuuugcuaaccuaacauuuaccugcaaauauauggccuaucuuuaaaaugauaucaaacaauuauaaa

SEQ ID NO: 13251 - RNA, 938 nt, Homo sapiens
auucauuugaauauccaauucuuucuaauagcuuuuugagagcauuuuucacauccuuguuucugaaacuauaaauuauuggauuaaacaugggaaauacaacaguauaaaacacugccaccaccuuaucagugucuagggaauagcuaguggugggcuguaaguacauaaacaggagcgcuccauagaauaaggugacugcuaugaggugggaagcacaaguggagaauguuuugcuucugccaccugaggacuugaugcucaacacagugaugaggaugcagaaguaagaaauaaauauuaccacaaaagugcuggucuggaugaagcugcacaaagcaaagagcagaagcugguugaucugagugucuguacaugauaaagccagaagaggugggauaucacagaaaaaaugauugacgauauuggagccacaaaaugacagccugaaugugaggcacacauggaccagugauguuguacuuccacugaaauaugccaacacaaugaagcagacacagacucuccuagacaucaguguaguauagagcaguggguugcagauggcugcauagcggucauaagccauugcugccaggauaaggcacucagcaucagcaaaagaagcgaagaaaaacauuuguagugcacacccauaaggagagaugcuuuuccuggaugccaagaaguuugccagcauuuuaggagugauugcuguagaacagcugaugucuaagaaagauaaguugcuaagaaaauaauacaugggaauuugaaggcuugaauuaauauuaacuagaauuauuaagaguauauuuccgaccauaguuaauguauauaccagaaggaauaccaagaacagugugacucugagagguagauaaucugugaauccaacaaauaggaacucaguuggcaugguguaauuacucuccaac

SEQ ID NO: 13252 - RNA, 10252 nt, Homo sapiens
auuccuuagacuauaugucauggaauuaauaauggagucacaauaguacgaaaaagagaaagcauuuugucaguuccugcugaaugacggguuuggggucuuaaguauguaaugaagccuuauccaaaugacaaugccacaauuaugagaugagauaaacagauggagaaaacuuugacacaacucguaguuguagcugauggccauuuauagauugugcagacaauuuugccgccagggauaaauaucaacagacauggagccaggacaugaaacacaguaccuauacagagauucaucucauucaaaaacauguucccacaggacaguguaaguguugggguaaugucacagaacaggugcuugauuuguuuggaaccauaaaauggcaaagagaaaaccuggaaugucugcacuauccagacaggaguuccagugauccaggagccagccaccaucuggguacagaccucaugguuuaugaagagaagauagugcagaggguuacaaauggccacauagcggucuuaggccaucacagccagaaagaagcacucuguggcucccaguauaagaaaguggcacauuuguguagcccaggcaacuaaagagguuauuccacucugggucccaagauuaaugagcauucuugggagaguaacugacagauaacaaauuucuaagaaggaaaaauugccaaaaaaaaauagguguuuggagacuaagguccagcuuuguuauuagaacaaugguaccacugucuaauagcuacagaagguagccaaaugccuaggcagauaggggcagguacccugugaaaccccaccuccaagccaaagacaguuuaaagccugaaagccaagcuacaaguuaaguccuuggacuggauugagaacuugucuuccuguuuggcauacuuuccacugauugauccccauacuucaccuauuuuacauauacuuucccuuuccuaauugguuuucuacacuguugugcccacauuugagugaugucuuugcuuugaccucuuuugcacacucacaaaccaaucagcacacacuccccguacugugcuuauaaagaccccagaguuacuugguagagaagaagcuggcuugacuuuggggaagagacaaccucauuucagggaagaugaccugcccuucccguacccucuccagcuccccucuccccugagagccauuuucaucacucaauaaaguucuccagguucaccauccuucaaugaaccaugugccucauucuuccagaugcuggacaagagucaggacucaccauaccagaaaaggcugucacacuagcccuuugcuucaccaguggagggcagccaccccacgugaugaggcaagggaccaacugagcugcuaacauacugcuauccguggaugguagaauuaaaggagcacuguaacacccucucuggggcuuuggggucacaggcacucucaccugggugcugccacauuccccuugaggcaacaugccuggucuagccacggguccugcauggugcuugcuucucuguugacacucagagugacuggauggauccugcacuugcucgcucacauguucccuccagcaaggaguugagcacagcagaccgaauaggugggguguuucuucccugaguccagugaaggggccaagaaaaauucuacaucaauaccacuggagauggggaacaucagcacagcccaagagaauaaguuucaucaauuuaguuccauucaguuagguuuuuuucuugugguuuuugcugguauuucauccauguaagugguaaauuuaacaugugcuuuucaauuugccucuauagauggauacuuguucucuaaauguaucaggacauccacaucaauuuuuauaauaacugcaauuuuuuccaauauaagaauguaacuauucauguacuucccacuuuuccaggucagaaccaauagcuuaucacuguacacaugccucuaaaguuucuugauuuucuuacuuuuauuuuuuauuuuuugaaaacagggugucacucugucauccaggcuggaauccaguggcacaaucauagcagcuaacuguaaguuugaacuucuggccucuagugauccuucugccucaguccccagaauagcuagaacuaugaauccugcaucaccacucuuggcuuuuccucuucuucuccuucuucuuuuuccuccucuuucuccuccuucuccauguuuuuuuacagagacagggucucaguugcccaggcuggcuuugaacuucuggccucaagagucccaucuugaaguuccaaagcacugggaucacaggcaugagccacugcgccgggucccugaaguuucuuuagcauuaugccauuaugggcaggacgcagugauucaggccuguaaucccagcacuuugggaggccaaggagggcggaucacaaggucaaaagaucgagaccauccuggccaauauggugaaaucccgucucuacuaaaacaaauaaaauaaaauuagcugggcaugguggcgcacaccuguagucccagcuacucagaaagcugaggcagcagaauugcuugaacccaggagguggagguuguagugagccaagaucaugccacugcacuccagccuggcuacagagcgagaguccaucucaaauaaauaaaugaauaaauaaauaaauaaauaaaaagaauuaugccauuauaucucugaaaacagcccaggaugaaccaaacuacccuacucagcauaagcacugcaacugcugaaggcccacagcuuuuccauaugaucuguuuauuuacuuuucuugaaaauucuauuuuacuucugauauggcuuggcuguguccucacccaaaucucaccuugaauuguaauaauccccaugugucaagggcaggaccugauggagauaaaugagucaugggggugguuucucccuuacuauucuugugguagugaauaacucuugcgagaucugauaguuuuguaaaaugggcguuuccuugcacaagcucucuugccugccgccaugugagacgugacuuugcuccucauuugccuccugccaugauugugagaccucccuagccauguggaacugugagucaauuaaaccucuuucauguauaaauuauccagucucagguauaucuuuauuagcagcgugagaacagacuaguacaacuucucuguaauuuuucucuaucaugauucaguagcacuauaucaucgauugccuuaucuccugaauucuuaccugucuaugccaacuguccauuucccucucaucacuuuauuugaccauagcuauccuuaucauagcauucauguuguuaggcaguuuaacaacaacaacaauaacaaaaugagagaaugacuuauugcacuuagaggaagaaaacaguaucuguugguaugauacuaaguggagaauauaggagaguuuuauucagaaaaaguagccugggaacauggauccagguugaaauaauaaagggaguauggcugggggaaacagaaauagcuuauguggcauagaugauaccugugaguaggugugcugggcaugaggagaaaagauauuagcccguuauguuaaauguugugcacuguuugugccucacaauuguucccccuaaaacagcuuuucagauaagauuucuaacaucauuuuucuuuauacaucaggaaggauacguuagaacugcuuuaacauaauaauacauuuccugcuacaaguuaaauauuaauuuugaauuuucaaauauuauaaacagaaccuucagaucaguauaaaacaguucauauuuacuuuucuuauauagguugaugcugauguuuuucucacuguagaggauuuaaauauuuagauauuuaaauuacuuuuggugaagcacuuguacaucaaacauauucaacccacuuugaaaacauuccacucuuucuaaacauaaaacgcucuuuaaauaaaacuauagcaguuaucucuaccuuaggaccucuccugccugacacauuaaaauuuuugauuuauaauuaaaauuucgguguaucuuuugcauccacuaaauugcuuuauuuaauuuuucccaguuacugcuuuacucuacuuaauauggagccucuguuccuauuaaacugagcacuuaaauauguuuuauuuguaauuuugucuuccuaaaaugauuucccugauccagauuugugguaagccuguguaacaguuguaacaaucuguuacaaaaaacaaaucuuuacuuaggauaaaaucaaaaucuggaauaaguccagcugagauagugguaaagacaccaggaaagcucucugucucuuccaggcuucaauuugugaauaacaauuuuuuuuuuccugaauuagguaguuuaagaaucuugucuugaagucggguuucucaugucacuaaucaauguugcuucguauuauauauuuaguaaaugguuauuucuagugguuuugauaauuaauagaaaauauuuccaagagaggaacuucuauauuacugugauaacaaauaggaaucaggaaaguuuauuacaaaguaucaggagccaugugccagagaccaugggaggugaggaacagguagugauaccucaaaggggagccagacguguccaagcaaagcagaauauugagaugccagccauagcugaacuauuucaggcgcacagguaacagguagcuaagcugaaaaaagauuucuaaagucucaacguaaggacaguguaguacugacauagauagagauauuuucugaugccauagaauaggaaaccaaggaaaaaaaagacucaaauacaaaugagaauguauugccuaauaaauaaugcauaccaaauuuaugaaauuuugacauuuaaaauacacguuauugggauaccuggggaacauuucaggaaaaaaaacacauuuuauucauaguucauacuacaauaugauaaacuuuaaaucauauacaaguuuagguauuuuagaaaguaaaacaaugaaagcaaauaauagcaaucuaagcaaaaauuuuuauaauucuggagcaaugaaaguuaaucuaccaaugacccaaauguuagaauguagaacacaauuuaaaaaaauguguaaaaauaaauaauuuugcaugguuaaaagaaaugagcccuaaaguaaaguaaaauaguauugauagaaugaaaaaaauacuaaguauaucuccaguaaagugcuauuugcccuucugaacaaugcuucaaauauccaggaaaaguccaaaauacaaauaguaaaguagaccaaacaauuuaaguaacaguucacagaaaagggaggaaaauuaucccucaaucauagguacaaauacucaacuucauucauaaaaaauuaaucuguacauugaugcaguuuaaaaaaauuauaagauauucuccuauacauuauguauuccacauauagguaggaauauggcaucuuugacuaacaucauagugugucuacucuuugaaucaauccauaaaucaugcaugcauaugaauauuuauucaguaacaggauguuggaguauuguuuauacuugaaaaagagcaaaccaacuaagugcgaaccaucuugugaguucucucucucugaaugacagccuugaauuuaacaguguuaucuauuguuuuuucuuccauagcuagugaaugccacuaaauaugaguauuauaauuucuucagauuuuuccagugcuuccagaaaaaacacuagcuuacugugaucuaguauaucuuaauuagaugugaagucguuuauuucuuuguguuaaauguuggaaauuauauauggcuugguuuuuaaguguaucuauucauagaaauuauuauucauuucucaaaaugguucaauagugucacauuacuuaggucauauuuuguugucaauuguuauuuuuuggagaagauaaaaggaaauuugcuuuacugaauuguuucaggcaaaaauagcaacaugauauaaaaauguuaaagaguauuggauguuucucuccauuauaaacaugauacauuuguaaaagaaaauuuggaaaucaaagguaggaauauauauauaauuauauauuauguaauaaaaauuuauauuaaaauauuaauuuacauuauauaacuuuaauucuaaaauauauuuuuuauauaugcauaauauacauauagucauaugguguuguaauuaucagacauccuuauauacugucuacuucuguacuuauuuaaaaggaaauauacagugaauauagcuuguuuugcucaaugauacacuucaucgauguuguacauguuuguguuuguacauuuugaucauucucuaauuuucccuucugugaaauuaucacaaucauuuuuccauucuaauucgauaaguauuugcaacucuuagucaugcuaagaugagcauucuagcaggaguucccuuccaugcuggguagacaccuagcaauuagauuucugcuggguagagacguagcaguuggguucucuggaugggggcaggcugguugcuaaauugguggaccaauuuacaugccagaauuguaugaguccccauuguuucacaucuuauauacaagcaguguggucaaugucuuuuuguucuuuucccucucuuucucuguaucauucccucuucauuugagucauccugauaggaguauuauggaucucaucugguuuuaauuaucauuugguuaguaauggauuauugucuuuuuuuccuuggccauuugugaagugcccuucauguuucuuaacaauuuuucucccaaauuuucuguguuuuugauugguagcacguuaaguaugguggauuuaaucacuuugcacuguaaaauuuuauucugaauuacuucuuuggagaaagauaacuucuuaaccaaugaaguucaauuuaucaguguuuuccacuauagcaaauaacuguauuaaaauauuuuucucaugccaaaauccugaaaauaagauacauaagcuuugaaauauuuauuguacuauauuucauauuuagguuuacaagcuaccugaaauuaugguuuuaauaaacagugugaaguaagggugaacuuuuuucuuuccuguuuauacauaaacauuuaauuaguuuaguaaaacuuauuaaauaaacauacuuucuacaguaaucugcagcgcuacuuuuuucauauuuaaguauguccaugugcugagugggcuuugcgcucucuauuaugugccaucuguuccuuuauguacuguaaaauuauaucacacugucagaauuucugcagcauugaaauaauauugaaauaaguccugaugcccaguaaagugauuccucccucuuuacucuucuucaagaggccuuggcuacuauuagcuguuuucuuuccacaguuuuagaagcaggugauaaauuagacacacacacacacacacacacacacacacacaaagagaauaggauuucauuguauuuuaaucaauugugguucauauugggggaaauugacaucuuugacuguauggagaaaacauguuuacucauuuauuaacucuaauaaucuuuagauucuuaaagauguucuauauauauauguuuaucucuucugucagugauuagauuuauuuccaauuucucagacuuuuuucuuucuuaaaaugcauaaucuaccaucucuaguagaauuauuuaauaaaaacuguaaaaaggagcaucuuuuucuuggucuuggucucaauugcagaaauacauauuucaacaucuuuucacuuaagugugguguuuacaacucagauuauaacacagaucucuuuuuuauugaaaccuaaacauucuguguacuauuuggaaucaugaguguagaaacacuuuggcugagguucuauuguuagucuuuacuguggguuauucuuuaaaucaugaagaggcaacaugaagguauagauuauauacaacaucuaaacauauaagccuauaguuauucaacaaauaguauccaaaaagcaaacauauacaguacucuuuacuaguugacauauuuuuaaaaagcuaaugauaaugauauaaaggaugagaggaauaagaauuuacacuaugauuuuuaggggaaauauugagauaugaauggcuagacaaggaagcaggucgaggucacuguucucauugucuaagguguuauucgagcucguugucucaccaccaagaaaauuaaggaguguggacgcaaagggugagguuggagcaaaaguuuaaugagugaaagaagaaagcucucugcaggggagagggaagcucaagugguuuuuuuucuguuuuuacaguugaauccaaaagcuuuuauaagaaacuccucucaguucuguagcuguuugagugacuuuuuuuuuaaucugaaaaucugucugcacaacucccccuuaucuauguaguugugguaugucucuaggcaggcacaaagcgccgcuucucuuguuuguauaacuguggguuuguuuuagguaaacccccuuccucccuguguaacuucccacggagcccacucuguauauaccugaaaagggggcggggggaaaccaguuacacaaagaacaaaaggcuucugugcuucuuaucugugcaggugcagucugacuuuuuuccaggcugcucuauuuuugccuguagcugugauuuuucaggcaggcugcuucuccaaggaccagccuuaaccuuuuaccuaacugauuuuuccuuuucuucucccucaguaagacauacuauguuuuuuaguaaauaaucccaagauacuaaugaauuugugcaaggacuuguggaguaaauauaaguuuguugaaaacuuauucauugaaauugccaccucuuugguuauaauuaugauuucagaaaguccagcauaaaaugagaaauuccguaauuagaaagcaaaauuagccaacauuaagucaggaaaauaagguaacaauuucugauaagauaauggcagaauuaagugagaaaauggauaaaucaguaguuaaugcauuaaauaggcaggaauuuucacaaagccauuuuuaaucucuuccucacauuguagaucaugagguuaaacacugaguugacaaugauauagaaaagagauaaaaauuugcaucuuauggaagaauguuuggauuuaggucauauguauguaaugauucuggaucuacagaauaaagccacaacuaugacaugagaugagcagguggaggagccuaugacuuguccuguuucugauggagacuucaagauggugaagaugauuuuccuguaguagccaaguaucaucauaaaagaguucauagcaaacagcacaacaucuguaaagagcaacaucucauucacaaaaguaucuccacaggccagcguugaguauugaggggaugucacauaaguuauuuuuuuuaaauaagagucacggccgggcacuguggcucaugccuguaaucccagcacuuugggaggccgaagugggcagaucacgacaucaggagauugagaccauccuggcgaacacuuugaaaucucuacuaaaaauacaaaaaaauuagcagggcgugguggcgggcaccuguagucccagcuacucgggaggcugaggcaggagaauggugugaaccgagggaguggagcuugcagugagccgagaucgcuccacugcacuccagccugggugacagaccaagacucugucucaaaaauuaaaaaaaaauuuaaaaaaaaaugaaaaaaaaauaagauucacaaaagggcauggagaaagccugacaugucugccuuaucuacccugaaacuccgacagucuaggagccaaucaucaguuagagaccuugugauucacaaagugguuauaggucaucacuguccagagaaagcacucgauaguuacaaacaucaggagaaagcacauuuguuuaacacaggcaaacaaauaaauauuuguuuucugaauccaaagcuuuaugaacauucuaaguacagugagagacaugaaacauauuuaaagaaggaaaaaacacugcagaaaagauacauaggaaucaggugauccuggucaauccugaugauuaaaauaugauuuccauuauuuccuaucauuucccaucaugauuaucacauagaaaagaaagaaaauaaauauuggagauugagaauaucaaaaaucuccaaagaauguauaccuuuacugaaaggaaauuuacuucccaugguu

SEQ ID NO: 13253 - RNA, 929 nt, Homo sapiens
aauggacugggaaaauugcuccucauuaacugauuuuuuucucuugggaauuaccaauaacccagagaugaaagugacccuauuugcuguauucuuggcuguuuauaucauuaauuucucagcaaaucuuggaaugauaguuuuaaucagaauggauuaccaacuucacacaccaauguauuucuuccucagucaucugucuuucugugaucucugcuauucuacugcaacugggcccaagaugcugguagaucuacuugccaagaacaagucaauacccuucuauggcugugcucugcaauucuuggucuucuguaucuuugcagauucugagugucuacugcugucagugauggccuuugaucgguacaaggccaucaucaacccccugcucuauacagucaacaugucuagcagagugugcuaucuacucuugacugggguuuaucuggugggaauagcagaugcuuugauacauaugacacuggccuuccgccuaugcuucugugggucuaaugagauuaaucauuucuucugugauaucccuccucucuuauuacucucucgcucagauacacaggucaaugaguuaguguuauucaccgucuuugguuuuauugaacugaguaccauuucaggaguuuucauuucuuauuguuauaucauccuaucagucuuggagauacacucugcugaggggagguucaaagcucucucuacaugcacuucccacuuaucugcgguugcaauuuuccagggaacucugcucuuuauguauuuccggccaaguucuuccuauucucuagaucaagauaaaaugaccucauuguuuuacacccuugugguucccauguugaacccccugauuuauagccugaggaacaaggaugugaaagaggcccugaaaaaacugaaaaauaaaauuuuau

SEQ ID NO: 13254 - RNA, 837 nt, Homo sapiens
ggugauccaugggcagcagcaagggccacgaugacagaccaugacgaggagcaaugcaagagcuagaggcccaggaguccaucuacccuaacuccuucauaguauuaucauaaaauccacccggcuucaccauuacugugacaucugaggcuggagaaaaugaugaaacuguccagacuacccucacguuuacauacagugaaaaauacccaggugaaguucuccuuuaugaaauauucccuccagaaaaucuagaagauaaugaugucucagacauuuuaaaauuacuagcauuacaggcugaagaaaaucuugguauggugaugaucuuuacucuagugacagcugugcaagaaaaauuaaaugaaauaguagaucagauaaaaacuagaagagaagaaaagaaacaacaagaaaaagaagcagaagaggcugaaaagcaauuauuccauggcacuccaauuacaauagagaauuucuuaaaucggaaggccaaguuugaugaagaauucuuggaaauuaaaaagaaaaggaugaaagaagaagaacagcaggaaaaaauaaauuaaguuggaaacaacuauuugaaacagaucauaaucuugacacaucugauauccaguucuuggagcaugcuggaaacaacguggagguagaugagucuuuguuccaauaaauggaugacuuggagcuggaggaugaugaggaugauccagacuacaauccuccugacccagacagugacucagcugacuaauggacauccccaucugcagagaggcuugacugccacagcaucuguggcuaugcucagaggguuuugauuuuccuuucuuu

SEQ ID NO: 13255 - RNA, 922 nt, Homo sapiens
uuuauuuuucaguuuuuucagggccucuuucacauccuuguuccucaggcuauaaaucaggggguucaacaugggaaccacaaggguguaaaacaaugaggucauuuuaucuugaucuagagaauaggaagaacuuggccggaaauacauaaagagcagaguucccuggaaaauugcaaccgcagauaagugggaagugcauguagagagagcuuugaaccuccccucagcagaguguaucuccaagacugauaggaugauauaacaauaagaaaugaaaacuccugaaaugguacucaguucaauaaaaccaaagacggugaauaacacuaacucauugaccuguguaucugagcgagagaguaauaagagaggagggauaucacagaagaaaugauuaaucucauuagacccacagaagcauaggcggaaggccagugucauauguaucaaagcaucugcuauucccaccagauaaaccccagucaagaguagauagcacacucugcuagacauguugacuguauagagcaggggguugaugauggccuuguaccgaucaaaggccaucacugacagcaguagacacucagaaucugcaaagauacagaagaccaagaauugcagagcacagccauagaaggguauugacuuguucuuggcaaguagaucuaccagcaucuugggcccaguugcaguagaauagcagagaucacagaaagacagaugacugaggaagaaauacauuggugugugaaguugguaauccauucugauuaaaacuaucauuccaagauuugcugagaaauuaaugauauaaacagccaagaauacagcaaauagggucacuuucaucucuggguuauugguaauucccaagagaaaaaaaucaguuaaugaggagcaauuuucccaguccauu

SEQ ID NO: 13256 - RNA, 915 nt, Homo sapiens
aaugcagcaaaauaacagugugccugaauucauacuguuaggauuaacacaggaucccuugaggcagaaaauaguguuuguaaucuucuuaauuuucuauaugggaacugugguggggaauaugcucauuauugugaccaucaaguccagccggacacuaggaagccccauguacuucuuucuauuuuauuuguccuuugcagauucuugcuuuucaacuuccacagccccuagauuaauuguggaugcucucucugaaaagaaaauuauaaccuacaaugagugcaugacacaagucuuugcacuacauuuauuuggcugcauggagaucuuuguccucauucucauggcuguugaucgcuauguggccaucuguaagcccuugcguuacccaaccaucaugagccagcaggucugcaucauccugauuguucuugccuggauagggucuuuaauacacucuacagcucagauuauccuggccuuaagauugccuuucuguggacccuauuugauugaucauuauugcugugauuugcagcccuuguugaaacuugccugcauggacacuuacaugaucaaccugcuguuggugucuaacaguggggcaauuugcucaaguaguuucaugauuuugauaauuucauauauugucaucuugcauucacugagaaaccacagugccaaagggaagaaaaaggcucucuccgcuugcacgucucacauaauuguagucaucuuauucuuuggcccauguauauucauauauacacgccccccgaccacuuuccccauggacaagaugguggcaguauuuuauacuauuggaacacccuuucucaauccacucaucuacacacugaggaaugcagaagugaaaaaugccaugagaaaguuauggcauggcaaaauuau

SEQ ID NO: 13257 - RNA, 930 nt, Homo sapiens
cuucacaucaacugaaacaaugcagcaaaauaacagugugccugaauucauacuguuaggauuaacacaggaucccuugaggcagaaaauaguguuuguaaucuucuuaauuuucuauaugggaacugugguggggaauaugcucauuauugugaccaucaaguccagccggacacuaggaagccccauguacuucuuucuauuuuauuuguccuuugcagauucuugcuuuucaacuuccacagccccuagauuaauuguggaugcucucucugaaaagaaaauuauaaccuacaaugagugcaugacacaagucuuugcacuacauuuauuuggcugcauggagaucuuuguccucauucucauggcuguugaucgcuauguggccaucuguaagcccuugcguuacccaaccaucaugagccagcaggucugcaucauccugauuguucuugccuggauagggucuuuaauacacucuacagcucagauuauccuggccuuaagauugccuuucuguggacccuauuugauugaucauuauugcugugauuugcagcccuuguugaaacuugccugcauggacacuuacaugaucaaccugcuguuggugucuaacaguggggcaauuugcucaaguaguuucaugauuuugauaauuucauauauugucaucuugcauucacugagaaaccacagugccaaagggaagaaaaaggcucucuccgcuugcacgucucacauaauuguagucaucuuauucuuuggcccauguauauucauauauacacgccccccgaccacuuuccccauggacaagaugguggcaguauuuuauacuauuggaacacccuuucucaauccacucaucuacacacugaggaaugcagaagugaaaaaugccaugagaaaguuauggcauggcaaaau

SEQ ID NO: 13258 - RNA, 930 nt, Homo sapiens
auuuugccaugccauaacuuucucauggcauuuuucacuucugcauuccucaguguguagaugaguggauugagaaaggguguuccaauaguauaaaauacugccaccaucuuguccauggggaaaguggucggggggcguguauauaugaauauacaugggccaaagaauaagaugacuacaauuaugugagacgugcaagcggagagagccuuuuucuucccuuuggcacugugguuucucagugaaugcaagaugacaauauaugaaauuaucaaaaucaugaaacuacuugagcaaauugccccacuguuagacaccaacagcagguugaucauguaaguguccaugcaggcaaguuucaacaagggcugcaaaucacagcaauaaugaucaaucaaauaggguccacagaaaggcaaucuuaaggccaggauaaucugagcuguagaguguauuaaagacccuauccaggcaagaacaaucaggaugaugcagaccugcuggcucaugaugguuggguaacgcaagggcuuacagauggccacauagcgaucaacagccaugagaaugaggacaaagaucuccaugcagccaaauaaauguagugcaaagacuugugucaugcacucauuguagguuauaauuuucuuuucagagagagcauccacaauuaaucuaggggcuguggaaguugaaaagcaagaaucugcaaaggacaaauaaaauagaaagaaguacauggggcuuccuaguguccggcuggacuugauggucacaauaaugagcauauuccccaccacaguucccauauagaaaauuaagaagauuacaaacacuauuuucugccucaagggauccuguguuaauccuaacaguaugaauucaggcacacuguuauuuugcugcauuguuucaguugaugugaag

SEQ ID NO: 13259 - RNA, 922 nt, Homo sapiens
aaugcagcaaaauaacagugugccugaauucauacuguuaggauuaacacaggaucccuugaggcagaaaauaguguuuguaaucuucuuaauuuucuauaugggaacugugguggggaauaugcucauuauugugaccaucaaguccagccggacacuaggaagccccauguacuucuuucuauuuuauuuguccuuugcagauucuugcuuuucaacuuccacagccccuagauuaauuguggaugcucucucugaaaagaaaauuauaaccuacaaugagugcaugacacaagucuuugcacuacauuuauuuggcugcauggagaucuuuguccucauucucauggcuguugaucgcuauguggccaucuguaagcccuugcguuacccaaccaucaugagccagcaggucugcaucauccugauuguucuugccuggauagggucuuuaauacacucuacagcucagauuauccuggccuuaagauugccuuucuguggacccuauuugauugaucauuauugcugugauuugcagcccuuguugaaacuugccugcauggacacuuacaugaucaaccugcuguuggugucuaacaguggggcaauuugcucaaguaguuucaugauuuugauaauuucauauauugucaucuugcauucacugagaaaccacagugccaaagggaagaaaaaggcucucuccgcuugcacgucucacauaauuguagucaucuuauucuuuggcccauguauauucauauauacacgccccccgaccacuuuccccauggacaagaugguggcaguauuuuauacuauuggaacacccuuucucaauccacucaucuacacacugaggaaugcagaagugaaaaaugccaugagaaaguuauggcauggcaaaauuauuucagaa

SEQ ID NO: 13260 - RNA, 904 nt, Homo sapiens
uuuauucucuugggguuuucccaaaauaagaacauugaaguccucugcuuuguauuauuuuuguuuugcuacauugcuauuuggaugggaaacuuacucauaaugauuucuaucacgugcacccagcucauucaccaacccauguauuucuuccucaauuaccucucacucuccgaccuuugcuacacauccacagugacccccaaauuaaugguugacuuacuggcagaaagaaagaccauuuccuauaauaacuguaugauacaacucuuuaccacccauuuuuuuggaggcauagagaucuucauucucacagggauggccuaugaccgcuauguggccauuugcaagccccugcacuacaccauuauuaugagcaggcaaaaguguaacacaaucaucauaguuuguuguacugggggauuuauacauucugccagucaguuucuucucaccaucuuuguaccauuuuguggcccaaaugagauagaucacuacuucugugauguguauccuuugcugaaauuggccuguucuaauauacacaugauaggucucuuagucauugcuaauucaggcuuaauugcuuuggugacauuuguugucuuguuguugucuuauguuuuuauauuguauaccaucagagcauacucugcagagagacgcagcaaagcucuugccacuuguaguucucauguaauuguugugguccuguuuuuugcaccugcauuguucauuuacauuagaccggucacaacauucucagaagauaaaguguuugcccuuuuuuauaccaucauugcucccauguucaacccucucauauacacgcugagaaacacagagaugaagaacgccaugaggaaagugugguguugucaaauacuccugaaaagaaaucaac

SEQ ID NO: 13261 - RNA, 953 nt, Homo sapiens
caugcaaaaccaaagcuuuguaacugaguuuguccuccugggacuuucacagaauccaaauguucaggaaauaguauuuguuguauuuuuguuugucuacauugcaacuguugggggcaacaugcuaauuguaguaaccauucucagcagcccugcucuucuggugucuccuauguacuucuucuugggcuuccuguccuuccuggaugcgugcuucucaucugucaucaccccaaagaugauuguagacucccucuaugugacaaaaaccaucucuuuugaaggcugcaugaugcagcucuuugcugaacacuucuuugcugggguggaggugauuguccucacagccauggccuaugaucguuauguggccauuugcaagcccuugcauuacucuucuaucaugaacaggaggcucuguggcauucugauggggguagccuggacagggggccucuugcauuccaugauacaaauucuuuuuacuuuccagcuucccuuuuguggccccaaugucaucaaucacuuuaugugugacuuguacccguuacuggagcuugccugcacugauacucacaucuuuggccucaugguggucaucaacaguggguuuaucugcaucauaaacuucuccuuguugcuugucuccuaugcugucaucuugcucucucugagaacacacaguucugaagggcgcuggaaagcucucuccaccuguggaucucacauugcuguugugauuuuguucuuugucccaugcauauuuguauauacacgaccuccaucugcuuuuucccuugacaaaauggcggcaauauuuuauaucaucuuaaaucccuugcucaauccuuugauuuacacuuucaggaauaaggaaguaaaacaggccaugaggagaauauggaacagacugauggugguuucugaugagaaagaaaauauuaaacuuuaaa

SEQ ID NO: 13262 - RNA, 961 nt, Homo sapiens
uuuucuuucucaucagaaaccaccaucagucuguuccauauucuccucauggccuguuuuacuuccuuauuccugaaaguguaaaucaaaggauugagcaagggauuuaagaugauauaaaauauugccgccauuuugucaagggaaaaagcagauggaggucguguauauacaaauaugcaugggacaaagaacaaaaucacaacagcaaugugagauccacagguggagagagcuuuccagcgcccuucagaacuguguguucucagagagagcaagaugacagcauaggagacaagcaacaaggagaaguuuaugaugcagauaaacccacuguugaugaccaccaugaggccaaagaugugaguaucagugcaggcaagcuccaguaacggguacaagucacacauaaagugauugaugacauuggggccacaaaagggaagcuggaaaguaaaaagaauuuguaucauggaaugcaagaggcccccuguccaggcuacccccaucagaaugccacagagccuccuguucaugauagaagaguaaugcaagggcuugcaaauggccacauaacgaucauaggccauggcugugaggacaaucaccuccaccccagcaaagaaguguucagcaaagagcugcaucaugcagccuucaaaagagaugguuuuugucacauagagggagucuacaaucaucuuuggggugaugacagaugagaagcacgcauccaggaaggacaggaagcccaagaagaaguacauaggagacaccagaagagcagggcugcugagaaugguuacuacaauuagcauguugcccccaacaguugcaauguagacaaacaaaaauacaacaaauacuauuuccugaacauuuggauucugugaaagucccaggaggacaaacucaguuacaaagcuuugguuuugcauguuucccaaggaaaagaugaaag

SEQ ID NO: 13263 - RNA, 876 nt, Homo sapiens
agugaacaacauaacggaauucaucuugcuuggccugacacagaacgcagaggcacagaaacucuuguuugcuguguuuacacucaucuacuuucucaccaugguagacaaccuaaucauuguggugacaaucaccaccagcccagcccuggacucccccguguauuuuuuucugucuuucuuuuccuucauagauggcugcuccucuucuaccauggcccccaaaaugauauuugacuuacucacugaaaagaaaacuauuuccuucagugggugcaugacccagcucuuuguagaacauuucuuugggggaguugagaucauucugcucguggugauggccuaugacugcuauguggccaucugcaagccccuguacuaccugaucacaaugaacaggcagguauguggccuccugguggccauggcaugggucgggggauuucuucacgcucugauucaaaugcuuuuaauagucuggcugcccuucuguggccccaaugucauugaccauuucaucugugaccuuuucccucugcuaaaacucuccugcacugacacucacgucuuuggacucuuuguugccgccaacagugggcugauguguaugcucauuuuuucuauucuuauuaccucuuacguccuaauccucugcucacagcggaaggcucucucuaccugcgccuuccauaucacuguagucguccuauucuuuguucccuguauauugguguaccuucgacccaugaucaccuucccuauugauaaagcugugucuguguuuuauacugugguaacacccauguuaaacccuuuaaucuacacccucagaaacacagaggugaaaaaugccaugaagcagcucuggagccaaau

SEQ ID NO: 13264 - RNA, 1057 nt, Homo sapiens
guccugugaacuuuccuucaaccuauucugcuccuucaguuuggacucaacagucauucuaaacccaaguaucaauacaaagacucagccucuauuucucauuuagucucaauguccuaauccacagccucuucauggccuuccucauuucagcauuucucagagaguagaugacaggguucaggaucgcgguuaucacuguguagaacacagccaccaucuugucuaugggcagagugguagaaggccucagagaguugaagacgcagggcccaaagaacaagauaaccacagcgaaaugggacccacagguggagagggcuuugcaccacccuucagagcuccagguucucagauggagcaagaugaccauauaggaugcuaagaggaccccaaaacugaucacagacagggugccuccauuggcaacaaucagcagaccaaugaggaaggugucagagcaggcaaguuugagaaggggaacuaggucacagaaauagugauugaucacauuggggccacagaagagcagguggaagaugagaaggauuugugcaaaggaaugcaugaagccucccacccaugcuauuccuacaaggacaguacacaccugccaguucaugauggugguguagcugaggggcuugcagauggccacauaguggucauaggccaucacagugagcaggaaaaucucagugccaccaaagaagugcaagaagaaaagcugugccaugcagccccaccaagauaugacuuuccuuucagccagcagaucugagaugaguuugggggcuguagcggaggaguagcagaucuccaugaaggagagguagcugaggaagaaguacaugggggaaccaaggcuucugcuggucaugacagugagcacaaugaggaaauuccccagcacaauugcuguguacaagaacagaaauaucacaaagcaaacccucugcaccuccugguugggagaaaguaccagaaaaaugaauucagucauguuguguauguuagccaagaggucaucaucaagaggcagcaauuuggguggugu

SEQ ID NO: 13265 - RNA, 192752 nt, Homo sapiens
gggaggggaagggagggggccgagcgcucgccgcggcucccugcagcagccccagccgcaugacgcgcggaggaggcagcgggagcagccgcgggagccgggaccggguagccgcgcgcugggggugggcgccgcucgcuccgccccgcgaagccccugcgcgcucagggacgcggcccccccgcggcagccgcgcuaggcuccggcguguggccgcggccgccgccgccgcugccaugucuccggggaagcccggggcgggcggagcggggacgaggcggaccggcuggcggaggaggaggcgaaggagacggcaggaggcggcgacgacggugcccgggcucgggcgcacggcggggcccgauucgcgcguccggggcacguuccagggcgcgcggggcaugaagccggcggcgcgggaggcgcggcugccuccgcgcucgcccgggcugcgcugggcgcugccgcugcugcugcugcugcugcgccugggccagguaagcgccgggugggcucgggcggggggcaggaggcuggggcgggacuggcauugacugcaccugcccgagcguacccccccgggggguuccggggaagggggcggggguccggauccccggauccccggaaggcgacuugcggggaccccggccggccucgcacgccggcgaucgaucccuuuuccggcugcccaggaucgggggagagaggcgggauccgggugccgcggugcccgagccucccggggaaagccuccgcgcgggcuccaggccgucccuggcccggcucuucccggcgcugggcacaucuggcgggcacgggcccggcuuccuagccggaggcggccggagggggcguguuugcggaggucuggggacgcagagccgggcggccuggcugagccuuugccgacagaccuccgacccggccugcaggggcccgaggggcggcgggggcgacagggcagggccaggcgcugggcaguggggcccugggcgaggcgcgggacuccgggccgagggcccuguuccuggggaaaguucccaggccggggaaaagguggccgcacgcuggcuuuucucaaggcagccggcccucuuggcgucgugcuugauuucauggguguuuaauucgugcuuugugggcgcuggcucccccuccccaccccacccucacccucuuuucuggcuucacuuuucagauaaugcugucccuggcguuuuggugaccgaccuuuccccuuccuggcauuuccauaggggcugaggcagagcagcugaaggggcauucccauuucacagauggggaacugagggagagaagugaaauagcggagcacccagcccgugccaugggagcugagccagcgggcacguccucuuagccucuggagccuguugggguuugaacccgcaggggaagcggucuagggcugccuugcugugcguuucugcaaaugaccaucuugcuuguuuuauacagacaccaucucugaggaaaugaguuauuggcuggggauggaaccugguuucagggaaaacuucuccagcgcgaauacaggagagagcagaagcaucacccuggggcagcaaugccgccuagcaggcuguaggagaagggggcuggggccugggggcugcgugacccucggcacccaagggucucuccucgcaguuuccccagcagguucugcacaggcucuccugggggccagaaggcaaugugaccuccugcagagaaccugggaguagaugucaggagacuggcuccagggccgggccacagggcuggacuugcucuucaggcuucucuacccucaguuaaccgcaucuguagaaugaguauagcacccucugcccaauggaauuguuugaggggcuuccacuggccaaugucuaaaagaacuuuguaaauauuaaggguuuccacaugggauucucauuauuaagguacagugccugugggggcugucuucucccuguccauguaaggaaauucagggaagcagugucugaaguuaaaaaagccuuguauuugaagauuucuuguaucaaaaguuuaugcuaaaacaaaaaccacaaaaaacagaaaacccccaaacuuaaagcuucauuuauuuuuaaauguauaauauauguaauuuuuuuuuugcuucagcaaaaaaauuuuaaauuauauauauauaaaauuuauuuauuuuugcuccagccauagugguugcuagcuguguucucaaucagcaaaaaguuucuuggguaaauuuauugcuugcucaauccuuccuuguauuucauuagcauauugccacucuacacuuguccuguauuuagauauuuccuuccucuaugguuuguucuguagaaccucaaaaggacucucuuauuucuuuuuuuuuuggacacauuaugaaauaggaagucuaaaaggcucccagaagaagcaucuucaaaauccacauucagcaguucauuuugauaauggauauuucagggaaucagugcauuuuugagcuggaccagacuuucaagacagcugaaaccccucagagcucuuagaugaggauauugauguccagagaagacagggagcaggcugaggucacccagcaagguauuagagaagacaagaugggaaccugggucaccggccugggccucauauuuucaaagugcuauuuuuuuuuuucccguguuuucacuuugaucuuacuuuuaaugauagggacguaucacugugucuucucaaaauggugggugugaauggaauuuuucaaaguugaaucaauuugagauauuucugaaguuuguuuaggaaacaaguaugugacuaccuuccuaagagcugacugguuuuuugaggccuggauuguguguguaugugcuuauguguguguuauaaaauggaaucaacuauaccagguuaaacaaauggacaagucauggaaaagacacagcucuguuuggacauuaauaagggcggguguggaagcuggaaagcugagaugccggaaggcucagugcuuaguaggcccggaaaagcaauuuuugaacuggcaucucauuccccuuuucuaagacaggaaggacggucagagaugauuccaacaugaggacuuugcuaguugcagugucugacuccucccauucucauagcaguuuugcacaguaguuuugguuuguguguauguuuuaggcaaugugacaaagcaguuuuccuccugccuccuugagaaauuuaauccugacagguucuuuaagaaaucagcuugaugugggcugauuuuaaaagaauaaaugaaaaaaaaaagcuggugacugauagcuguuuuauuggucuuguaguguuuugguuuuguuuuaucuucacuuucuuguuuccuggugaauaauaacuggguuuauuaucucucauggcuaauccuuaagccugauuccuuaccuguuccauccagaguacaaaguauauuuugacuccucuuuaaacugcuuguuagauucucauaugagugacuuuaaauauuuuuguuuugcuucaggacaacgggaaaaccaaacgauuauguuuuguuugcagacaguuuacgaaaacagcaaauugguuuaugguuagaccgugacuuugagcugacuucaaguugggccccacgauaaagauaaccauggaauacccaagcuuuccuaagcagagaggauccuggcuuccaaaugagcaauuuuggucagcaaagggguuauuuagcuccuaaaaguaauuuuugcuugagguuggggcugaggcagaguggcugaacaaccguaggccuggguguagccagaggaucaucaguaauuacuucucaguucauucacuucuugggcuagggaauuauuuugagugcaggauaagaggcaauuuucuguguguuucccuucuaauauaaugccacugaugauauuauaauuaauagguaacauuaugcaugacaggcacugugugcuaaggguuuuaaugcauuauuucauuuggccauuucagaaauaccaagagguaggugcuguucuuguuuauuuguuuguuuuuuuuuuugauagggagucccacucugucacccaggcuggagugcaauggugcaaucuuggcucaccgcaaccuccaccuccuggguucaagugauucucuuaccucagccucccgaguagcugggauuacaggcguaugccgccauaccuggcuacuuuuuguauuuuuaguagagaugggguuucaccauguuggccaggcuggucuugaacuccugaccguaggugaucugccugccuuggccucacaaagugcagggauuauaggcgugagccacugugcccggccuuuuuuuuuuuuugagaugaagucuagcucuguugccaggcuggaguacgguggugugaucuugguucacugcaaccuccgccuccuggguuccagggauucuccugccucagccucccaaguaccugggauuacaggcacgugccgccaugcccaguuaauuuuuggauuuuuauuagagacaggguuucagcauguuggccaggauggucuugaucuccugaccucaugaucugcccaccucggccucccaaaguguugggauuacaggcgugagccaccgugcccggccuguuuuuguuuuuaagagacagggucuugcuuugucacccaggcuggagugcagugguacaaacguaauucacugcaaucucaaccuccugggcucaagggcuccucucguuuuagccucucaaguaucugggacuaaaggcgugugcuaccauuccuggcuaauuuuuuuuuuuaauagagauggugucucgcuauguugcccagucuggucuugaaccucugggcucaagugaucugcccaccuuggcuccccaaaguguugggauuacaggcaugaaccacugcacccagccauguuuuuauuuuaucugagagaaaacugagguucagaacuuaacuguauacuucuggaaucuucacagagaaauaaaaaaaaagaaaaauaauuuacuauagauucauuaacuacuacguggcggagccagggcugaugucuccacugccccaauuuaccauccugugcuguaaaaagucauggagaagguuuucugugugcagcuaagagaggagguggcagacauuuauuuauuuauuuauuuauuuauuuauuuauuuauuuauuuauugagacgaagucucacucuguugccugggcuggagugcuguggcacgaucucggcucacugcaaccuccaucucccggguucaagcgauucuccugccucagccugcugaguagcugggauuacagacgugcgcuaccaugcgcagcuaauuuuuguauuuuuaguagagaugagguuucgccauguugaccaggcuggucuugaacucccaaccucaggugauccgcccaccucggccucccaaagugcugggauuacaggccugagccaccgcaccuggcccagacauuuuuuagacagucuugcuguguugcccaggcuggacucgaacuccuggguccaguugacaucccucuucauccuuccaaguagccaggacugcagggacaugcuaccuuuauuuuggguucuuuguguccuaaacccuguaugaucugcuccauuuguaacacagagaacccaggugcccucuuuccugcuuauauuucuuuggggccucaguuuacaaggcaagucugccuuuguggagauagacuggggucugggauggaaagaccuggguuugggucuuugcucugccacugcauaaacucagcaagucacuuaaccucugugacuucucauuuccuuaucuggaaaaugggacuaacacuuccugcuucacugggugguugagaggaucaaauaagauagaaaaggaauugcuacguaacaccuaaagcaaggcccaacugcuaguuguggcugcugcuguuacuuggagagaagaaaugaggccccagaucauuaguucauaugacaauuuuuucuuuuuuuaagacggagucucacucuguugcuuaggcuggagugcaguggcgugaucuccacuuacugcaaccuccgccucccggguucaagcaauucuacugccuuagucuccugaguagcugggacuacaggcacgcuccgucaugucuggcuaguuuuuguauuuuaguugagacgggguuucaccacauuggccaggcuggucuuuaacuccugaccucaggugauccaccugccuuggccucccaaagugcugggauuacagucugagccaccacgccuggcccauaugacaaauauuuaugaaguguuuuccacagaguaguauggaauaacucugggugugugcaagaugaacugagcucagucacaauacuuuuuuuuccccuaauguuaagaauuauuggcugggcagggugacucauuccuuuaaucucagcacuuuggaaggcagaggugggaggaucaggugagcccaggaguuugagaccagccuggaugacaaagugagaccuugucuauacaaaaaauuagcugggcauggugguguggaccuguggucccaccuacuugagaggcugaguugggaggauggcuugagcccugggagguugaagcugcggugaaccuugauagcgccacugcacuccaacccaggcaacagagugagacccugucucaaaaagaaaaaaaauaaaaaauaauuuauuuuagggggucuuaguaaagaaagacccccaaaaguccaugauuuuauaggucgaaugaggugaaaagugguaucaugauaaauaaauuuguuuaaauaucauaaaaaguuggucuaaagaaaaacauuggguaaauaauuaugugaguaugaugugguuaugaccaaauuguaaagaugaucaguuucuuaagucugggggacaggcacugagcagaggccgugguggggaacaggagccugucuucauggcucuuacuggccacugggcaagacucagauagcaccaaccaaccagucacaguugugauguaggaugugacugugaaugacaucccugcugcccgcuucagagaaagggcugccacuugccagagaaggaauggugauaaugagggacagccagucccuaaguggagaucccugaaaguggugaauaucuuagaccagagaagcccagagcaguuuuuuuaccaccuuguauggcugguuuuccaguggcuuuacuggugcccccucggaggacaggggcuguaggaaguuuguuauuacuuccuuauuagugacagcugcagucauccuauugucucagaauuucccuggcauguaaaugguaggauaagggguggugguaagcagauggggggcauuuugaaaacgaggcagugucagcucccacagaaggucuaauuuuaaacaugcaaauaauuuucaguuccacuuuuccuucuuccuguuagagggaaguuguccccuguugccauuucugaaacuugggcggacaaugucguuauuguguuacaaacgauuugcgucuccagggcaggaguugggugauauuuuucugggagccugugccagggcguagcccaguguuaucucaugguuucugagugaaugagugagugaguauuaaaacuucauaucaacauggagccuauaacacagugguucugaaucuuucuugggggggaaaagaagagauacaagaccccuagagaguauagagaguauguaaaagggaagaauccuuccccaaaagggaaugcacauauuuacaauauuguauccaauuucagaagguuuuuuuaaaauuuuuaauuuuauuguuuuuuuuuugagacacggucucaguuuguaccccagcguggagugcaguggcaugaucuuggaucucggcucacugcagccucugccuccugaccucaggugauccacccaccucggccucccacagugcugggauuacaggugugagccaccaugccugaccaugacuaguguuuugauguguggauuuacuacaauuuauuugaccauucuccuaucaauggacacuuuaguuguuuuaguacaccucccugucccgucacaaaucauacuuuguaauguuucugguggauauuucuuguaaccuucacaaguuuaucuguagaguaaauuucuaguuucaggauuacuggauuggaagaugcaugcauuuaaaagugugauugcuguugucagguuguccuccaaaaguguccccucaguuuguaccuguauccauagguuuggagagugucuguuucuccauaccgucucaucugaaaugaaaauuuuuacauguuugcuagucugaaaggugaaaaauuguaucuuguuuuuuuuuuuuuuuuuuuuuuuuuugagacggagucuugcucuguugcccaggcuggagugcaguggcgcugggcucacugcaagcuccgccucccagguucaugccauucuccugccucagccucccgaguagcugggacuacaggcgcccgccaccaagcccagcuaauuuuuuguauuuuuaguagagacgagguuucaccguguuagccaggauggucucgaucuccugaccuugugauccgcccgccucggccucccaaagugcugggauuacaggugugagccaccgcgccuggccguaucuuguuauuuuuauuuauaucuuuaauuuugaguuaguugaguuuuuuggucauuugccucugcuucuucuucuuuuuuuguuuucuuuuuuuuuuugagacagaguuuugcucuuguuguucaggcuggagugcaauggcgugaucuuggcucacugcaaccuccaccucccagguucaagugauucuccugccucagcuuucugaguagcugggauuacaggcgugugccaccacgcccagcuaauuuuuuguauuuuuaguagagaugggacuuguuccuuaggaaccauguuggccaggcuggucuugaacuccugaucucaggugacccaccugccucggccucccaaagugcugagauuacaggcgugagccacugugccaggccccauuuuuuguuuuuugguuaacucccuguucauuaaaaaaaaaaaaucuauaucuauagauagauagauauagauauaaucuuuguuaucaauuuguauaagcucuuuggaaauuaguccuucgauugucauuuguauugcaaacacauucccccucccccaugccaauuauuuuagauguagcacuuguuccuuaggaacucagagauaaauaagacccuaggguggugaagagagcauagaauuuggaacaagacuccuuuguuggagucuuggcucuaccaccucauuagcugugugaucuugggcagguaucuugaccuuucugauccuugcucuucauauuccaaaaaugcuaauaauaggaguaccucugacacaggguaguuggagaagcuaagugugaucauauuaugcuaaaauuccuuguaaauggcuauggaaacauaaacacagcauuuuauaaaauaccacgagguauuccauuuacugaagaguuacaucagaagaguauuucugauugugccacugcacuccagccugggcgacagacugagauuccaucucaaaaaacaaacaaacaaaaaacuagccagucauuuauaagaaugaguuacagcuauaggugcaggcgguaaauacucuccaagauaucuaaauaaauuaaaaggcuauguagagaacaauguauauauaauguuaccuuuaaagugacaaaaaaaggugaauauagauacuuguguaucagaagagagagguauuccauuuacugaagaguuagggcaaagaccauaauauuguaauuaucaauaauuaugaauugucaaaauuaugucaugaaaccucuuuuuuucuuuuuuuugagggggagucuugcucugucacccaggcuggauugcaguggugugauccugguucacugcaaccuuugccucugagguucaagugauucuucugccucagccugggauuacaagcaugcgccaccaugccuggcuaauuuuuguaguuuuaguagugacaggguuucaucauguuggccaggcuggucuggaacugcugaccucaagugaucugccugccuuggccucccaaaguguugggauuuuuuuuuuuuuuuuuuuggagacggagucucacccagucacccaggcuggaguucaguggcgcaaucuuggcucacugcaagcuccaccucccggguucacgccguucuccugccucagccuggcugggacuauaggcgcccgccacuaugccuggcuaauuuuuuuguauuuuuaguagagacaggguuucauuguguuagccaggauggucucaaucuccugaccucaugauccgcccgccucagccucccaaagugcugggauuacaggcaugagccaccgugaccggcggaaaguguugggauuacaggugugagccaccgcgcccggccccaugaaaccucuuauauuggguuugagauuaaauccacaauggauuguguguauuauauauacacacacagacacacgcaaauguauuaaaauguauaauaugaagcaguggaacuucccugauagcacaauuuaaauauuuccuuuuugacaaacgugcauaguuaaauaaauuaagugaccaccaggugugacugaagaguggccagugucuauuccuagccccgaaggagcacagggauauugacugugucccuuaaaaaaaacaaaacaaaacguagggcuuucuuuguauugguuugaacauuucucuuuaucuugugaccuggccaacucuggcuauggcugccuccugucucucgguacauuuucuguggcggucaagaggaguuauuuuaagccaccaaugggaaaguuuaaagacauaauccuuggcuguaauugcgggagacgggaggcugagagucugugcugacuugccaccuguuuccacggcagcaaggugauugugcauuuccugcugcuggcugaggggccagcaaauuuucaugucguugugucauggggaaguuuuccugucucaaugagagcacaccgugcuuguggucuuguuccugugaccaggacauggagaacuauggggagauuguucugggugugaagggaaauugcuggccagugcuuagugcacgggcuuuggagucagagccaacuucuccaccuccuaccugugugaccuugggccuauccuucuaaugcuuggagucucuucuguccucaucuguaugauggggauaacaagaauaccuacuuuauaggauugcuguggaggauuaaauggaucugcaugacaaaugcuuagcaugaaaaaaucccucaacagauauuggcugcuauuuuauuaucuuauugugcugagacacuggcauaauuuacaauucaaaaauuaaauuuuuuuaaucuuauacuguaguuuacaaggcccuuucacauauaugagcuuguucaauccucacagcguccuugaguuugucauuguuauugccauuuaaaaagguaugacucagaguggcuguaauugacuuguccaauucagguuucaucugucuuuugcagaauaauaaucauguacguucauaguauaggccaccucuuuuuuuuuuuguuuuuuaagacauagucucgcccugucacccaggcuggagugcaguggugcgaucucagcucacuguaaccuccgccuucuggguucaagcgauucuugugccucagccuccugaguagcuggcauuacaggagcccgcccaccaugccuagcuaauuuuuguauuuuuaguagagacaggguuucaccauguuggccaggcuggucuggaacuccugaccuugugaucugccugccuuggccucccaaagugcuggaauuacaggugugagucaccgcgcccaaguauaggccacuuuuaagaauuacucagaguuagcuuauaagaggcgaaucaguggaguccuccaguuugguucacacauaauuauuagguugaaccauauaaaguuacuguuuuugguccugugaauauuaguauuuauauaugguuccaaucugauauguuccagaaaauacacacuuaaguaaaguuuggaaaaccaaaucauagacuuacauacuguaaggcgguguauuugaaacugggauguaaaaucaauuuagugaguuaugaccugcauuaaaaaaaugguagaauaucagaguuugcugguaaguauuguaaaaauaccagaguuugcuggugaguauuguccauuucaguuauauaugugcgcacgugugugugguguguauguguguauacuaaauugcauauaaaaugaauuucuuaucauggguucaccuguugccagaaaacacuggaagucacuguuccagggaauggaaugguggaagaugccuggugggggauggagguggauucuguuuccagacacaguaaaaaaaaccaguauaaaguccccaauuaugcauugucagugucucuauguguagcuggaaaccauuccugcagcagguaagcaggaagaaccaaauugucgagaggcacuucaggaagggaagugggccgacugaaagcuuuggaggccugccuuuaaguagcugcuuuucuggaaacuucagggugaccagccuagugaacaagcuaugggucagcguuguguguuccuuugguaaauggauuugguagagagcuaacacuacugcauuuguaguuuauuuguuuguuuguuuucuuuuugagacgagucucacucugucacccaggcuggagugcaguguugcgaucucggcucccugcagccuccaccuccuggguuuaagugauccuccugccucagccuccugagaagcugggauuacagaugugcaccaccacacccagcuaguuuuuguauuuuuaguagagacgggguuucaucauguuggccaggcugguguugaacucccgaccucaagugauccucccaucuuggccucccaaagugcuggggcuauagggcugagucaccguacccagccugcgucuguaguuuaaaugauaacuuaaugaccaccauccaguagcugaggcucuaagagggaggucugaauagugggugacucagcucagcccugccugaccucuagcucuaggcugugcugucucuaggcuccggcacugauuugcaugggccugaaugaaccuucuggagauuguuagcccaacuggcugaaggauccugauccccagguuaauuugauucccaucaaacaguucauuuuuuuuuuuuuuugagaggcagucucgcucuguugcccaggcuggagugcgguggugggaucuuggcccacugcaagcucugccucccggguucaagcaguucuccugccucugccuccuggguucaagcaguucuccugccucagccuccugaguagcugggacuauaugugcaggccgccacacccggcuaguuuuuuguauuuuaguagagacgggguuucaccauguuuuccaggcuggucgugaacucuugagcuccggcaauccacccgcugcagucucccaaagugcugggauuacaguugugagccacugugccuggccuuuuuuuuuuuuuaauauaaaaaaauugaaaauacagauaaaaggaaacaaaauuaccuguaaucuccacucauccagguuaacuccugguaccuuuuugaugcgauuucuuugucuuuuuaaaugcauguucugucuauuuauacuacaauaggauaaccuccuacaugugcuuuguaacuuacaucuuuuaauuuuuaacaguugaggugggccgggcaccguggcucauaccuguaaucucagcaccuugggaggccaaggcaggcggauugccugagcucaggaguuagagaccacccugagcaacauggugaaacccugucucuacuaaaauacaaaaaauuagugguggugcacgcuuguggucccagcuguuugggaggcugaggcaugagcaucacuugagcccuggagguggagguugcuugaguccuggaggcggagugagccaagauugcgccacugcacuucagcuugggcugcagggugagauucugucucaaaaaaauaaauaaauaaauaaauaaaauaaaaaaacaauugagguggaugucucccuagggguaccccaggaagccacaggauaaaaagcaggcaucuugcuggagggucucuguugcucaguagaaauuauuuuguaauguuuuuugaaaaccacaaacauggacauauuauggacuggauaccacauuugcaucaggauuuuuuuuucaaccaguacaguacauaacaaagaaaucucuacccugcagacccucugggggugugagagcgcuccuugcuauucucagggucaauguauggcaaucugugaaggacugacaauauauugcaaacguuucccccugccaguaaauauucuucuuuuguauaacuguuagcuguugcauccauuccauuauguggagguaccuuaauuuaucuaauaaguccugugauuagucuuauaguuuguuuucaaaauuuuuuuugucacgauaggcccuauucaguugacuuugugaucagcucugaacauauaaucuggugauugccuuaagauaaauugaauaauaaaaguaacaauaguagcuaccaucgguugaauauuuaucaucaacuguugugagcacguuguacauauuaacucauuuaauccuaugacguagguauagggaaggaaacugaggcucagaaccucugccagcuaguugugggcuuccuuugaggcacaggggagcugaaugggagggucuacauaggacagggcgugucugaguccaggaaggacagcuggacuugggccagucucacaggugggaaggcugucuuucugugaggaugggugacuuguugaccuuugauccucagagcccugaugcagcaggagugaaaugauucccagagccacagaaaacaagaguaucuuugucuuggauuuuagauccuggagcuaucaggugguaagaaggcugucugacccagauuaagugaugucaugguaucauguuggggugugggccuuccuguuguaaauuauuugggauuucauagagaucgaagucauguguggaugacaugacuucaggaugucccauuagaagaggaacgugggggucaggcgugguggcucacgccaguagucccagcacuuugggaggcugaggcgggcggaucacgaggucaggaguucaggaccagccugaccaacauggugaaacccugucucuacuaaaaauacaaaaauuaacagggugugguggcacaugccuguaaucccagcuacucgggaggcugaggcaggagaagugcuugagcccgggaggcacagguuguggugaccugagauugugccauugcacuucagccugggcaacaagaaugaaacuccaucuccaaaaaaaaaaaaggcugggugcgguggcuuacgccuguaaucccagcacuaugggaggccaaggcggguggaucacaaggucaggagaucgagaccauccuggcuaacacggugaaaccccaucucuacuaaaaauacaaaaaaaauuagcugggcaugguggugggugcauguagucccagcuacucgggaggcugaggcaggagaauggcgugaacccgggaggcggagcuugcagugagccaagaucgcaccacugcacuccagccugggggacagagcgagacucugucucaaaaaaaaaaaaaaaaaaaaaagaggaacuugggaaagagcaugggcuuuggugucagcagaagcauguguccaguuccaugcucuucccuuauagcugugugacccugcuaucugcacagggacuugagccucucagaaucuguuacugcaucuggaaaauggaaaucuggaaaugucacugcaucuguagcaacaaccaggccauuuuguuacuagguuuaagugagggaaggcauguaaggcacucaguccagaucauggcacuuaguaggccugagcacauuugcucccaccucagugaccuccuuguuaacacgacaucuccugacuuuggggcugcagagugaugcagagcacuggccaguguugccaugcacccagggugcagggagaccugucuugcagguguucaaacaacuuuugucagccucagugucagggacuuuuguugcguagagcagucaccaaauccuauggugagaagagaaaucguuggagaugggggugcagggguggaagcucuuauuucagaagaccuguugugagguaagacucagacccucagcuucuauccggccacagaguuugggaccagccuuucgaugucuuuuggaagaugcacauggaaugcuuagccuuugcucuucccuggaaccuggcuuaggcuuugcaccuaucccaccaugugguuggggugagugaggacaacuucuuuuccuccagaacaugguuucuccaucucagcccuauugacauuuugggcuggauaacucgcuguuuugggaggcuguccugugugccccguaggauguccugcagccucccuggccucugccugcuaggagccaguagcgcccccucccccacagacaaaaaugucuccagauauuggcagauguccccuaaagggcaaacuacccuugcuguagguaauacuugcuuugaaguacugguguggauggccuaugcccuggcagucuuacuaggugggacuggcuguccucucauucucaugggauuggccucaugcugguagcugacuuccuccccgugagaccguaggucuaaacuaacaagguuuacacaugugacaaacauccagguugccagggcucaaaagaggguucacaucgacucccuucucauucacugaguccuuuuucgggagcuuuggccgaguuugugcugcgucugggcaucuaggugucgaguucuucccuaguguuuucagccucggcuuccuccucuguaaaaugggaguaacugauacuuuuccugucugggugggaaaggaaccccgugcuaaugugauugaugguguggugcuaagcucugcugcaagggaugugaaguugagggaaagguuuaccauuuauuaggagcuuugagaccaaguuccuuccacacaagagauaugcccugucaaagggagaucccauugcaaagagauucacugccaaguucccccucccacuagcucccuggagcaauuuucagcuuuuagaguguuuagaggccucaggguguaaagcgagagagagaaugccuuccagccagcgagagagaaugccuuccagccggugacauugagaauagcaggaaagaggcagaagaagaaacugacuugaagggugaugccagccaggggugaguggagugagguaggauuugcuuucugaaaacugggaugugcacacaaccuaucaagaauacuucacuuugugaggcccaaaaacagcuccuagcacaguguagagcagacuuggucagaacuucaauccuugauuuuuuuuuuuuuuuaacccgaauuucaugagguuuuucugagacauccacuggacugucauauaccgugugcugggcucucauuuuauccuuacaauuauuauguucauuuuaaagaccucauguuagcuagaucaguagggugacuacaguuuacaguaaucuacuguauauuucaaaauagcuagaagagaacaauuugguucuagcauaaagaaaagacaaauauuuaaggugauacauaucccaaguacauugauuugaucuuuacaaauugugugaauguauuaaauuaccacaugugcuccaaaacuguguucuugaaaaaauuaucacgcccauuuuagagaugaggcacagagagguggagggacuugcccagauccagguauguggcucuccuguaaucucgcuucuauugcuuugugaucagcagcaacuuaguagcuuucaaagcuucaauuuucuugugugccaaauggggcuaauaaauaccuuagaggauugugaucaagauuccgugaaaaaauguaugcagugcccccggcaaggugccuggcauacagaaagugcucuguacgcaccagcugcugucauuauuauuguuucaacuaccagugaucauaaaggaugccugcuuugaugagcuuuuccaggaauauggacuggucugcccugaucuacuugaauaaucugucucaggcccuauucgguaaauacauguaggaggugcagcugccagggaagggagggauguuaccuggagaggacagagucugaaguucaggaaauacagcaagagccuuccucagggaugaaacaugugaucuuauggucugacuagccucaagccagcugagcucauugccaugcaacuugguaguuaaugauugcuaguaagaaguuuaaaaggaucauccccucaaagaaugucagaguuggaaaagaccuuagggacauuaggcuaggaaagacaauguccuagugagugacugcuugggcccuguauagaagggauucucagaucacuugggauguccuggcucagcaggaggcuaaggugggaucaauuagugaugucugccauggccacaagagaggcaaggaguggcacaugugcuguuuauuugcugucuuuggcugcagcugaggacacugaggcccaagacuugcuugcuuacuggacgaucacccaagucauuaaaccacaaaaaucucuuuuggaaggaaucuguuaagaaugucugauuauaagaguugcaccuuugagcaaguauuuuuugcuugauagucuucagugaggaggaacugucuucaaagagcacauucugucuuuuggcaauucucccaauuagaacuuagaccacugagguagaaaggccuuagaagccccuuuaagugggcucuucucaacuggggcugcaccugagaagcuuuuggaaaauaccaguuggaggcucccuccccagaccaguggauucuggauaucuggguguauggacaccucuugcccccauugguguuuuauuuuccaagcuccucauguguuguuaauauguagccaggguugagaaccacugagaccaaaacucuuuggaaacagagacccagaaagggagaacaugauugucuauggguauguagggcuaguggcacaaggagaaggaaaacuaggggggaaaaggccuuuaucaaaugccacccauaugcuagucucuuuuacuuucaugccgagauucuucuuuuuuuuuuugagucagagucucgcucugucacccaggcuggagugcaguggugcgaucucggcucacugcaaccuccgccuucugggcucaagugauucucuugccucagccuccugaguaucugggaguacaggcuugugccaccacagcuggcuaaauuuuuuguauuuuuaguagagaugggguuucaccauguuggccaggcuggucuugcccuccucaccucagcugaucugccugccuuggccucccaaagugcugguaugccuggcccuuuuuuuuuuuuuuuuuugagauagggucguguucuguugcccaggcuggagugcaguggugugaucacagcucauugcagccucaacuuccugggcucaagcgauccuccuaccuuaccugccugaguagcugggacuacagaugugugccaccucuccuggguaauuuuaaaauuuuuuuuuuguagagaugggggucucacuauguugccacagcuggccuccaaguccugggcucaaacgauccucccgucuuggccucccaaagugcuaagauuauaggugcaagccaccucuccuggcuugcuucuuucccguaaauugagguguguuauuccacugcuuaaaagccuacauggcuucauaucgcuguuaguauaaacccaaacaguggucugcaagacucugaaccuuagaucaggaugaucagaccccucccuccccuccacccuccgaccucauccuggcuacccacucccuguucacagacuacagucaccuggcucuaguacaacagacacuugaaccuaccccgccccucucccucagggccugguacuauccuccucgcuccuucuuaucacucaggccccucuaucccaucauccuccuucauuuccucccauccuuaucaccuacucauuucugucugucuccccaccucuuggauuaugaguucaggggagugggacccccuaugucugauuuccuuauguguaggacagagcgugccucaaaagcaugcuugcuuggugaaugaauugaaagaaccacccugacauggagcugguauuauccacagguuacaauggacuggaccuccucuuccagucccauauaauuuuuuuuuuuuuuuuuuuuuuuuaaauuuugagacagagucucacucugucgcccaggcucgaguacaguggugaucuugguuuacugcaaccucugccucccagguucaagcaauucucgguccucagccuccccaguaguugggacuacaggcaugugccauuacaccuagcuaguuuuuguguuuucguagaaacaagguuucaccauguuugccaggcuggucuugaacuccuggacuuaagugaucugccugccuuggcaucccaaaguggugagauuacaggcaugagccauuguaccuggccccauaucacuucuuauuaucucauaauauucuuaccuuuugcagugacagccccaaaguguguguguguguguguguguguguguguguguguguguguguuugggguggggaucauaauaauccugcaggugggguuuagcucuggugaaaagagcacagauccuuugauuuggguuugaaucccagcacuuccucuuacuaagcugugugaucuugggacauuacuaaccucugugagguucaguuuuucuuggcugcaaaauguaagcacaauacuaauaaguaacugacagaugcugugcuucugccagacacuguacccagugcuuuguguguauuggcugagugaauccucaugacacccuaaugagguaggucucuucucuucuugcuuucauuuuacaggagaggaaaaugagaugcagagaagcuaagcaaccagccugaggccacacagccaaucaguugagagucagaguucaagccuaggcugcuugcugccagagucagaguguuagguaggacuuuaugaaaucaugcccacaggccccggaacagguaguggugcagacacuugguaaaccguaguuaccccucccacuuugacauuuacucuccuggugacauuuaaguuuucugacuguuuuguuguucaaguuggugacaaaaguaccaauuuccugccugcucacuuccaaacacagcuucuguugaugagaacuaagggaguacaacuuuucaggccgggggugugcaugguguuuugggccuuggugcucaggaagugugggcacucccuuaaauuuuuuaaaugggcaaaugagugcauuuuccuauuuaaauuuuuuuuuuuuuuuuuuugagacagagucucgcucugucacccaggcuggagugcgguggcgccaucucagcucacugcaaccucugcuucccggguucaagugauucuugugccucagccucccgaguagcugggauuacaggaggcugccgccacaccuggcuaguuuuuguguuuuuaguagagaugggguuucaccauguuggccaggauggucuggaacuccugaccucaacugaucugcccaccucggccucccaaaaugcugggauuacaggcaugagccaccaugccuagccucacucccuuaaauuuuuaaaauggguaaaugagugcauuuucccauuugaaacauuuucugcuucaaauccuuauugagcacuuugugcuaggcauugugacuaugaucaguauaaaaaccccaagaaaacaaaaaaacaaaaacaguaauucacuguccugucacccccaacucaucaauccuuugcuuuuccauaacugguuaccugggugcuuuucuucguugugauuauuuuuuauuggaaaugcagauuugugacugugaugggccugaggucaggucaccuugcugaggcgaguuuccugggcggcuuugcccuguuuugauaaacagaagaaugagcagcuggagcugcauuucaaguggcugcuuuaguugaggcaggcaggccucaguguuuaugugacaccgagcagcuucaaaaugagcuuggucauuuaaaaaaauuuauuuuuuccuaguuagguaacagugguauaacaacauuaaaagaaauguagaaacuagagaaaggaaaaaaaaaagcccuuuaucccccccaucacaaaacuauuauaauuucaaaauaguuacaaguacaauguauuccaaguggcuucuuauuuaagauaauuauauucacagagcagggaccguuucagguccuuuaaugcugaaaggcuaaauaaagagaacuuuuuauuuuuuccauguuaauacauggaugauauuaaccaugauguuuaauagcuacagaauacugcaugaaauggauguacuauaauucauuuagccuuuuucguauuuagagauuuaagcaguagccaauuuuucaccauuacaaguggugcaaggaccaauaucuucaugaauacagcauuuucuguaaagcagaaauucuuucuucaggauuaauuuccagauaucuuucugguauuagacacauaccacuugccuaauaacguuccaaaaggaauucauuguuuacauugcuauuagaacauaugagauugccuguuucauuauguccgucccagcacuggguauuaucauuaaaaaaaaaagauuuuaaauuuauuuauugaguuauuuacuugagacagaguuuugcuugucucccaggcuggagugcuguggcacgaucuugguucacugcaacguccgccucccagguucaagcgauucuccugccucagccuuccaaauagcugggauuauaggcacccaccaccaugcccagcuaauuuuuguauuuguaguaaagaugggguuucaucaugauggccaggcuggucucgaacuccugaccacagaugauccacccaccuuggcuccucaaaguguugggauuacaggcgugagccaccgugcccagccaauauuuuaaauuuaauguuuacauuugcacacaugccaauugggcuucaugguggcugccucacaccacuuuuuguccgugugugagacucacauagaggcuguuuucugugauccuuuuuuaaaaaauaauuacauuuuuuuaaugcucagggaaaaugucaaauaauuguuuauguuuuguacugaaaucugcacuggucugaugguacccagaaaaacucuuaacuguagccagaaaccagcugagccuaguuguaugcaaccugacugcaaaggucaucaggugcucucauuuuauuuuuagagcuauauuuuagcucuaacgugauuguugggugaacacuugcagaaugaaauaugacugacaccuaccagcugucuacacauuccugguuauaucuuaggaaggcagugugugcuagcaccuugggaagagaauguugaguucaaauccuaguuuugccccuugcaccaauaccuugaucagauuccuccccugcguccucccuacccuuucuucaacuucacaccuuaguuucuuuacuuguaaauuggguugauagugggcugcugucagaauuaaggacaucguuuugucaaggauuuugcauacaggaagucauggugacagcuguuguuacuguuguccugaggaguggggacaggagaggaggaaaacaggcugguccaggugucuuuccuuaaaggaggcuccagcuuaguuggggagauagaugggcuggucagaguuucaagucauaggcagugcaggccucaaaggaacagccaggacuugagacaagaaucaggccaagugaguaacuguugcugcuguggcagugaauguuagcagcccaggccugcaggggggaagacucauuugggguacagugagaggucuugcugggcaaaugcaggguguuugcggcaagguaggcuggggcuggacuuggaggaugccugcgugauuuagauucuaucuuguagagaaugagguaucauggaaggauuuucuuuucauguuguaaauauuaaucauuuuauuguuuuguauuuuugauggcaauauaaaaauaccagcuuuguugagauauaauuuacauacaguaaaauucauccauuuagaaaguauacaguucaaagcugggcgcaguggcucaugccuguaaucucagcacuuugggaggcugagguggguggaucacuugaggucaggaguucaagaucagcauggccaacaugaugaaaccccgucucuacuaaaaauacaaaaauuagccaggcaugguggugggugccucuaaucccaccugcuugcgaggcugaggcuggagaaucacuugaaccugggagguggagguugcagugagcagagaucaugccacugcacuccagccuggacgacagagugagacucuaucuuaaaaaaaaaaaaagcauacaguucaguuguuuuuaguauauucagaauugugcaaccaucacugcugucuaguuccagaauauuuucguuacucacaaaagaaaccccaugcccacgagugcucacuccugauuucucccucccccaccuccuggcaaccaccaauuugcuuucuguuucugugaauuuaccuguucuauguauuucaugugaguagaaucauacacuguguguccuuuugauucuggcuauuucgccuagcauaguguuuucaagguccauccauguuggagcagguaucacugcuuuguucuuuuuuuauggcugaaugauauuucaucacagagagauaccauguuuuguuuauccuuuuaugagcugauggucguuugggucauuucuacuuuuuggcuauugugagugacacugcuaugaacguuugucuaccaguguuuguguggccacggguuuucaaugugggaggauuuugaacuggggagugguguuuggagccuuuggguggggugggcugugaggagccugugugugugucugcccuuacugggcuggguuuagggcaagcuucaugugcuuccuuucuuuuaagggacucucugagacaggguuauuauccccuuuuugcagaugagggcacucaggcucagugagguuaaauaagcugcauggcuagacaauggcagauagcagcccuguccggcucuuagccagcuugcagccaccugccccugcugggccaggcgauugcaguggucuuggcugggaggggcccagaggcuguguggugcuggagagaggcagcaggcuggaccugguugggcaaggcugagugguugugggauaagaggagauguuucagagcagcacccacagaaccgcugugaugggagaaacaagacuucgaguuaggagaguggguuggacucuuggugcagccuaugugaccuugggcugaucuugucucuuuugagcaucacuuuccucaucuggaaccuggggcucuuguggcuuccugccucucucaagggugauucgggaggaagagugggagagagagagagagagggagaggauggaggcgagagagguggagugggaaaggagggcagaaucugcuagaaccugcagagcucauaaucuaggggcggggagggacaugcagcaggugcaggcaggugugggaggaaguagccuggucaucuggauggacaucccugcccauucagagaagcucugaacccugcaaaagcucccacguggaggccagugagcugguuauaauccagagacugucaguuuuuccuaguacauauuuggaccugagccuuuguuucugcaaagagucugguacugacucacacagugucagcagcccccuuccauccccuggcacaccccucccucauuccuacugagcauuaccuuaaaaccagugaggucuuucugggucuuaaaggucacccaguguccuugccuaucugggccugucucuguucaaguggcaaggcggaccauccccuuuaucacugacuugcagcuugccuggguuuuguaaaaagcuugucauugccaguuagaaaauaaagacagaaaccuccccuuuggcauugguaucgugaugacuugcucuuguucugacucuauuuugcuggcuuguuaugagucagucauuuuuuuuuaaugaaaugaauaccuuugucuuaauaugaagcuaggcauauaugauaaagguuagaugauuuuucaaauaugaaaucagaauucuacccauacucccaaauuagagagcagucugauguguuccccuuuacugugaccaguggcuucauaggggaccuaguuaugaguccuguuucuuuuuuuuuucuuuuuuuauuuugagacugagucucgcuuugucucccaggcuggagugcaguggcgcaaucucugcucacugcaagcuccgccucccggguucacgccauucuccugccucagccucccgaguagcugggacuacaggugccugccaccacgcccggcuaauuuuuuguauuuuuuuuuuuuuuaguagagauggguuuucaccauguuagccagguuggucucgaucuccugacgucgugauccgcccaccucggccucccaaagugcugggauuacaggcaugagccaccacacggggccaggccuuuuucuuuucuuuuuuuuuuccucacugugucacccagacuguagugcaguggcacaaucuuggugcaaccuccgucucccagguucaagcgauucuugugccucagccuccugaguagcugggauuacaagcaugugccaccacaccuggcuaauuuuucuauuuuuagcagagaugggguuuugccaugcuggccagggugaucuugaacuccagaccucaagugaucugcccgccucccagaaugcugggauuacaggugugagccacugcacccggcugaggccuuuuucuucugugcguuccugcugucuucccuccaggcagcagcaagcugguaggagcuguacuugugaguugacaucaugauguacagucacuggucacuuauaaaacugggcaggcccagagcaggaagggucauugagggucaucuaaugcaaaccguuuacuuuagagauguugaaaccaaggcgcagagaggggaagugacuugcccaagaccacacagcuaauaucacugugagcccagguuccuggcuccaguuccugguucuuucugcccccuucuucccgacacuaaagauacaguggugagcacacaggguauucaguaacguaucuauuuuugaccuguuuuuaauggaggcugaauugggcuuuuaggguugaguucugacacgugccaggugaucugcuggagggaaaucuguuacuucuggggaagaguugaaggugucuucugaacucuggaaucuguuuugaggggaggcugagcccaugcguggacccuuaggcugagcccaugccugcuucagauguuccacaccuuucaccacaauuuauuuauuuauuuauuuuuugagacggagucucgcucuguggcccaggcuggagugcaguggcgugaucuuggcucacugcaaccuccgccuccuggguuuaagcaauucucugccucauccucccgaguagcagggauuacaggcaugugccaccacgcccagcuaauuuuuguauuuuuaguagagacgggguuucaccaucuuggccaggcuggucuugaacuucugaccucgugauccaacugccucggccucccaaagugcugggauuacaggcgugagccaccaugccuggccuauuuauuuauuuuuuauuuuuuugaguugaaguuuugcucuuguugcccaggcuggagugcaaugguguggucuuggcucacugcaaccuccgccucccagguucaagcgauucuccugccucagucucccaaguagcugagauuacaggcaugcgccaccacgcccggcuaauuuuuguauuuuucauagaggugggguuucaccauguuggccaggcugaucuagaacuccugaucucaggugauccacccaccucagcuucccaaagugcuaggauuacagucgugagccaccaugccuggccacaccccgguuuauugcauuugcuucuaauagagaaaucaacccaguaaacaaaugaauuauuguuagcaaaacugggggguggguugggaaaggaaaguaguuccuucuauaauaaaacuugcugauauuucguugaaagucauugucuuacucauccuuguauaagauaagucacacaaugagugguaucaggguugcaggguuucccccugugaggacacaaugggaugaaccgugugugggauggucuguuaaagaaaaacaagaagccauguguuggaaacaaccuaaguauugagcgguggaggauugcugaaauuguggacuacuaugcagucauuaccaacgcacugaaaaaauguuccaugauauggcaggauguuuaugcuauaagaaauuuaaagacgcgagcuucaaaguaaaguauaaaccuaauuuggucaaacaggcugggcgcaguggcucacgacuguaauccuagcacuuugggaggccgaggcaggugggucguuggaggucaggaguucgagaccauccuggccaguauggcgagaccccaucucuacuaaaaauacaaaaacuagcuggguaugguggcucaugccuguaaucccagcuacucaggggucugaggcagaaggaucacuugaaccugggaggcggaggguguagcgagccgagauugugccacugcacuccagccugggcaauagagcgagacucugucucaaaaaaaaaauauugguuaaagaaacaaacguuagacuugaagccgugcuuuauauggauauguggugcacuauaauguggugcuuaaaaagcaacuuaggcagaccugggccaagucugggcucugccacguaacugcuaugugccccugggcaagucacuggaucuuucccaguucaggcuucucagcuguuaagugggacuaguaccuuaucucuuuggguuguugugagaauuaaaugagcuaucugggcuuucagagaaagggcuucaugugccguggcucugaucagaccaaacaaguuaucuacugcucuaagccaucaaggccccccaugccuguuggauacuguugaguuauuuggguuggcauguagugcagcguuucuggacauacauacucuggggacuccccaucccaaauuucuuacagucucuccagugugccacacgcuuucuugccacuagguccuugcaugugauggaguaacucuuguaccucugucucccuaaauagacgggguucuccaaggacaucgugccacagggccugguaacccaguaggugcucaguaauuuauuuauuuauuuauuuuuuuugagacagagucuagcucugucgcccaggcuggaguagaguggcguuaucacggcucacugcaaccucccacucccagcuucaagcaguccuccugccucagccuccugaguagcugggauuacaggcgggugccaccacgcccggcuuauuuuuuauauuuuuaguagagauaggguuucgccauguuggccaggcuggucucaaacuccugaccucaagugauccgcccgucucagccucccaaagugcugggauuacagggugaaccacugcgcggcccauuaggugcucaguaauuuguugaaugaauugaagacaugggacuugaguuaggcuuuuauuauuauuauuauuuuuugagacggagucucacucugucacccagucugggagugcaguggcgugaucuuggcgcacugcaaccuccgccuccuggguucaagugauucuccugucuuagcuucuugaguagcugggauuacaggcaugccaccacgcccagguaauuuuuguauuuuuaguagagaugagguuucaucauguuggccaggcuggucucgaacuccugaccucaggugauccaccugccuuggccuccuaaagugcuggaaauauaggugugagccaccaugccuggccuauuauuauuauuauuauuauuauuuuggagauaggguuuuucuguguggcucaggcuggacuugaauuccugagcccaagucauccuuccgcuucagccaauugaguagcugggauuacaggugcacugucccucccagcaaguugggucuuuaaauaaagagugggguuuggugagcagggugggugcacuguucuaggaggugggcaggacagaggucagugguggucccuacugccuauucagggaccagggccccugggcaaaggcagagauaacauuggcacaaucugccuuucagcuuucauugucaugcgggagucaccaugcuuuguaagacauuuaaucuauaagacuugauuaguuuugcuaccuuucauagcuuggggcuguguaugccuguuuguaagagagauccauccagaucaagccugugcagcaauaauguaugugcacaaggccucuuguguugugcugaugguaagauaggagcuggacuuggaggcaggagguggccuggguucuguuucuggacuuaccacuuacuagacggguacucuugaguggagucacuuaagaaaguaaugccgaucaggggcucagagugucccaaguguuuucucuugccuuauucucauuaaacagaaguacagcucagaauaugaugggccagucuuaugugauugguguuaauaaggcaguagagaguuggggguacucuggcagaccaugagaaccugcccuguuugaaggagaaugcugccuccucuuccuccuuuuaaaauucacacauaugaugcucacuaagugucuggcacccuuuuuucuuuuucuuuuuggggcagagucuugcucuguugcccaggcuggagugcaguagcacaaacacaccucacuuacugcagccucaaacucccuggcuuuaagugauccucccaccucagccuuccaaguaucugggaccacaggcacaugucaccacaccuggcuaauuaaaaacauuuuuuuguagaaaugaggucuuaccaggucgcccaggcugaucgugaacuccugggcucaggugauccuccugucuuggccucccaaagugcugacauuauaggugugagccacugugccccgccucaguuuuuaaaaauacuugcuuaaggagagagcacugaaggaagauuuagaucugcucuguugaagugacagaguacggugguuuccauuuaugcguauuuuguaguucggauggcuucuuguggggaguccugugaguucacacuugggggcauggugugggggaccugugaaguggguguucuggggugagugcgaugcuagucacugucccaguuuucuucucauuucuuuuuuugugagugcuuggcuaguggcagccuugcagaucagcuaguuuugacccacauccucccucuaaguggugcucauugaauugagccacagccccaaggucauguuuucaagguuggcauuugggaggccuugucagaaggucuuauaccauauuccagucacccaaagugcugcccgccaugccuguucguucagcaggauuucccugagcaccugcucugugccaagcccuaugcuaagcaccaagggaguaaauauggagggcaguguccccagaguccaggaacucgugaucuagucggggaggagagggguaccuacucugucuuuuacacagcaaguguaaccucugaagaaugauguuccaggaggcaagagcaacccuggcggacugguggagcugggaagggaaagaugcuucuggaggggccuugggagaagaguccuccagggugagccccuugagagagguuucagagcucucauccaucuucauauccuggcacuuagcccaggcacuaaaauuugcauauuuuugauggcaauuaaaaaaauacuagcuuuacugagauauaauucacauacaguaaaauucacccauuuaaaaaguauacaguucaagguuaggcacgguagcucaugccuguaaucccagcacuuugggaggcugaggcagguggaucaccugaggucaggagcuugagaccaaccuggccaacaucgugaaaccccaucucuacuaaaaauacaaaaauuaaccgggugugguggugugugccuguaaucguagcuacuugggagguggagacaggagaauuucuugaaccgggugggggaaguugcagugggcugagauugugccacugcacuccagccugggcaacagagugagacucugugucaaaaaaaaaaaaaaaaaaaagguuccauucaagaugucaagccccacgggacugaggguaacaugaggguaacagacaggugauguuaaauuccauuugggcucauguucacccccaggccccuuauuuucuuucaaacacauggaaugggcauuuagaacuaggaagaucaugaaucugguggcuguguagaugccauaccagguauggaccacaggcuuggagcgcagcagcauacaggggucagaggucaaggccaguggucuaucagaacccaguuccugcaggagccagugccgguacuagguagacucagaugacugaaugguccucgggaucugaaggccagugggggagaugaggccuggccucccggaagugcucaguaaacauuuguuaaucauuuccugccuagggaagcucugugguaugcucaggagaaucuugcuucucaugggggaaugggugguugucauuuggguggccugacugccagccugcuugcuggcucucugggaguuggggugguggcaucaaccugcagaggcggggcaguggggcagcucacggcuguguggguaaguaagcagugagcacagugagggagcuguugccaggagccucuuggcuuagugagccaagcagaaccaugugaugcacccugugggcggccaccuggggacucaggacaugcacccagaucccuccuccccuacccacuucaaagaaagugcugcccucccaguggugaugaagaccuuccgcuggccccagccucugggaucuggccuuuacuuggguauucauguggcccuggggguuggcuuugcugaaguugggcagagcagguggguucuggaaugugcaggggcaaccagaguguccaucuguuugggugaagccagcuguuuaggucugaaggaucuguuugauuuuuagaaacaugauguguuccagaguuaguaggugguggugauggaggguauuggcgugaagaguguggaugcucuucguuccuuugcuguuuugggacuaucucucuaugggguaguggccccuuuccuuguuaggaucauuuagaacccccugggaucaugagaaugaaugugggucuauccuuccuucugugugaggaaaaggggagguauugugguuaagcaaguuuggagaacucuggccugaacaaaaucaaacagaugucuuucuugcaggacuuagaagaaacuuaaaucuguugguaacucuuuaagagggaaggggauauaaaacccuuguuuucccuagauuuuuguuuuacucuauagcugucucuuuuuagaagcaucucaugagacuaauguuuuuaggaaccugcuguaggaaauucauuuauucaaaaaauauuuguugagcaucuguuaugugcuagugacugcuccaggugcuugggauacagcagugaccaccuccaaccaagaucccgcuuucaagaacuuccauucuagcagaagugaugaacucauuuuuauggagcaccuacuguguauuaggcaugugaguuaucacacauuaucugcuuuaccccucacaacagccuggugagguagauggacuauuuuauuuuauuuuauuuuaugacaguguuucacucuuguuacccaggcuggaguacaguggcgcaaucucggcucacugcaaccuccagccuccaccagguucaagcgauucuccugccucagccucucgaguagcugggauuacaggcaugcgccaccaugcccggcuaauuuuuuuguaguuuuuaguacaaaugggguuucaccauguuggcuaggcuggucucgagcuccugaccucaggugaucugccugccuuggccucccaaaguggugggauuacaggugugagccacugucccaggccagauggaccauuuuaaagauuagguaacugagcucuaggggucaagagacuuggccacuuuggcagcugcauugucguuuuuggauuaugucaucaaauugcaaggggagguggugaaauaaggaauuucugcaacagaaauuggagucugcgguggggaugcugcaggccuuagcugcuguaucacuguguccguuuaugaaggcccgauggagaagaggcucugaaucaggccgggaaagagguauuucucuggaacaacugguuuguuucuguguuaugggcaccgagaagcguguggcucaucauguuuuccuuuggcuuugguuacuaagcaccugagagcuagauuuguggcccaucuugacacuucugcaggaugggaccauauggcaugcauuucuaugugcugaucuuaccccaaccucccgcccuccaucccgcuuuauuauuuucucuauacucauuuuugccuugccugguucucuuguuuguuuuauucuuuuguguuauuuguauuauucuaaaccaccacauauacuuggugggauggagcuggguauaguuaaauuuuaaaaauaauggugagggccagguguggugguuuaugccuguaaucccagcacuuugggaggcugaggcagguggaucacuugaggucaggaguucaagaccaguguggccagcauggugaaauuagccgaguaugguagcgugcaccuguaaucccagcuacucgggaggcugaggcaggagaaucccuugaaccugguggaggucggagguugcagugagccaagaucaugccacugcacuccagccugggcaacagagugagacucugucucaaaaaaaaaaaaaaaaaaaaaagaaauaauacuaaugaugagaugacuugcauaagaucccccagcuacucuguggggaagucgggcuccaagccagcucuccuggccccacccucuuuccaacauacucagugccuuucuggauuaggauccacugcaagguuccuuugcagugggagccaggucuguuuggcuuuugcagccauuguguuauggguuccaguggaagcugggcuggcuggauuggagguguugaggggcuuggauugaccuaagugucaccuguggcucaagcaaggcucuggacuguggauuccuucuuggugagggcuguucagccucacccaggagagaacccauaccucugcuucuugcuugugaggcaucagguuucaagcaggggucagaccagaugagcacuguuauguucuucacagcugcuucccacucguuauccucauaguagcccaggguagaaaaggagaggaugagugggugguauugaugaagaaacggagaccuacagaggugaaaugacuucacccaccaggugauggcugagucugcaacccaacaaaaaacucuggcuugcuggcauuucucaggccagacaguuccaaugugaacccacgguaccuucugcgggagaaaagguggcaugggaagcaggaagagccuaggauuugggaguuggaugccauggacuugaguccuggccacuacuaugugcauauggggaagucacuuuucugagccucagccgccucaucuuuaaaaugugggcccuaauuucugcccugccagccucacaggauggucaugagaaacugaaugagaagaugaacauggaagccuuuugucuggcauuaaccacaugugccugugugcuggguucugucugcauugugcuaaugaugguggugaugguauuaauaguaauaauagugaacauuuaaggaacacugccuccuauaauagucaccaugguaaacuuuacauacauuaucuuaaugaaugcagaaaacaagcagaugagcagggaccgucuauuauuuucccauuuauuuuuguuuauuuuuaauuuuuuuuuuguagagacagggucucauguuguggcccaggucuugagcuccugggcucaagcaauccucccaccucgguuccccaaagugccaggaucacaggugugaguuaccucaccuggcuguauuuucccauuuuuacaaguggaaacaggggguucaaaaaaguuuauguaauuugcuuaagguuguagagauguuacauaguggaguccagauuugaucccaaguaggugacccuacugugguaucacugcuaucagauuggaaacagcagaagucuaggaccuuuuugguuugguugaugacaucugugcacaucauucugguagguaggggccaucugggggcaggaaguuggguguggguagggguuggcccuggagaggcaauagaagcuggggcuuggcuggauaacaagccuggcacacugaguuugucucugagguuuaguuucucaccuguaagaugaugauauaauaaugugccucaugggauuaaagaaaauaagagaugccuagauacuuauacauugcuauaaaaaugucuguguuauaagagugacauggcauuccacaaaaugcaguguagauguaaauuaguuggaauggugaccucaccccugcuagguagcacuggcuuaugucccaccugagaguaguagcaucugagggcuagccacacugaacaagccacacaccugaccucagcauccucuucugugaggggaaugcucucugcucuucuaccugcaugcaccguguuuguggaagugcucuguguaggacagggaaagcaccuugcagagagcaagggcccacuggcugcagagagccuggugggugauggaccagagauaagggugagggacaguuuagagugucacaguuucucauagagcuuugggcagugacaccaguauuagucucaggaccaucauugacuccugguuaguuuuucuguuuucaaaacacuuuaucagcuguaaagcacuuaaaaauguaaauuaguuccugcaaaaacaaaaugcacaaaaaaugauggcucugccaggcuggguugggagaugaauguguaugcaugugugaauggauucauuucugaugauaaaaauacuuuaugcuuauuuaugugaaacuuggaaaauagaggaaaaguauaaaauugaaacuaaaagucauccauaauccuucuaaguagcuuuaucauuuaauguuuuaguauauuuccuuccuguuuuuuuuuuuuuccuuaauucuggguguaugcaaaggauuuuguaacccuuuacauucuggaaacuguucaacaugacuucuuuuuuuuuucuuucaaccaauuuguggagaguccauuuugcaaagccuuagcacagugccaagcacaagcuacacacccgggaugcugcugaaugcagaugagagcaugccagcucugcugaaguugggggcugggggcaguggauggcugugaguggugugaagccccgggccacagugaagacccuggaauggcugagagacugggauuccaggagaccgagguuugaggggaggcuuuucauuguuugauuagcucuuuuuuucuuaccacauguaagucaucauaauacuuaaaaaauugcuguaaaaagcagcuaauuaaaaauauaaauacagucuuuuuggagacuagaaacagucacaagagaagcaguuucagugagaaccagauccuuugucagugucagcgagggggaggggcgucggggcccagccagcaaauccuucccuccgaacugggggugcggaauguggcacucccuuuaguuagacuugaugagcuuuggauuugaguaagugacagccccuuuuauuuccugcuuuguucucucccagguaccaguugaccacaguuuucauucaugcaaauggaagcugacagcugcccagggaggguuagauaccugggaggauagagcagaggcccuccuucuccccgaccccucgccucugcaggcugguggggaggggggcaggggagucgaguuacccucucuccacgcuuucuucuuguguaugugugcguguacgugcguguguguguugugugugugugucuugggggauggagaaccccucucaggagggccuguggaaaggcugggguaaguggagugagcccguggguccugcccuuccaggcugccaagaguuuaaguugcugccucccggucucugugcccuuuuccugccuguggaaggcccucucucuguuuaggaacguggauguggcaggggcugggcgggcacuuggccuuuauaacaacagaagaggauuuucagugacgaggaagcaucccgcccuucugguucccugucuuccaccuggccccacugcgacagccucuccaggccucugacuucacuagaaucugccccuccaccccaccuucccccgaaccccaccuccuuucucugagccugagaggaguuaauuguguuagagugcacugagaaaccuccaggaaggggcccuagucccuguguugccuguucagcaaucacauuugcucacgucuagaaaguacaauauaaugacucagguuaaggggugaaaaaaugugguggacauuuugccaggguacuguguuaacuguuccaagguaucacccugugugagacucaggaacauucaguguuuugguuuccccccuauuguacugaaugccggcagcuuuccccuucuaauuauuuaucuuaauaauuugaggaaaguugauuugcuuuuuaaaaacuggcauccaagcguacccuaucgcacugcacacagcugagagauuaaggcaguucuuuagaauuccuaguccguguuguguacacagcgauaggcugggguagugguucugggugcaacuggggacaggcgaggaaccauaaauuuggcaggaaagauuuguguugguacccuguuauauuugcuuugcaucacauauuguuuaaaaagagcgauauuuucguuaaaggaaaaggaacuguguauuugagauaagaaguagaauaaaaugaaaugaauaguuggguuucguccuguggccuucaaaauggcguuauuucugagaucccuguuucuaugcuguuccaguauuuauacggaacuuauaaaauacaaaguauaggcaugucccgagauccuggcgaggcuguaauuuauaguguuguucuuuuucuuuuguuuuacagagcugaguuuggugaaacuucaggagguuuuagcuaguggcgauccaaagacauuaaauauugcuuuguggguacgucuccaccuugcgucuuacuuggugacuguucagugguaggcaaaugucagaacccaguaugcaaauguggaaguggacagauuugagucaguuaucucagcugguguuaugaaauacggaaauuuuuggcguuggugguggagggcguuggcauaggaggcgugaaugcucuuuguuucuugcuguuaugggaguaucucuugauugccccaucaucuuguuugguguggccccguuuccuucuagaaguugaguucccugggcuugugagaacccuuguacaucugccuccauuaaacucacauuuggagaucucguaaaugaacgcagugcaguccgggggcagagugaaggcucagacugcagccggacauggcucaguuacccuagguggguuagcagcugagcagguacuggucucaaaacccucugaagcgaagcugccugucgauuccacaguugccagcuuccagcauggagcuucuggaaguaucacggacugaguugggucccaaugcuggaugucccuacucuuccuccugccccucccacguuuggaugggcaaaugcacuaagaacagcccgugggcaagugaaugaaaccaaaaagcagcaagggauuuggacaguccaccucagaguaucugacuuuauuuugaggggcaugugucagaguugggugaagaaagagauucucagauggagauagagaaagauccccaaaagggcaggcuggcuaccagugauuuauuuuuauuuuucuuacuuuuuuaagagaaugcagggcauuuuacucuucugugguaggagaguagacuggccacagcccagcccagaacccuuaacaaaagguuaagcugcugggcaugguggcucacgccuguaaucucagcacuuugggaggcagagauggguggaucaccugaggucaggaguuugagaccagccuguccaacauggugaaacccugucucuacuaaaaauacaaaaauuagccgggcguguuggcaugugccuguaaucccagcuacuggggaggcugaggcaggagaaucgcuugaacccaggaggcggagguugcagugagccaagaucacgccauugcacuccagccugggcggcaagagcaagacuccgucccuaaaauaaauaaauaaauaaauaaauaaauaaauaaauaaauaaauaaaauaaaauaaaauaaauaaaaaaagagguuaagguuuauacgcaggccauuucuaauagauguuauggaagccccagguuuuggggcaucaggguuggaaaggaagccaaaaauggguguguccaaaggacagaugcauugagaauggguuguaaaauuucagccauuguguagauuaaccagcacggcacccugccccucagccauuguguagauuaaggagcacugcacccugccccuccucccccaagcaugcagcaccugagaaagaaaucugacaaagaugcuuuaauaugagucuagcgcuuugagccuuucauugucaucuccagugcaauugucuguggguuuuguuuuguuuuguuuuguuuuuucauuuuuauuggacuuugcuuugccuuuuaagggaaacucuggaugauauacuucauuauuucacuugucagaugguuaguaauaugguauugccauuccugaccuaaggcagcaagugauuccuucuggcaaacucuuuaagaaacaugggcauggagccuggcugccugaguucaaaccccugcucugcugcuuaccaguugggugaccuuggucaaguuacuuaaucuccgugccucaauuuccuacucuguaaaauggagauaauaauagaaccugugucauuacauuauugugggaauuaaauguguuagucuacgaagaggggugccucaggcccaugguaaauuuuauguaaguguugguuguauauaagaugaugaaguccgggcgcgguggcucaugccuguaaauccuagcacuuugggaggccgaggcaggcagaucaccugaggucaggaguucgagaccagccuggccaacauggagaaaccccgucucuacuaaaaauacaaaauuagccaggccugguggugcaugccuguaaucccaguuacucaggaggcugaggcaggagaaucgcuugaaccugggaggcagagguugcagcgagccgagaucgugccauugcauuccagccugaguaacacgagcaaaacuccaucucaagaaaaaaaaaaaaaauuaagaugaugaagaugcagcguggggccaugagaagaguccuggucuggugaguuuggaaaccuggcuucuggccuguuucuaacacuguauguccuugggccagacccuuuccccuggggugcugauuucacaccuguaaaaugaagaaguuugacuugcacagugcuuuucuuagacugugguaagggguggauguggggguagugccaagaccaagugaaagaggcuucuggaccuccauccuugcuucagccagagcagcguggguucauuucauuuuuggauuuugguuugugggaagaaaggguucucuugccgguguguguguuucugauaaacaaagaaguguggaaguggcugaaugagaugacccaaggacucuuucugggaagaugcaggaggaaguaggugagcugaggggaagcugguggggauaggccugguggggccuggggagaaggauuugaaggcucaagucacacggugcaggaugggacucaauauagggugggauagggcgguggguaaaagccguuacaauuuuguccaaaugguaugggcugauuuacuuauuagggagguacaaauggcuucguguuauaaagugucaagauccuuauuuggauaaggcaaccagaguguagacgagagaguaagaguaagaaaacaaggagaaaaaugagugucuuaaggauguagaaauuuaguuugcuggaagucucugcagccugaacaaaacagcuguuagguuugccagaacuuaaaccagagggugccugccagugguucauauucuugcuaccucuuccuccucuugucuuguuuuuccuuuccauucuaauaaucacgaugaguuucccugacaugcacgccccuucauucauuuguaugaucacuuagagaugaggagcugccuugccagguagaaaaaccauucucaggaugaaucuuuggcuuucugaaucagaguuuucuuuggguuuuagaacuucauucuuauuaaagugggaauuuaccggccgggugcgguggcucaugccuguaaucccagcacuuugggaggccaaggcaggccaaucgugaggucaggaguucgagaccacccuagccaauauggugaaaccccgucucuacuaaaaauacaaaaauuagcugggugugguggugcgcgccuguagucccagcuacuugugaggcugagguaggagaaucacuugaaccuggaaggcaaagauugcagugagccgagaucacaccauuguacuccagccuaggcgacagagugagacucggacucaaaaauaaauaaauaaauaaauaaauaaauaaauaaauaaauaaauuggaauuuaauaucucuuaucauuucuucaauuccaguuuuuauuagauccacaacuuuuuuggucaaaaccagaauuuugauuaugugugccauccuaggcuaccucaccauccaaaaauccucuuggaaaaccccacgcuuaucaggaaaaggagauggaagugaaaaaauaaaaauauauauaaaaaaaggaaaaccuaguguuagcaccccuuauccagcaggccccccaccuggacccccaccuguauucacauuccucccacacuuacagucaguggcuucauuaaucucuaagguuccauguucugcuccccaaauagacuguuugcucauugaagacaggcaccacacuuacauuuuuuuucuuucuuucuuuuuguuuugagauggagucucacucugacgaccaggcuggagugcaauggcgugaucuuugcuuauuucaaccuccgccuccuguguucaaggaauucuccugucucagccucccgaguagcugggacuacagacgcaugccaccacagccggcuaauuuuuguauuuuuacuacaggcaggguuucaccauauuggucgggcuggucucgaacuccugaccucaagugauccaccugccuugcccuuccaaagugcugggauuacaggcgugagccacugugccuggucuuauauuucuuuucuauuuuucuacccugaucaaccuuuucuuuucuaucucucucacuguuucuacgaucaaaguaguggagucaguuuccuugcaucugucccaagcagccguugcuaaugggaaugagugucaggcacuguacaucagcccuguuuugaaacucugugccugcugccucauugacuagcuggagaguguugaacauuugguuguagaauguauguggauugcugaguuucacgcaugagcuguguugucauuucauucauucugaguggcaucugcgccagggcuaccuggaguuuuuccagcuccccaggccuagcaaaggcagggauccugucucauucagcugcauuucuugagcugugcuuagaaggccugccacacaguagggaaucaggaacagucgcguuuacagagcucucgggugauagaagggaaaguaaagguauauuaaauuucuucuaggcuugcugccuaauccccuaaggggccuucucauuucuuucagcagugccaucuggcaggccugagaguauaugggaauaaguggggugcuggaucuugugggcaggcuaugggaucugggaaagggguuagcaccugggccuggagggaccuggaaucuagggggggcauacaucuaagcuaaauguggcuguggcuugcaaacucagaggccuuucgggcagccuggugaaaugauaaaugggcaguugcuguuuauucucaguccuagagauuaaaaagaggugcccccauuggaaacuggagguuacauguucuacccaaagggagcagcugccagucggcuucuugcgaugugaaaguacagccccagaaaacccagguuaagugauguccccuaauuuuuaaaaguuggcaaccaauucaacuauaaaaucaugccugcuggccucugagcaguaggcagggcugguguaugccggaggccaccaggggacauaacaccugccauagggucagaauagguggguguuagucaccauccagauggucagauaccggaauugccacagaaaugaacaugacaugcagagcaggcagagcaggugccaaaaguugguaucaaggaggcgaaggucaaguucuuugcccaccagaaagccuucuguuccuugucuccuucccuuccugcaccuccaaggacucuccacugcucccuacagcuuaaguccaaauuucccugucuggcauucaaggucuuccauaccuuccuuacaagugcccuuuaggcgcucuaaauggcgcgucagcuccuauguguggccucagcuuagcaguccaguguucccucccccugaaucccuccagacugcccaggcugcaucugccucagacagccggguguucccaagacaugcugcacuuucuucccucucugauuugcucaugcugcuccucuuccuggaaugcucauccccccaauuauggaaaucccacuccccacucauccuucaaaaggcucuggacaaaaggcacauucucccugaagucggcuacccucccgacucuguaaauuuggaauaaaucacaucuuucagcuucuauagcacucacccugcaucuccaccacagcccuuaugacauagcuguugagaaaggucugucuuccuugguagaugaugaggucauuguggaagguucgagucuuacuuacuguguccacagcauuuggcucagggcaacagucaacagaggcuuagugacuuagacacuugaugguagaguauggaaaacugauucucaugaggaaggugcuuaaggucuuugguaagccugggaaaggggcaguuggcuggaacagagggugugagaggagcagguaaagcuggauccagcucucuuucagcccaaggcaauaccuaaaacccuaucucugacuuggaaaggcaguauccugcugucuuccugcuguggccaugagccucacuggggcuugacuugaauguuaggacuuuuuuuuuuuuuuugagacggaguuucgcucuuauugcccaggcuggagugcaauggugcgaucuuggcucaccgcaaccucugccucccaaguagcugggauuacaggcgcccgccaccaugcccagcuaauuuuuguauuuuuaguagacauaggguuucacuguguuagccaggauggucuccaucuccugaccuugugauccgccugccuuagccucccaaagugcugggauuacaggugugagccaccgugccuggccaugaguagguucuuuaguggugauuugugagauuuuggugcacccaucaccugagcaguauacacugaacccaauuuguggccuuuuaucccucaccugcuucccacccuuucccucugaguccccgaaguccacugugucauucuuaaugccuuugcaugagagggaaggcuuuuuaaagggcccuuuucaagguuugaaauaaggcuccaugacaauggccugauuuggaugggucuuggaauacccuuuuuuuuuuuuuuuuuuuuuuuuuugagacggcgucucgcuuuguugcccaggcuggauugcaguggcgcgaucucagcucacugcaagcucugccucccagguucacgccauucuccugccucagccuccaggguagcugggacugcaagcaccugccaccgcgcccagcuaauuuuuuuuuguauuuuuaauagagaugggguuucaccguguuagccaggauggucuugaucuccugaccuugucauccgcaugccucggccucccaaagugcugggauuacaggcaugagccaccgcgcccggcccggaauacccuuaaaauauagccagaaagggcugaggauggguaagaacccaggauauagagucuucccauaaaagggagggccaucaugcaagaugaacaacuugguccugauauggauggggcuagaaucuccguauuguugcuaauaagguggaacugaauccccucccuguuccccaacacaauaaaacuucagugucgucugggugcagugacucacgccuguaaucccagcacuuugggaggcugaggcagguggaucaccugaggucaggaguucgagaccagcccggccagugugaugaaacccugucucuacuaaaaauacaaaaaauuagcugggcaugguggcacaugccuguaguuccagcugcucaggaggcugaggcgggagaauuguuugaaccuggcagguggaggugcagugagcagagaucaugccacugcacucuggccugggcaacagagugagacucugucuccaaaaaaaaaaaaaaaaaaaaaaaaaaaaaaaucuucagugcagggccugucugcucuccagggaaggcugcaguauugucagguuuguuucuuuuuccccacaaaacugcuucggagagcucuuaggucccaaguuugccugcauccaggguccagaugcuuccaggguccagaugcuuccaggguccaggcagugaguggaagugaaggaggcuccucuagugaaagaaaaaggcauccaguguuaauaguauuucuucccaguugcauggggcuugcauauuagagauaaaggaaacaucuuagcuacuacugagccauaaguggucucaccuuucuugaaacauaaggccgucuugguuuguuguucuguuuugugcuuuucacagaggcauggacacugaaagacguuucucugacaguggagauauaggacugaagagugacauggcuugcagagcacuaccugucccccuaauccacacuguccucucuccucaugggcagccugagaauguggacccaagguagcccaucaugcaguucuucaugaaaucuggaaaucuuggcauuucaugggaaaucucaucacugcuaaaguaggcuuagauuuguuuuaaaaccuugugugggcugggugcagggcauuuuacucuucugugguaggagaguagacuggccacagcccagcccagaauccuuaacaaaagguuaagcugcugggcgugguggcucacaccuguaaucccagcacuuugggaggcugagguggguggcucaccugaggucaggaguuugagaccagccuggccaacguggugaaaccccgucucuacuaaaaauacaaaaauuagccaggugugguggcgggcacccauaaucccagcuacuuaggaggcugaggcaggagaauugcuugaacccaggaggcagagguugcaguaagcagagauugugccacugcacuccagccugggcaacaagagugaaacuccgucucaaaagcaaacaaacaaacaaaaaaccuugugugggugaaucaaacacgucugcaagccugauucagccuguagcccaccaguuugcagccuuuguuuagauccguaguggagaaagagguuaaagcuacaaguuaggaccccugaaaaugaaagaugguuuggaagugaaucugaaguaaauugucacuguaugguuucagaccguuuucugguaguaugugcugugugacacagguugucccuguguugugcagugguuuugagcacaacauuggcccuaggccugcaguguggggugcaggcccucugcugagggcugcagaugcugccgggagugcaguggaugagguccugcccgcacagccucauucggcguugauacccaugccuggaggaugugggcucaucuucuugggucaggugagccucuuacaccuguguucauugcuuagcucuuuugaugucauugcauauugguucaauuacuuuucccuuuucagagccaugaauaauaacuaugauuuugcuagagggaaaaaaugaaaugaucaagguaaugcauuuacauguuacauaaaauucauaucauacagaaaggcagaaggaaaacagggagaauuacuuguucccuuuucucucuuccccucccaauuccuuuaacaggaagaaugucucacuagucaugugaucuacagcaaauccuuuaaccucuucaaacccgcaucucuuauauguuacaggacaguaauaaaacuuaacucauauuauuguuauuuuuuauuuaauguggauuaaguuaguugguaugaaauucuccaaauccuaugcauauauaaagggugcucauagagcuuuuuucuucuuuuuuguauauccaggauuucuuuagcggucuuuuguaauuauaguaaaagcacugagguuagauuuauggguuuuuuuugaggaggauagacugaaucccuuucccgccucaaggcuauagugggucggcacaguuuguguuugcuaaacauaucuuuagcugcguaagagaaagaaggaaaauaguaaagaugaacaguacuguuuucuacuugaaguucuaguuggcccccacucccuuccauguaggaaccuuagcuugcuuuccacacccucccaccacuggacucacaaaggccccugaugagugccuccgguaagacagggggaaauuuuuaucuuaauuagaaaaaggcuuaguaucuugauuguauguucucuggagccagugauagagauaguauaagaaauucuggacauucaaauguaaaacagauuaauuuguaggaauguuggauuuuuaucuggacagauguuuugucuuuuauggaguugguugggauuaagaagugggggcagggucauguugguauuuuauuuuugcuuugggcuuauguuacuuaggauuaacuuuagcuguguauaacaacagcaacaaaucagauuuauagucaguuaacggaggcuuaagugauguaaaguuuuauuucucucucacauagaaauuaguuagagguaguaguuuagggcucuuagaggccccaggcugucauauucuaccugcuuacacauggcuuucaggaucuaggucaccucacaguccaugauggcugcuggggcuccaucccccuugucugagucauauguuggcagaaggaggaaaggcacagaucaagaggaggccuuucagcugggcgcggugggucaccugaggucaggaguucgagaccagccuggccagcauggcgaaacaccaucucuacuagaaauacaaaauuuagccgggcaugguggugugugccuguaaucccagcuacuaggggagcugaggcaggaggaucgcuugaaccugggagguggagguugcagugagccgagauugugccacugcacugcagccugggcaacagagcgagacucugucucaaaaauaaauaaauaaauaaauaaaauaauaaagaggaggccuuuccugcugcaucagcucucucugagcagcguuccugggaaguuccauggaacacuucugcuuaucucauuggucauaacucagucagaugcacacacugagcugcaagggaggcugagaaguauagucucuuagucccagauacaauauguauaaaauucagaacaaggguccuuuuacuaaggaggaggaagagacuggauguuauggauaugggcagcaagcaguguuuucaaaguacugaaacagauuguagaacuuuguaaacuggcugccuuucuacuccucugcucaccucuaaccaaagagccaccuaauuguucugcauggugaccauugccuguuagauucuuggugaauagauuccuagccucaucuuuuguuauuuuuauuuuuuuaauaaaugguagaaugaggaugcaggaaacuuggaaaagcagagucaaaguucaacuagcacaggagcagaagguaaauucuguuggcuuauagaaugagcccagacccuggugucagaagaccugggucaguucuggucuguccucuccugggacucaguaaagucucuuggcucucugagcuuuccacaucaguaagauggggaaugacaacccuuaugggacugcagugaggcuuagccaaguuggugcuguggaaggcccuacuggauuccaaagcaugauacagaugaugaauacuuuauguggcugaggugcuuccagcaggcacgugggaagcauccauguaagauuggggucaugcaaaauggggugggaucacaucgcgggaugaagcacuuggaugcaaaggccugugugguccagccugagucuggcucaacacacagggucggauccuggcugcgcuccuuacugcuguauguacagauuuggcucagagggaaugcaggauuggcaacaugcaucuagucuuucuuguggucuccuggugccucucauggugugcuuauucuuauucugcuacggagagugugacuuaagcauguaauuugcauauagcguggcuccugaaugcaagccacuaacccauuauuuuacuuaguaaguuccaguguuggggcuugggggaugguguguccuuugccagugaaugcuuauguugguacauuucaaggguuauuuugcuuaugcacccuccccacccccgucaacguuagagcuuagcaucauaugaaaggcagugucccugugacuguaucauaggguugaugaggaugaaaugaaguaacugcaggcaguguccagcccagugcccagugcucuguccaggcucagugagugaccuuugcugcugcugcugcuacugcguccagcuggcuacauggggcugguggcagagggugacucaguucucagugugucuuuuccugcccccugccagguugcuuccccuagccuaguucccuuuuuuugugaaaugcucaucccucagcucuggacuucaauguacuguugguuucaaaaccuuaugaaacacaacaucaaugggggaagggagaagagagaagcugagaagccuaacccaacucugacagcugagcggcuacagaggacuucucaguugggcuucaauacuucuuaagaacuuucaaguuaggccucagaugugauuuuguuugcugacuuucucuuugcuaccuuggcuucuauuuaguuaacaaaucuaggccgggugcgguggcucacgccuauaaucccagcacuuugggagguggaggcagagguggguggaucgccugaggucaggaguucaagaccagccugaccaacaaggagaaaccccaucucuacuaaaaauacagaauuagucgggcgugguggcacaugccuguaaucccagcuacucgggaggcugaagcaggagaauugcuugaaucugggaggcggagguugcagugagccaagaucaugccauugcacuccauccugggcaacaagagcaaaacuccaucucaaaaaacaaaacaaaaacaacaaaaaaccccaaaucuaauucauucauucagcgugcacaauuuauucaacacaguuuguuccaaacacuggggauaugccccaaacagaccaaguucccuguuucauggagcuuacguuugguggaagagagacaaauauagaaacaaaaguguaggcugggugcaguggcucacgccuguaaucuuagcacuuugggaagccgagguggggagaucacuugagcccagaaguucaagaucggcuugggcaacauagugagacuccgucucuauuaaaaaaaaaaaaacaagucuaacaucagguagacuucagggcugugaaagaagugacauaggguaagggaauacagcguguugaggggaugggugcuauuuuccaaggaaagccccuccugguggggggccauaggaaacagcuggugcaaaggccuggaagacucacuggcaucuuucuggaauagcaaggaucagcuuggugggaaguggaaugagcuggggguggaguggggugggguggauuuuggagucugagcuugagauaccugcuuggagaugcugagcagucugcaggaaccaggagcccggagcugagggaggacaugaaggcuggaauuguaaguuugagagaaaucagcuuuuugaagcugugggacgggguaagaucaccgucaugugagaggaugggacuggccagguggugcauguguccaggcucagcggauguuccugggauacaaguaccuguucaucuuguugacaucuaaucuguaucugcgcauagugaccaaggauaagccacugagcugcuccaaacgugugcuaugggauggauuaacuguguggguguggaaaucccucagaaugaugagacagggagcaguggagaggaagacagucgaucauugaucggugagccuguacuugagaucuggccuggauaguugugaugguaggugguacccacaaugauggcccuucaggggauuugaagauugugaaggaggaccaagaggagcuguuuggaccaccugugauccaaggcgggaacuaggaagacaccuaccggaagucuuuguggaucuuuugggauuggauuggauuagcagauacagagcguuugaccuauaguaaccagcugacuguucagcaaacgcuucacuuccuaaaaggcuucuucuuuccaaggcaaacuggggcaugugaggaacaggaacuuacaagagcuucuagucugaacuccaggugcugacacuguuaacaguugcugaguggaguccuucucacuuggguggaaaguaaccuguaaacuuggcccaagucucccuuuuccuguccuuuggcccaugcuguucuggugcuagauguuggcucuggccuuugcacugaccaucuccucgagauggcacguggggaggaugugcuguguugagaagaacuuggcuggauaggcaaagacuugagcuagaaaaagaacaagugguuauucauuuggugcuucccuuuaaccagggccuuuuuuuuucuuuuauuuuaaaggaaaccuuuaagaaaggagggcucucaggccuuucuuagaauuuaggucucaguuuuacaucaugggauucuguuuuucuuggguuuccauuagaagauuaaauaacauaguggcuaugaaagcauacuauagauacuaggaacuguugcuuugauuguguuaaaggauaccucuauuccccagguccuuuauugauucaucuuauuuuuauuuguauaauaaaucauuagaauagugccuggugcucuauugcacucacuugcauauacuguauaaagcuuuguacauauuacuuguuuaguccucacagcagcccuaggagguagguacuauuauuuugcucauuuugcaggcaagaaaacaggcacagacaguuaaauaaggucacccaacuaacaagcaguagagcuaggauuugaacugggggagccuggcuccauguucuagguucuucaccauuauacuccaaggccugucgguuuucccaucaaucucuacugaagaacaauggcgauggccauacugguaauuguugugcuuuauaugcugugcacuguguuguguauuucagaugcacgaaugagaaucuucauccccgcaagauauuaagagcccguuuuacagaggaggaaaugaaggcucagagaauugaguaacuugcuugaaguccaaagcugaggaguggagccagaauucaaacucgaguuugucuggcuuccgaauccugcuauuuccucagcacaguggccguccuccaaggcugucacauguuccuucccuggugauucacggcaccuggcuaccuccuuuuagacucacuuuguggcccauggcacccaguugugucaugacaggacaguggcucccauuucuccgggccugacugugaggccacaugagccaccccagggaggccagcagagucagagcuuggcuuugaaagcuguuaaucgaccugagccccuccaugucccuugcuccauuuuaagccuagggcuuuccuaaagcaccgcagaucuccuuuucuugugagaagagauuaggcagauguauacauacacgguaaugugcaagugucuaguuucuugucagcaucgggaugagcuguuuguagugaagagccugggccuggugagcccccgggaugauggguggggaccaucugugcucuccuggaaaggaaauugugguuucuuucuuuucuuuuuucuuucuucuucuuuuuuuuuuuuuuuuuuuuuuuuuuuaguuuaugggaaagggagacuugugucucaauugagucuuuguggcguuguauuacagagagucacagaaaauguucuauguaaaugacuaugugcucugauuagagccucaaugggcaccauugugucauauugcuauuauuggcgauugcaggauacuaaaugauauucucaucaggcugaaaaacuucaguguuagcagugaaacucgggguuaauuauacugcucugaauuagagcauggaauuaaguuguagggagaguaagccuauugcuuucuucccccucugucuuccucuucaagauucuugcuggggguuugaucagaauaguuuuuaacccauguucuauaucuguacuacuggcauuuuguucuccaugaguuacuaccccauuugggguugggaaacacaggaccaauuuauaggacagugggagaaggggagacauggucuacuuaauagugcauucuucucagucaauagcuggguaaaaaauagcaugaagauugaagucuuaggggaaugcuggacucucuagaggggccucuuuaauuuagcucuugucucuucugccuuugaauucucaucucuucugauccugacucaccucuuugaagaaaugacacacugaccuacaucuuggcugaaacagauagaagagucuaucucuguucugccccuucuuggcauucccagcacagccuccaagggagucugucccagagcugaggcaggcccucucggguugcaugccauugacuucucagcuuuguuuuaacugcagaguuuccagugcucugcucuucuugaauugcuccugauugucaccuucuugcauuccuuucucucauuucuuuuucuguaaauuucaugucacugguaucagguuuaaagucguauuuuuuaaaucccuuucaauguuacguggguuguaaauguaauuguuaauauuauuuaaaaauuuuugaaaagugauuuuuagugguggccuuaucauaucuacauauuauuacuccaccauuuugggauguuuaggucgaauccugguuuuuucuucuuuugcuguuguaagucauguauauuggcaauuagccuaggagagauuccuagaaaugaguucacugagaauaugagcuuaagagaaagugaggauuuaaagccagaucugucugccuucaaauccagcgcucuuuauacugaugugaguucuccugucuuuuuuaccuaucagaauucuagaacucucccagagaaaccaggcagauacugcuccacaccggugagcugcuucucaccuggguagucuagggugguuugcuccagaauuguauuucugcuuuuucuuuuuuuaacuuggcagugguuaaccauucccuggagcagcaccagguaagucagcuuguaucagagucaucugcuuuaccugacaugagcacacguugucauauauuugcacaugcagauaucauauguuaaacaauaucacauuguugaagaaaauuacacuggaaagcguaaaauauaguuuggaugccauauugaguguaacuuaauccacccgauucagaacuuuuguagagugccucggaguuccuauuuggaaauaucaguuagcaguuuuagucaguagaguaacauauuuucuauauuuaugauauaucaaagagacuuucugaagcagaacccugauugacucaagagucuuuuccaaauucuguauucucucagaaccaggauuuaauaggagguggguggggggugguccuuggucaaacuggggaaaagccucauaaugagauugccaaagcgcuuacagcauuugaaggcucagagagaugccguggucaggaagcuuguuugagucugucuggaagccaguaagucccacagaauaccuacugauaauccuguggaauaagcagcauauggaauguugcugagcuagaauuaaaguccacacacggccaggcgcgguggcucacgcuuguaaucccagcauuuugggaggccgaggugggcggaucacuugaguccaggaguucgagaccagccuggccaacauggugaaaccucaucucuaauaaaaauacauaaaauuaggugggcguggugaugggcaucuguaaucccagcuacucaggaggcugaggcaggagaaucgcuugaacccaggaggcagagguugcagugagccaggauugugccauugcacuccagccugggcaacaagagcaaaacucugccucaaaaaaaaagaaaaaaauauauuccacacaccuaguuuuucagcccuauacaggcugaccccauaccugccaucuccuuuucacuuccuguucuuucuggccuccgugaguccacgugugcccuugucucugcuugcugugccuuucucuuuccuccacguugcuaaauuccguccauuuuucaaggcucaguucagaucauccuucuuugcuuuaucauuuuacauacuguguaugguuuggccucuuggucugcugcucucugugucuguuguauggagcgcuuuucuaucugguauuacgguuauuugugugcaugucuuuugauucaucuacuugaagacaagagcuggucuugggcugccauuccugcaguguaggcucucacauugccuugcacguaguaagugcucaguaaaugcuuggugaacaaguguucauggcguaacuuaauacuuccaguggugagaguuccugucaagaguguuggcagugaaguuguuccccuuggcaauuucuaugcugaucucggguuacugcaugagacacagaaucugcguuucccucccuucagcaucacuggggaggacagccuuacuuuggaguuuuuuuucugaucaguuacaugaugguuucaucuuuaagacuacugauaacaggcagcucugccuauggaguagccauucuuuuuuuuuugagauggagucucgcucugucacccaggcuggagugcaguggcaugaucucagcucacugcaaccuccgccucccggauucaagugaaucuucugccucagcuuccugaguagcugggucuacaggcgcacgccaccaugccuggcuaauuuuuguauuuuuaguagagacgggguuucaccauauuagccaggcuguucuugaacuccugaccucgugauccacccaccuuggccucccaaagugcugggauuacagacauaagccauggugcccgguggaguagccauucuuuaucccuuuacuuuccuaauaaacuugcuaucacuuuacucuaaaaaaaaaaaaaaaaagacugaccagguguggugacucaugccuguaaucccagcacuuugggaggcugaggcaaguggaucacuugaggucaggaguucgagaccagccuggccaacauggugaaacccccgucucuacuaaaaauacaaaaauuagcugggugugguggcgggugccuguagucccagcuacuugggaggcugaggcaggagaaucaccugaaccugggaggcagagguugcagugagcugagaucauaccacugcacuccagccugggugacagagcgagagucugucucaaaaaaaaaaaaaaaagaaaaagacuauugguaacaacccucauuuuuuugagcacuugcuaugcugcuaacugcuuuaugcacacuauuucuuuaauccuuaacacuauuucuuuaauccuuauaucuacccaugagauaggguuuuguuauucaggcaguggcaaaaccugcggcuuagagagguuaaaaaaaaaaaacaacaaacugccucaaacaaagucauauaguaaauggcagugcuggagauuaaauuuaggucugucuuguucugcaguccauauaccauauaacuuugccaaauacaacacuaugguguguguguguguguguguguguguguguguguguguaugcacauguguggccuuuauugaacacugugguguguguguaugcacguguguggccuuuauugacuuauugaauugauccugaaucuucccuacuccuuuccugucucuuuucucuuucugaauaacaucauuucuuuuucucuacuggacauggucucuguggguuucaccccucaccccucuuauuuuugaaguuuuauugaggcacugguugaggcuuuagggcucccacuguuaaguuugacaguaauagguaaguguccccccagucucccuuuugcccuuucuuuuuuuuuuuuugagacagaguuuugcuauugucauccaggcuggggugcaguagugugaucuuggcucacugcagccuccgcuucccggguucaagcgauucuucugccucagccuccccauuagcugggaauacaggcgcacaccaccaugcccagcuaauuuuugcauuuuuauuagagacgugguuucaccauguugggcaggcuggucuugaacuccugaccucaagugaucugcccgcugcagcuucccagagugcugggauaacaggcgugagccacaccgccuggccgcuuuugccuuuucuugacauugccaaugcauccuguccccgagcgucucugaguuuuaagucucagauuuguuuucuuuggagacaaacugcagguagguguuacuucucaccgaaguucccagauagcacaggcuuugcuaaacaacacagcaccaggaacuccaucauagagaccgcaggaugcugugugcgcgcacaugcgugugcaccuagugagauguaaacauuuaccuggaguaaaagaaauucuuuccccagagcccaaauuuggcuagucuccuuauguacacagcuuugacagggauuccauauguuuugcucaucuuugcuuuuuugcagccuccacaaauuuauuuuccguaccacugccacuaaacagaguuguuucuaaagugcagaucugguugugccauuccaccgucaaaaauuauuuuuuggcuccuuguugccuucagggugauaggacaggugacugcucaccucuccagcuucucuuacuuucuuucuucuucuucuucuucuuuuuuuuuuuuuuuugagacggagucuuuccaggcuggagugcgauggugcagucucggcuuacugcaaccuccgccuccuggguucaagcaauucugcugccucagccuccuaaguagcugggauuacaggcaccugucaccaugcccggcuaauuuuuguaauuuuaguagagauggaauuucaccauauuggccaggccggucucaaacucuugaccucaagugaucugcccgccucggccucccaaaauguugagauuacaggcgugagccaccaugccccucuuacauucuuuucuucuguucacuacagccguggagagcuccggguuguccugcacaugugcacugcccucucuuuuauggaccuuuuaggcuggcugcacccuccgucugugucacccuccugcuccuccuccaccuggcuaguuccuguuggccacuuuuggaaauucaugccaguccaguccacccugaguacauccucuuucugugucacugagcucacuaugcuggguuuuaucuaugucucccucgcaacuagaucauucacgucuugaaguuaggcaucaugcguucuucauuucuguaccucccaacucaaugcuuagcacccagcaggggcucaagacuguguguggaaugaaggauucgugugaaaaugcagggagauggaaggcugagcguuucuguuccuugaccauucccggguuugacuaauaacucucauacacacugcuacucauugaaggccuacugugugcaugcauuccaugugugcuauacaguuuauuuauuguuaacccacguagaauucccagacacauagcguuacuacaaacuucaucacaaaaauaaagaaaccagggcccuguuucucuuuguuucucagaugagaagucucaccagaguugacuguggcuucugagcauuaugaggcacauguaggauuuaaagcugaaaggcuuuaucccugagacucagggaaauaugacaaucuuuuauuuuguuuuaauuaauauuuuuugagucagcgucuugcuuugucacccaggcuggagugcaguggugcaaucauggcucgcugcagccucaaccuccuggguucuagcgauccucccaccuuagccuccugaguagaugggaccacaggcacgugccaccaugccuggcuaauuuuuguacuuuuuguagagaugggguuuugcuguggucucaaauuccugagcucaagcaauuggccugacucagccucccaaaguguugggauuacagguaugagcuaccgcacccagccugacaauuuuuuaaacagaauuuuaggugcuugggcccuggaagguucccaguuguccaacucuugagguggggggugggugggggguggagagagagagagagaggaaggcuuuuccuucucaaauaguuugcauuuacacgaaggccacgguguacuuguuuauugaaucaauaaagauacaaucucuuugaauaguucagaaucugauaucccuguuagacugaguucaccuuuugugaaggacacaggacugcuggauaggguguugcagcaaugaggaguuauguuauaaggggucucuucagugucuuuuuggucauaugaauuuuauuugcccaguagaacaugacugaugaggcucugaauagucaaagaaaacaucucucuuauguucugcucaugaauagaacacucuguguccugaauuguugcuccacuggggccagcacgugguguauuuuucuaauguuugaaccaaugggcuuuuucauuuuggggcaaucaagguaaagauuuucuggugcuccugugugacagggaaagcaugucuuguauuuucucucucuuucccuucugucuuuugaguuuggaaaauuauauuuugaguuacaugacuaauuacaugaguaauuuuagcaaauuuacuagaaauugauguucugccaaugauuggaaaucccuuccuccccuccacucuucuaaaccaaaacagugcuguguccugaagcuagaggggugaguauucaguauuggaguacagcgguuuagaacauuggagacauuuacaaggauaaaucuauggcccuggguucugacuuucuuuugccuguguguguguguaggggugugugugugugugugugugugugugagagagagagagagagaaagagaguaagagagagcgagcuggguuuggggcugggaaggaagaaugauugauuaggaagcuguugugcagaguagaacaggacuuccugaaauguaagacccaaagaaacauagauagccauauuuuccaguccuggaaucagacucaagucugauaaaagguuuucuuuugauuugugauucugauaauaugaaaagucuuacaaaaguauagaauuguagcugguaggcugcuuuaugagaaagaaaauaaacucccacagagugggcauugaccugggagaucuggagccuggugcaagugcagaccaugguuuucacaaucuuugaucacuuuccuuuuguguugaacuuucucuuuuagcuccauauuuauaaauggggucauauuuagccagauauuuuauuuuuauuuuuauuuuuaaagagaggcaggaucuugcuguguugcccaggcuggagugcagugccaugaucauagcucacugcagcuucgaacagggcacaagccauccucccauuucagcuuccugaguagcugggauuacaggcaggagccacauuuccuggcuucuaguuggguuuuuuuguuucuggaagaacagaaccauacuccucaggccaggaagaccuagguagagcaagaccagcaaccucuuggcuagagggcugugggagcugagcaucagugagugaggggaaagcagugguuuuuugucuugagaagaaguucagcgcucaguuaaccagaacaagugccaccuguauaagacagcagacggucaaagcagaagagggaaggaaaugguugaauaauucuuuuuuuccuuuuguuccuucucugcccugagucucccccacccccaaagagauaucucaaaaugucaagguccagugaaauggacggugggauccuugaggaggggucuguggggugggggucucugaaggggcuaagccauggugggcuaauggcucuguuuaccgagugcaugcccuaugccuggcauugugcuucuuucucgaaaccauccuacagguggaggaagcggggguuuaaagggagccagcagccagcgacucucuaucuuacagcuucuaauuggcuuugaaaccacacaggcugcugcuggaggaaccuuugacauccucagugugcagcccucuccccucccucugaagggaggcauacuccuucacuguugcuuugacacucuaggauguuccaaaacuagguggucagcuuacucagaaggcucugggcauuuuuccuccugcaggagggacugcgcacaugcgaaagacaugaggaagcucugaugcucagggcugugggggcuuuggccuuggcccgcacagccuucucugguauagugaggucuccuuuuggguuuuucacuuguguuuguuuugaggcguaugugcuucauaugguugaacucauuccucgcccagcuggacauagaguugacugccucagugggucccaccucgggggugggaaauguaaccucaugagggccacuguaugguugggcagauucacagcugcucugaggucaggccuggcagguggcgagggccuaagaggaauuggaucacccuggaaccuagcuggggcuaggaugguuguugcaugugauuuucagcaggacucuaagggaucuccaaagcugguuggcuggcuagcgagguugggcgagggaauaacucauuugcuuaacuuuucauauguaacaacuggguuuuggguuucacaagagacaagguaggcaggcaggcucaggugguucuguauaccccauuucauacaugagaaaauggagacuuguuucagaucguaagguaguuggaccgcagcuacucuuccaagacugguauucguuccucuacucuguuaaagccagagagaggaugcaggccaagucaagugaccaaagcuaaaggggaaggaagggcuggcuggacuuagcagugaccacagacagaguugaagccuucacgguuggcguuggccuuguucacugcugugugccaagcugcugacagcaucuggcuaucgcagguucguaauaaguguuugcugagugaaugaaagaauauugguguuggggaugaucucuuuuucacuugcucagcaccuuccagaauuuuguucuucucuuugccacucccuuuuuucuccucccuggguaacaccucuuauugcaggaguaggaucagguuuugaguagcaccuuugggguacccauucaguuccucuuuucccccguaauuaugggauuugggauugcccuuugggagaauuagguaacuuuagguucuguauguuaauuugaggccuggauuuugaacuuccuucugaugcagauagaccuuggaagggaguccuuacuuagaaccucuuuauuuuaucuccucacugggagaguagaucccagacagguuuugggaaccaccugguguccccaagcgagcagaggcagaguugggcuugaaucuccuccuucauugcagugcuuucucugcccugaucccauugggugacccuggacuaugaauauggauuaugagugggcccugagagugaucagagacauccuucaagauugaagcugcuuugguuccugccacauggaacugagugggagaaugucucaauucaggauggugggagugucucuuuguccaaguaauaaauggaaaccguuugcucccgacuuuugcagauaucaagggcuugucuuuccagaguuugguuuucuucccuucucuccgccucccuuuucucugcccgccugugguuuugagccccucauggcuaucugggcagugauggguggaagggagcuggugcaguauucgaguagagaaguucugcugcagugaguguggggcaaguuucccagacccuuguugggucagggcaggugguuguggcccaguuguuuggccuucugcaggcugcaccccugcccugcugccugccaguggggugagggccuggccaccugguacuuaacaaguuugguucuacauguguucccgugaguggaggacaaaaugaaaauaccuccugaucguguucaaccauuaguugaacaaccauuugaaaugguuauugcaaccauuucagaguuuucuucuguuugugaugucaucugugccuuauaaggggugacuugcuaccuuauggagcaccuagguugaggcccggguugagcacaguuccauacguuagcucauuuauuuauuuugagacaggaucucacuucuguggcccaggguggagugcaguggugcaaucacagaucacuguagccuugacuucccaggcucaggugauucucccaccugagccucccgaguagcugggacuacagcuguguaccacuaugucuggcuaauuuuuuguauuuuuaguagagaugggguuuugccauguugcccaugcuggucuugaacucccggccucaagagauccucuugucuccaaaucgcuucgcagaagugcugggauuacagguaugagccaccaugcccagccaaguuaguucauuuaaucuucacagugguacaaugggcuaauaucucugucuuauagguaaggaaauggagacuaagagcucuuugccaaggguugcugucauccauuuauucaucaacagguaguuauuagguaucuacucugugcugggcccuggccugaacuuggcuuugguggaugagacugacaaguucucuguucucacagagcugagagucuggggauaaagaucccuuauuaugguuucuuuugugguguuguggggagagggugaugauuaggguuuggguacuggagagagaauuaggauuuuagcucauuuuacucaaaugcuuuauauugcaccauguuacuacauuuuccccugugcuuccccccuacccuauguggauuauuacaguuuacuuguguguaaacuuaggcucagagaggcuggguaacuuaucccagcuugcacaaaagaggaccugaauuugagcagaccguagguugaauucuguccuucuaugcugccuuucuaugaauaauauguuuacauauauauauauauauauauauauuuuuuuuuuuuuuuuuuuuugagauagagucuuguucugucacccaggcuggagcgcaauggugugaucucagcucacugcaaccucugccuccuggguuuaagugauucucuugccucagccuccugaguagcugggauuacaggugcgcaccaccacgccuggcuaauuuuuguauuuuuacuagagaugggguuucaccauguuggccaggcuggucuugaacuccugaccucaggugauccaccugccucggccucccaaagcacugggauuacaggcaugagccacagugccaggccuuacauaaaaauuguuuaaaaagcaguuugcagaagaauuaucaauccuuuuguuaacauuuuggugaacucuugaacacauuuuuuaaaaaguugagaguugcuaacaaguaaagugaaguccugugccuguuguaauuuggacugaggagugugaguugucuuggucuaaaggucagagugagggucucugccugcugcaggggucucccgguuaggguuagggugaaaagcuuuuuaaaauaaaccucucaaauuuguugucaacauuaaccuaugguaauuuuuuuuuuuuuucuuuuuuuugagacagggucuuacucuguugcccaggcuggagugcaguggugggaucucagcucacugcaaccucugccucccgguucaagcgaucuuccugccucagccccccaaguagcugggacgacaggcgcgugccaccaugccuggcuaauuuuugcacuuuuuugguagagacaggguuuugccaugucacccaggcuaaucucugguaauuuuuaaacucugcucaaaguuuuagaaaacauaagucuggaaauuccaaguugagccacuggugacuugugagcaugaguauggcaugggauugggggugggguggggcugacguggccuggggcagaugccgggugguucuguuuggaaacagaaguuccacugcacaugcagccuucacgucuugugggggcuuuugugggggcuguguacuucccaguuugguuauuaguaacuuuauuugguucuggucauuaacggcuuuugggggcguuuugggggccuguuugaggccccugaacaugcauuuuucaguugucguuguccauguuauuaaaaggauauguuggaggggguugcaguuuagucugcugcuguuucgaauccuuuucuuugauaguguuugccuuccucccaccaaaugcugcacugagagucucugguaccugggucccuccuucccuugccuuugcuugggaggucagugccuucauccaggacaucuuugggcauacagguaaucccaagcagcucugcucaguuguugauaccccuucucacagaaccugaucugccucagcucuccuugccuccuaaguggcagugccccgcugcugggaagacuccucucucugcuggaugcuucuucaggccugcugcugcacagcuuacggccaugaugacugcugcagugcagaaggcauuucaguuggcuguuuguuuuucaugcauuuuguguuuguagugugcuggccacgggagcacucuaaacacauuaugggccgggcgcaguggcuccggccuguaaucucagcacuuugggaggcugaggcgggcagaucacuugagcccaggaguucgacaccagccuggccaacacggcgaaaccccgucucuacuaaaaauacaaaaauuaaccgggugugauggcgcgugccuguauucccagcuacuagggaggcugaggcaggagaaucuccugaaccugggaggcagggacugcagugagccaagauugugccacugcacuccagccugggugacagagcgagacuccaucucaagaauaaaaauaaaaacaaaaauaaacauaaaaauaaacacuuuauguacacaaucucacaucacuuucacagucuuggaaggcagauauuucuguuauccucauuuuacagcugacgccuaucuaaggcuuguauaaaagucagucacuguccaggcucacacagccaaugcuggagggcuguguggcacccagagagcacaguugcugcuuggaauaaaccuucacuuauaguccggagcagggugguucuaaagcucccuuagcuuucccacuaguaagcuuccagguucugguacaguuucucagccucggcacuacugacguuuggagucugaugagucuuuguugugagcgcuguccugugcauugcaggauguuaggagcauacuuggccucuauccacuagaugccaguagcaccccccucccaacucugcccaguugugacagccaaaaugucugcagacauugccagauguccccugggggacaaaaucuugccuaauugagaaccaccgagucauggcaaccauuucaaacccuaagccaggauguacguggagauggagaaagguacaacauuuagaauugguacuguuggcugggcacgguggcucacaccuguaaucccagcacuuugggaggccaagacgggcagaucaccugaggucaggaguucgagaccagccuggccaaugcggugaaaccccgucucuacuaaaacaaaacaaaacaaaacaaaacaaaacaaaacaaaacaaaacaaaacaagucgggugugguggcgcacuuuuguaauuccauguacucgggaggcugaggcaggagaaucgcuugaaccugggagguggagauugcagugagccgagaucgcgccauugcacuccagccugggcgacaauagugaaacucugucucaaaaaaaaaaaaaaaaaaaagaauugguacuaucuuagaaaaccuggagcacccugcugcuuuaacugcagcccucugugugggcagacagauugacagugggcuuaaugugggguaaccuuucaucaugaaaauuaaauuacacugcaggccuuuuguagcccuccuauaugaaacccucuuaaaauauuuucuuuuugcaauggaagcuugggggaaaaaucauagucuuagauuuauugaaguuuuguggauaaaagcacuuuuuauuaaaaagaaccaggugaaaacuagaagggccucuuuugagucugcugacagacacguggagaauauauagucagcggaacauuccugugcuuuccguaaagcuguggaugaaccugccuuucagguuucguagccucuucagucagaugguuugagaaugcguguuuugugguguaugcacacagacuguaugaguuuguuuuuuuacacaugacuaguaaaccugucacauuuugucaaaugugauuuucuuucuuuauuaaaauagauuuuauuuuuagaguaguucuagguucacagcaaaauugagcagaaggugcagagauaucccauauaccccuggcccccacauaugcacggccucccccguuagcaacacccccaccagaguggaacaaucaaugaacguacauugacauaucacuaucacacaaaguccauaguuucuguuagaauucaugcauagcauucuacauucuguggguuuggacaagguaugaugacauguaacugugauuuccucaauucaauauguauaguuccuguucacacauuucuucacacauuuguuccucagugcucaaaugccugcuguauuccaggcuguauuugaagccccugagccuuuauuuggagaguucauugaacauuagagcaugcaguuugcugagaugucuuguacuuagaaaauccaauuuauaaaaaaccucaaauagaacaguaaauuuagggaauuuuuuuuuucugaugauaaaauuagauaacucuguugcauggauucuguaaaacacagcucccuccuguuacgccaugaauuggguucaauuuacaacaccccuuuaggcauacuuuuucagcaacacaugucugagccgaggugcacugugccucuuucuguagcaggcagcuuuuaggggguguccuaguggucuuauguuuuauacaucucaugggaguggcugguuucuaggaaauagcucacuugccaguuuugguaacccuaacagagcuguuuugccaaggcgucuggugaauauuucugucuuccagucaggacuaauauaguacuuuucagaggugauagccaguuaacugaugacuuuuuuuuuuuuuuuuuuuuuuuuuuuuugagauggaaucucgcucugccacccaggcuggagugcaaugaugcgaucuuggcuuacugcaaccucugccucccggauucaagcgauucuccugccuugccuccugaguagcugggauuacaggugcgcaccaccacgccuggcuaauuuuuguauuuuugguaaagucaggguuuugccaugcugcucaggcuggugucgaacuccugggcccaagugaucugcucaccucggccugccgaagugcuggcauuacaggcgugagccauugcaccuggccguguuuucuguuuuuuauuuagaggaagucacuugaucaugcuuuuccccccacccauggcauaggaaaaugauucuuuugcugauugugcugauuaaaugugauguggaaaaaccuacuccugguguucagagagguuuuccaggucacaguggggugggucucaucuggacaucagaaucauuauguuaaugauaacuaagagcaguugacugcuuacuauaagccagccacugaccucagggcauugcauaacuggcuuccuuuacucuucacaucagcccugugggcuugggagugagaccucuaccuaguuuuuaaacaaauuacauaaacuuuuuggggcucagcucccucaucugaaaaucagaaaaugauacuucucuggcauuuugagcaugaguucaggagucagacuuccuggguuugaauucuagcuucuucuaugacuuugagcaaauuacuuuaacuuugcuaagccucagguuucucguguugcauaggcagaugauagucauaucugaauguaacgagaaucaaaugcaaccugggacacagugaacacuuggugaacguuagugccuugguaacagugaugauagugacaauaaagaucgaugaugaugaugauggcgauggugcuuaacccaguaugaaggugaagugucuaagcuucuugagggcagaguuuugucuucuucugcacuuucuuucuagugucuagaauugccuguagguuuaccccuggaucccgucaggauggggcuaaauuuagaauuuuuggaaagaugugagcuagcccgucuacagugacauccagcucaguguguauguuuggucugugaacauaguagaggcaugauucaacugugaguuugugcugggagcauagauggaugcuuuucaggcucuugaaaugugcaagugugguucccuugcagcaggcauugccucucccucguuaaucaagaucuuuuccuugccaggacuucaggagauccuggacauccucuggagcccagggguggccucacccgcuccuugcuuuagccuggaaugcaggcccucaacauuccagccuuggguuagugccagagcugugaaagcagggcaggcauuuccaccuugcuugacaaaggcuuuugcucucugggugguugggggugccucugaagccaggcgagaccagagaucucauggguuuguguuucuucauugauacuuuuaaggggagcaacuuaaucagugggaaaccagaucucaaaggaugggacagauaaacgcaggguacagagaagagcuugggggagugucaagcuuauuugcccaaaagggcugacccuaccuuaccgccauuaauacauguccuucaugcaucccuggguaacagggaaguaguaccaaaaaucuuacagugcaauaaacacuuggcagaaauggagaaacuaguaauggcugagcagcugugcccucuccaccaccucacuaugcaguacgugggccaccagccgcuaggggccuggcagccacagagaugagggaagcaugcugaggacccugguguggaguuggaggggucauguccucugaaagguggccaccacucaucgccagcccuuacugucaugugagaauguggcucuguguuuccagauauuguuuuuuuuuuuccccuccaacagaagcaggaaauauaaaaaauuuauauaauauauauaaaauauauuauauauaaauauauaaauauauaaaaauaaauauauauuauauauauaaaaauauauaaauauauauaaaaauauauaaauauauuauauauaauauauuaaauauauuauauauaauauauuuauauaauauauauaauauauuauauaaauauauaaauauauaaaaauauauaaaauauauaaauauauaauauauauuauauauuaauauauuauauauuauauauaaauauauaaaaauauaauauauauaaaauauauauaaaaauauaugauauauaauauauauaaauauauauguauaaaauauauauuauauauuauauacuauauauuauauauaauauauaaaaaauauauauaaaauauauauauaacuucacggaaacucugaaggagaggucaaauauaauauuauauauuuuauauauauaauuuauauauauauaaaacuauauauauauauuuuugagagacagucuugcuguguugcccaggcuggagugcaguggugugaucuuggcucauugcaaccucugccucccagguucaagcgcuucuccugccucagccucccaagcagcugggauuacaggugugugccaccaugccuggauaauuuuuguacuuuuaguagaggcaggguuucaccauguuggccaggcuggugucgaacuccugaccucaugauccgcccaccuugaccucccaaagggcugggauuacaggcaugagccaccgugccuggccaggaaauuauauuuuuaugagaaauauucuguuguuuaaauucuggcaccucguucuuuuuuuuuuuuuuuuuuugagacgaaguuucacucuugucgcccagucuggagugcaguggcaugaucucagcucacugcagccucugccuucuagguucaaguaguucuccuggcucagccucccgaguagcugggauuacaggugccugccaccacgccuggcuaauuuuuguauauuuaguugagauggggguuucaccauguuggccaggcuggucuugaacaccugaccucaggugauuugcccgccuuggccucccaaagugcugggauuacaggcgugagccauggcgcccggcccuaguucacaaaauauauauggccaaacaaaacaugucuggggcuagacuuggacagggggccccauugugcaaccucuuauauagcaaauuagaguuuaccaggaaguuucugcccuucaggcccucugcucucacagaaacucuaugaaggagaggucaucuugucuauguuuguaagaagucacauugagagaaaugacaucuuagcuccucuuaugugccaaguaguuugucugcguuaucuucuuagauuggcuccaucucucaggugaggaaacagacuuggaaaggugaagugacuugcccaccuaguuagaagcacaucaucuucugauuccugucucauuucauuucaccgcuuguuugcccucucuguggucuugcccacggacuuguagucccugauguacgccaggccucucacaguguggcccccgggauucccuuuuaugaaaaaaaguugagcaugagcuguaaguuagaguagguuuuaauucuguccuaccacggagucuguuuuauaugagaacaaguuauuuaacuccucugaguguuaauuuccucauuuuuuuccuuucuuucuuuuuuuuuuuuuuaaagggccaguccccauucucacaggguguuuggaaggaguaacugaagggggguauauaaagccgcuggcagccaggcaugguggcucacgccuguaaucccagcacuuugggagccugaggcaggcagauugcuugagucuaggaguucaagaccagccugggcaaacauggugaaacccugucucuauaaaacaugcaaaaauuagccaggcauaguggugcaugcuuguaaucccagcuacuuggguggcuaaggugagaggauuacuugagccagggagguugagacugcaaugagcugugauugcgccacugcacuccaguuugggugaugcagugagaucccaucucuaaauaaaaaaaaaauaaauaaagccccuagcauggugccuggcacaugguaggcccucaaaagaugacccuccaaaguggccaggacucaccaugcauucagggaauauggauucuuuugguggcagcaggcugcauuuuugccuggcugaaugccugcaagcaugggaacuuuugaugcaacaguaauccuuggggucugaaaggccccaaaucucccgccagaucucugagguuaacauccagucaaccuuuugcuuuucauucuuggccucuuuccuccucaccuccaccagugugacagucauauccucucuauguuucugguaaguucuggccuugagggcuggucuuaugacugacaagugaagagcagugccacccucuacuccacauucucagaagcgucucuagguuccauacuuuaaggcaggcuagcuuccaaggcauacugacagacaucccugugcaguccugggggcacgagggucccauuccacccuggggcuucagggucaggugaggaagguagaucccugaaguuggguccagaaaaggccacugggcuagccugucucucguucuggucacugaccucaggauccagcaggacgcugcuagcuugcuuggcucagcucugcgagugcugggagcaauaagcagugcugaaaacgcgaugcauuucaacccaaagcacucugaucccuuuccaggcuuugggagaauguuuuuuccagcucgguuacuugcuggcaugcauaggucaauauacaagguguucucagagaagccggagcugaauguugacuuuugugcucccugggguguguucuggggaggaaguggguuuucagguuguggugcguguaggauguggucugggaugauuaguaucacacacuguggauaaaguuaacacgcauuguggagcuuuuuuccucuuuuguacuuuugggcgaaggugccucaaaagcagcuuuguuuaucaaggaggugcccuugauucuguaugcauuuuuaacaucugaauagaaguuagacgcacacauaauugcuuuacuugaugcaguaaauacguuucagccagauaauccauaagacccuaguucagauccugacuuugaucccucuuaguugugugagcucucaccaguuuacuugaccucacucucugagcgucagauuccugaguguaaaauagguacaaaaacucagauuguuguaagguuucagugaguuguugcguguaaagcauuuaguauacaguucuugucacaauguuuaguaauggcagcuauuaucuuaacuauuagagcggcaguuuggcguggcacuaauaaugaugauggugacaguuucacugagugcuuacuaccucagcuauucuuccaaguacuuugcaucacuuagcucauuuaacccucacaauaaagcgauaagguaggugcuguucuaaucucuguuuuacagaugcuaaaacucggcagccaggugugguggcucaugcccguaaucccagcacuuugggaggccgagguaggcggaucaucugaggucaggaguucgagacuagccuggccaaaauggugaaaccccgucucuacuaaaauacaaaagaauuagcuggguguaguggugcaugccuauaaucccagcuacucaggagacagaggcaggagaaucgcuugacuccgggaggaggagguugcagugagccgagauugugcuauagcacuccauucugggcgacaagagcgaaacucugucucaaaacaaaacaaaacaaaacucaggcacagagagguuaaguaacuugcccaagguaacccagcucauaaauaugaaaagagcagggacuuuagagucagaagaccuggguggcacgcuugcaugccguguccuggugguguggccuaccgcagagugacugacucugauugccuucccaacuguaaaauggugcuaaugauacagaccgccccccauugccugguguggugcgcggcugugagugcuuaauaauaggugcuuaggcaucauuugcuaauuaacugacuguguuagguuauuaggaaguuccagugggcuaauaaaagcucuggguaaacguuaguuguucuuuuaaauguccugaggugcuuaugauuggaguuuaaacagcacaccuguuuuucagauuucggaaccacuuaagagaggcacaguguaaagaagguggagaugagaauaucaccuuuacuccugauacagucuuggagaaugcagcuuaguuguggggcagcauuagcuuucugauaugaagcugagauuagguggauguaccaggccagucacgggcagccuuggguacccagaggccuucucacgugggucgaggcaggugguggaggugguggcagcgguagcccccauaauacuucuagguggaagaacagaccaccugagugagagaaaucacuccugagcccugggggagaacuguguggaggggcagaugggagccuggaguuuugagggaaaaaaaacuuuccuuuuggaagccagacguagggaagaagcauauugaucacaaugacuauuaaagaaagcuccccaacaccccagcaaaacacccacaaaacaagaaacuacuucugccaaugguucuagccaguuuucuucaccacaguucaugacugcuucauccuuuuaggugaucacacccaaaacuuuugggucuuccugccuuuuuuuuuuuuucuuuugagaccaagucuugcucugucacccaggcuggagugcaauggcacgaucucggcucgcugcagccuccgccucccggguucaagugauucuccugccucagccucccgaguagcugggauuacaggcaugugccaccaugccuggcuaauuuuuguauuuuuaguagagauaggcuuucaccauguugaccaggcuggucuucaacuacuggccucaagugacccaccugccucugacucccaaagugcuaggauuacaggcaugagcuaccacacccagccuuuuuuuaaaacaaaaccaaaaccaaaagagacagggucucuggugugcaguggugugaucauagcucacugcaccuugaccucuugggcucaagcaauccuccugccuccaccuccugaauagcugggacuacagauguguaccaucacacucaucuaauuaaaacaauuuuuuuuuugguagagaugggaucucgcuauguugcccagguuggucuugagaacuccuggccucaagcgauccuccugccuuggccugcuaaagugcuaggauuacgggugugagccacuuuacccagccuugggucuuccuugacuccugacucucaaaccucauauucaguccaucugccagucuguggguucaaucuucaaagcaaacccagaaccuuacuacuucucaccucuccccagccaccgcucugguccaagccaccaucgucucucaccuggauuagugcggggcucucuuccuggucuccccacuucugcccuugucccucuucagucuauuucuaugaggccaccagaauuaucuuuuuuaaaaacugaagucagaucauguugcuccucugcucaaagccccgcagugauucccuggcacgccgaggggaaaaggcaagauccucccaaaggccuguacgaucugcccccggcagcucccuggccucuucauuuugugccuccucugcccccucugcagagccacacuggcccugguaguuucuagaacacgucacguucaugccugccucugggcuuugcaugggccuucuucccaggcacaacguggggcucuccccacuucuuccacccuacagagaggccggcccugaucagcuguuuuauaauagcuccucccgaucaguacuccugaucgcucccuacugugcugugccuuuuuuuuuuuuuuuuuuuuuuuuuugaggcagagucucacucuguccauugcccaggcuguagagcaauggcgugaucucagcucacugcaaccucugccucccggguucaagcaauucuccugccucagccucccgaguagcuagaacacaggugcccgccaccacauccggcuaauuuuuuguauuuuuaguagaggugggguuucaucauguuggccaggcuggucuggaacuccugaccucaggugauccaccugccuuggccucccaaagugcugggauuacaggcgugagccacugcgccuggcugcucugcuuuuuacccauagcucuggcucuaauauaugacacugccccucccugaauuagaauggaggcuacagggggaugcuggucuguuaguugacugaugcaucuucagcacuuaagacagugucuggcacagaguaggaacagaauaugguccuguaacaaauacugaagguugugcucugugcaccugggauagagcaggagcaagacacaucauuccugcccucacaggguuauggucuccuaggugacaagguagugcacacuuccauaggucuuacucugggacaaguacugugccaaaugcuuccucccagccgccugaugagguagcuacuguuaguuaucaagucugauuuacaggugaggcaaagaaaggauaaguaauugacccaaggucacaccuagcagguggugaagcugagccaugggucuuggcuucaagaaucugugcucuuacccaccauaccugcugcugccggauucaaacccgaauugcauuaaggaaucaucauaaccuguuugauugaagcuauaagggaacuuugagcauggugaauggggcgcucuauggaaaagggguucugggaagccucuguggaagggagguuuuguuaagugaacuccccugguaaacggagugauuggcccccaauuagcuugcuguucggauuaacuguaauacaucacacuuucgaaagugaagauaugccuauuuuuuccccucuaggucuauaaaguagauuuuugccauuaguaaaauuuaaagugauugggggcuaugguuacugagaauucaagagguagauugacgaaauaauauuugaaugcaauuuuauuuuuugaaaaauguuuucgagauguccuguuuuuagccaggaagcaaacuccaggaaaacucucuuuuccauuaaaguguggaugguguacuguaaacaaagacuagcucucuugagcugccacguuucuauaacuuauagaaacagaagcuguuuuuuuuuucuaaagauccaaacucauguugccacacaaacaacaaaauaaaccaguguguuccaaaaacaagcauuugcucuacccacacgcacaguuggaaagaugcagguuugauugaagaagucggaagccagugagguaauggcagauucuuuuaggggcuccuguuaauuuuaguaagcuuggaagaagcuucuagguuguuuaguguuucuauuagaaccaucaccucaacgaauuuguuauuguagagauugauuaggggaucugcuuccuuugagcagccaggaucccccagcuccagcuucuagccugcuuuucuuccucaucucuacucuuucagaauaaugcauggcuuucaaguccugugugauagguggcuucuuagcgggccucugaaggggcugagauuuguuccuggggcugagacuuuguuccuuugagggugcagaggcugcuaccugcucaggcugcccccaaauugcucuugugugcagugugcugcuuggggaccaguccuggcucugccaccauggcggacacuacuggcuuccucuuaaucucaaucucuucuucuccuuucuuucuuuuuuuuggagacggaguuuugcucuuguugcccaggcuggagugcaauggcgcuaucaaucguucaagcgauucuucugccucagccucccaaguagcugggauuacaggcauguaccaccacaccuggcuaauuuuguauuuuuaguagagacaggauuucacuauguuggccagucugaucucgaacuccugaccucaggugauccgccuaccucggccucccaaaaugcugggauuacaggcaugagccacugugccuggcccucuucuccuuucuaacacaagccugcuucucaguuucacgcacacauaggaguggccaccugacccuguguuggcaaaugauugcaggcuguugucaccgguggggcuccuggaaaagcccucuaugggggauugacucuggcaugacugggguguggaugcugugcucagaggugcugcaguaaugguucugcugcugcugauaguaacacaggcagugcugugucaugcacaguaauccuguaagggagauacuaucaugaucucuguucgguggaugaggaaacagucugaggaaaggcaccugaccuguucaggccacacacuaaguacagagcugggauccuggcaccagcauuugcucucaccaccucucuguuauguaccucucacacaggugcgagucccaccccagaggggccuugagaggcugcaaguguccugggugggcugccugcuucaggaggacuuauuauuggggaaaaauacccccccuacuuauuacuaagggccgaaugcuuuauguucacacaacaacuccauguugugugacuuuggacauguuccuuaacuuucuuuaucuuggucuucucaucucuguaaaauugggaucauaauggcaccaacuuauaguuuuuuuuuuuuuuuuuuuucuuuugagucaggaucucacccuguugcccagacuggagugcaguggugugaucuuggcucagcccuugggcucaaacgauccccccaccucagccuccugaguagcuaggacuacagacauacaccaccaugccuggcuaauuuuuuuuuuuuuugguggguuuugcuauguuucccaggcugguuucuaacuccuggacucaagugaucugccugccucggccucacaaagugcugggacuacaggcaugaacuaccaugcccggccaaacuucuagguuucuuaaaaaagugccuggcaggccaggcgcgguggcucaugccuguaaucccagcacuuugggaggccgaggcgggcggaucaugaggucaggagaucgagaccauccuggcuaaaacggugaaaccccgucucuacuaaaaauacaaauaauuagcugggcguaguggcgggcgccuguaguaccagcuacuugggaggcugaggcaggagaauggcgugaacccaggaggcggagcuugcagugagcugagaucaugccacugcacuccagccugggcgacagagcgagacuccaucucaaaaaaaaaaccaaaaaaaacagugcuuguuguucuuuuguuguuauuguuaaaggaucauuaucucauuaucaacaacauuggcagguaauugagcaacuguuugucuccuugucaauguggagauagaaaauugccuacgagguuggacaaggugcuggagcagcgucaaggaagagagaucgaacaagaagacugcuuugcccuuggacagcuuuguuucugaagcacuuucucauauucucccauuuaaucauccccucccugccaacuuuuccaacaggugcauacuuagguagagcuauucuuuaucagccuggggcuaagauuuguuccugggcagguuaucuuugucucugccuggauagaggcaggggcaguagaguugucaugcauuccagacuacuagcuaugcagaagcaggagcaagguaagagcagauuuguaugaaugagggugucagggaauaucuuagauguccauuuaguuguuaaaaaagagaacugaugccuauauuucaaaacccaacuuugaucuggaugcaguggcucaugccuguaaucccagcacuuugggaggccgagguggguggaucaccugaggucgggaguuugagaccagccuggccaauguggugaaaccuugucucuauuaaaaauauaaaaauuagcugggcgugguggcacacgucuguaaucccagcuacuugggaggcugaggcaggagaaucgcuugaauuugggagguggagguugcagugagcugagauugcaccaaugcacuccaggcugggcaacagagcaagacuccaucucaaaaacaacaacaacaagaacaacaagaacaaaagaaaaaaccccuaacuuuggagagguuaucuccugaaaaggaggguuuuggucucuuucucgcacugcucuaaaauagugacuggcacauaguagguagucaguaaauauuuguugaaugaaugaaugaaugaaagguaauuggccuucccugcucaguucucauuaaaaauucugguuuucacauauaugggcagugucccaacaggcugcugggggguggccguuugugauggccucaccagucuuucccagagagggaagugcacauuuuuaggcuacuuuugcucugacugauacacuuggcugccuaacaaaaagccagagaagaacuaagauuuuuagcaucauucaaaaugcuugccauuccuuuugcuuugugaaaucaugagcuaguuauuuugaguucacauaaaggucagaacuugaucuggggaaggagguuccccuugguuuaugugaggggaacuuuuucgcccuucuguuuauuuuauccaaaggcuucuguuuuucucccaagcuaaaaucuggcauuuguuguagaaaguucucagcuuauguguguguguguguguguguguguguuuuuaaaaagagcucauauuuuggcuuuaguuuugauucucagugauuuuuuuuuucugccugagaguugauuuucugcuucuucaaaguccagcucucaagugggugccuaaaguuguuucguuuuagaggugacuuaaucauuuuuuaggccuuuaagugcugcucccagcuuguguuuccuucuguuuuuaguuuuuauguggggcagggucuccaaaguacacgggcucuuuuccccaccccucuacccucauuuuaacugugcaucaaauggguccuguuucuucuucauguauaauuuugugagucagggaagguggugaaggcccuugaacccuggcuuugucauggcccuuccuuaaggaccugaaggucucuucuccuaagggcuagguugguucagaaagugagaagggcuggaccuuuuguggggagaggauacagcaggguccgaacagcugggcugacaccgggcagcagcccagcagcagucggagcugcagggucagcucaccaugggcugaacuugggcauugccuguuuaggcagagucugcccgagccuuuccugcucccugagaauccucagcauguuuuccugcugagcaaggagugaggaaugaagcccacuacgaagcccgagcugcaaauguauuuauuuauuuauuuauuuagagacagagucuuacucugucgcccaggcuagagugcaguggugagaucucaguucacugcaaccaccgccuccuggguucaagcaauucuccugccucagccuccugaguagcugggauuacaggcgcccaccacgggcccgagaacugagucucgcccaucuaauuuuuguauuuuuaguagagacaggguuuugccauguuggucaggauggucucgaacuccugaccucaggugauucacccaccuugaccuuccaaagugcuaggauuacaggcgugagccacugcgcccggcucugagcugcaaauuuaauagggaaacugaaggaagagguucuccacagcaccaguggggcugagaccuguuuuccucaacuaccuuuuuuuuuuuuuuuuuuuuuuuuuuugagacagagcuucacucuuguugcccaggcuggagugcaauggugcgaucucaucuuacugcaaccucuucuucccagguucaaacgauucuccugccucagccucccgaguagcugggacuacaggcaugcaccaccaugccuggcuaauuuuguauuuuuaguggaaaagcgguuucuccauguuggucaggcuggucucgaacucccgaccucaggugaucugccugccucugccucccaaagugaugggauuacagaugugagucacugcgccuggccaacugcuuugguuucugaguccucccuccucuaagcccgcucagugugugucauuccugggaggcgguggcucucccaggaccccaugccgaaaucugccuucuucuugucuucauucccccaccugggguaccccucaguguuuucccauuacacagauucacguuuacauguucuagaaacaucuguaagucuuuuuccuguuuguaaauuguauauccucuguuagauuaaaaaacuuuuaaaaguaagugucuuucucuguggugaccuauuuguguggcauaguauagguuacaaagcccuuuucaugcauuguuuuacuuauaaguaauguuuauagaugauaccgagguagacccuauggggugcuuacuaugccaggucuguucuaagaauguuauacacauuaccuuacuaacccaccccaaccauccauuguguuauugucaccccuguuacaggguggagagaagaaggcagagagaaguggaaugacacuccugaggcuaggcauuugccaagugaggucugggauuugaacccaggcagcugaacuucagaauccugguguuuaaccacuauaccaugcuggccuucauguuauugagcaggauaaggaauugucacucuugacuuguuuuugaaacaugaaaacccuucucuuaaauucaaaaguaauacauagcugggcacgguggugugcaccuguagucccagcuacuuaggaggcuggggaagaggauaguuugaguccagaaauuugagacugcagugagcucuauagucaugccacugcacucuagccuggguggcagagugagacccugucaaaacaaagcaauaacaaaaaaaaccaaaguaaugcguauugcagcaaguacuuaaauaauguagaugcauaaaagcaaaaagugagaauccccacuccuccuccagugcucugagauagacugaaguaacucuucagggaugaguguaaacacaagggauguccucgaagacuuuccacuuggaaagcuuguguauuuuauacauuaaguaucauaaauauguaguuacccuaauggguccccgccauugcucugcaggcagugggcugagguucaggaguuaagucagccccagggcacaggguggugcaacagaagagccugagucgaauccagaucuccccucuccacugugacuguuuccugggaaacuagucaggggcugguuuuauaggaauuauccagucguauuauuauuauuauuauuauuauuauuauuauuauuauuauuauuauugagacugagucucgcugugucgcccaggcuggagugcgguggugccaucuuggcucacugcaaccuccgccucccagguucaagcaauucuccugccucagccucccaaguagcuaggauuacaggcuugagccacuauguccaacuaauuuuuuuauuuguaguagagaugguguuucaccauguuggccaggcucaucuggaacuccugaccucaggugauccgccugccucggccucccaaagugcugggauuacaggcgugagccaccgcccccagccuuccagucguauucuugacaaaugguuuuccaugaaguuguggacaccuuccagggucacaauuaaaugguuaaaugagucacgauuaaauaaugauuguggguaccucccagaguuucaaugaaaaagggaauuaacuuuggacacagacagaauaaugcaaaucuucaguuuugguuuagaaaaucugaaaccugcaguggggaauacagaaaagaaggaaguagaaggagucuguccccaaccccgccccuuccuuuuuucucuccucuggagagagaagggauuaggaggccuccuggaaaggagucccuuuccugugaucaaacucaccccuucccuccaccagagcaauuacagagccuccggccuggaaccuuccucaccggccuggaggagacaccauucugcggacaauggggggaaggaaaggaaagcaaugccgcugccaauggugcggaugacuuccucaaugccagacuugcuugcacuuucaaagucccuccucggagguccccugguaggaccuggagauaggaugugcuuucacucuuuacagacuauuguccaggaaagaaaguuucagacuuucuuaggcagggaagggcccucugacugugaauuuauuuggaaauuugaaagagaagagagucuuauccuaggaaguguucuuuuucuuucccccuggauuugacaggccaggcaacagcaauuauccaaaccacugcucugcaccaagaggcaaaccacaggaaaaagaaacccgaacaagcaaggagaauagaaguuccccaaagcaugccuucuuguuuuucucagaggacagucuuuucauucauguuuuacagauugguccaacaagugcaguucuucuagucuccuaucuagauaagcaggauauuagaaggaauaggagaggccugcaaaaagcuaugauaggguggaaauaggauaggagaaacugaaaaaaggggaggcgugcgcuccaacaccuccauagcccuuggggacgggcuuaguuucuaaugagaauacagaaggcccaugucucaauaggccccgaaaaauauuaauccagcccaauaugaacagucugcuaauuauaugacugggccugcuuaggagaucagggcaauauuacauucagaguacucaguuuaggaagaugacacaguguaauacauacagauuuccaucauuucuuuuauuccucauuuggagaggcaacagggcugagauagacauguuagcgauggcuagauugauugauuuauugacugaaugaauggccugcuuuaggcagcgggaacacugaaugaacauuuuaaaaucagcugguauaggucaggaacugugcagguugcugggaauggguagaugaaaagacauugcuaugguuuggcuguguccccaccuaaauuucaccuugaauuguaauccccauguuucaagggugggaccagguggagauaauugaaugggggggugguuucucccauacuauucuggugguagugaauaagucucacgagagcugaugguuuuauaaaugggaguuccccugcacaagcccucuugccugccaccauguaagaugugacuuugcgccuccuuccccuuccaccgugauugugaggccucgccagccauguggaacugugagucaauuaagccucuuuccuuuauaaauuacccagucucagguaugucuucauuugcagcaugagaacagacuaauacagacauggaccuuggcuguagggaguuugcacuguagugacggcaagagcucacgugauccauuuuaagauagaagagcgagcucaggcagaggaacacagagccaggaugguccaugcacggaaucuggcccugcccuuacuuucuccaggagcaugggcugggucccucuccucccuaauccucacuuugcucaugugugaaauguagaucaaguaaguucuacacucagaggucucuugugaagauuaaaugagaaaaggcauggaaacugccuuugcacacagccugguauauccugaugucugcugauacucuuauuuuuauguuccuugacauuccaaaucugccccagggagaauuccaggacagcucuggagaggaagugaucuuugaauccaaccuugaaaucacccuaggagaugcaaagaaggugacaccaguuaagaauaagauguguacccauuuucaaauguucuuuuuuuuuuuuuucagauggagucucgcucugaugccuaggcuggagugcaguggggugaucucggcuaauugcaaccuccgccucccgggauaaagcgauucuccugccucagccucccgaguagcugggauuacaggcgccugccaccaugcccagcuaauuuuuguguuuuuaguagagaugggauuucaccauguuggccagacuggucuugaacuccugaccucaagaauccaccugccuuggccucccaaagugcugagauuacaggcaugaggcacugcaccuggcccaaaucuucucaguucuaaauggcugugauaaaaacuacauugauaauuuuuuuuuuuuuuuuuuuuuggagauggagucucgcucuggugcccaggcugaagugcaauggcgcaaucuuggcucacugcaagcuccgccuccuggguucacgccauucuccugccucagccucccgaguagauggggcuacaggcgccugccaccacccccggcuaauuuuuuuuguauuuuuaguagagacgggguuucaccauguuagccaggauggucuugaucuccugaccucgugauccgcccaccucagccucccaaagugcugggauuacaggccucugcgccuggccuugcauugacaauuaauuuguuuauggaaagccaguuauccaaugauggugaacaaaugcaacuugacuguauaauacuuauuuugguuuuggaccaaagucaccauuaaauaugccaaguucuuguucaaggaaacagcuaaugucguggacuugcaucucauuuguaguugguucucccugaaaagucaguggugugggagaaaugauacuuagucaaaaucaucagugaaaaucauugcuuggaucaucccaaaauauaaugaacaaaagugauauuuaucugccacauugagaaacauucaccauaucucaauaagcucuccucagccaguugguccuuuugugguugaaaaaagugccauaucuuugguugggcauccaauaaaauaugguauuuaggggcuaccuguauggaaaauccauauccuuaaagguuagcucaccaggaggauguugagaaauggcacaaggggcugggcgcgguggcucaugccuguaaucccagcauuuuggggaggcugagguggguggaucacuugaggucacgaguucgagaccagccuggccaacauggugaaagcccaugucuacuaaaaauauaaaaauuagccaggugugguggugggcgccuguaaucccagcuacuagggaggcugggcaggagaacugcuggaacgcaggaggcggagguugcagugagcugagauugcaccacugcauuccagccugggugacaggcaagacucugucuccaaaaaaaaaaaaaaaaaaaggcacacaggaauuggguugggacucaguagaucaguagauuuagaucucccagcuuagucucaucuccauaguguggguggaguaguacucacacuauuuaaauuauuuuuauuucacuaccugaauccccucagcaaguauaguuuaauucaccugaguaauacgcuuaugcgaggggauuucuccaugggccuuuuguuuuugcuccugcuggugaucugauuuuaaaugugaacgugccauugcuaagaguuuuuguucuauguauuauucuguguggaaaauuucuuaaaugggauuauugaaguauacuucauuauuuaucuucuggcaauuuaucaacaacagcaaauaucauucauuauuguuuggaggacagaacuauuuuuauauucuuuaauuaaaaauggcuuugacauuuucaaauucagagggaaguugauaauuuagugcuguaugauaggaccuuuaguuggucugaaugucacauaauuguacaaauugcuguuaaaguauauuauuacuuauuuucugagagguagagggacuugguuauccugggauugcauaauuauugguucacuagaacuacagaugagugaaaagaaggguuagauacucucuaguucacuuuucuuccagugcagggaacauucuaugggguuccgaacagauauaauaagcucauaauaacaguggccauugauugaacucuuucuaucaaacaaugugaaaaacauuaguagaggugauaucuuagucugcuuuugcugcuguaacagaauaccugagacugaguaauuuuuuuuuuuugagauggagucucacucuucugcccaggcuggagugcaguggcgcuaucuuggcucacugcacccuccgccucccggguucacgccauucuccugugucagccucccgaguagcugggacuacaggcuccugccaccacgcccggcuaauuuuuuguauuuuuaguagagacgggguuucaccguguuagccaggauggucucgaccucgugauccucccgccucggccucccaaagugcugggauuacaggugugagccaccgcacccagccuuuuuuuuuuuuuuuuuuugagauggagucucgcucuguugugcaggcuggagugcaguggcgccaucuuggcucacugcaaccuccaccucccggguucaagcaauucuccugccucagccucuccaguagcugggacuacagaugcaucacgcccagcuaauuuuuguauuuucaguagagacgggguuucaccauguuguccaggauggucucgaucucuugaccucaugaucuaccugccucagccucccaaagugcugggauuacaggugugagcuaccacgccuggccauuuuuuuuuuuuuuuuuuuuugagacagagucucacucugucacccaggcuggagugcaguggcaugaucuuggcucacugcaaccuccgucucccggguucaagcgguucuucugcuucagccuuuugaguacuugggauuacaggcaccugccaucaugccuggcuaauuuuuguauuuuuguacagacgggguuucaccauguuggccaggcuggucuugagcuccugaccucaggugauccacucaccucauccucccaaacugcugggauuacagguguaagccacugugcccagccccaagacugaguaaggggugagcagaaauucacugguucacaguucuggaggcugggaagucucguaucaaggugccagcaucuggccagggccuucuugcugugcuaucccauggcagaaguacagaagggcaaagaaagagggcugaacuugcccuuuuauaauggcaccaaccccacccaugaggguggaguccuaauggccuaaucagcucucugagaucccaucuguuaauacuguuacaauggcaauuaaauuucaacaugaguuuuggaggggacagacauucaaaccauggcagguggcaagaaguaucaaacuacuagauccuugggauugugcuuuguacugggguguauuuuuuccaacaauccuaaaaaucauuugaauagagauagcaauauauaucuuacccauuuggaaaugcacagagauucaggaguguucacauagaaacagaagaucauuggcuuuuguccauucccaacgccagugaucuguuuuucuugacucuuuuugaucuguguuucugaauguguugauauacugcgcuacuggugugcaggaugauuuuaaauguugcacagaugaacauuaauagucaucuauuuuaauauguauuaggaaaaagcccauaaaacaaugaagcccauuaaaaccccaugguuucuuggauaguauuacauagggugaagcuaauuuuauuucaguaaaaaauaugcaggucaauuuaaauaaaaaaauagauaauaguauaaauggcuuguggcuacaguaaaaaugaugaugguacuugaauguccaaauuaauuuaagugauauauguguucauagauaccauuucauuuuaacgugguucugcuggucagaacagucuuacgauggggguggucuccaggcuucaccuugugcccacuggcucuguuugguuccucugggcucacacacagggagcuacguaugucucucucauuuccuuugguauguucucuggguuaaauguccccagcuaucugaucuguucccugcgggccuuggccauuccuguccuggccuuuacuggcagucucuauucuaaaaugugggcaucccacaugagguccagcuucuccugagauccccggaggugcagcugcugugauggugaccuuguuuagcagaugcucccugcaguccaaacucccacccaucguccugcccuuugauccauuucccaugaacugcuuaccucaguuuucucaucuguaagauggagagauaacuguaagugcuuagcacaguguuuacuagcacagacuacugcuauuacugucaagucacuuuuccuuugcugccaauaggucauuuucuguuuauggcuucuucaguaugaacugaucaacuguaacuugaaaauuuccagacuuaggacuuuuggacucauagugaaaggauccuuucccaauucccuugaucgguuuuuccuuuaaaaaaaaaaaagauauuugacaucuuuucacuuucaaguucaguuucucuucuccuuuuuuucugggugaugguuuauuauuuaaaaaauuucuauguauaugugauuuaaaaguaaacccacguagcugaaaaugucucauagguuuuucuugcauuuucaguugacccauucacuuugcaaaucuuuagaguauuauauuuaagacagcuugcagcuguuuucuuauauauauuuuacaugacaaaauuauauuuaaaacauauuaaacuuuaaaaaaccauaguuuauaauuuauaagccauguagcauauuucuauuuuugagacaggaucuuacucugucacccaggcuggagugcaguggcucgaucauggcucacugcagccuugaccuccugggcucaaguaauccuccugccucagccucccaaguaguugggacuacaggcacaugccaccaugcccagcuaauuuuuauauuuuuuguagagaugggguuucaccacguugcucaggcuguaauuuuuaaaaacuaaaaaaagaaaaaaaaguguuuacaggacuuuaaauugagaaacuuaaauaucuuuacauauucuguguuccuaauuuauuuuugcagcaguaauuauuucagcugucuuuaguauugacauguuggaaccucggauuaauuugugcauggauauauuuagagccuuuuacuugacaagaaucauguauaucaugacugaauuuguaauuucccagcaugagacccaaauuaauagacaguauuuagauucuaggcaacgaugcauuauauaaaccagcaucauuuagggaguggcaaagacucucuccccaccaguucugugaacuugggcaagguguguaaucuuucugagccuuaaucuaauuagacccuuucuccuguaacccagaggggguguuaguaaaguuggugugaaaaaagucaauuauuguacugaugcaauuugggugaaacugugaaguucaguguucacaugaugguuguggagacacugaaccuuaauccuuaggccagggauucaaaguuuuuuuugacucucauguugaacguugucuaaagugcagugugcccuaguuuuuagguaauucugagaauucuaaggcccuugcuggaauaauuaaugagaauaugagauuucagcaaauuagggccaggagucagugcucucagcauggaagaaucucaccuccaaaaauuuuauguggguuuuacacauuaagcaagcauaggugaggugcagugaaggggaagugauggcugucagucguuuggccagguuccuuugcauacaggggagcuaguggguguauaccagcugagacagcugaaggaggagaacaugaagaauaguuggaaacuauugaaccuccaagauuuuucugucuuuguuaacaacuagcaguuacaugcuagcauuauuuauuuauuuaguuaguuaguuaguuaguucuugagauggagucucacucugucacccacgcuggagugcaguggcaugaucucagcucacuacaaccucugccuccuggguucaggugauuuuccugcuucagccuccugaguagcugggauuacaggggcccgcuaccacgcccagcuaauuuuuguauuuugagcauguuggccaggcuggucuugaacuccugaccuugugaucccccugccucggccucccaaagugcugggauuacaggugugagccacugugccuggccuuauuuauuuauuuuugagacagggucucacucuaucacccaggcuggagugcaguggugcagucauagcucacugcagcuuggaacucuugggcugaagugauucuucuuccuuagccuccccaguagcuaggacuauagugccaccaugccuggcuaauuuaaauuuuuuuugugugugugugugugguggagauggguucucacuguguugcucaggcuggucuugaacucuugggcuuaagcgaucuucccaucuuggccucccagagugcugcgauuacaggcgugggccaccacaccuguccugugcuaggcucuuaacguccuucccagauguuaugucccuucccuugguggcugcugcuuucugccacauuuuaccuugccuuuccgcaccuucuaccaugucuccuuuuccagccucauucccugagauguagccggaguuccaguucagccaaccugcccguuguuuucucuccuggaacuggguguuugagccuccugcauggaguguucuuccuucccagcuaaaguccuggucaucccauuuccaucugaaaggcccccuuguucaugaagccucucaugguccuucccccuaccccagccagguauacuuucucuccucuuggaauuacccuauaggaagaacaugguggcuugaccuggguuccagucucacccaucuguuuaccuggggagugaucuugagugggucaauuuauguucucagugccuuacaaaauggggcagaggauaccuaacccccaggagcugguguggcugggguaccuuacacagggccugacuguaguagcuucucuccaagcauuggugucuuaccucuucuguuucucuaaugguguuuugcacauucauuguuguauuagaguuuguuuuuuugucuuaccuuguuuuaauaaauuauaaucuuaugggagaugacacugucuuuucuuuguuucauauauaaaaaguguuuugcugauauacguagaaucaaguuggucuggaguuacucuggauaagggaugaaaucagggagcucuuguguucaaaggggccuucuucccuuuuuugguucuuucuccucauuuuuuagcuuccauuuuuacuuccuuuaguauugagaaaguaccaggcucacuucaaagaguugacuucaaagcucccaccagcucagacauacuugccacugaagccuguaggaauuggcaucaauggaagacccuguggcgguugcauuuaagauuuuuuuugggacuucuauuuuuauaauucuuuuaaaugguaaagggggaggguuacaaaauaucugcgccuuuaagauaucaaacauaagccagugaaguuccaaaaaaaaaaaaaaagaugucuuagagaaaugaaaaggauuuuacaauugguagaaaagaacaacucuuuuuucuuuuucuuuuucuuuuuuuguuuuugagauggaguuucgcucuuguuguacaggcuggagugcaauggcgccaucucagcucacugcaaccuccaccuccccaguucaagugauucuccugccucagccucccgaguagcugggauuacaggcacgggccacuaugcccggcuaauuuuguauuuuaguagagacgggguuucuccauguuggucaggcuggucuugaacucccgaccucaggugauccaccuggcuuggccucccaaagugguaggauuauaggcaugaaccacugugccuggccaagucuuuuuucuuuaaaaaaaaaaagguuacuuuuacuguuuuguccuaguuacaagaucuuaggacagaaauaaagccuuaacuuguauguaacauuuuccaagauggcuaaguggaguugcagguuacauagcagaaaacagaggcuugggccuguugagaccucacacccaguucuucuuggagcugugggugugggcugaaagagaagacagggagauuaaagaccagugauuucccuccauggacccuuugaugcucuuguuuguugacuuuuugaggcuuggagugaccgacucuuccaggaaugagaaauggaaucccucccaguuuugauggucgucccaggacauauuuccugaaggccuacucugugucucagcaccauuccaggacuccccccgacagccuuacggagcgugcuacagucuuccugauccaauauccugccaccugcccacucauucacccucggcccuaccccaugccuuugcacgaaucuuuccagccugagcagccugagaugggucuuuuucccugcuccgaaauccugaccucauaauggcucaugaaucccuauucaaccuucaagaccugguucaaggguuaaauccuuuaaggagacuucuccugauuuuuccccagcugguugcuuuguucuccagcgauuuguaaccuugugaacaaauauucuacucauuuuauucuacuggaaugaucuauuuacacuuaucucccugcaaauuguauccugcccuucaauggcuaagugaauggcauaaacagaugcuauaggaauugagacuaaguuggagcugggugaucagggaagguuuuaaggaagagaucugggacaaauagcuaaagauggauucaguguuuuuuuuuucuuuuucuuuuuuuuuuuuugaggcggagucuugcucuguuucccaggcuggagugcaauggugcgaucuuggcucacugcaaccucugccgcccagauucaagcaauuuuccugccucagccucccagguagcugggaugacaggagcccaccaccacgcuuggcuaauuuuguguuuuuaguagagacagguuuucaccauguuggccaggcuggucuugaacuccugaccucaggugauccacccaccauggccucccaaagggcugagauuacaggcaugagccaccgugcccggccugauggauucaguuuaugugcaaaauuuaagaggauggguuucggcaguucagguuguuaggagacaaggguggaaagguguccuggagcccuacagagaugggcuucaagugccagccaagguguuugaccauuuuuagaagaggaaugagaugauuaaaguggaacuuuuaggaagaguaggagugagcgggauggauuuaaaaggcggagugagaggcaucaggaaggcuggguaggagagcauugcuacagucuaggagggagguggcagggguguagaccagggaucacaaagcaauggcuugccaucugcuucuguauacccagagagcuaagaaugguuuguaccuuauuaaaugguugaaaaaaucaaaagaauauaugcugugauauguggaaauucugugaaauucaaaugucagugucuguaaauaguuuuuuuuuuuuuuuuuuuuuuuuguggaacacagccauacuuuucauuuaugcauuguuugugguugcuuucacacaaucaugccagcccugaguaguugcugcagagaccauauggccugcaaagacuaaaauauguacuuauguacuaucuggcucuuuccagaaaaaaucagcagaccccagguguagaccaaccagggugaaugaguguaugacuggaaaugcaaagacgggcaggaucaagggacaguuuagagcagggguguccaaucuuuugguuucccugggccacacuggaagaagaauugucuugggccccacauaaaauacaccaacacuaacaauagcugaugagcuaaaaaaaaaaaaaucacaaaaaaucucaaaauguuuuaagaaaguuuaugaauuuguguuggucugcauucaaagccauggugggcugcaugcgggccauggguuggccaagcuugguuuagaggcggaugcaguacgggagaguuuucccuucucuucugauguaacuccaugucuugguggcgguguucuagauguaggcaucuuuaggcaggggagugugcguggaagggugaaaggguugugccuucaugacgcucguguguguguguguguuugugugugugagugaugcugagcuagucuuagaguaaaugcagacacuggaugguagcgaguucagugcaguuuuuauggagggacagcuugcugccugcugaugaagcuggacaagacuggguagugaagucaaaggcccacaccuaacucugaggcucuugggggcaacuguguugugcagagaagguaggagggcagaggaagaggaggagcggccccugggagaaugccuucuacccagcugcagcuucucaaggguguguuugcgucugaccuaagguguuggagcucuuuguuucuggcuguguucaggcuuucccccgcuugccuuuaggggaagcugaugacugcuuuagcguaaagagagggccaggaggucaacuucccuacagucccgugccugcuucuggguuggggcuggggagagugcugcccacugaacucucuaaauguuaaaagauacaaagaggaagcacagagugaaaagggagaccccagaggacagcagaacaucccgaagcauaucccccaucagagaagaggcaugauuuucaccuggcuugcaggugcaggaugggcaucucagaugcugugagucugagggcagaugcccaucaguccaggacaguuccuggggacaaaagccucuucucaccuuuagagaaauuaagucuuauugguagaaaauauuuuagagagguucuggucuaagccucucauuuugcagaugagaaaccacccaaggcccaagauggauggauuuaucaaagccgguugguacuggaacuuggauuuaauuucaggucuuuuauuauuacuauggaacaaaucuuaacuuuuucaagugcauaccaugugcccggcuaugugcuggauguagaugcuuuaucugcagguuuaaucuucacuacaacuaugggaaguagcuauugucucucuuuugcaagugugaagagugaggcuuagaaaggccaacuugccugugaucggguaacucaagagggaaauuggaucagaguccaucugagacugacuccagagccaauguucuuagccaauaggggcacauaaaacuguucugaguggcuuccuagcuccuguuuccaguguccaauccauucucgguuucuguucauucaucagaugugcacugaguaccugcaagaagucagaaggguguuggguuggugaggacagauuguauaccaucuuggcuuuggccgagccaaacagaaugccaaagaucggcaaagauagggaaugauuguucuuggccucagcuccacgcuccccuccucuguaaaacugccccugacaccccggcaggauugaauuccuccaccuuuaagcucccagaguaccuuagcucugucuuuagcacuucacacugugucaugccuccccuugggcccuaaggccaagagcaugugccauuuauuuuuguauuccuacuucuauagcccagugcauauugggggcacucaggaauugcugagcgaauaaaagaaugaaugaauacagacccagauugucaaugauucucaaaccuuauuuuacaaaagaaucacuugaaaagcugguuaaagaucaaaacuccugagcccuacuccuggugauugacuccuagguuuggggugggaccccagaaucugaauuucccggaagcgcccagguguuucugaugcggguggucugcaaaccacacuugcagcaacccuggcacaggugcccagccuucuggaauaaagacaggaacuaagcauuaaaaauagcacgccauucauuugcuugugccgagccgccaagugcccccuccugccggcgacagguccggaugugggccaguucucagcccagggaaaaugaacagugucuucuccguggugcccagaacagucugagucaguggaaugugcuggccagucaggcagaagggaacuuccacuucuuuuuuaaaaccuugguggaaacugugcuggcaaggcaaacagggaggagaggaagcuccauguggggcuugggcuuggcggacgacuuggggcuggccggacuuuggguggccgccgaggaccauugcuaaauaugccccuuucguccugaaauagucacuuccccggcuggcuuuuguguuggucggucgccacaaauguguggcuguuguucaaggaggccuccugggauauaaaaagagagaauggggccaggcugcggccagggcuguguaggaagacaggagagcugccuuuucuccugucccaccacggacucauuguaagauucagagggaguggcuucugggcccuggguuuacuuuuccaucuguaaaauggguggggggaaggggcagcaucauaaagcuucuuucuucuccugaaagggauguuuuaaggcccaugucaagauugaacacagggcucuguuguugggcugaugcuacugaugaagucucaggaagcucgaaguuuguaguuaacucuuucaggguagauguggugaauagucucuugguauuguguugaugguggcccacuagaacagaaggucccagagggcaagggcuuggucuuucuucuuccucucuguauccccacuguuuagaacugggcugggugcagaguagucuccauaaauguuuauggggccaauaucuccaaauauuggcaccuacuaagcgucagucccaucucucuuuugucuucuucacagguuuaacuugcuguuugagaagaggcgauaugaggagcagggcauuuuuggaggaagaaacuuuaccucuguuuucaacguuucauccaguuucucuucuuuuuacuuauuuggagacauggucuuacuuuguuguccaggcuggaggcugaagugcaguggcacaauuauagcucacugcagccucaaaacaccuggccucaagugauccuccugcuuuagccuccugaguagcugggaccacaggcuuacaccaccauaccuggcaaauuuuuuuuuuuuuuuuuuuuggagaggcagagucuugcuccguuguccaggcuggagugcagugguguagucauggcucgcugcagccucugucuccugggcuuaagccauucuccugccucacccuuugagccuccuuaauuuuuuauuuauuuauuuuuuuuuuguagagacagggucucauuauguuguccagccugauauugcuauuuuuuuuuuuuuaauggcgauguaguaaucuugcuuuguugcccaggcuguucuggaacuccuggcuucaggugugugccacugugccuggcccaguugcucuuuacaugguggaauaucagagguuaaagacuugguaaaaauucaugcggugcaauaaaccauguauuacauaauaggggugacacuuguuaacuucucccaggcucaguuuccucauguguaaaauaggugaauaguaucuacccuccaggaguuguacaaggcucauguauacauaguguaugugaaugugcuguaugggugcaagggguugcagaagugauaauguguguaaacagauggugugguuggcucauuggagggguggaggcccuaagugagaugaccucugagguuuacucuuccuagaguaguuggaaagcaauucagccucagugguaagcucucagcucuucuagggcaggucccucuuccaccacccugugucugcaagcauuuugguauuaaguuguuuuucuaaggcugggugcgguggcucacgccuguaaucccagcacuuuuggaggccgagguggguggaucaccugagaucaggaguucgagaccagccugaccaacauggugaaaccauaucucuacuaaaaauaaaaaauuagcugagcgugguggugugcgccuguaaucccagccagcuacuugggaggcugaggcuggagaaucgcuugaacccgggaggcgaagguugcagugagcugacaucaugucauugcacuccagccugggcaacaagagugaaacucugucucaaauaaaaaauauuauuuuucuaaaaagcucuuauuuuauugugaaacacuuaaauuagcaaaucucaggcuugcugaauaaggcuucccaggcaaaccacaucccacaugugcaaaugucuggugacacagugcuucauuuuuuuccacuaguacuuacuacuaccugacauuauaguguaaguuuacuugucuauuuguguauggucugccucuccuaugagaaugugagcugcaugaggucaggacauuguuuuguucacucaugaauucccagcacccaggacagugucuggcauguagugaguacccaguaaauauuuguggaaugaaugaaugaauacuuaagugggugggaaguucuuggaccuuagucuagacccaugguucucaaagagugguccugggacucuuggggauuccugagauccuuuuagggaucugugaggucugugaggucaaaguauuuuuauaauaauaguaaacuauuuguccuuucacucucauucccucauguaugcaaaucucagugaacugauauuuuccaaauaaccaaugcauaaggccacaaagccaugcaggguaaaaagagcuaugaacaaaaguuuucuagagaagaauuuggaggaaagagaguuuauucuagugaacagaucgcaaacugggagaugcugcguugguguaaaaugaaggugcauuccagagagcaaagagagaaucuaguuuuuuguuguuguuguuguuuuguuuuuuaaauuuugagauggagucuugcucuguuucccaggcuggagugcaguggaguggcgugaucuuggcuuauugcaaccucugccuccggguucaagcgauucuccugcuucagcaucccgaguagcugggacuacaggcacuugccaccacgcccacacacccuacuaauuuuuguauuuuuagcagagacgggguuuuaccaugcuggccaggcuugucucgaacuccugaccucaagugaucuacccgccucagccucccaaagugcugggauuacaggcauggcagaaucuagguuuuuauagcaaaauuucuggcccauguccccaaucagguuugauuaugcaaaugaagggggcgggucaaacuugcuuaguucugauuggcugacacagcugaguucugauuggugauacagcugagcccugauugguugauacagcugagcucugauuggcugaagcagacgagcucugacugcuugguucaugugagcucugaaagucccaagucaaaagggugugggguuuugugaaacuuggaguacguagugugaccucuagucagcaaauggccacuuggcuguauuuuaaauuuagguacacuuugcugcuugggguccaucuugaggggauugccuuuuucagguucauguuuguucacagagccauucaaagugcaguggauacauuauaaauuguacaauuauuuguaauuaaaaaaagaacaacagcaaaaaacccaaagugcaguggaugcaaagaccaauggauuuucauguaacagaauaugaaaaguucaccgacacaguuucacauuccacgaugcagagaaguuuuuaauaacugccauccacauguugaguuuugguguaacagcaaagaaaaauauccacaacuacugaaaaggcugagaaaauacucccuuucucaacugcauguuuuugugugaguccagaauuucuuuacauuauuguaacagagugaacgcagaagcaaauaugagaauccagcuguuucuuacuaagcagacauuaaagagauuugcaaauaucuaaaauaaugcuaucucucucacuuuuuuuuuuuuuuguauuggaaacaucauuuuccauacaaugucauuuauguuaacaggugacagauuuauuuauuuuuauuuuuuauuuuuuugaaacggaguuucacugugucacccagccacccaggcuggagugcaaugguacaaucuuggcucacugcaaccuccgccucccggguucaaaggauucuccugccucagccuccugaguagcugggauuacaggcacccgccaccacacuuggcuaauuuuuguauuuuuaguagagacgggguuucaccauguuggccaggcuggucucgaacuccugaccucaggugauccacccgucucagccucccaaagugcugggauugcgggcugggauugcgggcaugagccaccaugcccaacaacagauuuauuauaagcaaaagcucuuugggguccucaauaauuuuaagagcauaaaggagaccaaaaaguuuaagaugugcuggucaagacagagcccuguggacuauggaagggauugaagccauucuguggauccuauaggcuucuuuucuaagcgaaugauuaguguuuauucaguagcccuaugucaggugguuucuguaugaaugagagguuugccuuuccagcugcggcggggcuuugggcaaguugcugucucugugcuccuucguuugcucauguguuaaaaacuggcccaggggucuggggguggggugguaagaaaauggguugagucuccuucaucucuaacauuuucauguuuaauucuuggaaccuccacuuguuagcucuguucacuccucugaaagagauuggugagaauugaaacagugaaagaagauuuuagagaaaaggugacauguaaagcugaacaaggguugccugugaggcaggcaaaaaggacauuuauuauauuuaaaaaaaauuuuuuuuuugagacggagucucugucgcccaggcuggagugcaguggcaugaucucggcucauugcaaccucugccucccgguucagcgauucuccugccucagcuucccgaguagcugggauuauaggcacacaccaccaugccugguugauuuuuguaguuuuaguagagacgggguuucaccauguugaccaggcuggucuggaacuccuggccucaggugauccacucgcuucggccucccaaaguguugggauuacaggcgugagccaccgugcccagcccagaaaggacauuuauauguggggaccacugcaucuugcagauggguaaacugagguagcgacaggugaaggcucaguuacauucauccugggucccagacugucuccaaccuguagccugaagcuuuguuuccuuccucccuagcccaggaugacagcagugaccuuccaugggaucuuuuccugggauuuauugagccacugaggucauuggccucaggccaccugcgucucucgacugaccaguuauucuucaaggaagacacuguguguguguguguuuuaguugcucuucuauaacuuccgggugcucuucucagagcagcagugcuuuaaaaaaugucuguguguguauuuccccacuuugagccaugaaauauguucagucuguuuuuuuucuaguccaaaguauuuccauaucauugugcaccugaggaaaugcauacuuugauagaaaauggacaaaaaaguuguauugguagaauuaaaugaacuaaugcaugucaagcacugagcacuuugacucaauaguaauaauaauaauaauaacacaauguaucauuaugauaguguuauaucucuuuagcaaucuugauaguugacuuguauaauucacaguacagaagcuuauucuaaaacuaaaaugcuuugguucuccugugugccaggaacagcaguaaacuuuauguccuaagauuaguaugguuggaaaugcauguggcagugguucccaaacacuggugugcagauggaacacagcccgugaaguuuucagcgguccuuguuaaaaagagauaaaggaaagagauaaaggauaaagugcugagauucucgugaagcuaaaugaagcuaaauaaacauccuucaaugagaauauguccuuccuauaguuuuuggaggaaaauauuuccuuuugugagacaaaaguguuaguaggugguaaguacuuuuuauuuagcauaguacaaaguuguggcccucugucaacccuucacauuuugguguguguaauguuugaaacugcauuggucuguaaaaucccaaacccagguagauaaaaccaagaagugacagggcuggaagggaucuuaggaauuaguucauaaagaacuucaggcucagagaagacaugugaguugccuaaggucacacagcaaaucugaagcaaaucagggcuagaaacccauagacgauggucaugagcacugguuuugagucauccauuugaacacaccuguguucagauucuaccucuguuacuuaugagcugauuucuuaccugugaaagugggauaccuacccaagggguucacgggaggauuuaauaagaugauuuggauuaggaaaaacugacaaauuuccccuuccuucuucucccugccuuccccucaccuguuaauaaauagauccuugugaaaggucagugagcagcaucagccagaagggcuuuguuuucagcaaggucccugcauguaugauuacaauccuaaguaauaucagcuguugcuugcguugguuucucagcucucucuuggugaucucucucuuuagcuguugaaugaguucaaagaucuaggaagagcuuugaaaccccucuagcagcauuucugucuccagucccagcacaggucuuuggaggaugagauaaaaaggguuuugcccagggucaaaugcuguguacacgcuuggucacucuucccuuucuugagaugacauguccccuucuuggagacccaagaugauugacaacaauaacauuccuuuacaacguuuucuucucaucuagagcacugggaggcugccuuuuaacagagauaucacagaguagcaagcaugcagacauucucaugacauccuggcagauaucaagaccaaagaacaucccauguucccucuugaaggcuuguaauaacugccauaaauuaucuugugggaauggaguggcccuggccuaagcugugcuguaccggacucuccuggugacaguuuuaguggcugcauauguuugcagaagaaggaagcgugguaacuuggcaaacagcuccaaacgcuccuggcuugcugccacaggauuguccuugagacuugggcacagugaugugugaaaaaugcccaccuuugcucuugguguccagugggccuucuaugggcccucuauagaggucaucaccuggggauuccugacucuggccagguccugaggucuuuccauguuacucuccauguuacuugaguaacauaagagcuucuuauggcucuuauguucugcaggacggaugaacuagguacccaggacaggucuguuugugcacaaggcugucuccuucucccccuccuugguuuuucuacugaggcuuuguugugcuuggcucagggugauguuagcaaaugcacucuccacccugcugugccacauuaaggaaacgcauguuguauuggcuucugccaagucagcucacaugcuuuguuuuagugacucugugaagagcucaucaucuauuauuuauucagguaacacacuucuaucuccuaauuucggugcuacucccauuuuucauccccgguuagcgugcugugcgccaggagggcugccuguugucuuuaagaaccacuuugaacauuuuugcuuugguuauuuauucauaccaacauguuguuguuaaaugacgugaaauaaaaccccauuuuaaaaagaaauuguaaaaggaagcuauguccuguguggaaaucaugacaagcccagaaacauguuacaaaaacauuaaccaggagcgguggcucacgccuauaaucccagaacuuugggaggccaaggugggcagaucacuugagaccaagaguuugagacuagcccggggaacauggugaagcccaucucaacuaaaaauacgaaaacuauccaggcauaauggugcaggccugugauuccagcuacucaggaggcugaggcaggaaaauugcuugaacccgggaggcagagguuacagugagccgauauugugccacuguacucuagccugggcaacggagcgagacuccaucucaaaaaaaaaaaaaaaaacaaaaaaaacccacacacaacaaaaaauaaauauugccuguaccuaucaccugaggagcccauuguuaaugguugugugucuuuuuagucuuuuaaaaaauguguuaaaaaauguaguugucauaauguccguauauaaauuuuuaaguggaguugauagauuucauuugaagggcugcugugucauaaauguaaaaugcuuagcaaggugcuuggcaccuggagcuguucacaguaaauggaaggaauuuuuauggaggguguaagguagagugggcuccugagccagacugcccuguuccaggccuggcucugcuauaucuggcugcuagagccucgagccagccauugaagugcagugccuucauuuccccaccuguaaaauggggguaauuaucauauaccccaaagugcugucauaaggauuuaaugaaauaucccauguaagauccuuagagcacugcugccggauggucaucucauaguagguauugguuguuauuauucaggaaaauguuggaaaacacauuuuuaaacaaagcugguguucaguccccucccuccccccaaccaaggaaacucucuuuaauucccagucugcugugauucagugcuggccugggagcagcccucgagggcagacacagcacuuguccccuacccagcacagcaccugccugugcauccuuagcugaugaaugaggcucacagccccaggcgcccugcauccuucccuucuuucugguacccucuuuugucuccuccaaacacuugcuacucaggcuucagggaggaaguaggaaguaggaggugguuucucccucccagacccccagcucacacuggucuugaagggcguggcaucugacagagcccgguggcugguuuucacgugucuccugaagccaccccuaaggagaaggcuucgaugucaucuucuggucagagccgagcacagugguccucuucagagacagauccgugcagcaggauggcaccucuguuguccucccagacuagcaguagguacacgugggcuucgcaggcuguuuucugcccuggaaugcugcuguuuuuuagacccagcauaccucagugucagagaaggcugguuuguuugaaacggucagaaugucauaaauaccuuaugau[450 bp omitted]cgaggaggaaggcggggcaauguuaggagccucugugccuuggagcugcaggcgaguugucuggucuugggugauucccuuccuauguuugcaucucaauuuucccucuuguaaaauggagcugagagcaucccuuauaucacaggaaugucauuaggauuacuuaagguguuggaauguuuccuggccuaggggaagagcucaguagaagcuugcuauugcccuaauaucauuacuaucccagauaugcauuuucuuguuauuucccuguuaggcguuaagugugugaaaguguguguguauauuuaaaaggucaaaguaaaauucuuuagaaccuuagggcaggauagcucuuguuuaguuagggguguuuggugacugcuggagaagucaccuacccagcugaucuuacaauuacugucugcuuaaaggcagcucuugacuuggccuucucuaggggaaaaacauguaguuuaugcaacuuuucuuuucccuuucugcucuggauuugaccuuuuguuccuucaggugauugaaaaaauucgaaaagucaccuguuuccucagaauugcuuuaagacaagacuaagugaaccaacaagaaugaagucagcuuuuuggaaauaccucccaagaggccuugcucuuuaugcaggacuguuauuucaaaggaugguguccccuccccaaccauaagaacgauccaaaccuguuuucuggggcccagaguuugcugaggauaggacugggcugaagcuuucauugcuggucugugggguagagguaagccuccccugugaagcugguagguuacaugcuuuggcaacaugaauuguuauuucuggaguccccugggugcuguuuagaaaugcagguagguggcugggugcgguggcucaugccuguaaucccagcauuuugggaggccaaggcaggcagauuacuugagcucaggaguucgagaccagccugggcaauauagugaaaccccaacucuacaaaaauacaaaaauuagccagggaugguggugcaugccuguaaucccagcuacucaguaggcugaggcaaaagaauugcuugaaccugggaggcggggguugcagugagccgacaucgcgccacugcacuccagccugggccacagagcaagauuucaucucaaaaaaaaaaaaaaaaaaaaaaagaaaaagaaaaaaagaaaugcagguaggugcuucuagcuacugcugugggauagcaagguaguuaccaaacugauaaggguagcaucuuacuuacugcugaaaaauucagugucuuuuuucuuuuuuuuugagacagagucuugcucuguugcccaggcuggagugcaguggcgagaucuuggcucacugcaacuucugccucuugggcucaagauauucucuugcuucagccucccaaggagcugggauuauaggcacucgcuaccacaccuggcuaauuuuuguauuuuuaguagagacaggguuucaccauguuggcuaggcuggucucaaacuccugaccucaggugauccacccaccucagccucccaaagugcugggauuacaggcgugaacuacugcgccgggcuugaguuugacuuuuugaaaauauuccaccuauaagugaaguugugcaguguuugucuuuauguguuuagcauauuucacucagcauaauguccuccaggcucugaugggcacuuggcuuguuuccaugucuuggcuauugugaauagugccgcaaugaacaugggcaaauugccguguugaguuaaggaagcucuuuuccagucugaguuugcaaauagcuuuucauauaugagcguugaauauuaucaaaugcuuuucugcauucacugagaugacuuuauguauuuaaaaaaaucugauggccuauauuuucuauuucuaaacuacucguguauuccugguauaaaucaacucaguguguuacucucguuuuuauacauagcuggauucguuuucacuaauauuuuguuugagauuuuugccucagugaucauguaugugauugcucuguaacuuuucauucacauuuuguccuugucuguccugguaucaaaguuauauuggcuucauagaaugagggaaauguuuauccuucuaaaaauauuuaguagaguggucuaagaugagaguguaagugaguaaacuuucucaaucaaauauuuugugauauguuucaggaauuucauuacauguuugguucaauuuuuaaagcauuucuuuuuauuauuuaaaacuuuuagcauuggugaccauccaugugcugcuuuuauugccagcuuaacuuguuuuuaugacaucuucaggaagaaaaccucugcugucuauuuaauggagaugaauuguuaaacuuuuaccauuugcaacuacacgucucuaugagucagacuuuuauugaucguguacaacuaaaugaaacccggaaaugaaggaaauguaacaagcgauuuuauguauuuuuuguuugcucaaauugccuuuauaaaauagauugauacucuauaauaagcaaauguugugaauuuggaauuuucaaauugaggcuuacuaauaauguuaacuauuuuauccgaguuuauuuggguuucuuauaaaauguaauuucucaagaagauuuugcugcccuaaaaaaaaaaaaaagaaaaagaaaaagacaaaaagggaagccacugguugcuaauggcuccugcggcucugacgauccucgaugaaguguucuuugauuaagugucaagaugaguggugcagaccuuugacagacacaugauugugguuggagaaagcccagcauuaacugcugaccuugccaucugugagcagguguugaaugagcucaguucccucccagcccuucuuuuucccuggugggucauuggcuccugaguaagauagaugcaugcaauagaagagcuguuaauagcauuuacucuuucuuaauccuuauuaaucccauucauauuucagugucugaaacuuggcaggaugucaagaagccacagugcaaguagggaaauugaacagcaaggaccaaguacaauguuccccugauauuuaauuugcuaaaacauguaagaagaagaaaguucuuacauuguuaggucccaaagagagugccacuaagcaaccuugccaaaaccaccuugcuggagcuucuuauuaucuuuuuuuagcgaauggcaauaaagucauuuugucaagcuaaccaaguaccauaaugagaucuuuguggcauaaauuaaccgaguggggaaauaacuuugacagggguugauguccgaaaugaaguguuguuugucugaugucaagccuguggggaauuugaaccuugcacucuuuccugauaagacauuaaccucugcaugggcuugcuggcccaaccuuuugauuaacuggaccuauuuucuuguagaucuaauacaaggauuuggagaaccccaguaaaaugcuggagggacuuagacucugaucucuauugggaugugucaaauuggagauuuggugggcuuuucugcuguguuuacugcgauggguguguguauuugaagucuguauguggccuuuaaggauguguuuggggcgcagaaguucuggguaacagagaggcucucaaacguuagauuuuggauuagacuuugggucaacuucaggguagcaagaggauggauacccgagaacauguuuucuccgacuuccuggccccugucuucuaaguucuggguagugaugggucuuuggaggggcagcccuuucugccaugugaaucuuugcccagcccugagggggugagggcuggccaagggagccgggccauggucggagagaaggcugaggcuccuugagaagcauuuggaguuugagucaguugugucuuuuaaaaaaauuacccauuuuggacuugccuguggaagcaauuagagagaucacaggaccguuucugauucccaauucuguccagugucuauucagaaaaauagaaaacagucaacuggaacaggggauuauuugagcacacacagaguccuguugucucagcagcgugcccucagacaauuugccuuuuagugaaguuuaagcccaugaaaggaaauaaaaaguguuuuauuagauggcaaagaaagauggacuggacuuaugagacuuugagaauuuuugcuuuuucuuuguuaaugcaaacuuuggaagagagcaacucuuucuguaaugcaauuuauuuguacaaugugguaguuauuguuaauagcuaauaaugaucuucaacuggguaaaauaccauuguguguuugagagggagagagagagagaaggguaggaggagagggagaauaucuuuuguucaaagccaaauguugcuacuucugaagacgagugcaccuuauggguauagccagcuauaauguuuaucaaacauauacuuuuuuuuuuuuuuuuugagauggaguuuuugcucugucacccaggcuggagugcaguggcaugaucucagcucacugcaaccuccaccucccagguucaagugauuucuccugccucagccucccucguagcugggauugcaggugcacgccaccacacccagcuaauuuuuguauuuuuaguagagacaggguuuugccauguuggccaggcuggucuugaacuccugaccucaggugauccacccaccucggccucugaaagugcugggauuauaggcaugagccaccaugcccugccucaagcaucuauuuugugcaagagcuugcagaaguucuuuccugccacagccgugguuggccacauugcucccccaugaauauguggaaacugacacuucaggagaauugguggcucacccauggcauucagcuaguggguuauggggcagagacucaaacucagcccugacucccacagcauuguucuuuuucuguaaauugcugacuuacucaguugaucacaguucauugccguuuacagaauuugucugcacccauugugccuuuuaagugucgauuuucuuuccugaaagcacacaaagcaaagcacggcucugcagugugacccaccgugugcuguguggacagaugaugcuggucagcaggcaggaaaacgaucugccaggcgcuggggguggggcagaggauuguucuuccugaccuugguaugaaaaccguauggaguucuuagugaggaaaaucacucuuagcccaaauuccugcgaaggccgaugggauuguuuuuaagauuuguuggauugcuggauuuguugaagggagaacuggaagaagcuaucagaaguuuacagggcaucggagggagacacucccuuuggccacuuucuccgccaaaacuauccugguuuuagcccaacaguuucccacgcccgcccccacccccacaaccuuguuuguuuaaagaccauuaaagaacgucuucaauuuauucuggauugaguuuuccucaaaccaaaccaccccucaguucaccccccagagcuguugaggcccuuccugggggcuuguggcuguggcugccucagaucagagcagacccugggcugcaucauccuuccacauugucucucuaaaguaccugaagccaguaguucucaaacuuuggagaggguuuugagucaccucgagagcugauaagaacagaggcccagauugaaguugaauagugcugggccuuuguuuuuaccaaguucccuggaugguucugcuaccuccuagccugugagaacuacuccuuugugauuucuugccauugaaauuuuuucucaccuucuucuuggcuugagugcucuucuggguuccuuccggcuguccaaaucaaauuuaauuuucacacccagaccuugucccugcucucauccuucagcccacccuccuguuccccauucagccagacccccugccagucaguucaagugcuaggcaugggguaucgagucucaggccgguccacagacauuccagcaccuggugguaagaggugagugcugcguggacccacugaggaaggcucuggcugugcugggggaggggaguuuaugcucguccucauagaaggauaagcaggaauuaagugggcaaaggagggagugaggaagcucucacuuucuagguaguaggaccagcaugaaccaagguaggggaugacaacauggcucauucagggaauuugagguauguugauacauggaaaaauguaccugaaaugugaguccugcuuuugugacucacccuuuccuuuacauaagcauugauuuacaucuguuguuuuuuaagauaguguguauguugaaaaguucagaacaagaucaaguggagacauaaaaugguaagaugugaaaaguuguucuugccagauuaaaugguuccaccugaagaaaauuuuuuuuuuuuuugagauggagucucacuuuguugcaugggcuggaguguaguggcgugaucucagcucacugcaaccuccgccucccggguucaagcaauucuccugccucagccucccgaguagcugggacuacagguauacacugccaagcccggcuaaguuuuuguauuuuaguagagacgggguuucaccguguugccccaggcuagucucaaacuccugagcucaggcaauccccagccucagccccccaaagugcuaggauuacaggcaugagccaccgcacccggccugaauuuuuuuuuguuuuguuuauuuauuucuugguuuugcuggccuuuaagcaacccaagacuagggggcuuucacuccgucccuagagagcucaaagggccugacuuaggggacacagucagugaaggggaugaaugaaugaguuucagauccagguguucuggauaagucacuuuaccuuucugggccuuuuuccucaacuccaaacagaggaugucgguauagacaaucccuaggaucuuguccccuuuaugacugaucacacaguuccacugcuugcccuugaggcuuugguguccgcgcaugccuauucagucugacccacaagaggccaggccagcucuguuccaggcccugaaaaucccauuaaaacuccacucacuagccuguucccugggggugcugaaucagcauuuaauggggaaggccacgagcuaggcucugguggguaggaagugugugacuucucuuaccucaacaguuucuacuguaacuagcgggauaagguaaaucuauggaaaugcaaggcuuaugccgaggcucacagagugggccaggcugcauaaguccuggacaccacagggccugcuuugagaaggcagcuguggucccacagccuugaccaccaggcaccauccucuguugccaguggacccacauuucaaaucauuuuaucucuuuuuuuuuuuuuuuuuuuuugagacggaguuucgcucugucgcccaggcuggagugcaguggcgcgaucucgacucacugcaagcuccgccucccggguucacgccauucuccugccucagccuccuguguagcugggacuacaggcacgcgccaccaugcccggcuaauuuuuguauuuuuaguagagacgggguuucaccguguuagccaggauggucccgaucuccugaccucgugauccgcccgucucggccucccaaagugcugggauuacaggcgugagccaccgcgcccggccuuuaucucuuaaauaaccuguauucauuuguuccuucccaugucuuauccaccaaaaaucuccaauuggaaauucagacaaggauugagacccuguguucuuaaauuggguugauugaaaucuagaaacaaugauaguaauaacagaguuaucuucucucgaacaucugccuccugccugauguuauuucgcuuaauucucucaagggcuugaggagaguccugccauaauccuuccuuucagaggggaagaucgaaauuuagcucagaucucaagcuaguaaucaucagaaccaggauauagaaucaggacuagaccacauggucccugcucugagcugcugcggguccaucccuguggcucuguccaggguaaauggaugauucaggggaagggucagcaaacuauagcccaugggccaaaugcagccacugcuuguuuuuggguggcccaagagccaagaauaguuuccacauuuuuaaauggguggagaaaacaaaaucuacaaagaauaauguuucaugacacaugaaaauuauguaaaauauacauuuaacgcuuguaaguaaaguucuguuggaacucagcuacagucguuaguuuacauaucaucgauggcugguuucgcaguacaagggcacaguuuaaagccugccaggccuaaaauguuuacugucuggccuauuacagaagacguuugcugaccccugauuuagggcauucaugaggcuugaugagauguugaaaaucagcugucuccucccgucacucucuucugauuguggguaggcucuggugcaccagcucuccagugaucuccuaucugaugcucagaguucuuuuuccauugcauggaugucaaauaaaagugucugcuuuguggcauuucuggcuugagaguaccugcccaaugugauuugccaaggugccauuuuaucaaaagucuuaggaugacuggauggguuugccuugaauuuguuuugccuuugcugaugguuguauuuagguuaucauugaaagaggauugcagaacagcggcaguuuccugugcugucuggauugaaguugaauaaugcccuaacuuuuaauugaaagggacuguuguaggcgggagacugucuaagagcugaccugucaccaccaccugagaugucugagcccacccuuggacuuucuuggcacguggggaagagggggccuggguccugggcucccaccuaaacucagcagaccccacuggcagguguguguugugggggugauggaggcuuuuuggagggcauugagcuccuuggguggaggugggguggcugccuugggggcucagugcagcucuggccaugauggacagaaggagacaagaauguagcuucuuguucugagaacuucagcccaaguuccuccuuucaugcagcagaauccaagacacugacuugccccucucugcuguugaggcuucuguguugcagagauaccuucuggcccugcuuuauccuagugaggcagcucaccucucccguguuucacugcucgaacucuccuucccaaggcugugcuagugguagugaugacaauaauagcuacuauuuauugugugccccucguaugcuaagugcuucacguagauuauauaauuuaauacuugucacaacagucuuaugagguaaauacuguauauauauuuaaaaagacuauuuuuagagcaguuuuagguucacagcaaaauguagaggaaguuucacagagauaucccaagcaccccuugccauuuucucuuaguuaugaaaaugaucaaaugggcuggguguggucccagcacuuugggaggccaaggcggguggaucaccggaggucaggaguuugagaccagccuagccaacauggugaaacccugucucuacuaaauacaaaaaauuagcuggguguaguggcacaugccuauaaucccagcuauuugggaggcugaggcaggagaauuguuugaaccugggagguggagguugcagugagccgagauugcgccauugcacuacagccuaggcaacaagagcaaaacucugucucaaaaagaaaaaaaaaaaaaaaaagaucaaauagacuuccaagugcccaugucucagguucaguacugaucagcauuuuacccuccuuugcuucagcucccuccugucauugcucauugcugagaguggguaaggggcuuucucagguuccuguagcugguaggaucccgcuguccucaaaguuccugcacucaguggcugacggugccaggugacucccccuuuugggguccaugacauuugcugcuguuucuaaagccccuacugugugcugcuaauccccucaccaagcuugcagagcggaugguaacugacaggugaaaaaaugcaagaaguuaggucacggguccggggacauccugcuaauaggugguggugccaggcuucaaacucaggccugacuucaagucccgcagcuucucugccccacccugucucuguccuccucaccucuguaguguggugggacucggugggguggucguuugacugugggaacuucuguuugcaaagccuuggaaggacccaggugacugcagauaguuccgugagaagcaucugggacuguugaccucacugcugaucuuccuugugagccugugauagggcuaacccuuggcuuucuggccagaguguagacagagacccgauuagcauuuuguggucagucagaggcaguuugugaaccuggaacuuggaagcugguuuccuccucugggagggauguggagccuggggagccaggaaggcauggacugaauauacacccagcugggcaguggggaagggaggauuccguggggagcuagcccugaacacagcaagcauuugguaaauggugccuguuagcuguuuuuauccguauucuaagguggacgagcggcgcaggagagaacugguaggauuaauggagugguuucauuauucagauuuaagugcaugcagccagaagucuucaacugaagaauugaaacucucugcucuuuuuugggggucaugguggcagugugaggggcugguucaugagugaggagaaaagguaguggcaggcagaaugguacauuuuauauucauauugugcacauuauucacaccugacaugggccagaaauccucuccuaagagagacacuuggaaaguaaacaguuuguuaaucauuucaacccguggacuuugguugcagggugcauuuugaucaaggguuacaaacaccaaugucuucagggacauuuggggacauaaauaaagggaauggacaaaaagauggaaaagcauacugccucucagucuuucgcaugcucauguuugauagagaaaaucaacaucgugggggcaguguugcuuggcaacugccauuuguccucagcguuggggugacauuacuagggaauggcugugaacuccaagcacuuccccccgggaagcgaggcugacacucagauccaauucaugucuuuaauguggccaaaugagaaagccagauguauuucugagaagccaaaaaacaagauuuaaaaaaugcuaucucccuaauuuuuuuuuuugagacagaguuuugcucuuguugcccaggcuggaggacaguggugcgaucuuggcucacugcaaccucugccucccagguucaagcgauucuccugcgucagccucccgaguagcuaggauuacaggccaccaugcccagcuaauuuuuguauauauauuuuuuucaguagagacgggguuucaccauguuacaggccaggcuggucuugaacucccuugaacucaggugauccaccugccucagccucuaaaagugcugggauuacaagugugagccacugcaccuggcuucuaucucccuaauuuuuaaauacuuaagauuuuaagaaacaucacaggucaagcaaugcauggcagugggcuagauucagacaggggagccucaauuuaggacccccagauuuaucauacaagguggaggaaggguucagauagggacuuggggauugccaacucugacccucucuucagaugaagagauuagcccuguggaggaguccaggauuuguauuuuagucuugguacuggguguucuggguugaguugcuagaccauucugggacaaguugcuagaccauucugggacuuacuuucuuccuccauaaagucaaaggguagguagaucacacauuuuuaaagugugcuccuugaggugugucagggguuccauaagcauuugcuuucaguuuuauuaaaagcagccuguacucucaaauuugaguauauuugaaauuguaaugagagcaguugcucaggauggagugugguggcucaugccugccccacacuuuggaaaccugagguggaggaaaccuucaggccaggaguuugagaccagccagggaaguauagggagaccccauuucuacaaaaaacaaaaauauuagcuggguauagugggacacauguguaguuugaacuacucggaaggcugaggcugggggaucgcuugagcccaggaguuuaaggcugcagugagcuaugauugugccauuguacucuggccugggccacagagugagauccugucucaaaaaaacaaaaaacaaaacaaaaacaaauuaaaaaacaaaacaaaccaaaaaaaccaaccaacacauuugcccaaauagugaaucacaucaaauuuuaaaauucgcuggaaacuaucugcuucuuaauuugauuauacaucaauuauguucaaaguaaaaaacaagguaauuugaaacagcugcuuuuauccagguguauacacgguguauacauacacagauauguaugaaauguggaacucuauacccguauguauggaguuccuccuaagagucuuuuugagaaaauaguuccauugcuaaaaauacccaauggaaacuucuggccugggauuuccaaguucacccucggcugugcgucucaaaguccacacagccucaccaaaauagcccuucuggguacuuuuuucuguguguucuuggaggaggccaucgugccuccagcucccuaaggcggaagaugagccagcggggaucuuugcagggugguugguucucguuccuuccaccgaagccuuccauggcauuuuugggaccuggaauugugaauuauucugccucuuccccacagucccugaugacagcaugaaguucagagaguuuauuugcagaugaggcagggaagccggccuguucucaucuugcugugccugaugccuugugcuuggggcacuguucacugugcugccugcuggccugcuugucucugccuuuuggaugggagauaggccaccccacagugccacaccugccuucagggaagcuuuuggguguuccuugucuggcuucuggguucagugggagggcccacccagccugucauuuuaaugauuuaccuuagaggagccaguuuuauagggaguuguuggauaaucuucacaaggcagauaaaugggagagcaggaagaaugauggccuuucagaguugaaaucugugcugcuccaaaucccauaaacugcuauuugauuuuaaacauugcuugaagcgguucacauuuugguuaauuacgucaguggguaaaaauaacuauugucauauggugugugggcuuggcuuuagaaggauaaagagucuauuguuacccauugugcuauucagucacuuauuacccauccuuaaaagcccaacguggauaacagaaaaccuggagagcuuugucacuugcugaaauccaagcugcccugugaauuuauccccaaacacugcuccuuuugagaaacuuguacaagcugccuuaauuuagucaauucaaauggguugaugggggcuguucccaaggcccaggacaggcagggguuugugaccugcagcccuggaacugccuuuggguuucauggucucaguugagaccugcccaggguugaaccagcuuagugcucccugggggugguuaaguucaaggacuucaggguccgauugaccuugggcugaaucuugaccuggggcuguaagaugcucggucaggaccuuaacuuuuccaaggcucggugucuacaucuggaaaauggggauaaacacaguuccucccugcugggauuauuguaaggcuugaaugagaugauaaauacaacaucugacuugcgacuggacgguagcaaaggguuuaguuaauauuauaauaaguagaauggaacagcauuagauucucacacagggucacuauguuguuuucucccauucuaccccugcauauuacccugaagcacccccaagccucucccuccccaucccucaagccccucccuccccaucccccaagcucaccagguccuggcgcacccagaucuuucacugcuuuucuugccugugagcucuuggggagucaggaccaccuuaagcacccucugcaucuuuggcaccuaaccuggggccuggggcccugcagggccacaauuagcagcauggacaacagcauggacggagagggucucagagccuggagagcuccuaggggcuggagcagucacaggaagucaccaagugaauugaagggugguggcuuuggagguucagugaggcaagaagaaggcuguuaggcugggaauuaaggaaccuuguguuguucgagucucaggacaacucagauauggggucuguauugcaaaugccccugcgucauuuuacaacugaugaaaacaauggcuccacgagacccucaagugccagagcucaugagugacaguggaaguugaacuaaccuuuuaaccacccuaguccacaccugucaggcugacgggcuuucaguggugauguguugggagcucugugccgcagaucucugugugcuccugagacucugcccgccugucucuacccugcugugcccacuaggaggaggcugaccuuuauguucuacaccagugggugcccuuggucuccagcuuccagugggccagucuggcgagagacccuagcuggagaugaggggagguagccuuggccucucuccuugcccuuccucgcugcugcuaccccaggauucuugcccaucccuuacugguuuuccuuaaccccacccucacccuugaaaacagacucuuuaaaacucuccucacucacccucauugagugugucaucugcuccagcuaggauauuggcuaauaccgcauguuucagaaagaaaaauucgcaguucuauuuauuuuuuuacuguggauugaagggagaggcaaccagguauauggaugaaggaguagggccuggcugucaccacugguguucacaaaaggcucccguuuaaguccucuuauauuccaaaugagggguuauaggucgagucagggcguugcucuaacagaagcaaaaccaaaaauacacggccguagauacaacccuguucugguacuuccuaauuuuguguguacaugugugcaccuggagcuucaagaaaugaaaauggaaauggccugaguguuucucagcccuaggaugaggcuguuucugugauuuagggcuggagguuaugaagacuugguuuacaauaugcacaguacagaagcggggaagucaaggugugcugggcaaggaaacaucuuuaugugacccacaaagagugaagcagagggaagaaccagaaguuauucugguuugcagacugggagacagguuuaaugacacagucaugucagagagaggggaagaggagaauacguagggggucuguuuugauguguauguacauguaggauuuucauguagaggaguuggggaaaauuuuagaaguuuuagguguaaaugcagcugguaagauccuuaugacuuaguuucuuuuuuuucuucuuuucuuuucuuucuuucuuucuuuuuuuuuuuuuuuuuuuuuuuaagacagagucucacucuguugcccaggcuggagugcaguggcgcgaucucagcucacugcaaccuccgucuccccaguucaagcaauucuccugccucagccucccagagugcugggauuacaggugcaugcaaccacaccuggcuaauuuuuguauuuuuaguagaguugggguuucaccauguuggccaggcuggucuggaacuccugaccucaggugauccaccugccuuggccucacaaagugcugggauuacaagugugagccacugcucccggccuuaguuuuugagugggaagaaucuaguguucagaguggaccacugaugucauagcugcagguuuggcugaauugggauggugcagaaagccguguuaaccauuucuuuuucucugaggccuggaggaggauccuugugacuggaaccacaguugggacuggcagugguuuuuccugcuggcaaggaaaaaaaaaaagagaaaagaaagaguucgacuuaucagcacaaagaaaggaggaugugaaacuagaaccaucucuagggcaguucuagcaaugaacaaggcuggaaggcucaccggcgagggguuuccccucaggaaaggggacagagaagcuuccaccuccuggguagcauuggguguuccugggcacaucugggugacuaacggguuuucugccacacaacugggguauauagggaagucuuuggccagaacugugggccguacugcauucuucccgugucugucacugcugagucgugagcuugaucucuuuucuuaguguuugcuccuuuuguccagcuaugggggccagcagaagcuuugggucaucuguaccagugacuuugcugugaagauguaagggagagugguugaggucaagaucuggguucugguucuugugccuccucucuggcuguguguccuucaacaagcugcuuacugucucugggccuccgugcccucugcaacuggguuguuggucuauuuaaauacuuggagaaaaaagcugggcaugguggcucaugccuguaaucccagcacuuugggaagccaaggugggaggauugcuugagcccaggagcuucugaccaaucugggcaacaaagugagaugcuguccccauacagaaauaaaaaaauuagcugggcaugguggugcaugccuguagucccagcuacuugggaggcuuaggugagaggaucgcuugagcaugugggaucaaggaugcagugagcugugauugcaccacugcacuccagccugugacagagugagaccuugucucuuaagaaaaaaguuauucaaaaaauacuuuggaaaacaaugcuggggagaguaugagcuucagauugcacauugguuucuaucaggaggaucugagccucggugguguuaccuguaaaauggggauaaaaauaccucacaggguugcagugaagauguaaggaugaugaugaugacaacagcagcucaaauagaucauuuaacuuaauucucgccaaagcaaggcagguacaaagaucauccuguuggcagauacagacagggagggacagagagguuaauuaagcaagcuaccugcccgcaguuacauggccagaagcaguggcacugaacgacuuccuucaggcggucugaguccaggucucagcucuuagccaucacuccaugguucugugcugagacaagggauguagaaagcccagcacagugucuguuacauaguaggugcuuaguaaguuagaguuccuuuuuauccucagaaugcguuugcaaguauagccucccacagugcuuuuacuuuaaucuuuccccuuacugggcaaaaaaauguuugcugcccugugcgacuugccuagcuauugacuucucuuuuuucugccucucuccuaugauccauccuagacuguggauugaggcucagccuagauuaaagggcaggggcuggaggaggaagaugagcugaaaaaggguaggccugaggcgcgaaggaguugaugguaggguggaaggugggaaugggaaguuugagaauuggaggaccugggggcaagacuuucccccucugggcucguucuuuccuuccugugccguuuauugagugccuacuggguccaccauucuaggcauggggcacagacaagaucucuguucucauggagcacacagugugguuggaggagucagugauggacagagagugagggguguugguuuccauggcugcucggagaaggacuugcugaggagguggcguuuugggcaggccaugaaaaggucugggcagaguguguuugugggagggaauaaauauguaaaggcucuaggggagaaucaguuucgagaaugugagggggcagugagaccagaggggcuagugggcuguggcugaguuugaauuuuauucuaagugucauggaaaguaggaggacgguuuuuuccaccaggguccuuuuugauuauuuuauucuucgugacgauccuacuuaaaaaaaaaaaucuuauucaccaaaaagguguguuugugaaacaauagaguguacaaccuugaaucacuuuagauuuuuaaaguauagggaaacaauuauggaucacaaugaauauccuugagggcugcuccccuccccagcugacacugucagcuaaaccuuuaaggccucuugugugucaagcauuaauucuucccaaagcugcuugacaugugauuaaaaauuuuuacugccaccuacugauggaaagaagaagaugaauuuuuguacaaugaaaaucccaaacacaguggauuucugguuuccacugugcugucaggacugggaaaugggucuggggaaggggugugcugggcuugguaucccccccacccaacccccuuuuuuuggcccugacaaucuggucucugcuucuguguccuucugcuucagcucaucgcacaguggguggagggaggugcugaccuggggaguugcuccggggagagggcuggagguggggggaugugucuggggagaaacacugggcacugggagucagcagccgccagcccccacauaacccaguuaauccuuuguaauugaccccgagguugcaaugauucccuguguuuaaugucccaagacggccuaacccugaccagcagaccuuugcuuaaugugcuucuuaccaccccacccccauuauuaaauccucaacugcuuuauuucugauuugcauuuuccauggcugaaugaaucugcugacuuccguuuucuuuuucuguuucagauccugugcgcagguggcagugaguacccuuuuccucucuauucuuguguuguucgcuacugcccccuaauggacacacagcaacauuaacagcaaugugaaaugcuaauuuauuaaaaccugcucgguuuccaauuuuucuuuuucuuuuucuuuucuuuuuuuuugaguuggagccucgcucuguagcccaggcuggagugcaguggugccaucucggcucacugcaaccuccgccucccggguucaagugauucuccugccucagccuagcaaguagcugggauuacaggcacgugccaccauguccggcuaauuuuuuguauuuuuaguagagacggggcuuccccauguuggucuugaacuccugaccucaggugauccgcccgccuuggccucccaaagcgcugggauuacaggcgcgagccaccacgcccggccccaauuuuucuuuagaaguaggagugaggguggaaacaacaaaugaaagaaaaaauuuuaauuaauugugcaaucaugaugaaaauuuauauuuucuguaauuuuuuucuagccucaucugugggcgauuuaacuuaguugaaauuguaauacauuauuuguauauuguuuaugugcuguuauccuuuaaguauuuucuuguguugcuacauugcccuuuuguugcuacauugcuacauuuaaagaaugggguggaagaucgucauaaccuuuggaaaaugagaccuggacucccgcauguuuugcuuucaugcacagggcugagucccaacugcugacagugcugguucauucccugguaauaaaaugagaaaaauaaggauaugacuagaaguuuuuuaaggaagcuuaaauauauucaguugaaagcaccauccaucccuggauuauguccuuacuaauuuuuuggucauaaaacauuucuauaagaauugaaggccgggccugguggcucaugccuguaaucccagcacuuugggaggcugaggcagguggaucaccugaauucaggaguucgagaacagcuuggccaacauggugaaacaccaucuguacuaaaaauaccaaaaaaauuagccaggugugguggcaugcaccuguaaucccagcuacuugggaggcugaggcaggagaaucgcuugagccugagagguggaggcugcagugagccgagaucacuccauugcacuccagccugggcaacaagagugaaacuccaucucaaaaaaaaaaaaaaaaaaaaaaaauuaaaaauaauaguaguugguaguuuuuuaaaaaauguaccuuuuaggaaaaaaaaaaaaaaccaugguuuuuguuucuccccaaaauuugggaacuuuuuuuuuccugauugguaaaaucucaguuugugagauaaaauaauuagauuguacucauggaagcauauaugggcagaucuugcugaaaucuucuaauaaagcaaaucucaauuaauaaugguaauuagagccugugcaaacaaugggaagaguacugccguugguuuuucuuccuguuaauuaguuuaauaaauaaacugguggguaccuuguacaggcuugaaucacugcugcagaagaacacuucuauucaaacaucuaccguagguaguagaauugcgggaaacagaaaucaugagcuauuuuaacugaaaggauuuacccugggaagugagaguuuacagagucauuggaagggccgcuguauuaguuugccagggcugcuguaauaagaucaaggucuuggggguuaggacuucaacauaugaauuuggggguggcggagcacaagucagcucauaacagcuggggaggaggcuuuaggccuggcccugagaaauuacucccagacuaaggcugcagaacugacccccuagagagucaccaccuuggucauagacagcaagcagagagggaggaaucaggaagucccugcuguaguugcuggauccagcggugaauguucugagcugugauccugggaucaggaagcugcagccacugccacaguguugguucuagagccaggcagcaugagauccagucaucgcauccacacuacagcuauaagaaggaggaagggcagaagguugugcuccacccuuuaaggacacuugcuagaagucagacagaacgucuggucacacucuguuugacagaaguuagucacaugcaacaucuagcugcaugggaggcugggaaauguggucuuuguucccaacagcuaugcauauacagggccaaaaaucuccaggaguaugaugaagggaaaaugggggaauggaguuugggggucaagaguggucucugcugcaccucccugaacagagacucuaggagacuaguaaugaauucaagauaaagcagccaguguggccaagguucuccuucagugccugagcucuuggccauaggagcucacgccuccucuccuuuccugugaaugacugugugcaguguaagcauggagcuucugcacucucguggccagguacucuccauguggccagaaauggcaguuucugaggggcucauguuguaggugaugauacaaagaagagaaagagagggaucaguuuuuccaagugugcauuucauuucaguguaaauauuuugugagguggggcaucccugucuccuggagaaauauauuuuuaaucuaauuguuuacuuucuuugcauagccccuaguccaauuccugacccuucaguagcaacuguugccacaggggaaaauggcauaacgcagaucagcaguacagcagaauccuuucauaaacagaauggaacuggaacaccucagguggaaacaaacaccagugaggauggugaaagcucuggagccaacgauaguuuaagaacaccugaacaaggaucuaaugggacugauggggcaucucaaaaaacucccaguagcacugguaagcauaggcuuuucugccagucauguuucuuaaaggaaaucgguagaauuuauaaaugucauguuuuccaaauacuguucuucuuuuaauuaccuaagaaaaucuuuuuaaaaauuuuuauaaagauaguaaugcauauucauuauauaaaacauagacaagaaaagaauaacaaguaaaucauuaacuggagauaaccauugaucacuugauauacgaguuuuauaauuuuaagauauaugcaugccugugugcauauguauauacauauauauguuuuauuuuguuuuacaaauaucaaggucauccuuuacauguagcuucucaccaauauauuacaaauauucuucccuguuaguauauacauuucuacaggacaguuuuaauaccugccuggcauucuauuuucuaaaucaggguuggcagauaauaaugguccuugggccaaauauagaucacuuucuguuuuuguaaguaaaguuuuauugagucugccuauggcugcuuucaugcuagaauugaguaguggcaauggagaauuuguggcuuguaaagccugaaauauuuauucuguggcccuuacagaaaaacauugcugauaccuggguuagauaauugauucuaaaacugugguucagagaucucuaggggucuccuagauucuuucaagguauuucuggguauuguuuucauaauacuacuaacauguuauuuggcuucuuuacucucauuuuaucaugaguguacaguggagucuugcagauucuauaugauuugggaugacacugucacucuuacagcuaauggaauguaugcuuucauauuguuuaaaaaacuuuaucuuuuuuauuucuaauacaguaugguaaauauuaaucaauauaacccauauaaacaaaaauucuccgggagccuuaauaauuuuuaagaaguuaaaagggcccugagaccacaguguuuaagaauuacuugucuaaaagcauuguaaauuauuuaacugcuccccuguuguugggaagguagauuauuuauuuauaauuuuucauaaaaaacauugugauacaauaguuuuguuaguucuagaaguauugauaaaaucacauacacaguuaaaauaagucauugaauuauuucuaggguaauaugagaaacuuuuagaaauuccuaaggggcugggcacaguggcucaugccuguaaucacagcacuuugggaggcuaaggugggugaucaccugaggucaggaguucaaggccagccuggccaacauggcaaaaccccgucucuguuaaaaauacaaaaauuagccggguguggucaugcaugccuguaaucccagcuacucgggaggcugaggcaggagaauugcuugaacccaggaggcagagguugcagugaguggagauggugccacugcacucccgacagagugagacucugucucaaaaaaaaaaaaaaaaaaaaaaaaaaaaagaaaaauuccuagcaagcuuauguuaauuauuguuacaaaaauuugggcuuagagguugggaccauaccagauggucuucccagaaaucacuggacaggcuuacuguugaagggcauuuccagaggaagccaaucuacaaugauuggaauaagaaccuacuucuucaaauauacagacaucaacacagagucacaaggaucaagaauaaucagggaaacgugauauuaccagagaaacaaaauaaagugcaagugguugaccauaaagagaugggagauguaugaacugucugacagagaauucaaaauacauguuuuaaggaagccuagcaaacuuuaagaaaauacagauaaagaauucaaagaaaugaggaaaacaauaagugacuagauugagauauuuaacagagaagcaaacagaaauucugaagcuaaaaaauacuuugaacaaaaugaaaaauguaauagagagcaccaagaguagaacugaucaaguagaagaaauaauccuugaacuugaagacagauuauuugaaaauauacagaggaggaaaaauaaaaaaguggauaaaaaggaaugaagaaugccuauaggauuuaugcaacagcaucaaaagacgugguauuugaauuggaguucaucuaggggaagagaaagauaaagagguagaaagcuuauuuaaagaaauaguagcagaaaacucuccaaaccuggagaaagauauaaauauccagguacaggaaggacaaaugacuccaaucagagucaauucaaacaagacuacuccagaacauaaucacacugucaaacaucacagacaauggggauuuggaaagcaaaaagagaaaagaagcaaauaacauguaagggagcuccacuucagcuagcagcagacuucucagcagaaacuuacaggccaggagagagugggaugauauauucaccaugcugagggaaaacaaccugccaaccaagauugcuauacccagcagaacuggccaucaaaaaugaaggcaagauaaaagacuuuaccagagaaacaaaagcugagggaguucaucaccacuagacaugucuuauaagaaaugcuaaagagaguuuuuaagcugaaagaaaaggacacuagugauuaauugaaaacauaugaaaggauaagacuaguaaaauaaauacacagucaaauucagaauacaugaauacuguaauggucauacauaucuuuaauaugaaaguuaaaagauaauacuuaaaaaauaauaacuacaauaacuugcaggggggauaugcaauauaaaaagauguaaauggugacauaaacaauucauaauaugaguggggaauggacuagaaguguagaggucaauuugugugugugaucaaaguugucaucagcauaaaauaaccuguuauaacuauaagauucuuuuuauaagccucaugguaaccacaaagaagaaccuuuaguagauacacaaaaaauaaaaagcaaggaaucaaaacauacuacuagagaauaucacuuaaccucaaaggaagauaguaagagaggacggaaggaacaaagagucuauaaaacaaccaaauggcaguaguaaguucuuaccuaucaauaauaaccuugaaaguaaaggguuuaaauucuccaaucaaaagacauagagugcgugaauggguuaaaaaaaaaaaccgaucucaauaguaugcugucuacaagagacucaccucaccugcaaggacaugccuagacugaaagugaagggauggaaaaagauacuccaugcuaauggaaaucuaaagaguggcaggaguagcuauacuuaugucagauaaaauagacuuuaaguucaaaacuuuuaauggagacaacaaacaucauuuuauaaugauaaagggaucaauucaucaagaggucuuaacaauuauaaauauauaugcacccagcauuggaaugccuaaauauauaaagcaaauauuaauggaucugaauggacagauugacugcaaugcauucauaguagaggacuuccaccaccuuacuuccagcaauggacaaugauccagacaggaaaucaauaaggaagcaucagacuuaaacuacaguuuagaccaaauggauguaucagacauauacagaacauuccauccaacagcuguagaauacacacuuuucaacugcaccuggaacauucuccagguagaucauauguuagaccacaaaacaaguguuaacagauuuaagaagugugaaaucauaucaaguaucuuuucugaugauggcaucaaacuagaaauaaauaacaggaggaacuuaagaaaauucacagauauauggaaauuaaacaacaugcuccugaauaacuaauggguugaugaugaaauuaaaagggaaacuaaaaaauaucuugagacaaacaucacuucuuaagcaauuuuguuaacauauuucuuuuucuucuuuaaaauggugccauaaccuccuucaugaaauugcugugagacauaaauuagaaaaugcuuguacagccccugguauaggaucuguccccaggucacuuacagcagguccccagcaggggucaugcugaucuugccaucucccacaguaacuauuguuaauuguuuugucacaaaugccccugaacaaucaaugggucagugaagaaauuaaaagggacauuuaaaaauuucuugaagcaaaugaaaauggaaacacaauauacuaaagccuaugggauacaccaaaagcagcccuuccaagaaaguugacagcaauaaacuccuacaucaaaaaagaaagcucccugggcacaguggcucgugccuguaaucccagaacuuugggaggccgagaugggcggaucacuugaggucaggaguucgagaccagccuggccaacauggugaaaccccgucucuacuaaaaauacaaaaauuagcuggguguagugacacacaccuguaaucccagcuacuaggaaggcugaggcaggagaauugcuugaacccagagggcagagauugcagugagccgagaucgcaccacugcacuccagccugggcaacagagcaagauucugucucaaaaaaaaaaaaaaaaaaaaaaaaaaaaaaaaaaagcaagcucauaccuccagccuggguuuugagagccugucugaaaaaaacaaaacaaaacccucaaguaaauaaccuaauguagcacguuaaggaacuagaaaaauaagaacaaacuaaucuucaaauuaguaaaaggaacaaaauaauaaaggucaaagcugaaauaaaugaaauaggcacuagaaaaacaauagaaaagaucaauaaacuaaguuguuuuuuugaaaacaaagaacauugacaaagcuuuagcuagacuaagaaaaaagagacgcuacucaaauaagaaaaucagaaaugagacauuauaaacugauaccacagaaauacaaaggaacaauuaugaacaauuauaugccaacaaauuggauaaccuagaagaaauggauaaauuccuugccauauaccauuuacuaugauugaauuaugaagaaauagaaaaucugaauaauccaauaaugaguuaggagauugaaucaguaauagaccaucucccauuucuauuuauuacuguuguuauucuaagagacagugacucccucugucacccaggcuggaguacaguggugugaucauagaucacuguaaguugaacuccugggcugaaaugauccuucugccuuagccucucaaguagcuguggcuauuggugugcaccacuacauccagcuaacuuuuaaaauuuuuuuguagagauggggucucacuguguugcccaggcugcucuugaacucccagccucaagugacccccaccaccuuggccucccgaagugcugagauuacaggugugagccacccaguccucugccaaaccuuuaaagaagaucuaaugacaguucuucucaauugcuuccaaaaauugaggaggagagaauacuuccaaacucauuuaacaagagcaguauuaccuugauacgaaaaccagacaaggauacaacccaaaacacuauaggccaagaugcaaaaaucuuuaaccaaauacuagcaaaccuaauuuaacagcauauuaaagagaucauucaccaugaucaacugggauucuuccuagaaauacaaaaaggguucaaccugugcaaaacaauaaaugugcuacaccauauuaacagaauggaggacagaaaccauacaaucauuucaguagaugcagaaaaaacauuugaccaaaaaauauuguuaacugugcuuucuuuucugaacuuaagaacuugcuuuuccaaaaccuucccagaaucccuguaugaaucaacaaaauuuaguucuuaacacauuucuccuucuuuaaaauggugacauuagcugggcaugauggugugugccuuuaaucccagcuacuugggaggcugaggcaggagaaucgccugaacccgggaggcagagguugcagugagccaagaucacgccacuacacuccagucugggugacgagcaagacuucgucucaaaaaaaaaaaaaaaaaaaaaagaaauaauggugccauaccuuucucaugaaguuguugugaggcauaaaugagaacauacuuguacagcaucugggacauggacggccucucaaaaggagugcugcuguucuugcuaccugcaccacuguaacugauguuguuucaucauccucgucaccaucauuguuauugauuguaaauggaagcacaguggucaucuuccaaauaugccacucugacucugugaacuugucacuuuauaaagaggaaauucaagcuuggaggggccuucuggcaugacguuuauugaauuguggggcacaagaugcuucccugcuuguuccauuuuccuuucucuuguuuauucuccugccuuauuuauuuauuuuuucuuuugagacagagucuugcucuguugcccaggcuggagugcaguggugugaucuugguucacugcaaacucugccuccuggguucaagugauucuccugccucagcuucccgaguagcugggaucacagguggcugccaccaugcccaauuaauuuuuguauuuuugguagagacgggguuucaccauguuggccaggcuggugucgaacuccugaccucaagugaucugaucugccugccucagccucccaaagugcugggauuacaggcaugagccagugugccuggcuuccugcaguuuuuuuauugauuggaugaauguuuguauaucccaugagccagaugaggcacacuguccaugcacauagcaagaugguaacacuuacaccaucuuuacucuuuugggauuagucccaagcuccuugagaaugacugccguaucaccuggguuuuacucuucgguuucugguuguuacuccucagucuucagcucaauuaggaugcauccauuugguaguuuuacaguuaguaacccugauggcuuccacugguuuacgaucuuguacaucuaagaugaugaaacuaagguucagagaggugagaugacuuugaguaaaauugcauggugagcaacuagcagaauuggacccugaaaccagauuucuaauguccaaaucuugucccuuguuuaucauaucauggugguucaauaauaauucuucguguuuagugugguguacuagagcuaucaacagagaaacuugagacugagagguuugaagggacuaauucuaggucacacagcuaauggauggagcaggucuuuaaucccagaucuggguuccaagaccaguccuuuucucuuuacgcugcucugucccugcuaucuuuaugucagaaaaccacugagcuuccuucuagaugucaggguuuggcaaaaaaguuaucaugugcuucugcgucaugcagcguuuucugagaauggggagagggacucauuuugcaucuuugaucucucuuuuuuauuuugagauggagucucggucuugucgcccaggcuggagugcaguggcgcgaucuuggcucacugcaaccuccaccucccggguucaagugauucuacugccucagccucccgaguagcuaggauuacaggugacugccaccacacccagcuaauuuuuuuuuguuuuuuuuguuuuuuuaguagaggugggguuucaccauguuggccaggguggucuugaacuccugaccucaggugauccacccgccuugaccuccuaaaguuuggucucuuuuuguaucagcuucuauacagacuuaaccccauuuuuaagucacagccagcauggucaacuucugucaguuuugcuucuguuccaaaggcuucuguuuuacuaacauacacacauacauguaugcauauggauuuaaauaaauucuggugcagggaagucuaggaggcaaagagagauaaaacucugugauuggaaagucacuucuggaaacuagacauauagagcagaccucacucuuacauuucuuuuugaagugcaauaauuuuuuuuuuuuuuuuaacaauauagggcccaguccuguguuugacauuaaagcuguuuccaucaguccaaccaaugugaucuuaacuuggaaaaguaaugacacagcugcuucugaguacaaguauguaguaaagcauaagauggaaaaugagaagacaauuacuguugugcaucaaccaugguguaacaucacaggcuuacguccagcgacuucauauguauucuccaucacuccaggaauaggcaaugagacuuggggagaucccagagucauaaaagucaucacagguaagaugacuggcucccagggaugaugacaaaccauuucuuauuaugguguauucuagggccuuguccguucaaguugccuguuggaaagagaaugguuuucauaaacuagaagaggagaaaaggugcuauguuguuucaagccugggauuucugguggccacaucauucaguauuaaggcccuauguguuuugggaaguucuaacuacuucuguuugguuuuuaaaaucuuuuguuauuguugguuaacaccuaccuuucuguuaagacucaggaguagagacuuccuuaaaaacgcgugucuucaugguaauuaccagccuuuuaagcucccaggaaauugaugcuguguuuauauucccaggaguuucuguugggcaggaaaguuugguguauuuuauaggggaguguguguuucaaaugaaauaagaguuugaugauauuuaaauuuuaauucagauuugacaguuuagauuuugauuuaucuuagaugucaauaccgaagccaucuauuauagcugcaaacuuagcuuuuuuuuuaagcugaaaagaaccaaacauuuuaaaaaacagguggagaaacuuuuuuaaggugaggagaaccaaaaauugaagaaagagguccucuguuaguuuucugaucuagggggcuggggagugugaucucaggggcuggagucggccaugggcgccugagcucuuggagcccacggcuggaggugaacgagguccagcguggagcagcaaauaugaaaccaguggcuuccgacauuuuaagucaggaaacuauuucuuuaaacaaaaccuugcccaggagcccaaaaaguaaaaauaaaaaacuggagagaaaagagccaaagaaaugggagucacgggcacccugacaaaacuccuggagcuccucagagcacuauuuuaggggggaaaaccugccauaaagguuugcucuguuacauugugaaagagagggaaaggagagcacagagagaugacagaagagaagagaaugagagaaaagagcauagaacuuggaaauggucaugaggacaaggugaccccgaggggguggcugugggaaaggggaugcggaggugcaggaagcaccgguagaggggcugaguguccuuaucuagcuuaaagcccugagcacagggcugcaugggagcagguccaucagcugcugcguauugagcacggcacaugugccucucuguccuuaauguuauuuuguccucacaguaacccugggggcugcagcagaagacacuguaauguggagaaguuaaguuucuuccggugucucagaguuacugaguaucaagugguggggcuggaacccggagucuaacucuagaccacuguggugcagugauguucauaacagcuauccacagucaccgagcugggaauuuauugguucugcauuacuuaauaaaacaaaaagacgcaugacugaccugauuuagaacucuuugcaugagagacaugugcugugaagaaucaucuuaccguuucggagcuggacggugccuuagaaucaucuaggccgaugucuuuaccuucaggccccugcagcccucaggagggguuuugcucuaucugcagcacuaccugugcuuuucuguacaugaagcugcagcccuggguucuccuguccccacugcuaccaggaguguguguucuugagcaagccccccugccucucugggucuucguguucuuauuggaaaagugaggggagugcaugucauuuugggugaagugguuugacuuaugucaccaucaaccaaauaacgcgaugggaggaagguccaggauauaguggagauggaacgucuucugaaaaauccccuuggugcugggauauugaaugugcugcuuacuugaaaugucuugguaauuuaaaaugauauuauuugcauuaucuugaauugagaccuuuagauuaguaaacagucacuuuauuugaggcuuuguuccugauaucuaaaacacauacaauuaaaugcuaccauuuaaaagggacaguuuagaagaguguccagucacuauugggguuaaucuuggagaacaguguggauccuaaacaauuucaguuuuaagguuuuuuucuucucuuccguguuauuauuuucucccccagcccugcugugaaaugauggaaaugcauugggcucugauagaaaggaaguauuuuuagugagucacauugggacaucagugaccucagucauucuuucuuuuuuucuuuuaaaacccgcucccagcacugaaccccagucauucuuaaugaaggugacugcauauaucuuguuccauuaaugcauguuguauuuuuaaaauagagccgaucccaguuucugaucuccguguugcccucacgggugugaggaaggcugcucucuccuggagcaauggcaauggcacugccuccugccggguucuucuugaaagcauuggaagccaugaggaguugacucaagacucaagacuucaggucaauaucucgggccugaagccagggguucaauacaacaucaacccguaucuucuacaaucaaauaagacaaagggagaccccuugggcacagaagguggcuugggugaguuacaaaggguaccuuccgucucccuuacugguucuuacuuucaguaacuaaauguucuaaaaaauaaauugcucuuccauguguauggagauuuagaauuuauaaagggcuuuuccuccacauuuuaguuugaucccccaccugcaugaggaaggaaggaaacguguucugauuuuacaggggaacacauuggggcugagaacagcaauaggaauugaaacuuuuuagagucuggcacccaggaaaguuagaggccccuuuagcuuucuaucuaacagcugugucaacccaaguugggccuucagaggaacuuaucacgucugcugguugauguuggcguugucauuugcagguuucauagcauuugcagaggauccccaggauaacuccaugaggaggacaggcacuuaaucugcauuuuauacuuaagaaaacagagcuacagagugggugucaggauccuugcuugcgagugacagaaaccagacuuuggauagcucagacagaaggaacaauuuauuggcucauguggauuuuccugcuagcgggaggccuuagagaaagagaugaggcaauucucaucccucccucuugcuucuuucuguucaucagcuucauucucagagcagcucccucugcacacuuaaggagcccagcugcuccuguuucacacccugcagcugccccaccagccagcugccccaccaaccagggucugguccagggaaacgugucuugaguggggucugauuagcaaagucugcuucacagagcugucccuggaaauccaugcugggacaggagaagauaacaacccaaagaagggagaaugaccugaaauaagcagaguuugaaagagaagcaccagauaucuguggugcuacuggaauaacaguacaaauggagauggagcuaucaggccuuuuuauggggcugccucucucucuggaggaggaagggagcagauauugauggagcaccaacuguggccacugucugauggccaucugaugggguuggggcuccgaaggaaaaugggggaugugucccucuugugguugaugucuuuuugucuccugugcuugaaacagaugccagcaauacagagagaagccgggcagggagccccaccgccccugugcaugaugagucccucgugggaccuguggacccauccuccggccagcagucccgagacacggaaguccugcuugucggguuagagccuggcacccgauacaaugccaccguuuauucccaagcagcgaauggcacagaaggacagccccaggccauagaguucaggacaaguagguugaacuuuguaaaaugguggcagccagaguuuccuagcacaauguucugucuccugugauucugauucugagugauuucuugcauaacagcuaguuuugaugucagagggagcuuccuggaggagauuuuggacagagcagaucugcucaguuucuucuuaacuccaugggcagugcacaucucucauuaagugaaaucaaauacauggagcagccccugugugcgggcaccaggcacugccucacgccaucuuucacagcuuugcgugguggcugaugagacaaacuggcaucauacuuuccucuuaaaaacaaauaaucauugcuuguuuuuccuuugcuuugaguuaagaaaguuaugaaagugaguuucauuuuuucacccgccuuguaauucauaccgaucuuucuguugaaaugcuuguugacaugcacauugcugcuuccucgcuauaauuuaucagcacuuucacucuguaaguucaccaauauuuggaggcuuuggugaaaagagcgggaggugaacacauuugggaauacuuagagguaguuacuggccaggcuguguuacuuguacagggcuagaaguuuuggcaagacauuggugagaagccauucuguaaggaaugacaguuuuuccugguauccauguugaaggaggguccauuuguguccuuccuucccuuuguacuuguuuugcuaaugugggaguggguggggaggaugcggccguaggacaggcugccugaccucauggggccugcagugaccuggcaggaguggcaggugggaggcucucgggugaggagggcuuggauuccagaggguggguuaguuggaggaggaggaaggggcuccuaugugggugcgguuggcaguggugggguguccugcacaugguaagcuugcgugagagagugaaaggggcugaaaucuggucugugugcccugcgucaagccaugcacccagggcuggguccagccaggggaaggucccuuugacugauuugcuaaaaggacuuguagauuugugugggccuggggucccugcuuuuuaaagcaguuugagcaaaagcaaaguaguagugauuacaucucaggcucuugguggugugaauucacacacauccugcuuuggguugaacugucuucaugcuugguaaauaaucauuauaguagccuuucccucucuauaaggggcgaguguguguguauagauaagucuuagucaguuugggcugcuguaacaaauggccaugcacuagauggcguaaacaaugaacauuuauuucucaggguucuggaggcuggaagucugagacuggggugcagcaugccugggcuccgggugaaacacccucuuccucuuccagguugcagacucccugggucuucacgugguugaaggggugagggcgugguuucucuccagccuuuuugauaagggcacuaauaccauucaggagggagguaauucaugaucuaauuaccucccaaaagccccgccuccuaaaagcaucacaucagggguuacaauuucaacauaggaauuuuauggggacagaaacauucagucuguugcaacacacacacacacacacacacacacacacacacacacacacacagauaaacacacauuuccacccaccccagagcacccugcacuuuucaagugacuaguuagguggggcaggguuaaggaaaccaucagaggacauuguugaggcacccaagacacgacagaaagccaccucuagggcugaagggcuagaggaggacaggguguuucuggagcccagugagagcuggggcagugguggacacagcugugucaggacaggaggcccagagcaggaggugauggaggaaggcacugacuccuuucuccuguggcccuucaggggccugcccauuggcucauaguggaacccggucacagcccauguggcaagaccccccaugaugccuugcacaaggucagccuccugggcccagagcaggugagggaagggcaguggauaugucgggaggguggagugggcagguggugaauaacuggcacucggguuaucuuuucuugagguuaggauugcucuccaguuuuauaggugaggaagcugagcucaagugguuuuccuguggcccaccugggugucauagcagagugagcccuggaacccaggccugccucguccugacuucugugaucucgggcgaucacauagaucgcaguguucgcucuugcaucauguguguuugacaacuuuucugggugccccuggcccuaggguaagacaugcauagaguccaagucaucauuuaggucaaaucucuaaagucaacuuacaaaaaggaacaaagaauaacccugcaggugccauuggccagguuguuucuucaccgcccaaugaugccugacuuuggcugggaccgucaugcuuuccuagccacgguugauggugcagaggaggaaggaacacucccccaggagaguuugcugggcuugacagcaugcccugaugaccucucccucccucugccuuggccguucugguuauuuugaacuccucuuguguucucacagaugcuauucagguuuuugacgucaccgcugugaacaucagugccacaagccugacccugaucuggaaagucagcgauaacgagucgucaucuaacuauaccuacaagauacauguggcgggggagacagauucuuccaaucucaacgucagugagccucgcgcugucauccccggacuccgcuccagcaccuucuacaacaucacaguguguccuguccuaggugacaucgagggcacgccgggcuuccuccaagugcacacccgugaguucaugccuggcucucaccacccuuuccugcuguccugcuccgugccaggcccagacacaggaugcaugauguaguaauggugacuguuggcugaccacacgccaagcuucgugugacaugcuuuccuugcacuggcacauuguaugcucacaacagcccugugaugugguuggaaguagccuuauuuuauagauaggaagccaaggcugagagaggugcuagacagguaucacagcuggaaaguggcagaggugagauuaagccucugguauuucucaccuggagccugcgcuuguaacucucuuuccaguguggaggagaccuagagugaauugauacagggagacaaaaaugaccugguauucauauccccuugugucuugggugcugacauuauaacgaaucacuggcacagcuguaucucaucuuuguuuguuuaaaugucccuuaaaaauaagauuuuaugcagcaaauaaaaagcuuuagguuucaaagaagguccgauaauguaaaauaaaacaguaauggugcacuaguaguacagugguauaauauugauuauauacuauuaaacaauaguagugacaccagcacugcauuuugcacugugccaugagauuuauagacacuguaguggccuccgagguagguauugggguccccuuuuacagaugaggaaaugacacccugauggcugaacaguuugcccaaagccacagagcuagugaguagcagagcaggacuugaacucagggguguguggcucuggacccaggcuuaucccacaagaauguccauuccuucgcaggaagcacaccuuagcauucuuauagauguauuuuggacuggaucuuugggaaaaugaaauaugcuugcauuucuuuaccuuuuacucuuuuacuauuuauuaguuaggauuagguucagccacgaauaacaccaccaaaaacaacaacaacaaaacccaaguauccguggcuuaaacaagacagggguuuauuucucucuccuguaacagaagcccagugcuaggcaggauggggaugauagagguuauccaaggcucaguuguaugaaacagaaacugugagcuauuuuaaccaaaagggauuuauccugggaauugagguuuugcagaaucauuggaagagcugguguauuaguuugcuagggcuaccagaacaaguaccaaaggcuguguggcuugaacagaaauagacuuucucauaguucuggaggcugaaggucaaagauuaaggcaacggcaggugugguuucuucugaggccucccucuuggcuuauagaugacugucuucucccucacaugguuguccuuagucugcgugugccuaugcccucaucucccuuuauaaggacaccagucuugcuggauuagggccuaccuucaugaccucacauuaacuuaauuaccucuuugaagacccugucuccaaagacagccacauucugaggucuuggggguuaggacauaaacauacacauuugggggugagggagcacaagucagcucauaacaguugaggagcaggcuuuaggccucgccccaagaaaugacuccuggacuaagucugcagaacugacccccuggagagucaccaccuuggucacagacagcagagggaggaaucaggaagucucugcuguaguugcgggauccaggggucuauguucugagcugugauccugggaucaggaagcugcagccaccgcugagguuuugguucuagagccaggcagcgugagcuccagucauugcauccacacuacagguauaagaaggaggaagggcagaagguugugccccacccuuaaaggacacuuccuagaagucacccaguaccucugcucaugcuucguugagcaaaacuuagucacauugcaacaucuagcuccaugggagcugggaaauguggucuuuguuuccaacagguaugcacacacagggcuaaaaaucuggguggguaugaugaagggaaaaugggggaauggauuuugggggucaagacuggucucucucugcugucccucccugaacagaggcucugggaggcuaguaaugcauucgagauaaagcagccaguguggccaagguucuccuccagagccugagcccuugaccacaggagcucacgccuccucucauuuccugugaaugauugugugcaauguaagcacagagcuucugcacucucaugaucaagugcucucuccauggccagaaacagcaguuucugaggggcucauguuguaggugaugauacaaagaagacagagagagggaucagguguccuaaguguacauuucaucucaguauuuucugagguggggcaucccugucuccuggagaaguauauuuuuaaucuaguuguuuacuuucuuugcauagccccuguuccaguuucugacuuccgagugacaguggucagcacgacggagaucggcuuagcauggagcagccaugaugcagaaucauuucagaugcauaucacacaggagggagcuggcaauucucggguagaaauaaccaccaaccaaaguauuaucauugguggcuuguucccuggaaccaaguauugcuuugaaauaguuccaaaaggaccaaaugggacugaaggggcaucucggacaguuugcaauagaacugguaagcaaauaggcuuuucuguuaaaccaucauguuucuuaaaggaaaucaguauaauuaauaaacauaauguuuccaaauauuguuuuucuuuuaauuaucuaagaaaaaacuuuaaaaauuuucauaacacuaaugcuuauuuauuauaugaaauacagacaaguaaguagaaaaaacuuacauggaaaccaucaagcagagauaaucacuuuugauguaugacauuuuacaauuuuuaaacauauacauauagauacacaaauauaugugugaguauacauauauuuaauacauauauauuuaauauuuaauacacacacacacacacacacauauauauauauauauauauuuuuuuuuuuuuuuuuuuuuuuuuuugagacagucuuacccugucacccaggcuggagugcaguggcaugaucuuggcucacugcaaccuccaucuccuggguucaagugaagcgauucuugugccucagccuccugaguaauuggaauuacaggugugcaccaccaugccuggcuaauuuuuauaguuuuaguagagacaggguuucgccauauuggccaggcuggucuugaucuccugaucucaaaugaucugcccaccucagccucccaaagugcuuggauuacaggugugcgccacugcacccagcccacaaauauauauuuauuucuuucacaaacauugaggccaucuguacaugugguuuuguaaucugccuuuuccccaacuugccaauuaauuaugaauauucuuuccucuuaauaaaauauuucuacaggaugauuugaacaccugccuggaauuccaucaucugaaacagaguuggcagauaagaauggccccuaugccaaauuuggcucauugucuguuuuuguaaauaaaguuuuauuggaucacagccauguucauuugcuuauguacugucuauggcuacuuuggugcuagaauugaguaguggcagcagagaacguguggcuugugaagccugagauauuuauuuucuggccauuacagagaauguuugcugaccucugggcuagaucagugguuuucaaauugugguccagggcucucuagggaucccuagguucuuucaaggggucuccaagguaguauuaucauaacaauacuaaaauguuauuuggcuuuuucauucucauucucuuuuggaguuuuccaacuuugauccgauaugggaugacauugucucucaggucuaauggaauauaugcuguggauucuuacauuuuaaaaauuucuucauuuuaaaucccugauauaguaaauauuaauaaauauaaccuauguaaauacaaauucucugagagccuuaauaacuuuuaagaugguaaagaaguccugagagcaaaaaguuuaagaaccucuggucaagauguguuagaaauuaacuacugugcuguguugggcagguggacuguucacagucuuuccuaaacaacacugugaugagauacuuuguuaguucuagaaggcuaauugaaauugauaaaaucauuuuauagucagcuacgguggccugcacccaucgucccagcuacuugagaggcugcggcaggaggauugcuuggcccaacaguugcagacuagcaccagccugggagacccugucucaaaaaaaaauuuuuuuuuauagaaacaguuuaaauuauuaaauuauuucuaggccuacaggagaaacuucugggaaauccuagagaguaauguucauuauuguuguuuuaaaauuuugaaauaauuguuuuuuggaaagguugaaaaacauacagucuuccuugaucuaagauucaagauaguugaaaucuuuuauacagaggguagaauaaagauauaccuaauguaaaugaugaguuaaugggugcagcacaccaacauggcacauguauacauauguaacaaaccugcacguugugcacauguacccuagaacuuaaaguauaauaaaaacauauauauauauauaaaagaaaugggacagauuccuugaaacacacaugaaaugaguuacgcuuuugagauucuccuugaagaagcuucuucaacugugcugguuggguuaagcaccgauagucacucagaggaucugcuucugaaauaagggaucuacuaaaaugcaucccucagaugaaaugcaguauucccuuugcaaaucugcauuucagacuguugacaugacgucuuaacgucaacauguuucuucugucuuuuaaggauguggauaaugguaagaggaucaccacugagggagaugcaugauguugugcuacuugcuauugcccagaacuuacuguaacaauaauauaauaugcugggggucugcgaagugcugagugcucucauacugcauuuuacauuuuuaacacaacuucauggagcagguauuauuaucauuucugucuuacagaguaagaaaugggggcucugcaaacuuaaguaacuggcccagagugacaagguggcaaacugaccugugucugcugucuaagaccaagugcuuaaccaccauguagauugacacuuugaugugguacagcaguaaaguuuaguauuagugaggagagggcaucucuuuuacuauaguuuauugugaauauucuuuccucuuaauaucaguauuucuacaggguaauuuuaacaccugccuggaauugcauugucucaaaggacccguuucauucaauggucccauugaaugaaagucaagaaggcuugcuauaagaucuaaacucuuagggggguuaccuuucuauuaucaaauaaccuuuauuguuauuggaaaaagucagcuuaacagcauuaaaagcaauuucaaaaaaaggaaacgaauaccauaugauccaguaauuccaguccuauguauaucuccaaaagaauugaaaacaggccccuggacaguuauuuguacaucaguguucauaguaguagcauuguucacaguagccaaagguggacccaagaucccaucaacaaaugaauggauagauaaaaugugguucauccauacaacaaaauacuauucagccauaagaaagaaagaaauucugauuuaugguacaacauggauggaucuugaggacauuaugcuaagugaagccagacacagaaggacaaauacuggaugauuccacuuacaugaguaccuagauuaggcaacuuaauauucuacagaaauuagaauagagguuaccaggggcuguucagaggagggagugggcauuauuguuuaauggcuacaguuuaugcuggggauaaugacaguguuuuggguacagguaguggugauaguuacacaacauugugaauauugaugauaccgaauuguacacugacaaaugguuaagaugauaaauauuaugguauguauguuuuaccacaauaaaaaugaaaaggaacaaauaucucuauuuuucuaacccaacugaauuccuuuucucucuguguccacagucauacauuuugcuuguauacuguaauuauuauacaaauacuuuuauuuuguauuugaauuucuuuuuacucagucuauaccacaacuuuccccuauaguuagcauggccuucauauuuuuaguggcuaaagaguauuucaucaugcagccagaucacagugcccacagcccuccccauguuauugaauauuuagguuguuucuagguuuuuauguuuauagacaaaggcugccuuucaugggcuuuugucuguggaaucccuuugacaucaggaaucugcugguaggaaacaaaggcuccucccaguggcuucucuguaaggagaauccacuuaaaauuaaaaaaaaaauuaauuuuggaguagauaguacguaaacauggcacaauuuuuuuuguuuuuuggacaagguguuugcagugaaagcauuucccuuuuuuguccccuaccugcccauuuccucucccuggaggugacguuuguugccagguaaagagagacaggguugaaagccgcgguagaaaauaggcccagccuccgcgguuacuuccgggccucuauguaggcaucccuggugcagguggcugagugggcagcgggagaugaucggaggaugggcuccugugggagauuccauuucugacucugcucugaaggugcagggugugccuguuuucuucccuuccucauccguccucaaaugcugcaacuuaguaaaggucagcucuccauuucaguuuuccucuuugguauguaaggcugugucacgggaagauguuuccuucugagugacugauuuaaaaaacacaacaaaacaaaaaaaccucuuuauugagauauaauauacauaccgaaaagggauguauccucagcacauagcuucaugaacuuuuacaaacugaacacaucuuguuaccagcacccauauaaaaaaacugaaugugauuuccacuucagaugaccccuugaagggcuuuuuuuuuuuuuuuuuuuuugagauggaguuucgcucuuguugcccaggcuggagugcgauggcgcgaucuuggcucacugcaaccucugccuuccggguucaagugauucuccugccucagccucccaaguagcugggacuacaggcaugcaccaccacgcccggcuaauuuuguacuuuuuuugauagagacgggguuucuccaugcuggucaggcuggucucaaacucccgacuucaggugauccgccugccuuggcugcccaaagugcugggauuacaggcgugauccaccgcgccuggccuuuuuuuuuuuuuuuuuuuuuuugagacagagccucauucugucgcccaggcuggagugcaguggugugauaucggcucacugcaaccucugccuucuggguucaagcgacucuugugccccagccucccgaguagcugggauuacaggcguguaccaccacacccaacuaauuuuuguauuuuuaguagagauggguuuucaccauguuggccaggcuagucucgaaccucugaccucaagugauccaucucggcuucccaaaauguugggauuacaggcaugagccauugcacccagccuaagggcucauuuuuaagacaacaacaaaaaacuggagaacugguaagauaaacugggaaguucaugugcgucacagaagagcugaaauucuugagagcacugagugugugcauuucucagcucgauuuuggagugugccuuuugugaacucauuagaaagcguaauggcaaaagagcagguccucucgacagcacuuggagaggaagcugggcgucaugauaguaacaguuuucccuucuccuuccuuucuucugagcaguucccagugcaguguuugacauccacguggucuacgucaccaccacggagauguggcuggacuggaagagcccugacggugcuuccgaguaugucuaccauuuagucauagaguccaagcauggcucuaaccacacaagcacguaugacaaagcgauuacucuccagggccugauuccgggcaccuuauauaacaucaccaucucuccagaaguggaccacgucuggggggaccccaacuccacugcacaguacacacguaagucucuuaggaugcccuucuaaggaacagccucucuaacugucucuuggaggaggcacugguuaaaugauggccagugugcuucugggauccagguugacucugaaacugcugaaguugaaaacauuggucucagcaaugguucugcugucaccauggggcacuguucuucaagcuaugugaacuuagaauugucauuagaaggaagaaaugauuccuugggaauggugacugaaaugguucuagucauuccuugagaauacagaguagagaagggucaccuugucauguugguauuggaagauacugcccagaugaggagcuucgccugcaacaguuagggagguguuuugcgaauauuugaauuaaauacaugguaaagauguuaguuuguaauauguuuuuaguauauuuuucuccaucuauuagauuuaaaaaacagauuagaaauuaaauguuaaaaauauauuugaaauaaacuugaaguauuaaaagaagccuaaauuaaacuucuuuugagacuuaaucuguauaauuauuuucuugauguguuuuugggaaguuuuccaucuuuugagccagcaaauacuaguuuuauucauucuuucuaaaacgagccaggcuauuuuuggauauaguaaauaguccuggaauucuacuuaaucugugcuuuuacaugaauugccuuuuuuuuaaaaucaagggcccagcaauguguccaacauugauguaaguaccaacaccacagcagcaacuuuaaguuggcagaacuuugaugacgccucucccacguacuccuacugccuucuuauugagaaggcuggaaauuccagcaacgcaacacaaguagucacggacauuggaauuacugacgcuacagucacugaauuaauaccuggcucaucauacacaguggagaucuuugcacaaguaggggaugggaucaagucacuggaaccuggccggaagucauucuguacaggugaguguagccccaacugccucuuggacuccucccugaguggugcugaccuugcaggucaguccucccaagucuguaguuugucugguuuugugugaugugcagugauggacauugagcuuuccgaggcauccuguuagcuuaucggugcugucucgaugcccucaucauuucugcauucaauaaauauuuauugagcauauaccauaugccagucaaguccuugccuucuuggaacuuuucgaaggaggaagugggauguuuaccuagagugcucaggaaaggccucaaugacaaggugacuuuugagcaaagaucugaaugaagggaaggagccagccauguggauaucagggcaugagaacauuacaggcagaggccugugcagaggggccugugcagcaucaccacuguaucuggaggcuggaggaagagcaggaggcaagggugggaggaguggacccgcaggaacaggaggauauaggugggaggugaggccugaguggggcugagccaggauguggaugauaucuggcauugguuugucuuuugugcuggagaagaugaaaaguuuauugaaaugaugcccagccuuugcauccuucuugauccucaccuaucucacaacugaaaaugugugauaaagagaagagcccucuguguaauugaggaugcuuucagggcagcccaggaaaggcuuugcagacaguggugggcacuucugcucacagugcugacuguggcaccuuuaucacucagcacccgugcacuacucauuuucugcccuucucgcuccuaccucuucccuuuuuagcccaggccauucagauauguucaggcugauuuggaagugauggucucaugggaucagccucccugguaguauaggagcuccagccuugauggccucuggcuuuucaguggugagugggguggccacagaaaucccugcagcuuugggucacuucugcuccaucccaccuggucuagacacccaucuuugauauuugggugccuuucauugcugauauuuaucuuagcuauaguuauuuguagccuauagcaagagaaaaacuguaucugagcauuuaugacuggguguggguggaacaggagcuguaaaagugggugcaguguucagguuaccuuuccaggcccuggguggcaaauguggguguugcacuaggugccuugguagagcuucuccugcucuaaaauucugugacauucaauuaaugauaauacuguccuccaguuguaauauggaguuuucuauuuacaucaguuugauguuaguccucaguaaaaaucuaauggcccucagauagagacaaauaacacucuauuuugaagaugaggaaacugaugcaucaucaauggaugaugcaguauguuaugugaguagagagugucuugaacuuagacuuagaaaaccugggaucuaguuuuggcuucaccaccugccaugucaucaucagccaauuacuuaaccucucugagccucuguggauuuaucugcagaugggacaguauaggccucaccugucucagaaguaucaucaagagggccuuggcugggcugguggcucacaccuauaaucccagcacuuugggaggccaagguggguggaucaggaggucaaaagaucgagaccauccuggcuaacauggugaaaccccaugucuacuaaaaauacaaaaaucaacuggguaugguggugcaugccuguagucccagcgacuugggaggcugacacaggagaauuguuugaacccgggagguggacguugcggugagcugagauugcgccauugcacuccagccuggucgacagagcgagacuccgucucaaaaaaaaaaggggguccucaugaugagauggugcaagugaggagguugcuacuucucacaggaugauacagcugacucucauggagcccuggucucuuccaggcgucuuucuuggugccugacaucauuguucaauuuacucuucaaagaguccugcagcugaggcucagagcaguugggugacugacccaagcucacacaguuugguguugcccaauuuagggucagccccugccucuuccaccacaucacccacccaccuucucauccccaggauucugcuacucccuauuuccauguuugcaaaggcaaaagucccggaaucucaugcugugcuguacuugcuuugcagauccugcguccauggccuccuucgacugcgaagugguccccaaagagccagcccugguucucaaauggaccugcccuccuggcgccaaugcaggcuuugagcuggaggucagcaguggagccuggaacaaugcgacccaccuggagagcugcuccucugagaauggcacugaguauagaacggaagucacguauuugaauuuuucuaccucguacaacaucagcaucaccacuguguccuguggaaagauggcagcccccacccggaacaccugcacuacuggcaucacaggugggcuacaaggcaggggcuggucaguuggcacugugaucacuccuggagcggcugacccacagugggucugcacguguggacuagaaaucuguuuuuguuuuuuuauuuccccuaaaauauuugcuuuuacugacauagacugguuucucauucuauagaaaucaaucuaaaaaagcagaguaagaggggcucauuuuuuacauucuaaaagauuccuuuucuuuacagcauaacucauugccucauugccauguuuucuuuuauauuuuuuugagauggagucuugcucuugucacccaggcuggaaugcagugacgcaaucucagcucacugcaaccucugcuuccuggguucaagugauuuuggugccucagccuccugaguagcugggacuacagacacaugucaccacgccuggcuaauuuuuguauuuagagaugggguuucaccauguuggccaggcuggucuugaacuccugaccucaagugauccacccgccuuggccuccuaaaguguugggauuacccacgugagccacugcgccuggucgucuuuuagcccacaucuguugguggcuuacugugugcuauggugagggauacuauggugaguaggggcgacagggccccuggagcauaggacugagaagagcauugagagggagaggauuuccaggucugguggugggugagcuagcaugcugcugccaauuuugcagcaaggaccuggggauggaccuucucuggccagcuacaggguauagagcuggugggaaaugcaggagccugugcuagcaguugaccauuaacaugggaacgccaccucccagcgggcacugcugccgcauacuugcgagguugcugaagcuuguaguuuagagcaggaccaucccacuagaugugcaaugugagccucagguauaauuuaaaguuuucuagaagccacacugaaaaaaaagugaaaaggaauagccgaaauugguauuaauagcauuuuacuuaacuuaguauauuaaaaguauuauuucaacauguaauuucugugaaguauuaaugaguuauuuuaugucuucuuuuguacuaagucuuugauaucuagucuguauugugugcuuguagcacaucugaaugcaaacuggucaccucucaggggcuuggcagccgcauguggcuagagggcugcuguaucagcacagguuuagacaauuauguugugguuguuuuggaguucagauuucugucuccuugaaucuugaauauauauaauaaugagaacaggcugggcgugguggcuuaugccuguaaucccagcacuuugggaggcugaggugggaggauugcuugagccaggaguuugaaaccagccugggcaacauagcgagaucccaucucauuuauuuuuuaaaaauauauaaaaaaaaugggaauaacccaaacuguaugugugagaugaauuuagguagagagagagaguguguggaguggaucaucuuuaauucaguguguucuuucuuuuguguuaguucagagaguggcuccauacccuggcuuggaaagggggggugugcacaaucauggaggccauccauggaggguccugugggggcuuuucugguuucugggaagaggaucuguuggguuucucuaggugguauuugagaccaacucugggaaaaauguggggacuguuuaugaagaacacagagaagugcugugcccaggucucagcagaaaguguguucucucccaccucaucugugauucuucuccuuggacauuugcuccgucuuugcucucagcugaccagcugauccuggggccaagccaaguccauguggugucauugugcagcucccaaggccacaccuuagaguuccaccacagucucuuucucacucuccuucuuccaccccagaucucaggauaaugaacccggcucaucuugagucauaugggacugggggagaggacaagggcagguuagcuuccucaugcaaggauacuagcuucuuacucuaaugaugguuucuuuuacugugcaaaaccuuuucaguuugauuuaaucuugcuugucaauuuuugcuuuuguugcugugcuuuuugugugguauccaagcaaccauuguaaauacuaugucaagaagcucuuccccaauguguuuuuuuuuuuuuuuaaacaaauuuuacaguguacagcuuuaggucuaauguuuaaggcuugaaucuauucagaguuuauuuuugugucugguguaagauagagguccaguuuuauuaugcucacggauacacaguuuucccagcaccauuuguugaagaggcugucuuuuccccauugugucuucuugacauccuuguugaagauaaguugacuguauaugugagaguuuaauucugggcucaguauucuguucuauggguugaugucugucuuuaugccuuuaauauacuguuuuaauuacuguagcuuugaauaaauauaucuugaaaucaggaagugugaggccuccagcuuuauucuuucucaacgcuacuuuggcuauuccuggucuuugauuguuccaugugaacuuuaggauuuuuuuuuuauauucuguaaaaauugccauugggauuuugauggagcauugaauuuauagaucgcuuugaguagugucaagucuuccaacaaugugaagucuuccaauccaugagcaugggaugucuuugcauguauuuguguauuuguaucuucuuuauuuuaucgauguuuugugguuuucacucuacaagucuuucaucuccuugauuguauucuaauuauauuucaaucaaucuguuaaaaaauaaaauaaaagcauguacuguucaaaacaacaauagcaaaaccaaacaaggcugcugggugccugcccuggggauuuggcuggaugcccugaaggggucauugugagcuagguggguuucccaggaucugcugucucugcuccucaccaguuuccuucccugccuuuugcuucuggauuugcuguuuugcacgagcccagcauguagcuuccagaguaagaucuugaggagguugcugaagcauguucucuaccuaauguguugcuuugguuuucaauauugggugaucauguuuuguuuuguuuuguuuuagaucccccuccuccagauggauccccuaauauuacaucugucagucacaauucaguaaaggucaaguucaguggauuugaagccagccacggacccaucaaagccuaugcugucauucucaccaccggggaagguaaggagaggccuccguggguuaaacagcccaugagugaugcagugaccagagcuuucucugugcccacugaggcaugugaguaaugcagacacacgccugucuucucacugcagccuaugcuguguacucagacagagaaggagggugagguauuugccugaugguugacaaacuuucuggaaagggccagauugccaauauuuuaagcuuugcaggugguauagagucuguugcaagcauucgacucugccauuguagugugcaagcagucacagaagauacagaaggaaugagugggaccauucccacuagauguuauuuaccauggcagguggauuugguuuguggcccauaacuugcugaucugugaucuagguuuuucuucucuuuuaccucacugggccuuuuaggugguagaauauuaguuuuaaccaacucugucucucucucucacucuacacacguacacacaugccauccucagaggaugacuuuccuuugaaagaaaauagaaaaagauuugcauuugcuagugggaauuugcagaguaucuccuuagcugagagaagagguggauuaaaagcugcuuuuccuuaaagggcucuguuacauucuuuugugguaggaaaggaaucauucgagagucucuucgguagcuguguuugagugcuugcauaaggccuagauuuaaaagcccaaguuuuguuguggggguucccuccucccccuccccuccucccccuccccucuccuccuccuccccuucuccucccccuccccucuccuccuccuccccuucuccccuucuccccuucuccuucccuuccccuucccucuuucuuucuuuuagagacaagaucucaccauguugcccaggcuggucuugaacuccuggacucaaguaauccucccaccuuggccuuccaaagugcugggacuagacuacaggcaugagccucugugccuggucugggagauucuuuaugcaugaauaaugcaguguuuccucugcccacucucuccuacuguggugcuguccucauguccuugaggaggauagagaccaaacacacugucgggguuagggaucugggaggauagaaauuugcuggugccauaaccuguggcaaaauuucaaaaagugagguugaaaucucuaucuuuuaauuuugggucuguuuccagcucuuagucauuuugcugugaugcuugucagcaagucccauugaggaaggccauguugcauagcagccagacugaccagugcuggccugugauuagaugaaaccuugggcucugagcccgaugcccuggauugggaacccaacucuaccucauaggcagugugaccuugugccugguccuguuagccuuuuguaccuucguuuucuugucuguaaaauggagacaauaagcuuaugugaugggauucauggggaugaagugaguuacuguaggugaaacccuuagaauucaauguaagucaaaccuggcacagagagauacuugagagaugguugcugaucacuaucacccaacaucaccaccauguagauaugcaggagaagaaaucucucugccaucacuuucuuaugauucuccuucuguguaccuuucuuagcuggucacccuucugcagauguccugaaauacacguaugaggauuucaaaaagggagccucagauacuuaugugacauaccucauaagaacagaagaaaagggacguucucagagcuugucugaaguuuugaaauaugaaauugacguugggaaugagucaaccacacuugguuauuacaaugggaagcuggaaccucugggcuccuaccgguaaugucuucugguucuuacucuuugggggcugagccucaugagcauaaagcucuacaugccugcggucagacacgucucagggaccucuuuuugcucuuuguuaucccacagggcuuguguggcuggcuucaccaacauuaccuuccacccucaaaacaaggggcucauugauggggcugagagcuauguguccuucagucgcuacucagaugcuguuuccuugccccaggauccagguagggagaagacaacaguccuggcacugguucaguggcauuuugcuccacguguccauagaaggccagcuguguacaugccucccucagaccuucaggaggguuggugugcccagcucuccccucccagagguugagaugucacugggucaccgggcuuacugggcuuccuccuccgaggucccacagccuggaccccacacucucccuucucuaagugccaguuguucuuccaaucugcaaagauuauugacuccccuuaucuauguguggucacuugugggcccauaugccaggugcacaguuugacacauugcauugaauccuuaaauaguagaaucagaggaagccacauaaauugucuuguucaauccucuguuuauuuuucuucauaauuuuaauuauguuuauugauuuguuuauuuuauuuuauguuuuuuuuuuuuuuuuuucagacagagucuugcucugucacccaggcuggagugcaguggcacgauaucugcucacugcaaccucugccuucuggguucaagcaauucuucugccucagccuccugaguagcugggauuacaggugccugcuaccaugcccagcuaauuuuuguauuuuuaguggcgacgggguuuugcucuguuggccaggcuggucucgaacuccugaccucaggugaucugcccaccucggcuucccaaagugcugggauuauaggcgugagccaccauguccagccuauuuauuuuauuuuugagacggaguguugcucuguugcccaggaguacaguggcaugaucauagcucacuguaacuuugaauuccugggcucaagggauccuccugccucagccucccaggugggaccacaguugcuuaccaccaugccuggcuaauuuuuuguagagauggggucuugcuauguugcccaggcugguccugaacuccuggccucaagccuccuuccaccuucuuccaaagcucugggguuacaggugugagccacugugcucugccugcuuuuuggaagugagacuuuuaaggccuagagaggggaaguaacuugcccaggguuacacgauggcuuuagaggcaggccugaaauucuggucuuggacccuuguuaagugcuucuacccuuuaucacauagaccuaggugauacaggagcuucagggauccaagaggggugcauccccuaccuucaagccagaggcuaauggacuggcugguuuguuaguuugucugcuuuucuuuccuaguuggugguuguugggcgcaggaaagaaugccugccccagaagcaaaguuuagggaguccccacauccuuccccgguaaacaaauggguuuccugucaccugagcauggaugcugcuguagguaccucugcucauaugugggugcuagucucaaaaugucagagguggcaggaaaaauaucugaaaauccagcccaguucccuaaauuugcaguugaggagacagaccuggagaggaacaguaacuuucucaagaccauccagguaguaguggauugggaacaggaaccuggcuucugcaugcauagacuaguuuuagguccaaagcuauuuaacucccuugugugugugugcgccugugugugugugugcaugcauguguguguaugguauacacacuuuaacucucugguguuagggucccaggccaguuuuuagcacauuguguggucugcaugaacaccucuugaagugucucccauuuggacuuuucucaggugucaucuguggagcgguuuuuggcuguaucuuuggugcccugguuauugugacugugggaggcuucaucuucuggagaaagaagaggugauauugcuuaugcuaauaauaauacucugguauuuaaggaagcuuucuauuaaggaacauuucaaacuuugacagauucagaaggaaugauaugaugagcgccauguucccuucacccauaguguucugcauuuggccaguccuauuuccucugcgcccccagcugggcgauguuaaugugcucccagcugucacaucaggccacugauagacgccacagugugggaugcuacuuucaaaugauauguucuuguuuacaagucaguuucauaguauuaugauguuaagagauuucauuucagagguagcuaaguuugaacaccagcucugucuuugaccagcuguuuaggaagcuuagccuuaauguccucaucuaugauaggaggauaaucauugugccuaacuugugaagcugaggaggauugaauaaauaaggcacuucucagugucuugugccuuguaugcuauuacuauuauuuuaucuguacaacuacccugugaggucauuaaaugguaaaaguagcagcccuguuuugagugcucaccgugugccugcaucugugcuuucugugaauuaucgcaugcaugaggcucugcgaggcagguccaguaagucccuuccaaggaugcagaagcugagucaggaaguguggaaauagaacuugaaccugguccuugcacuucauggcacgcccucuugucuguguagugugugaagccuguguguguuaguugggauuucuuugcuguaaggugcugccaaccagggaaucuccauccugccuuagggguccucaugcggcccaggccgguuccuugugcugccacccugcccuguuggagugacaggcagagcucaugcuccagcuuuuagguuagguucuguuuuuuuuuuuuugagauggagucuggcucugucccccaggcuggaguacaguggcaugaucucagcucacugcaaccucugccuccugguucaagugauucugcugccucagccucuugaguagcugggauuacaggcaccgccaccacacccagcuaauuuuuguauuuuuaguagagacggaguuucaccauguuggccaggcuggucucgaacuccugaccucaagggaucugcccgccucagccuccugaaguguugggaucacaggcgugagccccugugccuggccagauuagguucugauuuuggggggggaaauggaucagucaguggcuggauaaaacaguuuuauuguuucuuguuaaaaauaagaguaauacaugcuuauggcaaaaaauauagaaaagaagagcaaaaauaaauaggaaaucugcaaucgcagaacccacacaaaacuacucuuaacauuuugaugugaccaaacucacacacaaaugugugcacacacauggaaucauguuacauguuagaaucaagccugcuuuauucagcuuagacauuguuggcagcuucauuucaucacaauuuuuuuuuuuuuugagacagaguuucguucuuguuguccaggcuggagugcaauggcguggucuuggcucacugcaaccucugccuccuggguucaagcgauucuccugucucagccucccaaguagcugggauuacaggugcccgccaccaugccuggcuauuuuuuuuguauuuuuaguagagauggaguuuugccauguuggcuggucuuaaacuccugaccucaggugauccacccgccucggccucuuaaagugcugggauuacaggcaucagccaccgugccuggcucauuucaucaucauuuuaaguggcuacagaguauucaacuguaugacaguaccaugaucuaguuaaccaauuuccuagguguuuccaaguuuuuuuucuuggccacaguuacuuauccuugugccuaaaucuuugggcacauucacgauuauuuccuuaggcuaaauuccaagcuaggcaagugcugggucaguggguaugcgugcuuucaguuuugauacauacugccaaauuaccuuccagaaaguuuuucuuaaauaccaaugcagaguugagucaacagugcaggagugugcagaugccucaccaacuugccaguuccggaucugauauguuuuuugguuuauugcauucauuuaucagaaaagcuuucucaaaaacaaaguaugaaauaacaagucuugcuuuacauuaaaguaaugccacugcuauauauuugcaaggaaguucuuaaaagugacuuggauaugauuuuuuucauucuuuuagauaguacaaaagaaaauaacuucacaaauuuguaauuagcauuugcagcuugggucauuaaguuuaguauuagggggcaggauuuggugucagcugugaacuaaugccugaggaaaagguguaacaccuuuauuucauagaugacaucaacuccagauacacaagggaaaagcacaggaaggaauccuuuuuugucuaaugggucucuuuucucuuaaaacaggaaagaugcaaagaauaaugaaguguccuuuucucaaauuaaguaagucucucaaauuaugagcuuuauuuuaaauccuccaaucuguucggugacuaucuauaaauaauuuuugauggaacuugcugucauuuuuccugauuggcacauuuugaccaugaccaucuggaaguuuuugcuagcucuguuuucugcaaggaaucuauguuuuauuagucuccugaagcuggcuuccuugucauguucuacucuucuaccaauaaauacggauuucuugauuaaaaaaacgucaaauagguuaucaagauccaggggagagaagaacuuacuuaaagucacaaaaccaauuaguuacaaaguagggucuagaaaucagauuuccugaaucauauuuuaguguuuugugaauaauaguacucugacccccucuugccaaauuauacccuggguuuuguuguuuugggaagauuguuuacugucauuucuagaguaugaaugagucuuucuaauugcauauuuuuucuuucccuuucuaucaugaagaccuaaaaagugaguaaucucuuuauuuuuuuuaauaacuuguacuuuucuauugaauauggacuucacugaauguaaaaaauccugauaaguuuuguuuucuuagaucuaaguuaaucagaguggagaauuuugaggccuacuucaagaagcagcaagcugacuccaacuguggguucgcagaggaauacgaaguauguugcuguaaauacuguuuuuaauugugucagguuccaacccaagcugggaucugaggggaguugguggauggguggcagguagcugaaagaacacucgagggacuguaggcaguugggacauggcuuuauucucucuccuacagagucagcagugcaguuauauuacucacagacaauaguggcucaaagccagguaugaacucacacaaacagguuacauuaaauggcuauauaacgcaagggguuguugcgcuccaaacccuuugcgucauacuguccuggaugucuaccuuggacuacuccugacugaagcacagccacuuuccuuagaaauuggcuuguuuuuccugaaaguuagaaaacuguuaacagaaacuaggaauucaagucagggaacuguuagccacaauacuuaggaagcuauaugagcuggaaagaaaccaaaugggcauguagaggucuggggcuugauggcaguguggccuaggauggcuugugaggcucacuucugaagcccugcacaaggaauuucuuggccagugucugccuuucaguuccccaugcugugcuccaaccagcccaggaaccagcccugcucagagugaccaugcacacucguccuccugugcugcccuguccagcaucucugccuuugcucucuugaaauccugcucagcacucagcacagugcacaugcugcuuccuccaugggcauucugggaucccauuaggaggacuugaguucugugugcucagacugccuuguuuccccuguugcuuguuaccaauauucagcauuucuuuaauucugccuuuuuguaauguuaguuuuuucuguguacaguacaccucuccuccagguugcaacugcuugaaggcaaggguuauccuuuuuccuauauucuaaccuuuguauuaguucucuaggcugccauaaaaaagcaccacaaacugggaggcugaaaacaacagaaauuuacugucuagaggccacaagucccaaauuaaggugugggcagggucacacucccuucuaaaccucugggcagcgcccuuccuugccuccgcagcuucugggagccccaggcgucccuugguuuuguggcagcaacacucugaugucugccucuguguucacauggccaucuccccucaugugucuaugucucuuugucucuuuuccuccuauaaggacacuagucauaugggauucagggcccacucuaaucuaguaugaucucauuuuaauuuguuuacauuuguaaagagccuuuuuuuuuuauacuuuaaguucuaggauacaugagcacaacaugcagguuuguuacauauguguacaugugccauguuggugugcugcacccauuaacucaucauuuacauuagguauaucuccuaaugcuaucccuccccccaccccaugacaggccccggugugugauguuccccucccuguguccaaguguucucauuguucaauucccaccuaugaguaagaacaugcgguguuugguuuucuguccuugcgaucguuugcugagaaugaugguuuccagcuucauccaugucccuacaaaggaccugaacucauccuuuuauggcugcauaguauuccauggugaaugugugccacauuuuucuuaguccagucuaucauugaugggcauuucgguugguuccaagucuuugcuauugugaauagugcugcaauaaacauacaugugcaugugucuuuauagcagcaugauuuauaauccuuuggguauauacccaguaaugggauggcugggucaaaugguauuucuaguuucauauccuugaggaaucaccacauugucuuccacaaugguugaacuaguuuacagucccaacaacaguguaaaaguguugcuauuucuccacauccucuccagcaccuguuguuuccugacuuuuuaaugauugccauucuaacuggugugagaugcuaucucauugugguuuugauuugcauuucucugauggccagcgaugaugagcauuuuuucaugugucuuuuggcugcauaaaugucuucuuuugagaagugucuguucauauccuucgcccacuuuuugaugggguuguuugauuuuuucuuguaaauuuguuuaaguucuuuguaguuucuggauauuagcccuuugucagauggguagauugcaaaaauuuucucccauucuguagguugccuguucacucugaugguaguuucuuuugcugugcagaagcucuuuaguuuaauuagauccaauuugucaauuuugucuuuuguugccauugcuuuugguguuuuagacguaaaguccuugcccaugccuauguccugaauaguauugccuagguuuucuucuaggguuuuuaugguuuuaggucugacauuuaagucuuuaauccaucuugaauuaauuuuugucaguuucagcuuucuacauauggcuagccaguuuucccagcaccauuuauuaaauugggaauccuuuccccauugcuuguuuuugucagguuugucaaagaucagaugguuguagaugugugguauuauuucugagggcucuguucuguuccauuggucuauaucucuguuuugguaccagugccaugcucuuuugguuacuguagccuuguaguauaguuugacgucagcuagcaugaugcuuccagcuuuguucuuuuggcuuaggauugucuuggcagugcaggcuuguaaagagccuauuucuaaauaagaucccacucauagguauugggggcgagaaauccaacauaucuuuuuggggcacaguuuaacccauaucaccucuacauuuccacuuuguucuuuugcuaccaaaacaccacggguuuggucuagguccugcuccucaccuuuacagaaagccaaucacugagaugacaaauauugccggggaagaaagcuuuaaucgggugcugcagccaaggagaugggagcugaaucucaaauccaucucgcugacugacuaaaaccagggguuuauacagcaggaaagaaauguaacaauguguaagaaaacaggaacuaggggcugggcaugguggcucacgccuguaaucccagcacuuugggaggccaagguggguggaucacgaggucaggagaucgagaccauccuggcuaacauggugaaaccccgucucuacuaaaaauacaaaaaauuagccaggcgugguggugggcgucuguagucccagcuacucgggaggcugaggcaggagaccgcgccacugcacuccagccugggcgacagagcgagacucugucucaaaaaaaaaaaaaaaaaaaaaaaaaagaaaacaggaaguagggaggggcaaggaggcaucuggugcagugaucugacuaguuucaguucuuuguuacucccugaagguccuuuccugagaaaggaacucagauaaaacaaauacaaguuucaggcuuuaauagcagaaggguaaauuucuauguuuauucaaaaacaacuugucuaugggacuguugggcugguuucacugucauaugcuaugcuaaauaugaauaauauuugaagacuaaauaaaugaacaccucauuuguuuuguuuucaggaucugaagcuuguuggaauuagucaaccuaaauaugcagcagaacuggcugagaauagaggaaagaaucgcuauaauaauguucugcccuguaaguuauuuuaucuacagcaucuucucuguguuccaucaguggccaucacaucucuaaguguagaggggagggaaucagugauccuaaguaaccacuuccacaaccauucauuagucaccuacuuccacaaccauccauuauucaccuacuaugugcuaagcacuauauuuaggugcauucucuuaaauccucacaacagccuuaugaaguagguaguagaauauuuguuuugcagaugaggaaaaugcacagagugguuaggugaucuuuccaagguuacacagguagugacgggaaaacucggcuuuguacuaggucugucugucucaguaagggaaaaggccagagucuguguucuuaaccccucugucucacaacuauuuauuucaguucuauaauucuggaaugaaagugagcagagggagacggggagucacacucucuguguccagacacaugggcugagugaauuccacagcuaaguaugacuuauauuuagcucauuuccuguuuuugagaauuaacaaugucugcaucuuagucaacaggauuacagcaaauugaguuuaaaauaagaauuauuuauuacaucaaaccauuagaugaaauguaaauaauucuccauugaaaguuccuuguaaucucucuuuuggguggggauuagggcacagagaggagcauaagcagauuguagccauguucugauggagcugaaauugauagacuuugcagauaauuuuuacaucaggacgucaucaucuuuauucgaagccguguuuuucauuccuggacuaaaacauuaaguucuuuuuaaauucagcauuuucuaguucuuggguucuuucucuccauuuauuuccuuguacuugacaaggaguauuggcccauguucugagggaaaugcuuuuaaaacuaggcuggggguauugcccuuguaaggguaauuugggauuauuggccccuuuuugugaaugucuguggagauucucagaucuggagugggagcugggaaguggguguuuggguauuguucuuauugggaagccuuuaggcugagacucaggucaguacuagacuuagcauuguuauguuauuuuguccagaggagggugagguaguacaaucagagacggggaaacugagguggugcugcuucuggcucagccugacacuugcaguucuaagguuauuauuucaucucuuaaguugggcaaguuuguguguaugcuuuugagaugacaauaauauuuauaaaacauaauucuguguuuuagacccuccuacucauaguagucuuauacauucaauuuauacuugaacuugguacucuguuuuuauaacaacuuguuuauaugagaauagaggcagaguagaaugguuaaccuagggaccuaccccguccuaguggaaggggcacuagauuugaauuuugacugccccucaccagauauaugaacuuggagaagucacuuaaucucuguaacccucaguuuccucaucugugaaacagggcaguggcuuguagggugguuuugaggaguaaauaaaauuguuuagcauauucccucaugguagacaccugaggaugcuaauaguaacagguucauuuuaugugagaaggcaucuggugugguuaagaucuuggguccuggugucaggcugcagguucaaauccuggcccugccacucauuagcucugcucuggugaucaugugacuucucugugccacggucauauagagugaccaugaggauuaaaugagguggucuauaugaaaugccacacugugcaucuucaaagacacaagucccaguuuugccauuuugaauuucauuuuuuuuucuguuuuguguccaacuuuacuaaaacauuugcuuauaauggggaccuuuuuucuuuuaaugucacagaugauauuucccgugucaaacuuucgguccagacccauucaacggaugacuacaucaaugccaacuacaugccuguaaguugggggacggucucacagcacuggacuguuucgaugaaaucuucagugugcuuugcuucuuucuguuucuuugagguugacuaugugcuguuucccauuuuuagggcuaccacuccaagaaagauuuuauugccacacaaggaccuuuaccgaacacuuugaaagauuuuuggcguaugguuugggagaaaaauguauaugccaucauuauguugacuaaauguguugaacagggaagaguaaguaucuuuuuuaguuuuuaaaauuuaaaauuacauuaauugcuuuuuauuguggcagaaggguaucuuaaaaaccauuuguuucuuuaaaaaaacucaaacauuagcacuuuauucuuauaaacuuguuuucugucuuuuuuuccccauaagagaaauguuuaaaaacauucuuuaaacaauucuauuuugucauuaucuuuuuuuuggacaaauaucagugucuucuguuuauuacguugcugcuggaguuaguaaauagcaaaaucucccaggccuagugcaagaugcuguucacgguguggcucuguucuucauuggccccaugaacacggacaagcccaucaugucucuaagcaaccggugucuucaucugugagaugaggguuuucaucagcuccaugauuuucaaauuuagguugagcacugaaccccuccugccuccaccccaggguuuuuuuuuuuuuuuuuuuuuuuuuuuuuuuuuuuugagacagggucuccucugucagccagccuggagugcaguggugcgaucauggcucacuacagcuuugaauuccugggcucccucccacuucagccuccuguguagcugggacuacaggcgugcaccacaugccuggauaauuuuuuuuauuuuuaguggaggcaaggucucacuguguugcccaggcuggugucaaacuccugaccucaagugauccugcuuccuuggccucccaaaguguugggauuucaggcgugagccaucacaccuggccuggaaccauuucuuuaagcaaaaucucagacuuaucccuggauaagccucagcagccuccucucuccugcaacguccugaaaucccucuucugcuuccaucaaagauaagauuuuuuuuuuuuagauggagucucacucugucgccaggcuggagugccguggugugaucuuggcuuuugcaaccuccgacucccugguucaagcgauucuccugccucagccucccaaguagcugggauuacaggcaggcgccaccaugcccagcuacuuuuuguauuuuuaguagagacaggguuucacuauguuggccaggauggucucaaucuccugaccuugugguccaccugccuuggccucccaaagugcuggauugcagaugugagccaccgccccuggccaauauuuuuuauaguaauaaaauucugcauuuccaugaauugaugugaagagaacugaaaaacacaugcuaaucuaaaaaaaugcugugccuuaggaaugggacuuaauguugcuuuaugaguuguuuuuaaguguagguucauugcuugaggaauaggauucgauuccuuaagccaguggaucucaaacuuuagcauccaucagcaucaccaggagggugguucuacccucagaguuucuaauucggaauugcguuucugccaguuucugggugauucuacugcuguggcaccagggugcacacuuggagugguacuguccccaggauagugggagcccuucaggcaucauuucuuuuauuguucuuuaauucaugguaagcuagcagauguuuauccagccccugguauauguaagauccugugcuaggggcugaggauggaggagggaaagauaacagagcaguaagagaugacgcccauccucauguugcuugugauagagggugggcuccuuacccucuuguugaaucaggagaauaggcuguaauagaaauaaaagcguuuuuaaaaugaaugcugauaggcugggugcaguggcuuacagcuguaaucccagcacuuuggaaggccauggugggcagaccaccugaggucaggaguuugagaccagccuggccaacauggcgaaacccaucucuacuaaaaacacaaaaauuagccaggcgugguggugcaugccuguaaucccagcuacuugggaggcugaggcaggagaauggccugaacccaggaggcggagguugcagugagccaagauugcaccacugcacuccagccuaggcaacagagcaagacucugucucaaaacaaaacaaaacaaaaaaagaagaaugcaaauaagcuuuuuaauacuguugagcccagggccuuauacaugaaacauucuuauaaaucuaucuguuagacaaacaaaaaugacauaauuacauuaauggagaacaugaagaugaauuuaaauggucuuuuguucaucuaaaaucaagauugaaguuagucuuagugacccugggugaauggggaagggaguguauuuucugcacuagauucuccauauauguuauuuuuuuucuguaacaacccugugagguauuaugauuucauagaugagguaacugaggcuuggggaguuuaagaacuugcccacaagguaggaacaaaaauauaccugguaagaggcugagcugggaaucaacuccaugucaguguguauccagauccuggguuguuucuuuggaaccugggucuuuaaagaaauacagaucccgcagccagagucagaaucucuggagguagaacccaggcaucucuuuuuaaacaaaacaaggccaggcacagaggcucaggcauguaaucucagcacuuugggaggccaaggugagaggaucacuugaggccaggaguucaagaacagccugggcaacauagugagacccccaucucuacaaaaauacaaaauagcugggugugguggcacgucucuguaguccaaacuccucuggaagcugaggugggaggaucacuugagccugagagguugaggcugcagugagccgugaucgugccauuguaccccagcuuguaugacagagugagacugucucaaacaaacacacaaacaaaaaacagaaaacaaaacccaaaacaacucaaacuucucaggugagucagauaaucaauuagcuuugaaaacuaccagcaguagagcacaccuuagaauacugagugugugugcguguguguguaugugggguguguguguguguguguaugugggguguguguguguguguguguguguguguguguguguguggucauuugccaaauggguauucagauauucuuggagagcagguguuuccugguuauuucuguucacaucugcccaccaacuuuauagaaaucaaagaccccagaaugauuuaauuugauuuucuuuauugguguguguauuuguauugcaaccgauguauaucugaaagccuugggaaaaaguccucauuucuuccagcugucugggguuaugggagaagaugaggucagugaacaguugugguggcuacucuaggggcaaagggagcuggauggggacuguguccuaggucaagggacagcugcugcucugcucuaaaucaauuuucaugcugaaagcagggccuguuguaggcagaucugauuuuuaaagagaaaauaagucuggauuuuuaugagaaauuuuaagaguuggcaagaauuguaaauuaaaaaaagaaaaaacaauuccaacaggugcuguggugugcccauagacccagcuacuugggaggcugaggcaugaggauugcuugagugcaggaauuggaggugguagugugcuaugaucucauuugugaauagccaccacacuccagccugggcagcauagugagacccugucucuauaaaauaaaauaaaaaaauucgaagggucaaacaaaacccaacuagaaggucugauuccaucucugaugccaguuuucaauagccagucucccuugugagguuuuagugauggcagauggcaugaucugagucuucuuauaaaaaugcaauuuuguucuagaccaaaugugaggaguauuggcccuccaagcaggcucaggacuauggagacauaacuguggcaaugacaucagaaauuguucuuccggaauggaccaucagagauuucacagugaaaaauguaaguaagaagucaggaucaguugagcucauguaauuaccauauguuaauuugggggugauauguuuuagguugauauuaacuaauauguuuuccuaugcagugagaaauguuuugcugcuuuccuuucagaacagaacaauccauaugcauguauacuccaaggcaaccccuugacuuuucugggaaauuuacuuucuugggaauaaccuaaguuauuucugaauaaaaugaaucuuaagagcauggcucuacaucaggaacucuuuccuuucuuuccacuuccaggugacuugcucauagauuuuacagaacaaacuguagccuuuuggauuauuugguuagaaauauggcaucaggagcggccacuugcuguuaggaguaauugauaacaguuacauuaauaggauuccagggcauaugcacauggccuuccuuccccucaaaauuuacaaaagcaaauccaauuaaauugugcaggcauucuaggaagucaaguuuaugugcuuuuuuucuuuuucaaggaugcuuugaaaauagaggcagugccaugaagcagcauugguaucuguugaugggugugugcauuggcauaacucucugcuguuuauaucacaggccuaaacauuaggcaugugcuggcuugaagucugagacuauccuaaggaaauaaucugaaaugcaaccaaaggcuuauucagaaagacgagucucagcauuauuuauaauagaggaaaacuuuggaaaccaugcagacaugguuuuguagcuuuuguagcuuuugcagaauggauaacuuaacuaugacucgucugcuuauaauaucauuauucagcuauuagaaaugauggcccaggugcggugauucuaaccugugaggcuaaggugggaggaucgcuugagcucagguuugagaccagcuugggcaacaugcugaaacuccaccucuacaaaaacaaaaccaaaccaaacccaaaaauuagccaggcaugcugguauacaccuguagucccagcuacuuggaaggcugagguaggaggauggcuugagcccaggaggucgaggcugcagugaaccgagauugugccacugcugcacucuagccugggugacaaagcaagacccggucucaaaaaaaaaaaaaaaaaagauaaauaagggauggguagacuauauaauuaccauggggacaugguaggauguaauguaagagaaacauucuaggagaugaaaauguaugcauauuaugaauagugcauaaaaggaaagccgggaaguauagauucacuggaguugaaucuugaaucuuuuggguggguuuuggggguugauggguuagggucuaguuuaugagauuauccuugaagauuccacaagucauggauaaaguauaguauauuaaguaguaauucuuuacuaauugcugugucucaaagggucuggccucaauauuucaguuccuccucuggagaugccaucaaagcuguuaccaugaucuggccaccuaaauaaugcagcucacaguaguagaaaaaugucaugcuuauuucuuuucuuuucuuuucuuuuuuuucuuuuuuugagauggagucucucucugucauccaggcuggagugcaguagcacaaucucagcucacugcaaccucugccucucggguccaagugauucuccugccucagccuccugaguagcugggacuacaggcaccugccaccaugcccagcuaauuuuuuuuguauuuuuaauagagauggggugucaccauauuggccaggcuggucuugaacaccugaccuugugauccaccugcucggccuccaaaaguguuaggauuacaggugggagucacugugcccggccugucaugcuuauuucuauagauuuugcucauuugaacugacuggcuucuccuugguugccuccacugcuuggggcuuaccuuguggaggggaauuuaggauggaguuguccacaucauuuuuaaaaauugcuguuacuaugauuauuauuuuuuauuaacuaaacuccagacuuuauucagauuucauguuuuuccacuaaagccuuguuuuguuccuggcucugauccaggacaccacauggcauuuaguaccauguuauuuuuuaauuauacaaaaugccugaauacauuuuccuuuagaaaaucgagaaauuacaaacagagcuaaagauuuccuuugacuaccaccccuaaccugagccccuuugccccuccacgaagauaauacuaaguauaacccuccucacuucucccucuuccucucccccuccuucuccccuugcccgcucccacucccuuuccucucccuccucccucucccuccucccucucccucccuuuuucuuccucuucccccaccuccaucucucacagcugguuucugucuuuggaucaguacuucugguuaaaugugugaauguuaacuuuaucugugaugaggucuucuagcaccucucccuucacucugucuguuuuuccuguuuuccaaauuuugaauacugcacauucuuaucaugaauauacauuucaaaaaaugagugucaaagggcagcugucauaauggagauggaaaugccugcagugcagauguaggucacauggguacggauguaggucacauggguauggucauucccugguaugggcauaacgaguacagcugagucagggacaggacucgccccagcuggggugggcuucuggugcuucaagguauaugcuuugguaugagguagggaaccagucuguguaauaaugagcucuauugucuuucagauguugaaauggaugguuuuuugggggaguccuuucucagcucucuccaauucuaaauauuugcauggugcuugcuaguggccugucacuuuauucacuucucuaggggacauagugaauuaugaggccauucuugccuagaaggcacugauuaucaugguguauuugaguaaauuauuuuugguuuuauugucagugacauucccaggggggcucggggauggggcucaugcagcucuaaggaggugcagguguaagaaugugaguucauuauugauaggcagcuguggcaggaagggaaggaucugaaugcagaauuggaggaugagggacuucuguugcaucugaaaucaguguuggggaaaugacuucacuucugugaaucucugcugccucaucuuuaaagggggauaauaaacucuccuucuugagcauauugugaggguuugaugagcaagcacuuuaucagcugcugugcaaauguaaaguuuaauuuuuagucauuacaacuccugguuaguacucaggcucugcuugauuuccccugccuuuuugauguuguuaggcagccuuucugucuggaucuaaaucauuuucugggcuuuuagauccagacaagugagagucacccucugagacaguuccauuucaccuccuggccagaccacgguguucccgacaccacugaccugcucaucaacuuccgguaccucguucgugacuacaugaagcagaguccucccgaaucgccgauucuggugcauugcagguacgcagauggcacgucacgugugacagauuucaaaugucauuauauauuuaugagcacuuuacaaaagcaaagccuaagagggaauguaauaggcauuuaugaauucaggaaagguuuggauaaggaaccauggacuuacucccuaagcccugagcuuccaaaacagggguuggcaaacuguaacccauggaucaaaucuggucagcugcuguuuuuguaaauaacauuuucuaggaacacagcaugcccauuuauuuauauauuguuuaugguugcuuuucugcuacagugacagaaagagaccauaugguuugcaaagcuuaagauguuaacuaucuggcccuuuacugaaaaaguuugccaaccccuaacaauaagaaguuagcuuugaagcuaaaggaauuaauuuaggacagaagacaggaggggcucuguugcccaguggggaaaaaauggcuaaaaugugccgccauccuggguuaugggcaacuugaauggaacugagauugaagaagcuugagcaaaggguuauauguguggcaucugacucaaaugugaguuugggacuuaggccccagucccaagcuagugcugucugacuugcugaggcuucaacugagcaaauguguacugauccugugcauugcccucaaagugugacagugaaggaaagcaagauauauguacaaaugaggaacucuaagaggguugcagucgagggaacccacuguaauaggcuuauuucucuuuucucucagugcuggggucggaaggacgggcacuuucauugccauugaucgucucaucuaccagauagagaaugagaacaccguggauguguaugggauuguguaugaccuucgaaugcauaggccuuuaauggugcagacagaggugaggccaagaucuguauuugacauuccacccuuccccuccauuuuuuuuuuuuuuuuuuuuuuuuuugagacggagucuugcucugucgcccaggcuggagugcaguggcaugaucuuggcucacugcaaccucugccuccuggguucaagugauucuccugccucugccucccaaguagcugggauuacaggcacgcacaccaugcccagcuaauuuuuguaauuuuaguagagacgguguuucuccauguuggccaggcuggucucgaacuccugaccucaagugaucugccugccucagugucccgaagugcugggauuacaggcaugagccacuuugccuggcccuuccccuccauuuuuaaaagguugcauugugucaugcacuuguguuaaaauaugucacccuuccagaucuuuccagcucuuggcugugaacuaacacuggauuucuuugcagacuuuaagcugacuuggaauuaaauuacccaauacaagugacauaguaguacugaugucaguaauggaacuacuacugagauagugucaggauucuuuaccuugcugccucugacucauuaaauaaucuuaggacaucuuugaacuuuggcuuccagguuuuaaacucauaaaacugguauuuuccagucuuuguuucuaagaaggucugaccaucuuuaaaauaagcuaaugaaacaaacucaucaaacauuaaugaugugacauaucauaaugcugcuuaaauguuaauacagcaauuuauccucacccagacuuguacauuuuaaagacuaucaauuaucauagcuacagaaggguggcugaccagcggagaaaaggaacacuuaauaucuaugguauaguuucuguacuacugcuggauuugguuuuacccaaacuguuacugagaaguguuuuugaggcauguuuucaacagaacauauugcaaaguugcuuuccucaaaggggugaauguuccuugaccaggaugagagcagaauauuaauuuuguaucaggcuaucguccuguaccgauuuagaacucuaugaauaugugcuguguuuuugagucuagcagggaauguucuagaugccuggguacauugcgugcucuggggugagcuuggugguuguuguggaaagagugaaauucaacuccuguguuggucaaaagagagauuuucuuuuuucugcuauaauuauauaaaguaguauuucucaaucuuuuauccuuuuuugagaaacauagaacucuuaucccugcuacuagagucuaaucucuuuuuuauauuuugaaaacaauacuuauucauaugaaagcauuugacaauauauuuuucucuccucuuuuuuuuuuuuuugagacggagacuugcucugucaccgggcuggauugcaguggugcgaucucggcucacugcaaccucugccuccuggguucaagcgauuccccugccucagccucccaaguagcugggacuacaggcgugugccaccaugcccagcuaauuuuuuuuuuguauuuuaguagagaugggguuucaccauguuggccaggauggucucgaucuccugaccucaugauccgcccgccucggccucccaaauugcugggauuacaggugugagccaccgugccuggccucaauauauuuuucucuuacucuuccuuccccaauccugcuuccuggagguagccaauguuuauaguuugguguacaucuuuauaagacucuuuauguacaucuguaaacacacacacacacacacgcacacacaguacuuugaaaaaauuggaugcuguuuuuuuuuugagauggagucuugcucuguugcccaggcuggagugcaguggugccaucucagcucacugaaaccucaaccuccuggguuccagcgauucuccugccucagccuccugaguagcugggauuacaggugugugccaccacgcccagcaaauuuuuguauuuuuaguagagacgggguuucaccauguuggccaggcugaucucgcacuccuaaccugagccgaucuaccugucuuggccuccccaaagugcugggauuacagacaggagccaccgcgccuggccagauccuguuuuauguauguugcuucucugugauuuuuuuucuccucuuauaauaucauggauauuuuucugugucagcuuauacccuuguuuccucuuuucuucaucacuauccacagauucugauauaccuaccugaaggauaguccucauccagcuccaccugaucaucuccuuuuaaccucgcuccucgguugagcauuacaguugauucuuacucuguacagucucacuagccaaggcaaucuuguuggacauuugauuguucgaaugugugugugcauuuuuuccucuacauuuccuccuuccuuugcccuucccugagacuguggcauuuuuccuuggggaggggagguguggagugugcucuucugguugagaaucauugaggaaggacaucuugcuucugugauuucagauuucacugcaauguuguuaccucuugaaacauguucgcuugaaccguuugcuguuggguggaugggguuugggaguugggcgggggaaugaccuguuugaaaauaauuuugggugcuaauuucugggacccauguucauuuucugucucucucuuucguuuuucuaucaggaccaguauguuuuccucaaucaguguguuuuggauauugucagaucccagaaagacucaaaaguagaucuuaucuaccagaacacaacugcaaugacaaucuaugaaaaccuugcgcccgugaccacauuuggaaagaccaaugguuacaucgccuaauuccaaaggaauaaccuuucuggagugaaccagaccgucgcacccacagcgaaggcacaugccccgaugucgacauguuuuuauaugucuaauaucuuaauucuuuguucuguuuugugagaacuaauuuugagggcaugaagcugcauaugauagaugacaaauuggggcugucgggggcuguggauggguggggagcaaaucaucugcauuccugaugaccaaugggaugaggucacuuuuuuuuuuuuucccccuugaggauuguggaaaaccaggaaaagggagcuaugauuuuuuuuuccaaaacaauuucuuuuuuaaaaaagacuauuuuauaugauucacaugcuaaagccaggauuguguuggguugaauauauuuuaaguaucagaggucuauuuuuaccuacugugucuuggaaucuagccgauggaaaauaccuaauuguggaugaugauugcgcagggagggguacguggcaccucuuccgaauggguuuucuauuugaacaugugccuuuucugaauuaugcuuccacaggcaaaacucaguagagaucuauauuuuuguacugaaucucauaauuggaauauacggaauauuuaaacaguagcuuagcaucagagguuugcuuccucaguaacauuucuguucucauuugaucaggggaggccucuuugccccgacuccgcuuccccugcccccuguacauuugugcuccauuuuuucuucccuuuucccucccaguuuucuccaaagacucuucuguuggcaacauuuucaacccauugguugggugagaauggcgacucaaauaucaccuugagaauuucugugggugggaaugggagaagcagaggaauccuacaguggcagaaauccuuuucuugucccuguauuauccuuuuucucaugucuguauuugguaugaaggauuauuuaaaggugcaauaugugaauuagugauucaugauguucuagguuuuuaguaacguuuuacucagguuggcauuuuaugugucugugucuguauguguguguguauguucagaagcguggcaaucugugaacacuucagcgugaauucagugucagauuaaucccuccuuccccaaaguccacuggcuuucgucucucucugccgugacacauaucggaaucuacuguguauauauauauauauauauauauauauauauauauauauauauauauacacuaagcucucaaaaacagucauuccuaugaauugagguguacaaaguuugaauuuguaucaaagauguaauuauuauuuuuaaaaccuuuucacuauacugcugcuguaauuacuuugauuuuuaaaauguagauuaauuuuuuuuuuuuugcuucagguguguauccaccaagaauuucaaauuuauguggauuuauuuuauugguacauaaucuguaaacuucuuaaggcauuaacaugaaaagauuuuuucuuuuuauuuuauauuguggcucagguuauauuuugaagauguuuugaguuuauccuccaauaggcaaugaaguugacaagguuuuaugaaggaauaaccaagucccuggaguccuguggcuguugccacaguaauguguccugcuguaaacaggacagguguguccuguugagaaugugagcgggcucuuccagccuccuggucccuccugacucugccacgccccucaccucacuggcacuucgauaacugacuggacguguuaaugggucuuuuaggguucuaaagggugaaccacacuuuuaaagccccggcugugguucggaggguuagugcuguaugccuuuuauuucccuuucccuuugagguacugaaaggaugaaaagguggugucauguuuuggggagaaucuuacuucucaaauggaaauugcacuuuuugcugaauccuuugcauuuuuuugguaguaagcaguucauugaguaucagguccucaaaggaaugaguuggcccggcuagggugggcccucuugaccuaacuucagagggggccuuggcucaguaggugugaaucagggaagccacauuguccucagggugcuguaugaagcugggugugggcggauuccucccacaccuucacacuggccugccuccaacucauacagaucucggagcggucgguacuucauucauaggucccuguucaggcagcaguucugugggcuguggcccucuccccuccaauauguccgaaaccauugugauggguggcaaaucccagggagcuccuaagcccugcucugcccacaucacugccacagagaagucagaggaagggacuuguugcuaaaaaauccuuuaaaagguuaaauacuuuaaaagauuaaagcaacauaacuguaaacauauuguauaaaaaugaaaaacacaggaacccucuucccuuccgccuggugugggcuugggaaaugggcaagcggccccagcaaucaugggaggaacucuugcgggggagcggucugggauuccaaaugggcaggucacacgaaggucacgaugcuucucugcauccugaaaagggcuggggacagggccagugggggugguaaggguauuuauagcacagugcuugaaaagggaagauuaauguguaaauauaaaggacacacaggcuggggguuggucagaggcaagaggagggugccucugagcuucaaccccucccaggaacaaugagcucaaauuggaagaguccaguggaaucggggggauggugugagcaccccuguucagucuuugacaauugcauacagaaaagcagcugguauggguuugggugucaaugaaagggccaaagacugguggccagcugguuugggggauuugggccauugauagcaucucccaggaacaacgacuuuuugccuccaaaguuggaucuagugaugaucagcaccagcaggaaaugacauuuggugucugcccacugcagccauacugugaccuccagccagacuuccgccuaauugacuccacuggauuugugcucuguugagucagaggcucccggggguuggggaucgaggggcgggggucagcuaugcagcccaucacguguguuuuucaucugggaugaaaaagccugguucucuuuugaaaugcuugauuguacuuauugagcuaaacaagucuuggugacuguuguugauuugccucaaaaguuuuaaguccuggguuuucagacuacuguguagcagcuguguguuuaacauacuguagcuuuuucucccuugggggcacauacaaauaggauguguugauguggacucuaaacuguaauuuuccuguaacuauuuuggaaugaugcauauuucuaauguuuguuauacuuguacagaguauugcuguugguugcuuuuuuuuuuuuuaaggaaaaaauggccugaaaacauuuuuuuaaagacuuacaaauaccaaauauaaaaaaaugucaaugcauuaugccuuugcuucuuucuuucuucuuuuuuccuucuuacaaugugccaagcaguuuacuggccugcauuuuacuugggcauccuuaacaaaaacacauuucucuuugggauuuccggauuguuuuaguuuucuagggcuguuguaacaaguaccaccaacuggugguuuaaacagcagagauuuacuuccuacaauuuugguggcugaaauccagaugugggcaggguugguuuccugugaggccuuuuuuuuuuuucuuuuuuugagacagagucucacucuguugcucagaguggagugcagaggcgugaucucagcucacugcaaccucugccuccuggguucaagcaguucuccugccccagccuucaggcgccucucuucguagcuugcagauggcugucuucuccccaugccuccacauggucuucccucugcuugucuguguccuaaucuccuucuuuuuuuuuuuuuuuugagauggagccuuguucugucgcccaggcuggagugcaguggcaugaucuuggcucacugcaaccucugcuucucgggcucaagcgauucuccugccucaaccucccgaguaguugggacuacaggugccugccaccacacccagcuaauuuuuuuguauuuuuaauagagacaggguuucaccauguuggucaggcuggugucgaacuccugaccucgugauccacccgccuuguccucccaaagugcugggauuacaggcgugagccaccgcucccggcuaaucuuauaaggacacgagucauacuggaucagggcccacccuauugaccuaauuuuaccuuaauuaccucuucaaagacacuccaaauguagucaaauucuguuuuaguggggguuaggacuugaccauaugaguuuuggaagggacccaguucagccuguaacacauauucagggcaauuuagugaagaggaggcuuggaggaaguggcugugugucuuaagauuguguguguucccagaagguuggagguaugagccugcagguggauggauacccaguugguuggggguguguuaugauauaguuagcucuccugggcuuucugcuuagggacagcgcuugggcugcggauaaaguauccaucaucuuccuguuuugauucaggccaaaguugucccagaacuuuucugcccacaguguugguuuagaggaggcagggagacacuguauugcugaccuguuaucugcauacuuaaaaaaaaaacaaaccaaacuaggcuacccugcaaaauagcacagcauucucugcuccuagcacuuaguuugauaaaaacuaccuuacccagguauagccuaggaauugagauauugugggaaagaaaaaccgaaugaucaccugugguuuuauaaaauguaaagcuuaagugagaaaacaaauucauagaacuauaaacagagaacaaucccaauaagaauuaaauaagugcauagaagaaaagaaacacaacucuagaauaauauaauagugggauuaggaguggauuuuauuuuuauauucaccuguuuauaguuucuaacuucucccaaugaauauggaguacuuaagaguaacuaguuuaaaacuuagcacuuuucccuccuugccucaaaaaagugaagcuacaguauaguuuuaaauuuacuagucaaguuacaaaauucuuuuuuuuuuuuuuuuuuuuuuuuuggagacagagucucgcucugucacccaggcuggagugcaguggcacgaucuuggcucacugcaagcuccgccucccagguucacgccauucuccugccucagccucccuaguagcugggauuacaggcgcccgccaccaugcccggcuaauuuuuuuguauuuuuaguagagaugggguuucaccguguuagccaggauggucuccaucuccugaccuugugauccgcccgccucggccucccaaagugcugggauuacaggcgugagccacgacgcccggccaagcuuccaaguucugauagccaucccaucccuucugggguuucacagcucuauuuggggcugaacguggcagaucucuggggccuccaacaugagagccugggcuuuacauuccugcaggcaggugaagccuccugacccaaaaggugaguagugggccccuguuggggccagcaguuuuggaugaugccacuagauggcggcagagaacugggcuguggaagcaauccuuggcuaggcuguggcagggcaguggagcacauaggauuggaaaagaaaccaggagguccguaaggcaaggcuaaaaaccagcaacagggcgaaggaagcgcccuugccagcagcuggcagcuuuccguauaauuuguuagauaauauguucaugguaaaaaaauuuaggaaaagaaggaaaauaaaaaaauccuauguu

SEQ ID NO: 13266 - RNA, 9754 nt, Homo sapiens
cuauccugguuuuagcccaacaguuucccacgcccgcccccacccccacaaccuuguuuguuuaaagaccauuaaagaacgucuucaauuuauucuggauugaguuuuccucaaaccaaaccaccccucaguucaccccccagagcuguugaggcccuuccugggggcuuguggcuguggcugccucagaucagagcagacccugggcugcaucauccuuccacauugucucucuaaaguaccugaagccaguaguucucaaacuuuggagaggguuuugagucaccucgagagcugauaagaacagaggcccagauugaaguugaauagugcugggccuuuguuuuuaccaaguucccuggaugguucugcuaccuccuagccugugagaacuacuccuuugugauuucuugccauugaaauuuuuucucaccuucuucuuggcuugagugcucuucuggguuccuuccggcuguccaaaucaaauuuaauuuucacacccagaccuugucccugcucucauccuucagcccacccuccuguuccccauucagccagacccccugccagucaguucaagugcuaggcaugggguaucgagucucaggccgguccacagacauuccagcaccuggugguaagaggugagugcugcguggacccacugaggaaggcucuggcugugcugggggaggggaguuuaugcucguccucauagaaggauaagcaggaauuaagugggcaaaggagggagugaggaagcucucacuuucuagguaguaggaccagcaugaaccaagguaggggaugacaacauggcucauucagggaauuugagguauguugauacauggaaaaauguaccugaaaugugaguccugcuuuugugacucacccuuuccuuuacauaagcauugauuuacaucuguuguuuuuuaagauaguguguauguugaaaaguucagaacaagaucaaguggagacauaaaaugguaagaugugaaaaguuguucuugccagauuaaaugguuccaccugaagaaaauuuuuuuuuuuuuugagauggagucucacuuuguugcaugggcuggaguguaguggcgugaucucagcucacugcaaccuccgccucccggguucaagcaauucuccugccucagccucccgaguagcugggacuacagguauacacugccaagcccggcuaaguuuuuguauuuuaguagagacgggguuucaccguguugccccaggcuagucucaaacuccugagcucaggcaauccccagccucagccccccaaagugcuaggauuacaggcaugagccaccgcacccggccugaauuuuuuuuuguuuuguuuauuuauuucuugguuuugcuggccuuuaagcaacccaagacuagggggcuuucacuccgucccuagagagcucaaagggccugacuuaggggacacagucagugaaggggaugaaugaaugaguuucagauccagguguucuggauaagucacuuuaccuuucugggccuuuuuccucaacuccaaacagaggaugucgguauagacaaucccuaggaucuuguccccuuuaugacugaucacacaguuccacugcuugcccuugaggcuuugguguccgcgcaugccuauucagucugacccacaagaggccaggccagcucuguuccaggcccugaaaaucccauuaaaacuccacucacuagccuguucccugggggugcugaaucagcauuuaauggggaaggccacgagcuaggcucugguggguaggaagugugugacuucucuuaccucaacaguuucuacuguaacuagcgggauaagguaaaucuauggaaaugcaaggcuuaugccgaggcucacagagugggccaggcugcauaaguccuggacaccacagggccugcuuugagaaggcagcuguggucccacagccuugaccaccaggcaccauccucuguugccaguggacccacauuucaaaucauuuuaucucuuuuuuuuuuuuuuuuuuuuugagacggaguuucgcucugucgcccaggcuggagugcaguggcgcgaucucgacucacugcaagcuccgccucccggguucacgccauucuccugccucagccuccuguguagcugggacuacaggcacgcgccaccaugcccggcuaauuuuuguauuuuuaguagagacgggguuucaccguguuagccaggauggucccgaucuccugaccucgugauccgcccgucucggccucccaaagugcugggauuacaggcgugagccaccgcgcccggccuuuaucucuuaaauaaccuguauucauuuguuccuucccaugucuuauccaccaaaaaucuccaauuggaaauucagacaaggauugagacccuguguucuuaaauuggguugauugaaaucuagaaacaaugauaguaauaacagaguuaucuucucucgaacaucugccuccugccugauguuauuucgcuuaauucucucaagggcuugaggagaguccugccauaauccuuccuuucagaggggaagaucgaaauuuagcucagaucucaagcuaguaaucaucagaaccaggauauagaaucaggacuagaccacauggucccugcucugagcugcugcggguccaucccuguggcucuguccaggguaaauggaugauucaggggaagggucagcaaacuauagcccaugggccaaaugcagccacugcuuguuuuuggguggcccaagagccaagaauaguuuccacauuuuuaaauggguggagaaaacaaaaucuacaaagaauaauguuucaugacacaugaaaauuauguaaaauauacauuuaacgcuuguaaguaaaguucuguuggaacucagcuacagucguuaguuuacauaucaucgauggcugguuucgcaguacaagggcacaguuuaaagccugccaggccuaaaauguuuacugucuggccuauuacagaagacguuugcugaccccugauuuagggcauucaugaggcuugaugagauguugaaaaucagcugucuccucccgucacucucuucugauuguggguaggcucuggugcaccagcucuccagugaucuccuaucugaugcucagaguucuuuuuccauugcauggaugucaaauaaaagugucugcuuuguggcauuucuggcuugagaguaccugcccaaugugauuugccaaggugccauuuuaucaaaagucuuaggaugacuggauggguuugccuugaauuuguuuugccuuugcugaugguuguauuuagguuaucauugaaagaggauugcagaacagcggcaguuuccugugcugucuggauugaaguugaauaaugcccuaacuuuuaauugaaagggacuguuguaggcgggagacugucuaagagcugaccugucaccaccaccugagaugucugagcccacccuuggacuuucuuggcacguggggaagagggggccuggguccugggcucccaccuaaacucagcagaccccacuggcagguguguguugugggggugauggaggcuuuuuggagggcauugagcuccuuggguggaggugggguggcugccuugggggcucagugcagcucuggccaugauggacagaaggagacaagaauguagcuucuuguucugagaacuucagcccaaguuccuccuuucaugcagcagaauccaagacacugacuugccccucucugcuguugaggcuucuguguugcagagauaccuucuggcccugcuuuauccuagugaggcagcucaccucucccguguuucacugcucgaacucuccuucccaaggcugugcuagugguagugaugacaauaauagcuacuauuuauugugugccccucguaugcuaagugcuucacguagauuauauaauuuaauacuugucacaacagucuuaugagguaaauacuguauauauauuuaaaaagacuauuuuuagagcaguuuuagguucacagcaaaauguagaggaaguuucacagagauaucccaagcaccccuugccauuuucucuuaguuaugaaaaugaucaaaugggcuggguguggucccagcacuuugggaggccaaggcggguggaucaccggaggucaggaguuugagaccagccuagccaacauggugaaacccugucucuacuaaauacaaaaaauuagcuggguguaguggcacaugccuauaaucccagcuauuugggaggcugaggcaggagaauuguuugaaccugggagguggagguugcagugagccgagauugcgccauugcacuacagccuaggcaacaagagcaaaacucugucucaaaaagaaaaaaaaaaaaaaaaagaucaaauagacuuccaagugcccaugucucagguucaguacugaucagcauuuuacccuccuuugcuucagcucccuccugucauugcucauugcugagaguggguaaggggcuuucucagguuccuguagcugguaggaucccgcuguccucaaaguuccugcacucaguggcugacggugccaggugacucccccuuuugggguccaugacauuugcugcuguuucuaaagccccuacugugugcugcuaauccccucaccaagcuugcagagcggaugguaacugacaggugaaaaaaugcaagaaguuaggucacggguccggggacauccugcuaauaggugguggugccaggcuucaaacucaggccugacuucaagucccgcagcuucucugccccacccugucucuguccuccucaccucuguaguguggugggacucggugggguggucguuugacugugggaacuucuguuugcaaagccuuggaaggacccaggugacugcagauaguuccgugagaagcaucugggacuguugaccucacugcugaucuuccuugugagccugugauagggcuaacccuuggcuuucuggccagaguguagacagagacccgauuagcauuuuguggucagucagaggcaguuugugaaccuggaacuuggaagcugguuuccuccucugggagggauguggagccuggggagccaggaaggcauggacugaauauacacccagcugggcaguggggaagggaggauuccguggggagcuagcccugaacacagcaagcauuugguaaauggugccuguuagcuguuuuuauccguauucuaagguggacgagcggcgcaggagagaacugguaggauuaauggagugguuucauuauucagauuuaagugcaugcagccagaagucuucaacugaagaauugaaacucucugcucuuuuuugggggucaugguggcagugugaggggcugguucaugagugaggagaaaagguaguggcaggcagaaugguacauuuuauauucauauugugcacauuauucacaccugacaugggccagaaauccucuccuaagagagacacuuggaaaguaaacaguuuguuaaucauuucaacccguggacuuugguugcagggugcauuuugaucaaggguuacaaacaccaaugucuucagggacauuuggggacauaaauaaagggaauggacaaaaagauggaaaagcauacugccucucagucuuucgcaugcucauguuugauagagaaaaucaacaucgugggggcaguguugcuuggcaacugccauuuguccucagcguuggggugacauuacuagggaauggcugugaacuccaagcacuuccccccgggaagcgaggcugacacucagauccaauucaugucuuuaauguggccaaaugagaaagccagauguauuucugagaagccaaaaaacaagauuuaaaaaaugcuaucucccuaauuuuuuuuuuugagacagaguuuugcucuuguugcccaggcuggaggacaguggugcgaucuuggcucacugcaaccucugccucccagguucaagcgauucuccugcgucagccucccgaguagcuaggauuacaggccaccaugcccagcuaauuuuuguauauauauuuuuuucaguagagacgggguuucaccauguuacaggccaggcuggucuugaacucccuugaacucaggugauccaccugccucagccucuaaaagugcugggauuacaagugugagccacugcaccuggcuucuaucucccuaauuuuuaaauacuuaagauuuuaagaaacaucacaggucaagcaaugcauggcagugggcuagauucagacaggggagccucaauuuaggacccccagauuuaucauacaagguggaggaaggguucagauagggacuuggggauugccaacucugacccucucuucagaugaagagauuagcccuguggaggaguccaggauuuguauuuuagucuugguacuggguguucuggguugaguugcuagaccauucugggacaaguugcuagaccauucugggacuuacuuucuuccuccauaaagucaaaggguagguagaucacacauuuuuaaagugugcuccuugaggugugucagggguuccauaagcauuugcuuucaguuuuauuaaaagcagccuguacucucaaauuugaguauauuugaaauuguaaugagagcaguugcucaggauggagugugguggcucaugccugccccacacuuuggaaaccugagguggaggaaaccuucaggccaggaguuugagaccagccagggaaguauagggagaccccauuucuacaaaaaacaaaaauauuagcuggguauagugggacacauguguaguuugaacuacucggaaggcugaggcugggggaucgcuugagcccaggaguuuaaggcugcagugagcuaugauugugccauuguacucuggccugggccacagagugagauccugucucaaaaaaacaaaaaacaaaacaaaaacaaauuaaaaaacaaaacaaaccaaaaaaaccaaccaacacauuugcccaaauagugaaucacaucaaauuuuaaaauucgcuggaaacuaucugcuucuuaauuugauuauacaucaauuauguucaaaguaaaaaacaagguaauuugaaacagcugcuuuuauccagguguauacacgguguauacauacacagauauguaugaaauguggaacucuauacccguauguauggaguuccuccuaagagucuuuuugagaaaauaguuccauugcuaaaaauacccaauggaaacuucuggccugggauuuccaaguucacccucggcugugcgucucaaaguccacacagccucaccaaaauagcccuucuggguacuuuuuucuguguguucuuggaggaggccaucgugccuccagcucccuaaggcggaagaugagccagcggggaucuuugcagggugguugguucucguuccuuccaccgaagccuuccauggcauuuuugggaccuggaauugugaauuauucugccucuuccccacagucccugaugacagcaugaaguucagagaguuuauuugcagaugaggcagggaagccggccuguucucaucuugcugugccugaugccuugugcuuggggcacuguucacugugcugccugcuggccugcuugucucugccuuuuggaugggagauaggccaccccacagugccacaccugccuucagggaagcuuuuggguguuccuugucuggcuucuggguucagugggagggcccacccagccugucauuuuaaugauuuaccuuagaggagccaguuuuauagggaguuguuggauaaucuucacaaggcagauaaaugggagagcaggaagaaugauggccuuucagaguugaaaucugugcugcuccaaaucccauaaacugcuauuugauuuuaaacauugcuugaagcgguucacauuuugguuaauuacgucaguggguaaaaauaacuauugucauauggugugugggcuuggcuuuagaaggauaaagagucuauuguuacccauugugcuauucagucacuuauuacccauccuuaaaagcccaacguggauaacagaaaaccuggagagcuuugucacuugcugaaauccaagcugcccugugaauuuauccccaaacacugcuccuuuugagaaacuuguacaagcugccuuaauuuagucaauucaaauggguugaugggggcuguucccaaggcccaggacaggcagggguuugugaccugcagcccuggaacugccuuuggguuucauggucucaguugagaccugcccaggguugaaccagcuuagugcucccugggggugguuaaguucaaggacuucaggguccgauugaccuugggcugaaucuugaccuggggcuguaagaugcucggucaggaccuuaacuuuuccaaggcucggugucuacaucuggaaaauggggauaaacacaguuccucccugcugggauuauuguaaggcuugaaugagaugauaaauacaacaucugacuugcgacuggacgguagcaaaggguuuaguuaauauuauaauaaguagaauggaacagcauuagauucucacacagggucacuauguuguuuucucccauucuaccccugcauauuacccugaagcacccccaagccucucccuccccaucccucaagccccucccuccccaucccccaagcucaccagguccuggcgcacccagaucuuucacugcuuuucuugccugugagcucuuggggagucaggaccaccuuaagcacccucugcaucuuuggcaccuaaccuggggccuggggcccugcagggccacaauuagcagcauggacaacagcauggacggagagggucucagagccuggagagcuccuaggggcuggagcagucacaggaagucaccaagugaauugaagggugguggcuuuggagguucagugaggcaagaagaaggcuguuaggcugggaauuaaggaaccuuguguuguucgagucucaggacaacucagauauggggucuguauugcaaaugccccugcgucauuuuacaacugaugaaaacaauggcuccacgagacccucaagugccagagcucaugagugacaguggaaguugaacuaaccuuuuaaccacccuaguccacaccugucaggcugacgggcuuucaguggugauguguugggagcucugugccgcagaucucugugugcuccugagacucugcccgccugucucuacccugcugugcccacuaggaggaggcugaccuuuauguucuacaccagugggugcccuuggucuccagcuuccagugggccagucuggcgagagacccuagcuggagaugaggggagguagccuuggccucucuccuugcccuuccucgcugcugcuaccccaggauucuugcccaucccuuacugguuuuccuuaaccccacccucacccuugaaaacagacucuuuaaaacucuccucacucacccucauugagugugucaucugcuccagcuaggauauuggcuaauaccgcauguuucagaaagaaaaauucgcaguucuauuuauuuuuuuacuguggauugaagggagaggcaaccagguauauggaugaaggaguagggccuggcugucaccacugguguucacaaaaggcucccguuuaaguccucuuauauuccaaaugagggguuauaggucgagucagggcguug

SEQ ID NO: 13267 - RNA, 4864 nt, Homo sapiens
ucaagacagcgcaggggccugggcugccgggcgcugcgcgugcccgcuuuccgcuuuauuggcagaguccaggcgcgcccggaggccguggcgcucgcgcgggacuuucgagccuccggcccggccuggcaugcacgccccuggcccucccgggcucuucucuggcccggggcucacaguagcuccgaggccccgaggcccggcggggcggcgggggcgaggucgggguacaccaggaagccggagaaggugauguacuugccgugguugcuguaggcgccguagccgucguggucguggcugagcagccagacggcgucgccgcgccgcagggccagcaucacgcucuggcucugcaucucgcggcgccgcgacgcgccgucgucguaaaucauggccugcaccucgucgcgguucuucaucagcuuaaccgacagcgucuuacgcggcagcuugcccagcgugaaggagaagaaguaggcgccgggcagacggcagcggaacacgccggccgccgcgucgaagucgccgccaauguugacgaacucggugucgaaggcgagugguuggugccgcggcccggggccagcguccgagcccaccaagcugcgcgugcgcgccgccgagaaggccgagcgcggcucggggggcgcgggcggcccgcgcgcaggcgcgucagcgucggcgucggcguagacuagguagccgcugaagguggcgccgggcgcgccuagcgcguacugcggggcgccaugcagccgcagccacacugugucgccguagucgagcugcagcauggcgcucuggcuggcugcgcgccgcgcgccuggccgccgcugcucgucgaaggccagcgccugcaccucgucgcgguuucgcaccagcaucaccgacaggcucuugugcggggccuugccagccgugaaggagaagaaguaggcgccgggcacgcggcagcgaaacuggccgguggccacaucgaagucgcccccgauguucacguacaccuugucgaaggucaccgccaucuccgacgugcccuccagggggguggugcgugccgccgagaaggccgagcgcagcucagaggaucccgggccgggggucgggcccagggcccagcaggccgcugggcccagcaggcccagcagaagcggcagcauggcgccugggagggagacggaggggcgagaguggaguguuggcaggggcggcuuccaaacgcccggcucuccaccgggagacaaggguucucuucccagcccugcccuugacccacaaguagguuucaauuuuccuacauccuuggauucucaaacucuagcgagccucacugucacuuggagggcguguucaaacauacauaguugggccccaucaccagaguucauucaguaggucugugaugggccugauaauuugcauuucuuuguuuuguuuguuuguuuugagauggagucucgcucugugaaccaggcuggaguguaguggcacgaucucguuucacugcaaccuccaccucccggguucaagcaguucuccugccuuagccuccugaguagcugacauuacaggugcgcaccaucacgcccagcuaauuuuuuguaucuuuaguagagacgggguuucaccauguuggccaggcuggucuugaacugaccucaagugauccaccugccucagccucccaaagugcugggauuacaggcgugagccaucgcgccuggccuugaaaccccgccccccccccuuuuuuuuuugagacggagucuggcugugucgccaggcuggagugcaguggcuugaucucggcucacugcagccuccaccucccagguucaagcgauucucccgccucagccucccaaguagcugggacuacaggcuugcacccagcacacccagcuaauuuuuguauuuuuaguagagacaggguuucaccauguuggccaggauggucuugaucucuugaccuugugauccgccugccucggccucccaaagugcugggauuacaggcgugagccaccgcgcccggccgaaaccccuuucuuaagugaaagcuugaacacagacuagcagaaacacucugguuaaagaggccuacagcccugucugcugggcuugccccuacaccucccauuugacacucaggggcccugguaacccgggggauucaggggagucucugaguuccccucagcuccaguuggcugcauuuuccugugguuauuuuaugguccuuggucugccacucacgcaggcacuggcucucugugucaacgcucugcaugaccguuacuguuuaagccccaucugagcaggaaaggaaaucgcugcucccugaccccuuuccuggccucaccaggggcccuuccugcacagaggaggcgagaacaguugggcuuugagguagcuuccucccccuugaaaucagaguaaaagagaaggugacuccuuucucuuugcuuggaggcugguuacucagaagaaggaguggcgagccaggggcuacuggggauggacagggacagcaacaauuccagcagggcuuuggcaaggcugugaagucagcagcuuuguuccuugggagugauggauuggagaggacagauagccagaucuggguucagguccuggcucuaccacucacacugugaaaccuugggcagguucccuaacuucucugggcauggcuuccuccauguaaauggggaagagaccucacacacaggcuugcugugggggugugcugagauaggugugaacaugguuugucaacggcagugcugaggugugcagaugcuucugucgguugcccugacaaaagugaucugguccaguucuugacguaaggguuuagggacucagucacuccuaccccugagagcuuggugaaggcacugcuuaacucaaaggagucacucucugauguagggauuccauccugcuuccuaguagggcacgugcuuuggggcuugaauacccaaaagcccugauguggaaacaaaacaggaaagaaaugagcuggagacagccugggaugugggcugcuuuagaaaaugcccuguauguguagcucugugucucuuagagacagcagggaccugcugagaaggguugucagguguagaugugcagaacgucccagcuagaaucuagcucacacuccacauguuagagcagcaccuggcguaaaguaugccaccuucucauucucauacuaaagaccccaaguugcuagccaacugaaugcugucuccuuccagaggaggugcuuuuuguaauucucacaaagguguccuauggauuaguuaggugucccuugguuaggacagggaggagggaaggggccauccacaguggugaagauggcaccucacaaguguccagugcauucccuuuuacaaaguucuuuuagacacauggucuuggcaaaccuacaagacaggugggccgucucccauuuuauagaugagaaagcugaggcccaacaagggaaagcauuuuggcccaaggucacccauggagcacugagguuuuuugacucaaauuccguaugccuuccugucacucuucccuccuagacacagguauguccagccaauuuguucugugccucaguuuaccuuuuugcaaaacuaggagaggagaucagaggaaugagucuugggauccagggugaggaagacagaaagcaaaaccaaacaaaagcaagcaaacacauucucuaguguuuugucuucugggaacacggaaaacagcucagcuuuuccauaccgcugcuuuccuaguggguccugccccagaagcagcugcccagcaaccuccugaccaaggcuggugcaccccaccagugccaagggucuuccugugcacccaguacccagccuccguuucacccacacugcccaauucccagaucccuggauccucguccuucccugaacccccuucccugagcaggucagaggugugggagggugugucaggugggugucauagcuccagggaaggaaauggcuguuccuggcucuguccaggugggguucaaaauagucaucuucaaagagaaaaacugggacacagagcuggagagacccagagccccggagccaaggcgggaggugcagcgaugucaggcugaggggaucgcagaguucccccuugcccugccacucaccaguuaacccuucccucaagcccugccagagcccccuccccaaccuaccuugaaagccccucauccuuccaagaagucccacuuucacagaagccaauuaauccuuauuuuuaaaaaacaaaaaccaaucccucucccccgagaccuucccuccauccauccaucccuuuggaaugaaagcccuugugccuguuucacgaaaaggcucccagguccuccuuucaaggaaaaaggacccaauuuccccgcgccuccccagcccucgcuuccaguaaagggggaaccucggcucccugccuccccucagcugcccucaccuggcugggggcggcggucgagucggguucggucugagcccgcgaucuggcuccgggcugcgggcugcgggcugcaggcugcaggcugcgggugccgggcugcgcgcugaccgcccgcgcugcggcaggggcggcgggggcuccggcugcuuuucccggcucugaggcggcagcggacagggugcuggggccaggggccgggcguggggaggcgugagggaaagggaaggucagcuagagagggagccgagcgagagcgaagaggcgggggagagacgggagggggagaggaggggaguaggggagagggaggggcgagcugcggggccuaggggcuccgcacggagucugcgccgagcacugg

SEQ ID NO: 13268 - RNA, 7639 nt, Homo sapiens
cuucuuccgggcggacguggagccggaagcggagguuccgggcuccgggaugaaaggagggaacgcaggugagaaagcgagacaggcagguagggaaaucgugaggugagcgugguccuagcuccuuguggcagagccuagagagaaggcgaggacgcugaagaaccaggcgggugagaggaggggagggggcgggcguuuuggguucuacgcuacacaccccucccccgcucucugagccaagcuuuugacgagggcgggcgggccugagcgggaagaacgguuucccuggcgaccguuuccaagacgacucaagguggagcggggacauugcacagggugaugggccucccagugccccggccugggggcggauggacucaaguucugggacgcagccauagggagucuuucgagcgagcggggaagugugggggaagcagcucagaagagagcaaauguaagacccacggauaucccaggcuaggcuucauauggagcgucuuaacuccaugcgcugggaaggagaggaccuggccacuaggccggggccagggguccuuuuugucugauucuacugccccugagcuucacuaguuuuaugccccaguuauuugguuaguaaggcuuuuacgaucacaggccucucccagcccuuugcuuucauauauugaccuaaaucccaagucuuuuguuaacauuauggaaaggaauuauuccguguuuucucaggaaaacacccagaguuggaacuuuuauuuauaucauuagcggaggggcgccacuggggauaacgaacccagauuugguuaaaggauagcgucagggacaucauggauagggccaggacuaaggccaaucuggacccacuuugcucucacuucuuccuuuucccucccugaguuggacaguuggauucacagacuauggcugugaauuccucagguuacucaagaugguguugcuuugcagacagcuggcagagagagaaguuggcuagcauggaaucaccagaggagccuggagcauccauggaugagaacuacuuugugaacuacacuuucaaagaucggucacauucaggccguguggcucaaggcaucaugaaacugugucuagaggaggagcucuuugcugaugucaccauuucgguggaaggccgggaguuucagcuccaucggcugguccucucagcucagagcugcuucuuccgauccauguucacuuccaaccugaaggaggcccacaaccgggugauugugcugcaggaugucagcgagucuguuuuccagcuccugguugauuauaucuaccaugggacugugaaacuucgagcugaggaguugcaggaaauuuaugaggugucagacauguaucagcugacaucucucuuugaggaaugcucucgguuuuuggcccgcacagugcaagugggaaacugccuucaggugauguggcuggcagaucggcacagugauccugagcucuauacggcugccaagcacugugccaagacccaccuggcccagcugcagaauacagaggaauuucuccacuugccccaccgcuuacucacagauaucaucucggguaaguuuagggaggggacacaccauacccaguuacuuggcuaugauguucagugaauguucuaguuuaggagaaaagaacccucaagcuuccugguguuaguuuacauuauuauuccugcauucuuacugagauaaccugcugagaaagauugaggugagauucaguguaauugcugucagagacacagugcguuagaggaagaagucaggaaaauuaaagcacaacauuuaaccacacagaguagugaggagugauuuguauuauacucuaauuuauccuguacuucguaugucccagugggucuaauuaccuauguaaauuggugauggggcaagauaucuaagacuaaaaacuuuuuuagugaugggccaacguuaggaaacaauccuaaccuugcaagugagauauagccauacuuaaggugugagguuggccaggcaugguggcucacaccuguaaucccaacacuuugggaggccgagguggguggaucaccugaggucaggaguucaagaccacccuggccaacauggcgaaaucccgucuccacaaaaaauacaaaaauuagcugggcaugguggcuugcaccuguagucucagcuacuugggaaggcugaggcaggagaaucacuugaacccggaggcagagguugcagugagccaagaucacgccaccgcacuccagccugggcgacagagcaagauuccaucucaaaaaaaaaaaaaaaaauggugugagcucuguagcuuaguagguugcuuccauggcagaugggaaaauaucgagucauccauuuugauuuuaaaaaagcaaggcacauacucugguuucucuucagauuguauaaaucuuuuaccuuuuacuaaagauuuccauggagaggaacgguuaugagucuuuacccaacuuuuugagggcucauguaacacaugagacuaucuuuaaaaaagagcaagguacgggccaggcgcaguggcucacgccuguaaucccagcacuuugggaggccgaggcgggcagaucacgaggucagaucaaggccauccuggcuaacauggugaaaguacaaaaaauuaccugggcaugguggcaggcgccuguagacccagcuacucgggaggcugaggcaggagaauggcgugaacccgggagguggagcuugcagugagccgagaucacgccacugcacuccagccugggcaacagugcaagacuccaucucaaaaaaaaaaaaaaaaaaaaaaaaaagcaagacccgccaggcaugguggcucaugccuguaaucccagcacuuugggaggccaaggagggaggaucccuugauggcaggaguuugagaccagccuggacaacagugagaccuugucuauacagaaaauaagaaaauuagccaggcgugguggugcacaccuguagucccagcuacuugggaggcugaaacaggauugcuugagcccaggagguugaggcuauggugauggugauugcgccauugcacuucugccugagcgacagggugagacccugccucaaaaaaaaaaaaaaagcaauuuuagguuaauuucauguauauguguauguaugcauguacacauauacacaugcccagcaguagucuaauaaagugguucacaucuuuaaagucccuuacucugaauuucucuuucggauugucauugaccaugccuuuccucuggcucucacagauggaguuccguguucucagaacccaacagaggcaauagaagccuggaucaacuuuaauaaagaggaaagagaggcuuuugcagagucacucaggacaagcuugaagguaaggcaaaucucuuaauuguugagacugcauacucuccaugcauucuugccaucaguuaauuuggccucuuuuuuuuuuuuuuugagauggagucuugcucugucguccaggcuggagugcaguggcgcaaucucggcucacugcaagcuccgccucccggguucacaccauucuccugccucagccucccuaguagcugggacuacaggugcccaccaccacgcccggcuaauuuuuguauuuuuaguagagacaggguuucaucguguuagccaggaugcucucgaucuccugaccucgugauccgcccgccuccgccucccaaagugcugggauuacaggcaugagcccccgcgcccggccuuuuuuuuuuuuuuuuuaagacggauucucacuuuguugcccaggcuggaaugcaguggugcaaucucagcucgcugcaaccuccacuucccaguuucaggcuauuuuccugccuuagccucccaaguaggugggauuacaggugcugccaccacgccuaauuuuuguauuuuuaguagagaugggguuucaccauguuggccaggcuggucuggaacuccugaucucagauagucugccugccucugccucccaaaaugcugggauuacaggugugagccacugugccuggccuaaccuggccucuuugugugucugugugugagagagagagaugggaguuucgcucuuguugcccaggcuagagagagagagauggaguuucgcucuuguugcccaggcuagagugcgauggugcgaucucggcucacugcaaccucuaccuccuggguucaagcgauuuuucugccucagccucccgaguagcugagauuucaggcgcccacgaccacgcccagauaauuguuguauuuuuaguagagauggguuucaccauguuggccaaacuggucucgaacuccugaccucaggugauccacccaccuuggccucccagagucuugggauuacaggcaugagccaaugcgccuggccuaaccuggccucuuuuugauggccagauuaugaauggucgucucuguuuuuuguuuuguuuuguuuguuuguuuuugagacagagucuuacuccgucucccaggcuggagugcaauggcaugaucucagcucacugcaaccuccgccucucaaauucaagcaauucuucugucucagccucccgaguagcugggacuacaggugcauaccaccacgcccggcuaauuuuuguauuuuuaguagagacaggguuucaccauauuggucaggcuggucucgaacucuugagcuuaggugaucugcccaccucggccucccaaagugcugagaugacaggugugagccacugugcccggccaucucuuguuuuuuuaauuuuuuguauuuauuuauuuauuuuugaauaaguuaucucuggcuugaaguugauaugagcuggggagaaggaugucuuuguaaccccaguaccaccaaucuaugagcuuucaaaguuccuugagaacuacugucaucaaguuaacaaucuuaaucacccuuugucugaagcacuagcuuaugagaguuuuuuaaaagcuacaaggaugaauacaacagauucuccgcccggcauaaauugccucaaagaaagugacuagaggagaguuggaugccauacaguaauuagagaguaguaugauaaagcuaggaacaagugugagggccaggaucuuaaggauaugugucuuagcugagccuuagccuagaauuuaacagcugucauauaauuuuaauuuugccaauaggaaauuggggagaaugugcacauuuaccugauugggaaagagucaucucguacccacucguuggcuguguccuugcacugugcagaagaugacuccaucaguguaaguggccaaaacaguuugugccaccagaucacugcggccugcaagcaugguggagacuuguauguggugggaggguccaucccacggcgcauguggaagugcaacaaugccaccguugacugggaguggugugcuccuuugccucgggaccggcuccagcacacccuggugucugugcccgggaaagaugccauauauucacuggguggcaagacacugcaagauacccucuccaacgcagucauuuauuaucgcguaggugauaauguguggacagagacaacucagcuagagguggcugugucaggggcugcuggugccaaccucaacgggaucaucuacuuacuagggggggaggagaaugaucuggacuucuuuaccaaaccuucccgacucauccagugcuuugacacagagacagacaaaugccaugugaagcccuaugugcugcccuuugcaggccgcaugcacgcagcugugcauaaagaucugguguucaucguggcugaaggggacucccuggugugcuacaaucccuugcuagacagcuucacccggcuuugccuuccugaggccuggagcucugccccaucccucuggaagauugccagcuguaacgggagcaucuaugucuuccgggaccgauauaaaaagggggaugccaacaccuacaagcuugacccugccacuucagccguaacugucacaagagguauuaaggugcugcuuaccaauuugcaguuuguguuggccuaaggcuguggggaggggaggagaacugcucacuccuuuucccuccccauacaaacucaaaguccccugggccccaauucagaguuauguuuuuuuuggcacauacuagaaaggcagugccucagcccuucccugaauccauggagguguucuguuuggggcuuuuuagacugcugcugcucagcugguugcuugaacugacaguaggccagccuguucucugccauucccuagucauccugugccucaccacagcuugcuuagagcaagccuuuucucagaccuuaggcacagccucuccucuuuaccugaucaauguuaaauguaagcaccccugaucccaggacauaaggaaagaugcccaauuguacuuuuguucuauagccugugaaauggcuaguugaucauuuuuccacaaagaauuagguguuaagaguuuuccuucaggcuuuacuuaggagaauggacuaagcugaagguguacuucaccagcaagagucaacucuagaauucaggauguuccuucuauuguuuucuuauccaucugucaggaaauguaacuuugguuuuauuuuuggcuuauuccaagggguaagccagaaaauagaaaugauuauuucugauuaauagcagaaacuuuuucaaucucaaauauauaaggugucugcucuuuuaaaagcucuaagcuaagucaagagcuaggaacuguugauacaaauaaaaguuuuugaagggauaugugugucuguguugaauuccaaaggggugacuuugaaggggugaggguguuucauucccucaggggaacucauuacguaccaucacauggcucagucugcagcaguccugacugcagcccaugcucccacuucuccagauaggaucccuacuccacagggccagugagauucagauucugacaguggcaaagagccagaggugagucuccuuuuuucaagugcuaaauguuuuuugaguuguggugcuaaauauuauuaggcacaauauuagguacauaauagauuuuuguuaaaauacuucuuuagcccuauucaagaaaagaugauagccccaucccuguccuguaucccaugaauacaagccacacuaaaucuuuuccuuucuagccacacaacaguguuauuucaagaaaacaaaacaagucagagaaagaaaaauuaccuauuaccuauuggcacauuucuguuacgucaagucugggcuuaagcccuguugguccuguuaagcucuuuuuguucuguaucaagcaggagugucuugaguucuuucuaauccccauacaucaugucuuugaaaugacaaaagucccauccuuuguugcccgugcaguaaucugcuuguggaacucuuuaagaacauccagcuggccaggccugauguggauguaugaccggaucuuggcgauggcucuuacagccuccucuggacuccauuugugcaccugaaguacaggguugggaaaucagcagagaaagaaagaagcaggugucaaggugcccuugacccaugagcaggugcuaaaggacucugagauuucauuucuuuggaaa

SEQ ID NO: 13269 - RNA, 14886 nt, Homo sapiens
cgagucuccaaagucaucugccaaggucaccagcuaguggguugggagcugggaccugucagcucuucaccaugacauggugguggcccugugggcauuuggcagggugugguguuucugcugugaggugggggacccaggaagagcagccacccauauccagccuugcaggcccagaaagagcccagugaguggggugggaugaaggucaggccaggagcuccagccagucagcccccagaccccgcaucucucccuuguagcuggggccuggcgccugaagcagcugcucagcuucgcccuggggggacucuugggcaauguguuucugcaucugcugcccgaagccugggccuacacgugcagcgccagcccugguaagugaggccacacgccaggggcaagacagugccaggagugggggccuggugcccacgcccagggauggccaggaugaccaggagagggauucuggguuucuggcaggagcuugccugggagggagggagggucauuguccuggucucugggcccuggucccagugggaguucugggccccagcugcccaacccacccuugucacugcccuggugcccuggaugagaucccauuccaaauggcccccuccuauggcccuggcuuggcuuggccuggccuggccuggcauugccgcccccugcagguggugaggggcagagccugcagcagcagcaacagcuggggcugugggucauugcuggcauccugaccuuccuggcguuggagaagauguuccuggacagcaaggaggaggggaccagccaggugggccccacacucaagggccuggauauaucagccucuguucugugguagugcccggggccuggaggcccagggucugaguugagcccugaaaagaggggucuccuggcccucuccugggagcugcgggagguugggccaccuucuuugggacugacaccauuagccccugauguagcuuguucugguagccugauggugacagcaguuggggaggguuuguugaguuugggggcacccaacugauauagcagcagaggauucuagcuagaaaaaacagggguuccuaucuuuuuuuuuuuuuuuuuuuuugagacggagucucgcucugucacccaggcugaagugcaguggcacgaucguggcucacggcaaccucugccucccggguucaagcgauucuccugccucagccucccgaguagcugggaccacaggugcgcgccaccaugcccagcuaacuuuuguauuuuuaguggagacgggguuucaccauguuguccaggauggucucgaucucuugacuucuugauccacccaccucagccucccaauuauuauuauuauuuuuuugagaagagucucgcucugucacccaggcuggagugcaguggcgcgaucucggcucacuacagcuuucaccucccagguucaagcaauucuucugccucagccucccaaguagcugggaccacgcccagcuaauuuuuguauuuuuaguagaggugggguuucaccauguuggccaggcuggucucgaacuccugaccucaggugauccaucugccuugggcucccaaagugcugggauuacaggcaugagccacugcacccagcccccgucucucuuucuccaucucucuccccuucugucugcccuggcugaguggggggcaucuaaugucaccucucccuccuucuccuggcccuaggcccccaacaaagaccccacugcugcugccgccgcgcucaauggaggccacugucuggcccagccggcugcagagcccggccucggugccgugguccggagcaucaaagugaguggccugcucagggccccugcagccguacugcccugaguggccagccccacucagcccugccuccugccuucccuccuucccaggucagcggcuaccucaaccugcuggccaacaccaucgauaacuucacccacgggcuggcuguggcugccagcuuccuugugagcaagaaggugaggggcuuggggccaguggggcucuggcgauuccaguggcagccauguggauuccaccugugucuggagucucugcuucuugccccuccauugccagcgcccucaucuaaggcucucaucccccauccucccugcugcuguccuggccgccacuguucucugauccugagccccuggucuguuccuguucccaguacuccuuguugggugccucugucaagcugcuaggcguggccccugccugcuccuagaugcuucuuccucuaccuccucccucuggccucuggccucuggcccagaggcagccuacucugcagcuggccgagaucuuucccaccucacacuguucccccugccuggaauguucucccgcccacgcuucgagcggcugacgacucauccuuggggccucgacuuacauggacuccuccaccaggccuuugcugaccuccucaucuaaauuugguuccugggccugcuccccugggcacucuauccauccuuuccuucccagcgccugugagugugugagugaguccugucucuccccucuauaccgcuagcuucgugaaggcagguuccuuguccccuuuagucacugcuguauuuccaguggccaacacagugcccacccagagccagcucagagcagaguaaaccucuguggaaugagugggcgaguggggugcucagcccucaacacagaccccgcagccacggcuccccucccugcagaucgggcuccugacaaccauggccauccuccugcaugagaucccccaugaggugagcgcuuguagggcagcccccaggggcccaggcccccacagugcccaugaucagcauggguguggagcucaggaggguguggggcugggccuguccagcauggcacucuggggcugggcugugagggcuggagcuccucaccccagcagccugcagcugccaucucugccauacucaggaugggggucccaggggaaggguggggaagggcagggggcucaguguguauaucguaccugagcacucagggcaucaggccccgcuggggcgcagggugaaccucuggaccucccuucaggugggcgacuuugccauccugcuccgggccggcuuugaccgauggagcgcagccaagcugcaacucucaacagcgcuggggggccuacugggcgcuggcuucgccaucuguacccagucccccaagggaguagguacgggcguggcgggugguuguggcggguggcaucagcagaggggcaccagccaaaggguguggcuaccgcacugcugguccccaggcccgggagguggggagcacacacagugccuuggguacccaguuggguguucucccgcugcagaggagacggcagccuggguccugcccuucaccucuggcggcuuucucuacaucgccuuggugaacgugcucccugaccucuuggaagaagaggacccguggugagugaccuguuggaggaagaggacugccacucacagggcccuuaggggcucaggagggaagggcuccuggccgcugccugcucccccugcccaugccuccaccgugagccguucccuccccacaggcgcucccugcagcagcugcuucugcucugugcgggcaucgugguaauggugcuguucucgcucuucguggauuaacuuucccugaugccgacgccccugcccccugcagcaauaagaugcucggauucacucugugaccgcauaugugagaggcagagagggcgaguggcugcgagagagaaugagccucccgccagacaggagggaggugcguguggauguauguggugugcacauguggccagaggugugugcgcgagaccgacacugugaucccugugcuggguccggggcccaguguagcgccuguccccagccaugcugugguuaccucuccuugccgcccugucaccuucaccucccggaguaagcagcgaggaagagcagcacuggucccaagcagaggccuugcccugcugggaccccgggagugagagcagcccaaggauccagggugcagggaacuccagagcugcccaccucccacugcccccucagcacacacacaguccccaggcggccuaggggccaaggcuggggcggcuuuggucccuuuuccuggcccuuccuuccccacuucuaagccaaagaaaggagaggcaggugcuccuguaccccagccccacucagcacugacaguccccagcuccuaguagugagcugggaggcgcuuccuaagacccuuuccucagggcugcccugggagcucauuccuggccaacacgcccuggcagcaccagcagcucuugccaccuccagcugccaaacagcagccugccgggcagggagcagccccaggccagagaggccucccgguccagcucagggaugcuccugccagcacaggggccagggacuccuggagcaggcacauagugagcccgggcagcccugcccagcucaggccccuuuccuuccccauugagguugggguaggugggggcggugagggcuccacguugucagcgcucaggaaugugcuccggcagagugcugaagccauaauccccaaccauuucccuuggcugacgcccagguacucagcuggcccacuccacagccaggccuggcccugcccuucaccguggauguuuucagaaguggccaucgagaggucuggaugguuuuauagcaacuuugcugugauuccguuuguaucuguaaauauuuguucuauagauaagauacaaauaaauauuauccacauacuggcugccuugguucugcacggccuuccauggccaggcagggccuuccuuacugccacugccaggcccuugucucugaacugucaccccagugcaucucugaacguuccaugucuuccuggcuuaacuuuuuauuccaaugacugagcaccuauaugagccuggccguaugccauuuuagccccucaccaccacaaacuccaggacgcuguccuuaucuuuuuuuuuuuuuugagacagagucucacucugucacccacacuggagugcaguggugcggucuuggcucacugcaaccuccgccuccuggguucaagcaauucuccugccucaaccucccaaguagcugggauuuacaggugugugccaccacgccuggcuuuuuuuuaaaaguagagauaggguuuugccauauuggccaggcuggucuugaacuccugaccuugugaucugcccgccucagccucccaaagugcugggcuuacaggugugagccaccgcacccaguuagugcuguccuuauagaccugaaagcuggagcauuuuccccaccugccccccauuccaccuugacugaaaauguuaucagggaagggagcuccagccacaaagucaucucuagguuuggccucagugaaauuaagcucucauucgcuuaaaaaagaaaggccggaugugguggcucacgccuguaaugccagaacuuugggaggccaagguagggggaucgcgaggucagcaguucgagaccagccuggccaauaaggugaaacccugucucuacuaaagauacaaaaauuagccaggcgcgguggcacgugccuguaaucucaccuacucaggaagcugaggcagaauugcuugaacccagaggcggaggcuguagugagcugagaucacaccacugcacuccagcccgggugacagagcaagacuccaucucaaaaauaaauaaauaaaaaagaaagagaaaagaagaaaaaagaauaugggacccuuauucaaaaccacacacccucccuucugaauguguggaguauaagaacaccaggcgcagggcgccccuuccccaguccugucaagagaauggggguggggguguccaguccaccucuucccucccaggaccaccgucaauagcccacuggcugggaucugcagucugggcagugucauggagcgugggagaggugggugugaaaccccagugauguccuuagcugggagugcuuggcugucaguauuucuaucagcaaaacauuuuaaaacaacauaguauuugcuucaccuagcugcaacacaucccguaagauaacugucucaaggacccauugacuccuggccucagauccaaggaaugagccauggccgucccagccggcugccccccucaccuaugcaggugcucagggcugcuagcuggggugccaagcccugcuggauggcagacagugcgugcaagcaucacagcccacuggaagaggccgggggccccauuuuagagaugaggaacccaaagcaggguggguguggucccugugggggaacuugggugucauggucaggagcaaaugcccuguccgguuagaagagagaacaggaauggaggacuggggcggccaaguccagggcaggggacagaaacagaagcacuucagggguugugcugcuggacuccugaggcaggggcuggggagucagugggaagccaagcagggccacccagggaaggcaaggggccagcuggagugaagagauagcagaauugggggaggggagcacagcgugacagaccaguccuagaggggcucccaguggauccuguucaggcucaguuuuuggccaaagauagggagagaaagagcuaaggggguaucuggagaaaaggggacccaagggccaggaaacaagggaggaugcugaaagccuaaacccaagccuggcuuuaccaggaggcaaggacuagugccagacaccaaaaugccgaaagugaaaggguggcuucuauccagguccucugugcaggaacugcagggccaugagccucugaaagcucagagcagaguggugcucggggagagagggcucugaggggccugaaggcccaggcagcagcugcagcaccacacacagccccagaaagccucauccugaccagugguauggggcccacggcugucuccggguuuccaggcgucagcaccuggggaaggugccucccacacacgcccccacuccuccagccagagcccagggaaggcagacaagcagcggcagggacccuaaaccaucuuuuauugcgcacuucagccgugagacuggggcuggccugugugcccuaggcguaguauuguagguuggcuuucuucuuggccugcaccuccaggaugccuuccauguaguccucgugggugagcuccguggcaccccugcgcagugcgaucaugcccuacagccgggacaaacagagucuaggucugaacgccugaaugccuucccuggcucccugaggcucaggccucuucccucagccgucuccaccagccaaaugcccccauccuguccagggagggggcaagaaggcacaaagcaacgcacccaccccagcugaccacucaccgccuccacacacacagccuugcacugggccccauugaagucaucugugcagcgggccagcuccucguaguucacgucaggacuggggacaggacagauaccacaggcucaguggcuuaugcggaaugggcagaggggccaaauauccuccccuggccccgucaagcaacaaagucaaguugcccugugaucagaggcaagucccuuacucaaugcgccuuguuuucuucucaguacaagaugugggggaugaagggaggaaguuaaugcagguuauaacagguuauuucuagggucucuugagcucuggccuucuagaaaucugcaucugggacuccagggacugacuguccucauccugugcccagcacugcgcuugacacugucacaucuaauccuuaccacgacccugugaaaucagugcuaucauccccaagucccaaauaagaaaagugaggcugaggccgggcgugguggcucauaccuauaaucccagcacuuugggaggccaaggugggcggaucacaaggucaggaaaucaagaccauucuggcuaacaaggugaaaccucgucucuacuaaaaauacaaaaaauuagccgggcgugguggcgggcgccuguagucccagcuacucgggaggcugaggcaggagaauggcgugaacccaggaggcggagcuugcagugagccgagaucgcgccacuguacuccagccugggcgacagagcgagacacugucuccaaaaauuaaaaaaaaaaaaaaaaguaaggcugagagagggcaugccaccugcugagagucauacauaucugaacucaaguccaucuggucccggccauuccuggcguguguuaaugggcugaggugugaggccaggaaacuaagugccuccagccucugugccuucagaugagggguggagucuaaggagcagagcacccagaauuacgacaugggcccuggcaagacgcuacaucacacaacugaggagaaacggaggcuggcguguggaacggugcugugugugccuggggccugggaggugguggucguggaggcuggggaagaucaguacagagaagcauggcagagacauccuccugcgccuguucaggucucugugcccugcccgugcuccugcucaccugacauucaucuuucgggaguggaucugcaugauucuggcccgggccuccucauugggcaucgggaacucuaucuugcggucaaggcggcccgagcggaggagggcgggguccaggauguccacccuguuuguggcugcaauuaccugaggaagagaagccacaacuugaaaggagcaagguguucacagaugggcagacacggucaaaaaaggcagagaggcagcccccagagugcaggugagacacaugggauguuaaagacagaucccaauucucauuccagcuccaccacuggcuagcugggggccugacagcuccugaccucugagccucaucaucuuugccugggagugcuaauacucaccuuaacuuggguguugggcuggaagccauccagcugguucagaagcuccagcauuguccucugcaccucccgguccccagccuucucacugucaaagcuagggcacaggaagcccgagaugcuggugagggcacagcuuaggcagagcccuccccuccucuacccccuggaagccuaaccuaacccguccagggcagggaaauggcucacucaacuuggggcccccagcccagggacuggcacauaaaaagugucauuaauuguugaccacauucagagacugaagagacuccuagaaucaggugcugggcugaggauaaaacagugagcaaggcugggugugguggcucaugccuguaaucccagcacuuugggaggccaaggugggccuaucaccugaggucaggaguucgagaccagccuggccaaccaggugagauggugaaaccccaucucuacuaaaaauacaaaaauuagccaggcgugguggcagccaccuguaaucucagcuacucgggacacugaggcagaauuacuugaacccgggagguggagguugcagugagccgagaucacgccacugcacuccagccuggacgacagagcgagacuccaucucaaaaaaaaaaaaaaaaaaaaaaaaaagcaaaaccaaccacugcuugggcuguuaacugugaugaauguacacuugcaaacugagcuaacgcuuaaaaacacagguaucuggcccagccuuggacggugcuguacaggagagcccaggcaggcaucccccgggaaguaucccugaggcugagaucugaagguugaaagcacaccagcuaggcaaccaaccaguggagaacaggguaagagccacggcgggccugaaacgcaggaagcaccguggcaggaguccagagcaggggaggcuggggacaggcaugagaugagggugaaggcgcaaaaaggcagcacacguugagccuuguaauuccagcauuuaucccagggagcaacagggaggcccaggaaaguuugauuuuuuuuuuuuuuuugaaacagaggcucacucugucauccaggccggagcacaguggcacaaucucagcccacugcaaccuccgccucccaaguucaagugauucuccugccucagccucccaaguagcuggaauuacaggcgcacaccaccacacccggcuaauuuuucuauuuuuaguagagauguguuucaccauguuggccaggcuggucucgaauuccugaccucaagugaucugcccaccucagccuuccaaaguguagggaauacaggagugagccacugcacccagccaggguuuuuaacaggauugguuuaugucagggaccacuguggguucaugugagcgagguggccagauuccugcuuuggcuuuuuuuguuuuguuuucuuuuuuuuuuuuugagacagagucucacucuuucaccaggcuggagugcaguggcgcaaucuuggcucacuccaaucucugccucccagguucaagugauucuugugccucagccucccaggcaucugggacuacaggcgccugcuaccacgcccagcuaauuuuuuguauuuuuaguagagacaggguuucaccauguuagccaggauggucucgaucuccugaccucgugauccgccugccucggccucccaaagugcugggauuacaggcgugagccaccgugcccggcccagauuccuguuuugaaaggaacaugcuggcagcugugggaaugaauggcuggggaaacagggaggcuauugaucaggaguuaggaauuggaaucucaagaguugaggagccaccauccaggggcaggaggggauacagggugggaaggaaccacaauuuagcacaacugagagucaacccgcuuccccuuaccgccacagagaucgcuagggacccuuggcccucccuuaccgcuuggugccgauggcauccaacucaucaaugaagaugauagagggcgcuuucuccuuggccagggcaaaggcaucccggacuagcuuggcaccaucuccaaugaacaucugcaccagcugggggccagccagcuuuaggaagguggccuggcaggaaaaggugguagagucaggucaaaggcagacccuuugagcccaucugguagaguuucugcuccugcccacuucccccgcaucccucccaaaguacucaccuuagucugugcggcacaggcccgggccaggagggucuuccccgucccugggggcccauacaucagcaccccuuuuggagguuggauccccaaguucucaaacuucuccuugugguucauuggcaagacaauggccuccaccagcugccaggaggaaguccugggugaggagaugaagcccugagggcuucuacagcccaacccuucauggcuccaaccccaaucugcaucccuccuacucuaacucagggacacgcccauuucuuuccccauaucaagaggacacaaggcugggcgcgguggcucacgccuguaauccuagcacuuugggaggcugaggcgggcggaucacaaggucaggagaucgagaccauccuggcuaacacggugaaacuccgucucuacuaaaaauacaaaaacauuagccgggcgggguggucgggugccuguagucccagcuacucaggaggcugaggcaggagaauggcaugaacccgggacgcggagcucguagugagccaagaucacgccacugcacaccagccagccugagcggcagagcaagacuccgucacaaaaaaaaaaaaaagaggacacagaacacucauccccacccaggcuggcuauggacucuccaggaacgggaguauauggcagaaaagacaccgggccaggggcugggagcaguggcucaugccuguaaucccagcacuuugggaggccaaggcacgcggaucaccugagguugggaguucgagaccagccugaccaacauggagaaaccccgucucuacuaaaaauacuccgcuaaaauuagccaggcuuggugucgcaugccuguaaucccagcuacucgagaggcugaggcagaauugcuugaacccgggaggcagagguugcggugagccgagaucgugccauugcacuccagcaugggcaguaaaagcaaaacuccaucucggaaaaaaaaaaaaaaaggacacugggccaagaaccaggagccugggcuccaguccuggcucuggucucucugugauccugggcaaggcauuuaaacucucugggcuucagucuccucaccugucacauggcaccccucccuuccucccuagguugcuaugaggaugaaagacacauuagggagaugagcugcaucaauggcguggagaaacuaaaaggcugacaaggcugcuggcagcugccgugccucccucaccuccuggaucugcuuguccaaacccccaaugucacuguauugcuccgugggccucucgucuaccuccauggccuucacccgcgagucauacucugugggcagcgucuccaggaucagauaggagucuuuguucacacccuaaggacacagcacagggccuucagauuuggcccagcucaagggcuacccaacugacugggugacaggugucugcagagggaaagacacaggacugggcaauacaagaaucaaacagcaaguagacagaaucccagacucucggagcuguucugccaagauucagagccaacagugaccuggggcggguacaggggcucagcuagucaccagaaaagcacugccugggcucaggccccacucaccaccaggucuccuggcuuuagcuuuucagcauccaccaacccaaucacaggaaggaaguacgucuguggacaaguuacaggggcagucucaguuaguguccucagggaaggcucccuaguccugucccacauccgcuccucacccuccuccagucucucauugcugagccacgcucaccugucguguagagguuuugaucacagcacacuugcccuuccucugggaguccaggucaauauuggcaccauccuccucuuggucauuaggaucaacauccaggagcugggaaggaaaaaauacucagcuccuugaacuccccaaggcccagugcuuccuaagacaguuccuaauaccugcagggcuggccauccuuaccucccuccuccaauagcccugagcccaccaaacgugggugccccugcuaagcccagggauugaucucuguguaggugcugcuccucugcacagggcucaucuaccccggaggagacauaaccaacagaaaaggagacacgugagaccucccaggacuuugcaggccccgucuuccccaugaaagugccccaggagguguagcucugacaugcaguuuggccucaauaccuccacccacucuuucccuaguggccccaccccaggcuguccccauucccugcugacucccucucuuccccuccacauacacacacaccucgaugacguuggagacaagguacggcagggucuuguucacuuugauuuucucacuguucucuuuuaucuuguccuucauggcuuggagcucaugggugacucucaacacuucacucuucaugaucugagaucaggaggggaggagaagcaaauauaaacccuggcacagcuuaugcuagagcccuguaacuagugagguccagggugcccaggggacccucccgcauccauucauccagcucugaggcucucugaaggcagagucugacuguguccacauccugcagaagucaaaagaggaggccaguuuggaaaccuccuggugaaauagugguaguauuggaauaaaagcaggccuccgagagaggcaaacauagguuuuagguucugccucauaguaagaacugggugcuuuaucgcaguacaaaccucucugggccugucuccucaucuguaaaauaggcauuuuacuaaaagaaggauucuugagaggauuauucccaguucucacugggaaaggcaaucugauaacuucucaucucagcccaggccucccaccacccccuaccugucuucuugucccuuuuaaggcuuaguuuucuuuccucucuuccugauaugagggggaagcccgagccccaugucucccccagggugcccgauuaggaaguacgagaggcgacucggaucgccggggccuguccugugggggcuccaucgcccgcacaggagcugugcgcccaccuugaucucacuguccagcagccgugugcgcuggaugaucuccuccguggacaucuugagcaccuccuccccaauuccaucuugcuguaaaaaauuauuuguuuauuuauauauuuacuuuuacucaggacaagcaucccucguucuccgaacccacucacagccucaguuuccacgcccauaaaaccaggauggagucaggaccccugcccacaucccaaacaaccccguccccgggaucgggccagaccuugacccccagccaccuccuucccucuugucaauggcgucucccugcgggccccgguucccggaccgccagcucgcccggugcccaccucggccucaucccacacggucgccaucuucuccugccgagucacuggacucucaauauucggcagcagauucauuuccuggaggagcgggcagaagaugggaccaggcgggagccgcaacgggagauuaauaccgucuuucuuaaagccuucucuugaccaguggaaaaccucuccccacaaaucccgacucuugacccgaccagcuccggccgugcugcggagcagcgaaucugccucuccgauuccaaagaccaaccccuggccacaggccccgcccccgcggaccccgaaacguucccgcccgcguccuauuuuugccgggcgcgagagguggggccgcu

SEQ ID NO: 13270 - RNA, 8098 nt, Homo sapiens
cgcccucuacccgggucccccaccgccgcgaggcggaagcgcccucccgccgccacuccccccgaccccgcggcacgcggcgccucggguuccggacaggccccuugugacguggccgcgcgccgggggcggccccgggccgggggccgggcggccgggcggccgggcggggcagagccugggcggggcgcggcaccgcagcuggauggcuggggccgcccggaucgccgccgccgccgccgcacggugagugccagcaggacccucggggcccgcgccccgggcgugauggacccggccgaucccucgccccguccgacugguccucaucagaccugggccggcucccaggacccgggagucaggcucgcccgcuucggccuccucucccccaucgcuccgcgccccacgccccaucccucccucgcuguccucuccgcgucccacccgccucucucuagcucucucacucucuacuuuccucuccccuuggacucuccguguauucccucccgcuagccugugguccccucaccucugcgugaccgccucguccuggcccagucuugccugugguccccaguggagccccgcuggcuucaucagugccccugauuaguuaaggccuggagguccuagacaugggcaucucugccaccacccagaggcagcugcuuucuuccccucccaucuccaucagaaggugaggaaacugaggcagggacaucaccagcucaaggucacagccagccugaggcagagcagaccacauuuaaaccucaugcccgaguuuccagauggaacuucucgcuugguugacucacguccacauccugugaucggccggcugggcacauuccugcugcagggagccccaggccuucccuggcacaggcagggccucugcgccuccucaugccggguacauccaccugcacuuucaggcuuaucucguccucacagcugaggcaggugauauugaucccuguccugcagaugagggcacugaggcucagagggggggcuucagagauuugcccagaguuagacagcucaaagugcagcauagaauucaccgugggggcucuaaagccugcgcuauacaagagagaggcauccccuggcuaaaggcuccuuccucaucagccccaucuccuguugcccucagugcccuggggacauuggucucauguccuaggaagaagcguggauggucuugcccuggcucaucugcucaguuuccccacguaugucucucugaauccaccccauccccuuagaaggggugccucagucucuggggugucgcgggcggcagggccuccccuggcagccagagacacccagcugggccgggccgugccgccgguggcugaggagagccagccagcgccucacccugucauuagggaaaguuuagccucaggcggaggugcugacacagucuggagcugcucagaaggaaaaaauacgcagugcucaggaguaggguguggagacacagggccccauugcugugcacccagcauuuggaugcucagacgcucuggcaaggacagcaggaggguggaugccagggucccuugcggggaggagggaggcgccacguuuccuaagcaggugugcggccaaggcuguagcucauauagguggccuuuuguguuuuucaguacguggcaugccuggaugucccugcccuggcuguggcauggcgggcccaaggcuccucuuccucacugcccuugcccuggagcucuuggaaagggcuggggguucccagccggcccuccggagccgggggacugcgacggccugucgccuggacaacaaggaaagcgaguccuggggggcucugcugagcggagagcggcuggacaccuggaucugcucccuccuggguucccucaugguggggcucaguggggucuucccguugcuugucauuccccuagagauggggaccaugcugcgcucagaagguaggugacucuccgguggcgcccagggcuggccagggugugggaagcaugcugcugcucuucuuaggagaccccaggucacagagugucugagauggagggagaggauagaauagaacuucuccccuugguccuguaggagcuaucuagccaggggcggcuggcucuggcuuccccaggaagcuaugagcaccugguagcagggccugccccuggggagggggucuaggagauggggaugugggcacgggugggagcuuuguccugacuacccuuuuguaccaugagcauguacugcccguucacaaauaacauguuguaacaaaacacgcaggagagcucuagggagcugcuaagaaugcacgugccuaucccccaccuaagagggguggaccaaggcccugggaaucuguuagaaacgagcaucccaggggcuggugcugccagcuggaugcucaggaaccauucacuuaccagaugguuacccagcagcucugugccaggcacugggcugagggcggugccacagcugugaauagagcccugcuugggccauggucaggccugugcucaacccucagagcagcccugcggggucagugcagggagcaccuggauuauuaguuccauuuuacaaguggggaugcacaggcacagagagguucuuugaccaguccaaggucacccagccaggaaauagcaguuuccccugggaucccaccccaaacccagcugccucuguccucuaggccucaguuucucuaucaagccaaaggguuggacauggcuuucaggcaggcgacuuccaacccuggaugcugcaaguccccaaaucucugccacuuuucugagagugacagcagcugagaagagaaaaauucccacguaaugagcacuugcuguacauauugucauuuaauucccauaagagcccauaaaaggcucacagcuguaaucucagcaguuugggaggcugaggugggcagaucaccugaggucaggaguucgagaccagccuggccaacaugaugaaaccccgucucuaccaaaaauacaaaaauuagccggaugugguggcacacaccuguaaucccagcuacucaggaggcugaggcaggagagucgcuugaaccugggagauggagguugcagugaaccaagaucacgccacugcacuccagccugggcaacagagcgagacuccaucucaaaacaaaacaagauaaaauaauaauucccauaagacccaauuuacagauggagaaaccgagucuccaaagucaucugccaaggucaccagcuaguggguugggagcugggaccugucagcucuucaccaugacauggugguggcccugugggcauuuggcagggugugguguuucugcugugaggugggggacccaggaagagcagccacccauauccagccuugcaggcccagaaagagcccagugaguggggugggaugaaggucaggccaggagcuccagccagucagcccccagaccccgcaucucucccuuguagcuggggccuggcgccugaagcagcugcucagcuucgcccuggggggacucuugggcaauguguuucugcaucugcugcccgaagccugggccuacacgugcagcgccagcccugguaagugaggccacacgccaggggcaagacagugccaggagugggggccuggugcccacgcccagggauggccaggaugaccaggagagggauucuggguuucuggcaggagcuugccugggagggagggagggucauuguccuggucucugggcccuggucccagugggaguucugggccccagcugcccaacccacccuugucacugcccuggugcccuggaugagaucccauuccaaauggcccccuccuauggcccuggcuuggcuuggccuggccuggccuggcauugccgcccccugcagguggugaggggcagagccugcagcagcagcaacagcuggggcugugggucauugcuggcauccugaccuuccuggcguuggagaagauguuccuggacagcaaggaggaggggaccagccaggugggccccacacucaagggccuggauauaucagccucuguucugugguagugcccggggccuggaggcccagggucugaguugagcccugaaaagaggggucuccuggcccucuccugggagcugcgggagguugggccaccuucuuugggacugacaccauuagccccugauguagcuuguucugguagccugauggugacagcaguuggggaggguuuguugaguuugggggcacccaacugauauagcagcagaggauucuagcuagaaaaaacagggguuccuaucuuuuuuuuuuuuuuuuuuuuugagacggagucucgcucugucacccaggcugaagugcaguggcacgaucguggcucacggcaaccucugccucccggguucaagcgauucuccugccucagccucccgaguagcugggaccacaggugcgcgccaccaugcccagcuaacuuuuguauuuuuaguggagacgggguuucaccauguuguccaggauggucucgaucucuugacuucuugauccacccaccucagccucccaauuauuauuauuauuuuuuugagaagagucucgcucugucacccaggcuggagugcaguggcgcgaucucggcucacuacagcuuucaccucccagguucaagcaauucuucugccucagccucccaaguagcugggaccacgcccagcuaauuuuuguauuuuuaguagaggugggguuucaccauguuggccaggcuggucucgaacuccugaccucaggugauccaucugccuugggcucccaaagugcugggauuacaggcaugagccacugcacccagcccccgucucucuuucuccaucucucuccccuucugucugcccuggcugaguggggggcaucuaaugucaccucucccuccuucuccuggcccuaggcccccaacaaagaccccacugcugcugccgccgcgcucaauggaggccacugucuggcccagccggcugcagagcccggccucggugccgugguccggagcaucaaagugaguggccugcucagggccccugcagccguacugcccugaguggccagccccacucagcccugccuccugccuucccuccuucccaggucagcggcuaccucaaccugcuggccaacaccaucgauaacuucacccacgggcuggcuguggcugccagcuuccuugugagcaagaaggugaggggcuuggggccaguggggcucuggcgauuccaguggcagccauguggauuccaccugugucuggagucucugcuucuugccccuccauugccagcgcccucaucuaaggcucucaucccccauccucccugcugcuguccuggccgccacuguucucugauccugagccccuggucuguuccuguucccaguacuccuuguugggugccucugucaagcugcuaggcguggccccugccugcuccuagaugcuucuuccucuaccuccucccucuggccucuggccucuggcccagaggcagccuacucugcagcuggccgagaucuuucccaccucacacuguucccccugccuggaauguucucccgcccacgcuucgagcggcugacgacucauccuuggggccucgacuuacauggacuccuccaccaggccuuugcugaccuccucaucuaaauuugguuccugggccugcuccccugggcacucuauccauccuuuccuucccagcgccugugagugugugagugaguccugucucuccccucuauaccgcuagcuucgugaaggcagguuccuuguccccuuuagucacugcuguauuuccaguggccaacacagugcccacccagagccagcucagagcagaguaaaccucuguggaaugagugggcgaguggggugcucagcccucaacacagaccccgcagccacggcuccccucccugcagaucgggcuccugacaaccauggccauccuccugcaugagaucccccaugaggugagcgcuuguagggcagcccccaggggcccaggcccccacagugcccaugaucagcauggguguggagcucaggaggguguggggcugggccuguccagcauggcacucuggggcugggcugugagggcuggagcuccucaccccagcagccugcagcugccaucucugccauacucaggaugggggucccaggggaaggguggggaagggcagggggcucaguguguauaucguaccugagcacucagggcaucaggccccgcuggggcgcagggugaaccucuggaccucccuucaggugggcgacuuugccauccugcuccgggccggcuuugaccgauggagcgcagccaagcugcaacucucaacagcgcuggggggccuacugggcgcuggcuucgccaucuguacccagucccccaagggaguagguacgggcguggcgggugguuguggcggguggcaucagcagaggggcaccagccaaaggguguggcuaccgcacugcugguccccaggcccgggagguggggagcacacacagugccuuggguacccaguuggguguucucccgcugcagaggagacggcagccuggguccugcccuucaccucuggcggcuuucucuacaucgccuuggugaacgugcucccugaccucuuggaagaagaggacccguggugagugaccuguuggaggaagaggacugccacucacagggcccuuaggggcucaggagggaagggcuccuggccgcugccugcucccccugcccaugccuccaccgugagccguucccuccccacaggcgcucccugcagcagcugcuucugcucugugcgggcaucgugguaauggugcuguucucgcucuucguggauuaacuuucccugaugccgacgccccugcccccugcagcaauaagaugcucggauucacucugugaccgcauaugugagaggcagagagggcgaguggcugcgagagagaaugagccucccgccagacaggagggaggugcguguggauguauguggugugcacauguggccagaggugugugcgcgagaccgacacugugaucccugugcuggguccggggcccaguguagcgccuguccccagccaugcugugguuaccucuccuugccgcccugucaccuucaccucccggaguaagcagcgaggaagagcagcacuggucccaagcagaggccuugcccugcugggaccccgggagugagagcagcccaaggauccagggugcagggaacuccagagcugcccaccucccacugcccccucagcacacacacaguccccaggcggccuaggggccaaggcuggggcggcuuuggucccuuuuccuggcccuuccuuccccacuucuaagccaaagaaaggagaggcaggugcuccuguaccccagccccacucagcacugacaguccccagcuccuaguagugagcugggaggcgcuuccuaagacccuuuccucagggcugcccugggagcucauuccuggccaacacgcccuggcagcaccagcagcucuugccaccuccagcugccaaacagcagccugccgggcagggagcagccccaggccagagaggccucccgguccagcucagggaugcuccugccagcacaggggccagggacuccuggagcaggcacauagugagcccgggcagcccugcccagcucaggccccuuuccuuccccauugagguugggguaggugggggcggugagggcuccacguugucagcgcucaggaaugugcuccggcagagugcugaagccauaauccccaaccauuucccuuggcugacgcccagguacucagcuggcccacuccacagccaggccuggcccugcccuucaccguggauguuuucagaaguggccaucgagaggucuggaugguuuuauagcaacuuugcugugauuccguuuguaucuguaaauauuuguucuauagauaagauacaaauaaauauuauccacauacuggcugccuugguucug

SEQ ID NO: 13271 - RNA, 11600 nt, Homo sapiens
uaucugggucaggcugauguuaaaacguuuaccaguugguaugaucuuaggaaaugcaaaugagggagaaggccugaaggugcccuaagggccagggaggccagcuagggauuaaaaaugugcaauggcagaggcacacacaaccuaaaaccauucuuguaguuuucuguaagacuuaucuccauuauuagguuggcuuguuacuggcaaauacuacuuuuuuuuuuuuuuuuuugagagucuugcucugucaccuaggcuggagugcagugacaugaucuucacucacugcaaccuccgccucccggguucaagugauuccccugccucagccucccaaguagcugggacuacaggcauguaccaccacgcccagcuaauuuuuuuuuugguauuuuuaguagggacgggguuucaccauguuagccaggauggucucgaucuccugaccucgugauccgccugccucagccucccaaaguguugagauuacaggugugagccacugcacucagcccaaagaauacuuuugauguuccucuuuguucauauuuguuuuugaugucccccuugaucauguucuguguuuacccucauggccggccucuccaucuccuaggcagccuggcauccucgcuacaaccucauuguugugggccgauacccagauccuaauuucaaaaguuguaccccuuaugaauugaggacgaucgacguguucgauggaaacucagggaagaugaugugucagcucuaugacccagaaucuucuggcaucaguucggugaggcuuggguccucaaauaaugaugggaggaagcagggauucaaccuaccuuauugaccaaaagugaccagaaaucaggugucucugcuaauaccuucacccucuccucauguugacacucuugucucugcagcuuaaugaauucaaucccaugggggacacgcuggccucugcaaugggugaguaggaggagaaugucucugacuugccaaguccgauccuacuucccaagguucagugcgggccagccucagccccgcccugccacauucaccccagggcaguggcccacgaagaagauggcugggagacaguggucucuauagccaaggcccuccauuccucuggcuuugucuuggucaugcaaugccuggcuacuguccaguuuccuaguauuucuuuuuuuuuuuugagacggagucucgcucuguccccccgggcuggagugcaguggcgugaucuuggcucaaugcaagcuccgccuccuggguucacgccauucuccugccucaaccucucgaguagcuaggacuacaggugcccgcuaccacgcccagcuaauuuuuuguauuuuuaguagagacaggguuucaccguguuagccaggauggucucggucuccugaccucgugauccgcccaccucagccucccaaagugcugggauuacagacuugagccaccgcgcccggccuuccuaguauuucuuuaccaaauuguagguuugcgggccagccccaggcucugagagauugguaacagaaaguguaagucagacuggucucacucuuccuagguuaccacauucucaucuggagccaggaggaagccaggacacggaagugagagacacuaaagaaggugugggccagacaaggccuuggagcccacacaugggaucaaguccugcaagcagagguggcgauuuguuaaagggccaaaaguauccaagguuaggguuggagcaggggugcugggaccuggggcacugugggacugggacacuuuuauguuaaugcucuggacuugccuccagagacugcuccagaguuggugacacagcugucccaagggccccucuguaucuagccuggaaccaagguuaucuuggaacuaaaugacuuuucuccucucagugggugguagcagagggaucaagcaguuauuugauuugugcucacuuuugauauggccaauaaaaccauaccgacugagcuucugcguggaucuuccagaagugaccuggucagagagcuucuugcgucucagaaaugaagaaaaagcacaggaaacagcacuaucaguccaauaggaaacagcacuauucauucucugggagcugccccagcccuauucugggccacagucuagaacuuucuuuuccagcucacaaccugcauguagcucaggucccuggagaccccagcccagcugagggagagcaguuuccugauucgugugacaagcaacucccuucccaccacucccuacucccucccaaguacagacaaccuuccguccugcuccaguugaaggggugacaacgauuccugaagcauucugucugagucuaaugguggcucuagccagacacagggaaauguggcuggcuggcuguugggugauccaguuccuugggagccaauguuuguaccccugguauuagcuguuuuucccacuaaaauaagcacugagaggcaagaccgugucccucugagcuauuugccgaagacuucaggcuggaggaaaaagaacagggcuugauagaagugcaagguggauccagcaccaacucugccauuuucuaauccuagguccugagugaacacugacugccaguuuacaucucagguguguagggagcguggaggaggcaaauccuguuuggagaaagccaguguccaacacagcacuugguaaacaucaggcaugggaaugcugagugacaggcaccaugggccacgcugagccccacucgcucaucuggcuggggucaucagagggaggcccaacccaggaucuccuguccaugggcuggggagcagcaacagucaggagcgagggcccagcccaccuccccuaggagguggagggaagggggcugagugguugucaggcgugguccuccccaucugcgacguggcgguagccaggaggcugggccugcauccggaagaggacggugaggagcagcacuaugaggaggaagaggauggagccacauacagccaaggccacaaucaccucugggcaugggggaggcaagagaaaggucaugucagcguuccaucauaugccagcuacuguucugacauauaggagauacacagagguggccaagacagagucccugcucucauggaguuuacauucuaggagaggggauguaauaaauaagcaaaugggcuggucacaguggcucacgccuauaaucccaacacuuuggaagguugaggugggcagaucaccugaggucaggaguuggagaccagccuggccaucauggugaaaacccaucucuacuaaauaaaguuggccgugcgcaguggcucacaccuguaaucccagcacuuugggaggccgagguggguggaucaccugaggucaagaguuugagaccagccuggccaacguggugaaaugccgucucuacuaaaaauacaaaaaauuagcugggcaugguggugugcaccuguaaucccaacuacucgggaggcugaggcaggagaauugcuugaaccugggagacagagguugcagugagccgagaucacgccacugcacuccagccugggugacaggaugagacaccgucucaaaaaaaaaaaaaaaauuaggagugacaggucagugacgaaugugauacagagagacaaagcaaaguaggucagcagggaaggcaucauugagaaagugagaaguuuaacagagaccuggagucaaugaaugacauacaacaaucugagaagaguaucacagggcagaggagacgaagggcaaaaggcccagauguggggauaagccuggcacaugcuaguaucaucaagagucagucucaccagaguagaguaagcaaggggcauguaggagauggggcaggagaccagauggaguagggccuagaaggccauggugaagaacuuggauuuuauucuauaugugaugggaagccacuagaaaauucugagaggacaguaguaugaacugguuuacauuuuuuaaaaguuaacucagucggccgcgguggcucaugccuguaaucccagcaauuugggagacuaaggcgggcggaucaccugagguugggaguuugagaccagccugaccaacauggagaaaccucaucucuacugaaaauacaaaaucagcugggcauggugaugcaugccuguaaucccagcuacucgggaggcugaggcaggagaaucacuuacacccgggaggcggagguugcagugagccgagauugcgccacugcacuccagccugggcaacaagagcaaaacuccaucucaaaaaaauaaaaaaaguuaacucugcuguguugaaagacugguagggacaagaauagaaccagaaagaacuaggaagcuuuucauucggucaggcaagagcugacgguagauuggacugcggaggcaagagcacauauuaauauuugaaagguugagcugaucuggcagugggcuggaugagggguaugagaaacgguaugcagaaugaccccaaggguuauacugugccacuaggugacucguggcauugacugaaacaaggaagccuggaagaagagcagcuguggaaggaaaagcaucugguuuuagacauugcaacuuugagaugccuuacuuaacaugcauguagagaucucaaguuggcagcuggauaugagucucuagcucagagaagagguugugaaucugugagucagggcguaaggacagaagugggcauggagaugggcauaaagucaugaggcugcaugagaucacuugggagugugcacagauggggaaagcuccagggaugaguccugggucauccguucuuuagugaggaagggacgccugaaagucagaagccaagaaaguguuucaggaaggggugaccaauuauguaaugcugcugagaggugagagaagcuaagaauuagucacuggcuuugguaggaggugacuggucaccagacaaguauggcuucaggguaguggaaggugacacaagacugucuaaugugagucuaagagaacaaguggugaggaagcagagccagauucuaggcagcucuuucaaggauuccauucugagagggaagaggcugguggcuggggaagagguggcucucagaggucauggaugggcuuuugggagggaagugauccaguagagaagcagaggcgucagagcuccuugcagagaugaggagagaacccaagugcggguggagaggccacccuaagcgguggcuucccccaggaaguaaccugguggugggagaacgagccaauucucucuuggcucuuauuuucucggugauacaagugagacaucacccgagggugagaaguggggagaagguauaaagcagucuggggucggggagggaacuccuagcaaaugcagucaaauggcuggaagugcgacagcucuugagaugcguggaugugaacugcaggcuggucuagggcaugacuagcaaggaggccggugacagcucaccugugucugcaggaccgcuugccagcuggcacuccugcugccaauccuugggcacgacgggcucugugaggcgaaggaaguccugcagugggcagcggugagggcagccaggcaggcugagcggccagggggccuugucacucucguuccgaaaguacaucuccacugagaaauuccugagggucgacaggaggcaacaugggagcugcucagccugcccaucaugggguccuugggcugccccgagccaccucccgagggccccccuccagaggacacugcuagcuccacucacccagaaucuuccugguacaguucaaauauguggcaggaggcguagggggcuuguucaccauuguagacauccagugccauuugcagggcaaccaggguagugucgugcugcgggggagaggggcugcccgucagcauuguuccccacacccgcaggaaccgaacagagaagaaauccagcuccuugccugacacagcacgcuagggagcgcaggcacucaccgcagaguaaaccagcagcuuggggagcugggagguggucgccauuagggucagguucuuccuuaucugagccagcaggacuccugaaggagaaaaguccccgguguugcuggcuacagccaccucugccuucuaauuagaccuaucugugcuccuuucacccucugccaggccugggccucaucaccuacacggagaacucuuuagugucauagggaccauguaagaacucuguggcaccccuccucucuaagaacugucaaauguacagaaggaagcaagacaaaacaagauaucugccuauauuucaacacggauguagaaaccugccuguguuuacagaagcacuucaguuugaaacaaauguaaacuuaagauugcuucagaguacacagcgggugggugcaugcccggguaacuaccauaugcucugaaaagugagaugucaaaaaggugugacagcaggcaugcccuuaggugcucaaauaaggaagcuggcauguguguuacucucagccuucucaaaauggcccccagugguucucuuggggcagcuauucauuuaggagagggagggucuucugaugugggcgaaacuuaagaacaugaauggcagggcugggcgugguggcucauguguguaaucccagcacuuuggaaggcugaggcgggcagaucaccagaggucaggaguuugagaccagccuggccaacauagugaaaccccaucucuacuaaaaauauaaaaauuaguugggcgugguggcaggcacuuguagucccagcuacuuaggaggcugaggcgggagaaucgcuugaaccugggagguggaggcugcaaugagccgagaucgugccacucuacuauagccugggugacagagcaagacucugucucaaaauaaauaggcuggguauggcggcucaugccuguaaucccagcacuuugggaggccaagguggguggaucaccugaggucaggaguucaagaccagcuuggccaacauggugaaacccuguuucuacuaaaaauacaaaaauuagcugggcaugguggcugaggucaggaguuugaguccagccuggcgaacauggugaaaccccguuccuacuaaaaauacaaaaguuagccaggcaugauggcaugugccugcaaucccagcuacucagaagacugaggcaggagaauugcuugaacucaggaggcagagguuguagugagccaagaucgagccauugcacuccagccugggugacaagagggaaacuccauccccccgaaaaaaaauaacaauuuuuuuaaaaagaauaugaauggcagaaaaggaagagagguggggaaauuuggugacuagcggcaugaggagggggauuugguuuugaaagagcagggaguguuucaguagagagggaagugugugagaagcccccacagcagauuuuuaacgccuuaggguccugaggaguagagugacacgcuguccuugucacucaccccccugaagccgggccuucuccgccugcugguagauuccgaagaggaagcggaagcugaaguccuuuagccggcugagacgcugcaugguuuggggugaggcccagggcggcaggcgcagcccgugcguuugcuguguaucgcagcaggcagguuagcgccccaggccuaggccagccucuccagggggcagcucucuucccuagugggaaggugccugugugugugagggagggagaggggagagaggcagaggggcuggaaccaguagacauggcaggcgguguggaugcuucagggcacaggaaaggaagcucaggcacaaaaagugagacucagcagaaaggagcucuggguggagagcagcagggacugcugacaauuaauaaaccauuucccacucugaggaucucugucacccaugagggaaguucccguguuucacaagcacagccucccuggaccuccccaggggcgugacgguaucaggcacuguguucuaccguccuggugaccugggccugcugagagggaaaagaaugaucacagugggcacccuagugggcucaccucacagaagagugugucauagacauuccagacggucuccagugucaggucuguaagcccugucucguuggccaccauguccagaaauugcuaugaaaaauggaucagggucucaguccugcucuggggaaaagacagcguggugagcugcaccucugcccccacucacugcauuccgagaacucucauucugauacucuggugucugccgggucucguucugcagcugcucauaacggggacaugggcccaacgggaacuucagcagcuguagagcgaagcggggaaacaggcagcgggaaaaggagccuggcaucagcaggccuacggccagagcuguccccucaccaccccagggaagggcuggccacucuuacccuguccucagugaugggcacagugugcacaggaauaggcugccacgagauguucggguugaagcgcugcaucccguugggagggaagaguccagccagguuggccucagcacucaugagaguccggucaaagucugugcuucgcacauaaaccugcagcgauagcaacacaagucguguguguguguguguguguguguguguuggggaaguuuuggucacccugaaguggagccuuguauguauguguguguguguggugggaaguuuuggucaccccaaaguggagccccagaggagaaccuguuccugauggucacccagcaaacuaaaccuaccauacaucuggcccucacccuccucuggccucuggccuuccccaucccccaaacacuccacuggggguugucaccacucugugaagaacucuugugggaauggccuuaguugaaaugccccuuccagucaaaagugcugagucaaucaguaaggcucucuggucugucugguuucauaacaacaccucucucccugucuagaucaggguccuuggggcagaaacuggcuccagugacgacccuuagagaccagggagaaaaaaauaagauaaagggcugggccugguggcucacaccuauaauccuagcacuuugggaggccaaugcaggaggaucgcuugaggccaggagcucgagaccagccugggcaacauagugagacccugucucuacaaaaaaaaauuuuuuaauuacccaaguguggcgggcacuuguagucccagcuacuugggaugcugaggcaggaggaucacuugagcccaggaguuugaggcugcagugagcuaugacugaggcaugugcuacaguuugggugacagagugagaccccuuuaaaauauauguauauauuuugggccgggcacgguggcucaugccuguaaucccagcacuuuaggaggccgaggcaggcggaucagcugaggucaggaguucaagaccagccuggccaacaugaugaaauccugucucuacuaaaaauacaaaaauuagccaggcaugguggcacacaccuguaaucccagcuacuugggaggcugagacaggagaaucgcuugaaccuaggagguggagguugcagugagccaagaccaugucacugcacuccagccugagcaacacagcaagacucugucucaaaaaaaaaaauuuuuuuugaagagcuuauucagagauaguggcucaugaaaagggaggaggaaacuggggaaggacaagcucaggacagagcugggccuuaagagaacaauaacaaugucuauggauucuugauacggcugaggcugacagugguaaucagaggaacagcuucccccauuccugggguggggcgaagacucaaggagcaggcacacucaccaguccucccugaugugcccuaggaauauagcacgaccuggcgcagcagacagggcucaaaaaccucaucuugaucaagaaaagacaagcccucucuacgcaugucuuccccgcugucuuucaucuuggcccugucugguuuaucauuagauacccccacaacauucuaagcuccaugaagacagagaucauaucuguauggugcacaacugaaugcaaagugcuagcacaguccuuggccuuuaauagguacucaaugucuuggauggaaagccugugauuucacagucagaaaccacuuugccaggcccgcccuuaaguccgaauuuggaugcuuaaucaaauuugccucaucccagccaagcaggggcaacucagcuccuagggcuuuguuccagacagcucucagaugucuuuuccuguaguugugaccaaaaauacaagaaggaggccaaagugcccagccucagccuuaggcucccugagggcaaaagaugagggcagcauaccuuguuccccuugccucuggagcucccaaccuuaccucuugccggugauaagagguguuuaggaagccgugauagcgcugccgcagggccuggcccaguucccagugcuguagcauccccuccugugggcaaacccaaggguuaagagggucuagagggaagggguggcuucaagccccaugggguuuaggcccuguugcuuuccagguucacgcuuugcuggagucaauuaaucugaucccagaagucuuucauuaaguggccagucaugcacagcaauaucaugggcacagagauuaagguuaugaaaucuggucaaagucagcacccauaugggaaaaggcaguuuaguaggaccccaaguuuuguagacugcucuagacgucgcucauucugcagcucauccugaggaaaggcuggcuucugacccaccuugguuaacugaccaaaccccuggggccauucuucuuccugauagggguccuugggauaugucuucacuggugaacggucuccauggcgguacagcugagagaauaaaaugguuugccuauaggucagaagcauccccuugauagggacccagagccuaccuuuugccccauguuagggaaggaagucucauucccucugggaagccuacuggcugcaaaagaccccagcuaggagucagucacuucuuccagauuccagagauucuaacuuagcuaagcaaugcuacuggagaccauaggcaaagccaagguacagguaggaagggaaaagagaagugaaagcaacguaugugguggggacaacuggggaaaaaagauaaccaaaggcuucuuuagggaugagucuuaaccauucaaccacuucccugucucaaggcagacucaccccgacguauucggucauccugacucccauaagccagggcuccaggucaauccugaauccagccucccaacuacccaggccagucguccccuccuaaaccagcuguuccuucccgagauccucgaccuccaccagcuggccuuugcccuuuuagcuucagggaagucuuuggugagcccaucucucauuaccaagguaacgaagcgcagacuccgggcccgggugggcggcaucaccaccagguucacgccgagaaggagcuggaggagagccgcccggcuccagccggaccgcuugcccgccaucaccguuguaaucuaugcagcaaacaag

SEQ ID NO: 13272 - RNA, 8623 nt, Homo sapiens
cucccacucucuccugggcccggugacccagcggcggugcccugagccuugaagaccagggggagcgcggaccaacggggucgaacgcccgggcgcagaaggucccggacgcagaaggucccgggcgcgcagaaucgcagcgggucggagagccccggcgcucucagaggagugcgcccccagggacgcggcucugagcccugggaagcugaggcgccuggcugcgcccucugaagcucguacuuuuccucccacccucagcucccugaagagugugagugcgugcgcgcggaguuuuaaacggcagcuuuaaaaauagcaaaauuauguuguuucuaaauccaggaggaaucacugacgcguucuuuacgcagaugaauccgcucacaaaacgggaaagggaccuggagaaaaugaauggggguaauuuugccugccgagggcucacuugcugggcagugcuaauggaaggguaaaacugccuccccaagacaccuguggggcacccaaggcgcgccaccuuuggccugaggauucuggccguguuuggcaaaucauagcugaguagugaaucugaaaccugggaugugguuucugagaccaauuucaacacccacucucucuuagggcuuggacaagucccuuaucucuauuucuaccucuauaaaacaugacaggugaccagcugaccuuccgcugagccaugagccccagcuaauuaaugauuguaaaaaacaacugcagaucagaggagcugggaaaauggcaaaucacagccacaggguuuuguauucuuuaaaaucaguuaacaucccuccuagcgccugaaggccuuuaggcaccuagaccgaagugugaaaacacaagaaugaaauuaauuacaggagccaccuauuaaaaccucauuaaaaauaaaguuggcagccaggcugugggaucugggaaagccaggccauagagagacucagaaaacagggcuguucaucagaccacaaagagaaggggauguggacuggaaaacaucuggcuucccuugggcucaagucugggagcagaaagcagaaauguugcagcugaucuuaauugccccugagguacuguaggggaaaaaaaacaacaaaauaaaacccagagcauagggggcugcuucuaagcugaaaguagacagacaugccuuuggaaagccagcuccaagcuaaugcuacccccagggcucccauucugcgcucuauggccagagcccuuaacauccacacugcuccaucagugcuguccucaacccagaguucaagaugagaugucaguggacagagggcugcauaaagacagaaaucuggucgggcgcgguggcccacgccuguaaucccagcauuuugggaggccgaggcggguggaucaucugaggucaggaguuugagaccagccuggccaacauggugaaaccccaucucuacuaaaaauacaaaaauuagcugggcaugguggcgggugccuguaaucccagcuacuuaggaggcugaggcaggagaaucgcuugaaccugggagguggagguugcagugagcugagaucgugccauugcacuccagccugggcgacaagaacaaaacuccaucucaaaaagaaaaagaaaaaaaaugacagaaaucuaaggcugggcacaguggcucacgccuguaaugccagcacuuugugaggcugaggcagguggaucaccugaggucaggaguucaagaccagccuggccaauaaugaaaccccaucucuacuaaaaacacaaaaaaacuagcaggcguggucguggacgccuguagucccagcuacuugggaggcugagacaggagaauugcuugaacccgggaggcuuagguagcugagauugcgccacugcucuccagccuggucgaaggaaacuuucucucaaaaagaaaaaaagacaaaucuagcaaggcauuuggcucaggguaccaaugggcagauugguccauagccagauuucacgccacucacagacucaccuugaguuucuggaauauccuaaccacugugccuucauuuguuuauuuaugcauucauucacccagccaagaaaacacuugaguuuuuacuccaugcuaaggcuaugcuaggaauguugggaguacaaaguuaaauaaggcagaguccaaguguaccguaaugaugcaaggcagauaggaaguauugagagaaaacaggcagaagggacggccuuucacaggacaugacacugauaggucuugaugaguaggaauuagucacguggacaggcauucuaggcaggagcuucagggugugccaagccccagggguguuaccauaugacuuugugaccuagcaauucuacuuuuugguauuuacccuggacgaacauguacaaaugcagaaagagguacaaugauguuugcauauaguacuguuugcaacaggggagaacugaaaacaaauguucaucaugaaggcaauaguugaacaaccuaaaguucauucaugcuguggauuacucugcaaaaacucaagaacaagcuagaggcaggaguucgagaccagccuggccaacaaagugaaaccccuucucuacuaaaaauacaaaaauuagccaggugugguggcgugugccuuuagucccagcuacuugggaagcugagacaggagaaucgcuugaacccaggaggcggagguugcagugagcugagauugcgccauugcacuccagccugggaagcgagagcaaaacuccaucucaaacaaaaacaaaccaaaaaaaaaaaaaaaaaaaaaaaaagaacaagguagagagagacauauucuuuuuuuuuuuuuuucgagacggcgucuugcucugucgcccaggcuggaguguaauggcgcaaucucagcucacugcaaccuccaccucccggguucaagcgauucuccugccucagccuccugaguagcugggauuacaggcacgugccaccacgccuggcuaauuuuuguauuuuuaguagagacgggguuucaccauguuggucaggcugggcucaaacuccugaccucaugauccacccgccuuggccucccaaacugcugggauuacagacaugagccaccgcacccagccaagagauguauucuuauaagaagaccuccaagacgaugucaagggaaaaaagcaaaaugcaaaacacacuaaaucuucacagaaaauauacuucauacugauuuuggcguuuaucuuuaggcagaggucuagaauugguaagggacauuuuuguaauguuagaaaauuuacaaugagaauguaccuauguguaaauuauguaacuaaaauuaaaaacuggggggugggcgaguggguauuuguaucuaaaauagugcuguccaauuauuuucugcaguggugggaauguucuauagcugugcuggccaauaugauagccacuaguagcaugagacuguugagcacuugaaauguggcuauugaaaacauaaacuugccgggugcaguggcucacgccuguaaucccagcacuucgggaggccgagguuggguggaucaccugaggcugggaguucaagaccagccugaccaacauggagaaaccccaucucuacuauacaaaauuagccgggcaugguggcucaugccuguaaucccagcuacucaggaggcugaggcaggagaauugcuugaaccugggaggcggagguuguagugagcugggauugcuccauugcacuccagccugggcaacaagagcgaaacuccgucucaaaaaaaaaagagaaaacauaaacuuuuaauuaaaaaaaaauuuuuuuaacaacugguaaucaauuuauuaaaauuguugacuuaagcauccugcaauggugacuuccaccucaacuccuggcucaauacugauggaaguaaucugcuuaacaaucucagaaggacugugcaagucaaugagucgcugguggauucucaucuggaaacgaucccaugucuuagaaccuucaccacaagggguuuuucuuguagugauucucaaagucuugguaagcauucggacugguccuuucacuuugagauucuuuuccuuugcgccucugaucaagucagcacacaccuuuuccagggauuuuauguugcggcuuguuagggugauucgaauucagugaaucgccaccuccggcuccacggguguuuuuccgguauccuuaaaagccauggcugcugcguggcuuccugaccgacuuuuuccucagcgagagugaacagcagugagucaggagcaggagagugcggacgagagacucacagcaccuacgaccgcgucuuccuccaauuuaaaaauuuugaaauuaggccaggcgugguggcucaugccuguaaucccagcacuuugggaggccgaggcaggaggaccacuuuaggccaggaguucgagaccagccuggccaagauggugaaaccacgucucuacuaaaaauacaaaaauuagucuggcauggugguaugcaccuauagucccagcuacucagggcagggcugaggcaggcgaauugcuugaacucaggaggcagagguuauagugagccaagauuguaccacugcaguccagccuggaugacagagcgagacucuaugucaaaaaaaaaaaagaaaaauuagcugagugucguggcacauaccuguagugccagcuacugaggaggcugaggucaccggagccugagaggucaaggcugcagugagcagugauugggccacugcacuccagccugggcaacagagugggauccugucacaaaaaaaaaaaaaaaaaaaaaaaaaaaaaauuaacaacuacaugugaguaguggcuacuguauuggacugugcaggucucgaaucucuagaauaaugaggucaugaugggguggagguaucagaggcauuugaaccagagagacuccagcuugaauaggggcuggguaaaauaaggcucagaccuacugggcugcauuccaaggagguuaggcaugcugaguccagcugauaaaaggaugcgauaaagaagcuggccaaaaccuaccaaaaccaauauggcaaugugaccucuggucauccucacuacucauuauacgcuaaaucuaauacauuagcaugcuaaaagacacuccuaccagugccaggacaguuuacggaugccauggcaaugucagaaauuuacucuauguagucuaaaaaagggagaaacccacaguuccgggaauugcccaccccuugaccagaaagcuccugaauaauccaccccuuguuuagcauauaaucaaaaaauaacuuaaguauucuuagggccgggcgcaguggcucacgccuguaaucccagcacuuugggaggccaaggcggguggaucacgaggucaggagaucaagaccauccuggcuaacaaggcgaaaccccgucucuacuaaaaauacaaaaaauuagccaggcgugguggcgggcgccuguagucccagcuacuugggaggcugaggcaggagaauggggugaacccaggaggcggagcuugcagugagccgagauagcgccacugcacuccagccugggcgacagagcgagacuccgucucaaaaaaaaaaaaaaaaaagguauucuuaggugagcagcccuugcugcugcucugccuguggaguagcuuuuuuuuuuuuuuugagacagagucuuauucugucacccaggcuggagugcaguggugcgaccucagcucacugcaaccucugccuucuggguucaagcgauccuccugccucagccaccaaaguaguugagauuacaggugugcaccaccaugccuggcuaauuuuuguauuuuuguagagacggguuauugccauguuggccaggcuggucucaaacuccugaccucaggugauccacuugccucagccucccaaagugcugagauuacaggcauaagccaccguuccuggccagaguagccaugcuuuauuccuuugcuuucuuaauaaacuugcucucacuuuauucuauggauucgccucaaauucucuuucaccagacccaagaacccucuccuggggucuggaucaggacaccuuucugguaacagaagcagauggaagaugaagcuggaaagauagguugggauuggauggugaagauuugcaaagugggcuagggaauuuggacgcuacccuauaggcagugggaaguguccaugagaguagguagaucagauuuccccuuuuauuuuauuuauuuauuuuuuugagacagagucucgcucugucgcccaggcuggagugcaguggugcaaucuuggcucacuguaaccuccgccucccggguucaagcaauucuccugccucagccucccaaguagcugggauuacagaugccugcuaccauggcuaauuuuuguauuuuuaguagagacgggguuucaucaucuuggccaggcuggucuugaacuccugaccucgugauccaccugccuuggccucccaaagugcugggauuacaggcaugagccacggcgcccagccagauuuccccuuuuuaaugauaacucuggccacccugccgagaguagaucagagccggcuaagugcugcaggcagggcugucuccucugaaggcugcuuugugaguuucccuccguggccucuggacauugccccaggauuccugacaggcagcugaguaaaguauucuaauuucacagcuauguuuuucagagcucaggcagucccguguaaagacuggucccaguuauugagagcaguuaaccucaguggggcaggcuguuuauagguuaccaaggcagaccgauggcacucgggugaaaaugaaucgcagguuucaacagugcagccuauagagaaaguuucuccagggucaggaaguuacccuauuaaaaaaaaaaaaaaugauguuacccuauauagucuaaaaaggggaggaaccgguaguuccgggaaucugccauugccccaggcagauucuuuagcugguccccgccucagcaggagacgccccaggaguugccauuguguacuccggguuucagcucuguuggccgggaggcuccugcuccagaagccuacccuggugcacuugggcacccauugugugaccaacaccaggcugggugcucaguccuuaauucgaagaaagcaggccaggugcgguggcucacgccuguaauccaagcauuuugggaggccgaggaggguggaucacuugaggucaagaguucaagaccagccugaccaacauggugaaacccugucucuacuaaaaauacaaaaauuaaccgggcauaguggcgcacgccuguagucccugcuacucaggagacugaggcaggagaauugcuugaaccggggaggcagagguugcagugagcugagauggcgccacuacacuccagccugggugacagagcgagacuccgucucaagacaaaaaaagaaagcagacaagaugucuacuucauggaauuuuccacugaaaucaaauaaagguccaaaaacaucauuaccaauugucaugaguguuugaaggaaaaaaaaaagggacagugugcuggaagaggauagugggaguguggcuucagggaguuuaagccuccacccaaaaagacccagaagacaaauggaaguuaagaaggugaagaggggaccuagggaacggcauuccaggcggaacaacugaagacugauguaugaaaagguccuuacaugagaacuugaccuuccaggucagaaggguggagugggcagggcacggugaaugagcgggugagaggccuagaaugaggugggagaggcaggcagcacccagacacuaccaggcuuugugaguucuguuccgagugcaagagggggcccuuggagggauuuaagcagaggagggaacugaauggccuuuuuggauguugcaugaggaauggauuagagcaaggaauuagcaaaccauggccuauauggcccacagcuaagacugguuuuuacuuuuuuucuuuuuuuuuuacuuuuauuuauuauuauuauuauuauuuuauuauacuuuaaguucuaggguacaugugcacaacgugcagguuuguuacauauguauauaugugccauguuggugugcugcacccuuucuuuuuuuucuacagagacaaggucucccuguguuccucaggcuggucuugaacuccugggcucaagugauccuccugccuuggcuccccaaaguguugggauuucaggcgugagccauugcacugggccgguuuuuaccguuuuaaauugaugaaaaaaauaauaaaaagaagacuauuuugugacgcacaaagguuauaggaaauucaaauuuuggcaucuacaaauaaaguuggauuggaacacagccacacucauuuauuuauaaauugccuuuggcuguuuucacaccacaaugguagaguuaguaccguaggugcgacagaaaucauauggcucagacagccuaaaauauuuacuaucugccccuuacacaaaaacuggccugacucauggauuagaaagagagaaaaagcagggaaauccaauuaagaaguaucugcgguagaugguacggggucagaugac

SEQ ID NO: 13273 - RNA, 23378 nt, Homo sapiens
cugccgugacaaggggcaggacugcugagguugcucgcucgcccucagccagcgaguuaaagggccaacuaaugccagcucuuuccucugcgugccacaggguggugaggucgaagcugcaccggaccucacggcagcacagagccaaggagccaggggccuuuggcuuucagagaagagagaagcaggaggcccuggagagaguguccucagcuucgguaccgacgcccuaccauuaccggugggagcccagagagugaggccaggggccggcacugggcagggaggcaggauccagaggacacugcuucacucagaccaacagggagccaggcccugcaggggcuuuauuuugacaccacuuuguuucaauacaaacaguccagaaagaaagucaagucccucugggggaggggcaaggggaagaguggucuguguugcuugggagcccaaccuacaacccaaaggugggggcugggcugagacugccggugcggcaggggaagauggcaccaagaaugacagugcuuggcucagcugccagagggugaggcccacagcucucacuggcgggugcuguccaggccaagcccagaaugaugcagaggaaggagcucagccccaggagccugccucugccucucacauccucugcuucccuggccagcaucaagcucacagcauccagagucgaaucacagcagacaagacccuccauggccaccaacccggggaagaagggauaaagaaugucacagaggguccugcauuccacagcagaugguacagagggacccugagacacccugaaacaaucuuccaagugcuuacuguagaaagggguggugagacgggagaacccaagggucuccggucugaucccaaaugaaaccuuuagguaccagguaaaguuuccagcccuugguaacgcccagacaaagguccuuccccucuccuggcacccagaagaggccacuggcagcagcagcagcagcaaguccgcagccucuuuccccaugggacgggucuacagugaacuccuuccaggccucccccugguuccagaggauggggacccaaggccucgaacuagaagaacccuagagccagcaaaaaaagccuucuaccuuccgcuuucccuaccuggggaaagucuggacccagaauaagccaucgugggggaacccccuuucccaguauggcaggauaagugagcagcagcugugggggcaggacagaaggacaagagucuaacacacggaggguggugugagagggaauaaagggcucaguccacaggcagaggacaagggcugguacugaccauuccccucacaggagugagcgccucaaaggccaccccacacacacaccacacauacgaaguaacaaauccuccccagcuuccacaaggcaaagcauccccagccugggaacuguggaguucuuguugccgucaccaucguaagccugagucacagagcucggaucaguaggaaccguagcgauccugggggcgaggggggagaaaaaaaaaaaaaaagucagaggcucuaagcugcagcagcuucccagcaaacacacugccugccccagcaccccacagcaagacuggggaggcaggggcuggacagcccggugaggcaggaguccacggugagagcuggggcagcggccacucgggcacccgacaacagggaagcccugccuggccucacagaagcugggaagagaagagaaagagcgguacaggugacaaggccagggaagaucauggcagacacagaggcaucuuggagaggcccggcccuggcacggagcugaaaggaaggaagcugcccuccaagaaaaugccucucucuagacucuugcuuuuucguuugugguuuuuuuuuugagacaagaguuucacuccugucacccagacuggagugcaguggcaugaucucagcucacuacaaccuccagguucaagcgauucuccugccucagcaucccgaguagcgggauuacaggugcacgccaucaugcccagcuaauuuuguauuuuuaguagagacgggguuuugccauguuggucaggcuggucucaaacuccugaccucaagugauccacccaucucagccucccagugcugggauuacaggcgugagccaccacacccggccgaaaaugcucuuaaggcucagaggggcugagcaguagcagugucucuaugugguggcgaagggcaaaccucccagcacuccucauuaggccccacuucagccucaccugcaaggaauucaucacaccauuggccagcacagccauuuucccagccacagacuugacacccugcuuaaacugggcaauguccgcuguaggcagcacguuccccagagauacacuuccuguaaaacaagagcagggugacccagagcccagcaagaagcccuucccagucacagcagggcccucccgcccugcucccaggccucacuuggugccugccaccccaccagggcccuaccugcuccgugagcuccauccauguccccaaagaggucugaagagcugauggcacugcugccugagagcugcugcagccgagaccuggccucauacuguggugaggaaaaggccaggccuggggaucuuggggcugaugacccaaggacucacacaggccaggcccuccuggugcuaaagcccaaagcagcggcagggagaaagcucaugcuucugccugcugccucggaccucagggcagacagccccacuuaccucugcauccaccucccgcccaaagaacaugucagaugagauggcuuuggcuccugcgaauuucugacgcgccucacuagacucgaggccugagcuccggcucuccacuucccuccgguuuguggcucugaggggaagauguggaauaucucggacuccucccauuaucaucaggggaggcagaguacagaggccaaacagagcaccaguggccuuuuggugauggguuaccaggucccauucugucuguggcucuguggcucugggccccucuccccuggugaggagucacccuucuccacauugaggccaaggcccagagagcuuaggaaccugcacuaggcaggguggaaauacagccugcaguggccuaggcuccugcccaaaagcacacagcuucgucagcauucaggaggccacacaacugcugcuacccuaauccuagugacaacuugccuaguacuacaaugagcauaugugucggucugccuggcuuuauaccuacucuugucauaacuaugaauagcaaacugcccccuuuacucucaaaagcauccugguguggaaagggagaugguugcucucaucucacgcugaguauguggacacugggccagguauuuccggagacccuaugaaguaguuacguucccauuuuauacggggauaacucacagauauuaugucaacuaaacagaucccagauuaagauggaguaggguuuuaaaaaauaagaagggggcuggagacauaaaaccccugaaaggaggucaggacugaagcauacaaucaggcuccuccggccagagaaauggaccccaagcaaaagaagcugccaggcccucuaugaugacaaagcacaacucaaaccgaagccugacugcugcccugucuaaugaggcaggcaccagccacugguggcuauuuacguuuaucagaaauuaaacuacaucagaaauuguugcucaguugcaccaaccacauuuuaagggcucauagccacauaguaguggcuaccauauuaaacaacacagagaacauucccaucaacacagaaaguucuucuagacagugcugccuuagaauucucuaccuucagcuuguuuaaaaaaaaaaaagaaagaaaaaagaaaaaacagcccacucuaccuuucugaaauaggccggaugcuugagauggucacuucuggcuccuucuccucuacccuguccauaccccaggcagcaucuguaucccagcgggagccaaagcuuuccccuaaggaaaagggauuguccuuguaccuagggagacaguagaguggcucagagaagccugaugaggaacacagcagccaaguuuacagcuagaaaacagccuuacuuuggggguccagaggcgaaaguaccaacaucgucaaacaaguccagcugcgagcgagaggauuuugcacucacugggguuuccugcucaaucaccugcaucucagacagcacggagugggagacagagcugcgcagcaaagcagagccaggcaugagaccaaaggauaggcaucagcaucaccgcacaagagacaaugcccagcaacuggguucuccuucacggagcgucacccagagccuucuguccuuacccaagcacagggcugggccagaccccaacagaaggcuagcuguguguggugaccugugaagcacaccucagaauucuuuacacaucagcuuuguuuauuccacguaggaguucccuggccagugacgguuugccuguuauaauuuaauuuuauuuauuuauuugagacagauucucacucugucgcccaggcuggaguccaguggugcaaucuuggcucacugcaaccaccaccucccagguucaagcgauucuugugccucagccucccgagcagcugggacuacagugcacgucaccacacccagcugauuuuuuguguuuuuucaguagagacaggguuucgccacauugcccagccuggucucaaacuccugaguacagacaauccacccgccuuggccuccaaaagugccaggauuauaggcgugagccacugugccuggcucguguuguaauuuuaauauugugcaccagaugccaguggucucuguccugaacaacucccuaccuugugcacuaugaaccccauccuucacugaugggguucacaaagcaaaggaauggaugaagaaaugccccagcaccagggaaaugaacauaacugcaucaaagaaugaguucuucaucauccuacucuuuauuaaaaaaaaaaaaagccaggcaccguggcucacaccuguaauuccagcacuuugggaggccgaggcgggcagaucacgaggucaggagaucgagaccauccuggcuaacauggugaaaccccgucucuacuaaaaauacaaaaaaauuagccgggcaugguggcaggugccuguagucccagcuacuugggaggcugaggcaggagaaugacgugaacuuggggggcggagcuugcagugagccgagaucgcaccacugcacuccagucugggcaacagagcgaggcuccgucucagagagaaaaaaaaaagcaccucaaagcacaaagacuggccuuaugcacuaagaccuagaauugcugucucguuucucaaagaaaaggggucuaggguuggcaggcaauacaauacaacucuugaugccucucauuccucugucaggcuccacaaggacacuuuaaggacuaauuugauuuaaaucaauucauuaaaaaauaucuauagcuuuuagcuagaagaaccccaaggagugauuauuuugcaauagggcugaguugggccgggcaugguggcucacaccuguaaucccagcacuuugggaggccgaggcagccggaucaccugaggucgggaguucgagaccagccugaccaagacggagaaacccugucucuacuaaaaauacaaaauuagccagguguggaggcugaggcaagagaauagcuugaaccccggaggcggagguuguggugagcugagaucacaccauugcacuccagccuaggcaacgagauugaaacucugucucaaauaaauaaauagggugaguuggguuuaaguaaacaauuguugcacugcuaaaaaacuguucauaugccuuaaccccuuggucaucccuuaacccagucaucuauuaacccagucauuccuaugugacugaagcagggaaaggagggagacccaauguccuuucaaguuaaaauguuaugcucuggcuggauguggcucacgcccguaauccaagcacugggcgccguggcucacaccgguaaucccaguacugugggaggccgaggcgggcagaucauuugaagcuaguaguuuuacaccagccugggcaacauggugaaaccccaucucuacuaaaauacaaaaauaagcugggcaugguggcacaugccuguaaucacagcuucucaggaggcugaggcaggagaauugcuugaaucugggaggcggaggcugcagugggcugagaucacaccacugaacuccagccugggugacagagcaagacuccaucucaaaaaaaaaaaaaaaaaaaagaaaagaaaagaaaaaagaaagccgggcaccguggcucaugccuguaaucccagcacuuugggaggcugaggcagguggaucacuugaggucaagaguucgacaucagccuggccaacauggugaaaccccaucucuacuaaaaauacaaaaaauuagccagacacggugguacacaccuguaaucccagcugcuugggaggcugagacaggagaaucacuugaacccaggagguagagauugcagugagccaagaucgugccauugcacuccagccugggugacagagugagacuuugucucaaaaaauaaaaauaaaaagccauagcagccagacaugguggcucacaucuguaaucccaguacuuugugaagccaagguacuuaaacccaggaauucgagaccaggcuggacaacauagcaaaacccugucucuacaaaaaguaaaaaaauuagcugggcaugguggcucccggcuguggucccagcuauuugggaggcugaaguggaaggaucaccugagcccaggaggcagagguugcagugagcugagaucacaccauuacacuccagccuaggcaacagagcaagaaucugucucaaaagaaaaagaaagaaaaccacagcaaaccgagugguucugaaacaggaaggauuccacccaaacugagggcauuugaaaugugggggauaugugaggguauuacagggagcacaaauggcaucucuagacaggaauuaaggaugauacuaaaugcaccgcaauucucagggaggucuggaaaaauaaacugucccaugacucaaagugccaucaagaaaaaccacccuagucucuugaagauacugaaauaacaccugauccuguguuuuguucacauaccuauucagucauucaacuuacugagcacauaccuacuaugcgccaagcacuguauuagggacuuuagaacaauaagccaagugaucuauucagacuuggagaaacaauaagccuagcaucccaaacugcuaggaaggccccgcaaugguucccagaaaacaacggcauuucccugccacacccggagcugagccucaccuucgggauaccaagcccaugcccaaccuuucugccugcucucgcuucuucccuuccagauucuguagcuucuuuuccucuuucuuacgaucaaucuggagcuccugguaggccagacgcauggaggcgacccuuagggggaacaaaggugucaguggccaccacccauccugaccuguccaacauacccacccaccaagccccgcagaagccugaggccccggcagcaaacacuuacauggacuccuccgccugcuucuuggcaucggcugccugcugcucacggagcuucucugccaccugagccugccgcucaaucucacugaagcucuggcugcucaccuucugggccccuaggccuuucuuggcacccagcugggaacagaaucauguaaggggccuucccaaucacacucuccucagaucccucccagguucaggcacuguagccacacccacaaggaaaaggcccuucuuaaaauuuaggguaaaaaacaggagcccaaccagcauggccaagacaauagugcuccgcuggagcugggcaugggcggcucacacagccccagcagagcccgggccugaggacggcaguuaaugcugacagggccaaguaugugccaagcacuccgccaagcacuagaugugcuccaucucaccgacuccucccagcagcccuugaagacaggcuuuaaaucccuuuaaaucuuuaaaucccuuucacaggcgagguucggagaaacacaguaccuuugccaaagucauauagcugguaagugguaaggucaaggagugaacccagguagccugcacccagcuccuaaccccucuaccauaccaccucuccccaccuaccccuuucuuagcugcugcuggcuucuucuugccaaugauggagcuuuucaguucugcgugagaaacggguaggcaugagcuaagacaaaggcagcucagaggcaguagcucaguauacaccaugcagcuucauggcaagagcuccuaagaacagcuucaggcaagggaaggcaaagcugccaccaccagcuccaaccagcggugucaaagccaaagacagacguggcugggguauuuacuggcacccagcagagugagacaggaaccuagaccugaagcaccagagacguccgaagcaccagagacguccaaauucccugaaccaaaacaaagacugcgaggcagggagcauauggugagcaccaggcuccgcuucuaaagcaggaagcugagaacaggggcugggcuccccaagcagcugucaguuaccucuggcaggaagggccccuuuagcugacagauacacggacucuggaggagaaacagacuuguggcuaacaagaggcccaccccagagccuccacagagcucccaagcccagcggucucuaugaagcccugcuucagaccaagcuaugccagccuucucauggaucagucugacagucacucugcuggguuccagccccaacccccaagagucaacagaacaaaccgaggucagcaaauggacuguucgcccugaaccaagucugaaagacacuaaggaaaauguaggaaagaguuaaaggacaggcugggguacuggcugagaaagaacaaugucaccuccagccuucggcagcucagagcugucccuccacccccggaaaugcaccagacaagccagcccugccucagagcccagggauagguguccagucucaugcuggccuccccaacacuuuggcuagacccagccccacacucagaggcagaccccaggccuuauacaccagcccacccagauucaucaauucaaagggcuuggcucuaaaaucaguguugcauccacuauuucaaucacaguccccacuccagagaaucagauagaugcucagucuccuguggccucuguccacacggccaggcaguaggaccucugaaaagaacauuugagguccacccucucccagacaccccacgccugcccgcuggcauacugacccagugaggcuuugggugaggugccaagcaggucuguguuggggccaugcuccggcucuguggaugcaaugguaggaguuagagaugagcuccuagcuuccugcaaccuccccuugaaagaagugaugggacaagaaucgguggcuuuccucagcuugccaccaaaagauaaaaggaauaucuaccacuuccuccaaggauuaaaaugaaucccggcccacccaaagauacaggaggaccccugcuccuauugucauggccagauguccccuuccaaacccugaguccucuccuaggaccagggcaccugguuggaaucugggcugaacucacgugccaggccacugcucucuguagacggggcuggcugcugggucccugaaggcucaguggcuggcgcaucccaggcagggggcugaaaaggaggccagaucacagaugccucggugagccacuccugcuggcaagaagcaccaagaccuacaagcaccuuguggacaagaaaucauacuccaaacccaugaggaaagggacuggaggguagcaaacaagaucacaguugcuauucacuguggaagaaagcaggaagacaagcagcccccaccccaaccccuucacuauuuacuuagagccagagcccauucuccuaacuuaaagacaguuaacuaccaccaccuaggcaggcacagaucuaaaggcuccucauauaugaauauauuuaauuaucacuacaaccccuaugaaggagcuacaucgccauuuuagaaacugagguuuugacagguugagugacuuggccaccaucacaggaaugcggaguagagaacaggaauugaagccaagagucuaacuucagcacccagggccaguaaagaggaaacccuccucaaagggguggggcggggaggagagaauccuuucacuguccccaagcacagugccuuuuuuuuuuuuuuuuuuuuuuuuuuuuuuuuuuuuuuugagacggagucucgcucugucgcccaggccggacugcggacugcaguggcgcaaucucggcucacugcaagcuccgcuucccggguucacgccauucuccugccucagccucccaaguagcugggacuacaggcgcccgccaccgcgcccggcuaauuuuuuguauuuuuaguagagacgggguuucaccuuguuagccaggauggucucgaucuccugaccucaugauccacccgccucggccucccaaagugcugggauuacaggcgugagccacugcgcccggcccacagugccuuucuuauaggggaagaauccaggaaaauuuguuuggggcaccggacaccucuugaaacuucaagaagcugccucucuuccccgccagcccaauuuauaggagucgauuucuaaggagggcuacacugcaccuccauuuauggaggaggaaacaccuaggccuacccagcaggaacaguggacuucauacgugguguccaagacaucacaucaaagcaaauggaaucuacaaccaugaucacagaaggccugggccuugguaaauugccugucaagaacaacugggaaaacgguuccuugugggcacucacuugaguguguucugugaagaaaucagaguccuucuucucuggggagugauuaggaacggcacuacucauguugucuauccaaagcuagaaaggagaagacaccccuaaaacacagggcucugaauacuccuaacccuccugccccagccccaagaacaggcacuuacaucagugccaugccuagccagggccgcacuccccagcugccggaucuucucccgguacaucugggcagcucggcuauuauauuugguguuggcaucauuggcugugcauccauguuggcgaaaaaaagccgucuggagagcaaagaagagagcagcgcgugcuacgggugauucucaagaaggaaacguguuggcuguaggagacaucuccuuaugacagcgaaguuauuaucuauacaggaugauacacgcuacugacaccgguuuuucagagauaaaguuucucgaaauuccugcaaaaaacaccuugcagcgggccauccucugauaugacugaaguccaggccccacugaacgcugccugagcacaacaucccauacccagccuccccauccuucauccagggcaggcccacaagacccaaugacugugaaggcucccaacuccuguggcuuuuccccaagaacaccugcccaguuuaauuggaaucugaaacccauuuaagagaagcugugaccaguuucgaaguuuucagaaaauagcuuauggugguguuauagaacagagaacccucugaacagggaaaacgacagggccucuuagggagucgugcaaaguuaguaaccaggcagaagaauggaaggugagggaaguagaaggagcuuuaccgcauuggcauucccgccgaccugcauacaccucagcuggaaccaguuccaguuggaauccaacucuguggaccuguguacaagggcugcgucucacccacuagcagauaccagcaggauuucccuggcaacccggauaccugucacuuggccucaggcugcuguaggcacccaggaaacauuaaucagccaucaccccauuuccuccacacuacccuguccaugaaaacucuccucuucguucauuuacuccaaagaguacuaauuauguccccagauccgaaaggaggucacauucucaggcacgcacgccuggauuuggcuuuccccuaauggauggucacagucucacuagagacauacuggucuaacaacauaucagcaacaacaaggucaaugccucccuuuccccucaacuaacgcucagagucucaagccugaccgucaaaaaagaggaaguuuuggcccagaggcggagacggaccgcccaugugccaaagggcccacacaggugguucccucuggcaggaggcuaccggacccucucggcccagaggcuucccaccgaauucagagcggcccaagucgaggcagccacucucccuuguugcccagacaccccuggccggccggguggaaacacggcaaccgcgcggagagccuaccugaugaagcucagauggacgcccagggagcggugcaccccggaacagucaaugcacaagaaaacaccguacgugaugcuggcccaacucggauucuuggcgccgcagucgaaacaggccuggguggaggcggcgaugagcgaaucgucaggggccccgaguaaaggccaggcaccgacaccccagaaacauaacccaccuccgcccuucucccucccucaggccccagcgggacgagagacuccgcgcgcccccugcucacgcaccuuguugguuggaacugcgcgaagccucuuaaaaagagucuggauuucggucuuguucggcuccgccgccauuuucucuccuucccagacacaaccgcggcugacgggucccgccgcgggccaauccacggcggggagggcgggcucaccaggccggccucagcggugccugggccagccgagggguggggugauuggaguccgaucuggaccaaugggcagccggcgggacgggggcggcgacgacaaccgcggccgcaagaaucaacgccgcgccgggccaauccgcagccggggcggggcgacggcgcgcggaccggcccaaaccuccucgcgcgcguaguacccuuccccccgccccucccacgccgcaacccccagguggagucgcccccacgccgcgcaggcugcgggaggcugggggcggggacccccacuccagcuaauuacagaucgaugaauaaggauuaggcugcccaaacacuccucgucccuccggcccgaacgggcagacgcauuggcccgcgucucgcccagccuucagccguucucgguuaacagcaagccugacagcgaguccccuccacuccagauuaguaucucgaaguuccagagcagguaccaagcaggcaaacccuuuuccaaccccggccccauaacagacgcuaggccucucucuagaugcccucugguggccuggcaaggguguccuaucaaaaaaaugcacaugagcccgacagugguguuuuuguuuuugugugugggugugugucaaguuuuaauacacgcuagaacaagccacaagagggugcugcuaggccagaacuacacucaccccaagcccaccccaggaaccccaaagcagaggucaggaacugaguccacagcuccuggggaggcccaggcaccccugaacgcuucugucaccucugaccucccaucuugcccucagccuagacucgucccuucccuaccagucccuucccuagacaaaggccccuccccucccugggucccaggacuuccucccucaagggacagaggagcagccagagagcgacgguucagggcccugaggguccggcucuccaggagaagcugggcucugaaccaggguggguaaacguugcagaagggcugucaggacacucaggcgcccacacacuccacguaguuggcaggguacaggccaaugcggccacucugcaacuggccuuggcaccagcccugcucguccuccucacucaucuucagcagcuccuccccugggggaaaggggauuggucacugccaguggcccuggcccaggcccuguuccugcaacugggucaaggacugagggggaugguguggucccagagcccagcuagcaaagacauggcucaggcagaggcaggucaaggucagcaagcugccccaccccagacccugaaugcagccaccaggcaccagcuaucuggaccuggaacagcugaagggacagaggacuggcccuuaagaaguggguauuuggcuucccuuucugacaccccugcucaggcagauaaggcagaggcugaagcuaggaaaggggucccaggguaccugcucggaagcucagcucaucagcuuccuggccagcguagucauagagugcccucacccgaaccccgguggcagccuuccggggacucucuucaucugaccacuccucauccugccccgugcuggagaggggaggcaaagggagcagcucagagugcaaggaacacggggcuggagaucucacccaggaucagggcaaaggccucccuacccccagaggcaccugggagagucaggugagguacuaaagauucuagcucuaccucgccaugcccgacugugagcaaagaggcaauuccugccacacgcagcugauuuaaggcauaaacgagagggaaugugggaaaugcccagcaaaucuaaaccacuaugagaaccaguaucauuacaacuacuaaguaggcccucaggucccuggcaccaauuuucaacccauuucaggugugaaagaaaugaaaccaaggagaaaggaaaggagggcgggaggcagagcuguuucuuugccacagccgcgcuccuggcucucacccuggggaccccggggacuggggugggggugcggugccaucucuuguaggcacaaugcuggucaggguaaccucaucagggcuccggccacccuucucuuuccggcugauuguccucuguguguccaaggaccacuccuguggggacagugcuuauagucagguggggccaucugaaccaccuucacuuacuucaucccuagcccuggccgagcugagugggagcccaucccaccucccauccccaccccgccuggaacacaugccucgaacuguggccaguucauggccaugccuggcccgugggugcugcgccaccagcgcagauccucuucgucacuggcugccucaaugcccuggugcaagucacgguggaguucauggaaccuaugacccaaggcacaccccucagucuaggaagucuagacccugcaucccucagucccagccagggccucggggagauggaggagacccaguacuaccccagaucuccaugcccaccaggcaguucauacuucucacugcuggaaagguccaggugcugguguaaggugagcagcauauccuugaagaaaagaagccgcuggcgcucggcggccuggcaggucucaaaggccuguuccauguccuccauguagcguggaguguagcgaugcagcucugccagcgucugcucauacugagcuuuugucugggugggagaggaggggccuggugagaaccagaccuucuuccacccaggacuccaccaguguuuaccagacacugccauaggcugcuagacccagggcuagccacuaggggcaaucagucccaagacccagcuccugcccucaaggaccccagcagccuaacaagggaggugacaucaggcacagcauauaaaagagucuggugaggauugaaaugaggucaaccuacaggaaaggaugggagaaaucagaaaaggcuuccuggaggagguggaaacugcagcaucucaggauggggaggauuugcauauccagagcugcaggaaaggacacuucgggcaaaggguacugugcaaggaaaagagcuggaaguucucaacugcugaagucaucccagugccugaaacuccauuucuuucccuaguaaagcaucaccuuuugucagguuccuccuuuaaaugaucaucuggagagaggguggcaggugaggaauaggguaauaagggugcuggggacuggacaagauguucagggagcaagauucauucaggaagccgugcccugggcgggggccagggcugggaccuguggccuguaccuucucggccuccuuggcacagcguuccacccguuccugcaguuugcgcagcugcuccugggagacggcgcugucugccuuugcguggcucucccucgucugggcggucuucucauccuuccgggcugcgugguagcuuuucuuggaagccucaaccuggcaugcauggagaccacucuggacccuggaugccacaccuuggcccccucgaucccuugcaaacaaacaggaaggagccugucucggauaccucccccacccagccucaccuccuucagccucuucagccagggcuucugggccuugcggaagccguccucggccgcccggcucucgcggaagccgcccagcacaggccgguggaaagccccccgcugccaggcgcgcacccgcucacuguccugcccuugcagcuucucccgcaccuccaggugcagcgcgcucagccgcucagccgccgugaaaaaggcaugccaggccuucuccagugugccauacugggggccugcagggagggacagggcuuaggccaggccuggguaccacccaaaaugagccuagccccucucacugggugugaggcauggaggcaugggguacgcgcauggggugcaaaggugaaugacaacccugucagcugggcuuauugaaugaggaccaugugccuuaucucacugacuccuugucucagccaccaucgugaggacagcgacauugccaacauugaacaggcaaaacacugaggaccagagaugugaacucgcccaaagcauuauggcuacaacaggagcugagggccgggcacaguggcucacuccuguaaucccagcacuuugggaggccaaggcggguggaucacaaggucaggagaucgagaccauccuggcuaacacggugaaacccugucucuacuaaaacuacaaaaaauuagccgggcaugguggcgggcgccuguagucccagcuacuugggaggcugagacaggaaaaucacuugaacccgagagggggagacugcagugagcugagaucacgccgcuguacuccagccuaggugacagagcgagacucuaucucaaaaaaaaagaaaaaaaagaggagcugagauucaaacccaucucuguuguguaaacacuacacuccauugccucaaaggaagagccugugugugcccucgaggaagacagcuugcaggguggaaagauccaugcucccagucagagggccugggcucaaccuucagcacuuccuagcugugugccuuuaggcaagucccuuagccucucugagcuuccaguuucuccucuagaaaaugcauaaaacaggcccaggugcgguggcucaugccuguaauccaggccgggcacgguggcucacgccuguaaucucagcacuuugggaggccaaggagaaaggaccgcuagagcccagggguucaaaaccagucugagcaacauagcaaaacccuaucucuacaaaaaauacaaaaauuagccaaguguggugguccaugccugugaucccagcuauuguggucccagcuauucaggaggcugaggugggaggaucaguugagcgugggagagggagagguugcagugauccaugauuguaccacugcacuccagccuggugacagagugagacccugucucaaaauaaauaaauaauaaacaaaggaaagaaggccagaugcaguggcucacgccuguaaucccagcacuuggggaggcugagguggguggauuaccugaggucaggaguuugagaccagccuggccaacaugguaaaaccccgucuuuacuaaaaauacaaaauuagccaggcgugguggugggugccuguaaucccagcuacuugggaggcugaagcaggagaaccacuugagaggcggagguugcagugagccaacaucaugucacugcacuccagcaugggcaacaagugcaaaacgucucaaaaaaaaaaaaaaaagaaaggaaagaaaauggguaaaacaaccaucuccacaggguuguugcaacuaucaaaguaacucaugagcauccuuuauaaacuuuaauaacaccacagccaugaggaugaccaggaggaucuucccuuucuaagggaggguagacguggaggccucaaacuucccacgagacgugcaaaaagaagcuggcccgacaguccugcacucagcugcccucugcccccugcgagggccuggcucacccuucuccacggucccccuccacuuucgggcccagucagccaacugcugggcauaagccuucucgaugcgggcgcgcuccuggaagcagcugaccagguccccgcacagccggugcccguccuccacccgcuguaccgugcgccuguaguugccagccugggcauacaggaaaagggugccaucaccagggagaagcuuccuuuggggcuggggcugucagaugggcuccuccccuagacaaguagcugagcccaggacccagcugcucaccucccagaaacugcccccuaaggccuccccuccagcguccucuucuggagccaugguguccccgcagcacggaaugguggcggauuuggggcuguggagggcagagggguaagcaggaaagcuggacauuauguuucuggggauaggaaaagacccucucuauaccugggccucgccccacugccauccccaccacccaaggagucaucagagcuaggacuuagcaggcagggugcugaagacccuaagaagggccaggaugggugaggauggagucucaaagcucuuccucucacugcucugcacuuccccccccgcccccccacauaccuggggccuagagaucacuucaaggacccggguguccaacucucaaugcugccaccgugacucugccuugaaggagaacagagcgggggugagggugggggccuagagcguccagggcggugcccggcacccccaauauagcaacugcugucagaagcgccggauuccagggaggagaaugccaggcaggucacacgauccagccagggauuaaauggcaggcgggggugggcggugggcagaaggccccacucccccaacugccgaugagaggacuccugcccaggcuagggccucuguugccuucccuugagugacaagacaacccuguuacccgagaggccaagucagagggugccuggccacaucccaguagcucccuguacugaggagggcacgaagggaaccaagaggccuggcuucuguguuggccaggaagcccgaacaaguguauguaacugucuccuccuaaggaggccccagcucccucuaagauggaacuccucugugugcucagcugccaugccagggcuggugugaaacucaaaccaagcaacgcaccagaaauacgaggggcccugcagucacggaagauacucaucucacuccacacauccacugagggcccgcaaggcuccguggggaacacacaacccgggccugcccuccaaaggccuggcguccagggcagcauggggaagugagaagcgauggccaacuauaagaaugucucccaggcugggugugguggcucacgccuguaaucucagcacuuugggagacugagguggguggaucaccugaggucaggaguuccagaccagcuuggccaacauggaggaaccucgucucuacuaaaaauauaaaaauuagccaggcgugguggcgggaaccuguagucccagcuacuuaggaggcugaggcaugagaaucacuugaaccuaggaggcggaggagguugcggugagcagagauuauaccaccgccugggcaacagagugagacugucucaaaaaaaaaaaaaaaaguucccuagaaucgcagaggacggcaagccaauuccaaccccagagccauggccccagggacucaaggacacaguggcauguggcugcuccccuccugccucugggcagggucucagcuguccccagcacugacugacucacagacccuagaaggaaaucgcuuccucucugagcaggcccaagggacacagccagacccaggaggacagugugcgcccuuuguccccaaagcagggcgcugucacagcgcuuccuccaaacucaugcaccucugcuucuccuucaaaccuccaauuaaggcaucuucuccucagucacuuccccuguuucucuguccuugcuccuguagccccgggugacccuucagccgggguguauaacccauggaguuguggcugacaggacagugucuaucuucagucaccgacagaggcuuccaggauucugauuuguguguccccacgcgcuggaaucagcaauaauuaguuaagugagaaaagaagcgauguccaccuggagcgcaggaaacgcgcccgcuccagcagcugugggaaugcuugguccaagugggcuucccccucugcuaacaggagacagagcuaggggcuccgcggagacccaggcaauggaggugcccaccaggggccucacaagcucgucacuugguucccucugcaguguguccugucugcccagaaaggaccugacagggcgauggagagaaagagagcugcugccaugaaucacagggcucuggagccgccccaguccagccucaggagccuggggccccuugccuguuccagccuccgaguucccugcuccccagagagcugccccccaccccuucccucucucuggccccagaacagagcaagcuguguguaccgggcuggcacagcucccuccggccucccagagcaaacacaggcccaagccccgggugcagccaggccccacagccccagccugaccucucagcaagcaagcaaggagggcuugcaccuuggcccccauugagcagguuggcacccugugccuccugagcucagcagagacccaaaucaguccccaccgcaggcaagagcucagaaagcagguaaugcaaucuucccagccccgggagccagcacguucggcuccgagaggucuuccugggcuuggcagggucuccuugcagcugcacgggccaagguaggaagucccugguucagggaagacccagucucccuaccugaggccugaagguacccggccccagaccagccccaaccucuuccagaagcugggggcuugccccugggagggagcucagccauucugccuggcccaucccuggaaccugagucacaggcugcgcccaagggcuucuuucccgggcagccccucccggugcgcccgcagcucuaggauuugaggacagagcgggggggaggggagggggcgucaguaggcugguccgaagagggacagcgagguuagaggggcuggaaccagaagccagagccagccaggagaucaggaggcugggggaggggguggcgcagccaaagcgggaggaggcagggccagggaggggcauaacaaaggggcacuuuuggaaacccgaccugccggccggggugccugcuuccagaugacgcacuccgaaccccagccuccacuccagagcucggcgcccagaggcuacgcgccucuggccucaacccuuauggaccgcgccccucgacaggaccccuugccgcccggagcugcauaacucggagcccguggagccacgcggagcggcagggccaggccuagccaccgaagcucuagacuucuuggccaaacuuguugaacuuggucuuggcggggguggggccacugaucaccgccaaggggaggggacgcccccugccugggccggccuugccgugggcuccagaugguggccccgggcagcggacccaggaaucggggcucgcugcauagggcgagggaucgccagggagcgaggacccucuggggccucggggcgggcgcgaggcgagcggacgggggcccucgaggggccccugaagacggcucagcccuccagcgccggcgccgccucccccgggcggccugcggaauugcgaagcccgcggcaccgcagaugggacggccccucggcgcggcuacggcccuucccgucggcacgcagagcgggguggccgggggcucccugggcgggagucggcuccauugcaaacuucagaagccggagcaggagagggcgggcucgagccaccgcacccgccgccgccuacccgcgcguccccuccagggcacucaccgcguccucccugggccccucggcggguggggguccggccacgcuccggcccgaguccugccgcuccugggcccgcgccgcggccucccggagcgcgccgggcccucccccgggaagcccggcccccggcccccggccccgccccucuccuggccgccgcugccucaaccccacgcggcggggcagcggggcugcaggcaucgcggcgaccagcggcucuuguggcgcgggucgagguuucucugcuucgcccgugugcggagugccugggcgggcuccccaggguugcgccccggugccgcagggagccagauuucggcuuugccucucccggaccguugcagagccugggagacccgagggagcaagaagggaccgggccggcacgggcagccuuggagaggggccgggggaauuacacugccuuacauuuuuagcugcacagcuuguuuagaaauuggcucaggcgaggcucacaaccaccccuuguaagcauuaggauucccacuguacagaugcaaaaacugaggcucgggggcuuuucagaggcuugcccaagauuucccucuagucaggcagggcugggacuccaaaaccgugcccuaccguuccacagcugcccugcuaaucuggggcgccuucuaaggccugagacgaacacgcggugggggugggacaaaaaggccuaagcuccucccgcuccgaguucuuauuuccagauuuuguaccacgauucauucuuacccuucgccccuccacccccuuuaucagucugguacauuuuuccauaucgccacgaugccaccccacgcuaaauaaaucccuucucccuccucucucccuacuucccucuccccgcuuucccccgggggugagauuuugcagagcggcuccgucuguuauuuauauccacuggagcgguccaagaauguuccgaagcugaccuaaucgccaccugcucggccucuccgccccucccacucucuccugggcccggugacccagcggcggugcccugagcc

SEQ ID NO: 13274 - RNA, 3061 nt, Homo sapiens
gggaugacuucagcaguugagaacuuccagcucuuuuccuugcacaguacccuuugcccgaaguguccuuuccugcagcucuggauaugcaaauccuccccauccugagaugcugcaguuuccaccuccuccaggaagccuuuucugauuucucccauccuuuccuguagguugaccucauuucaauccucaccagacucuuuuauaugcugugccugaugucaccucccuuguuaggcugcugggguccuugagggcaggagcugggucuugggacugauugccccuaguggcuagcccugggucuagcagccuauggcagugucugguaaacacugguggaguccuggguggaagaaggucugguucucaccaggccccuccucucccacccagacaaaagcucaguaugagcagacgcuggcagagcugcaucgcuacacuccacgcuacauggaggacauggaacaggccuuugagaccugccaggccgccgagcgccagcggcuucuuuucuucaaggauaugcugcucaccuuacaccagcaccuggaccuuuccagcagugagaaguaugaacugccuggugggcauggagaucugggguaguacugggucuccuccaucuccccgaggcccuggcugggacugagggaugcagggucuagacuuccuagacugaggggugugccuugggucauagguuccaugaacuccaccgugacuugcaccagggcauugaggcagccagugacgaagaggaucugcgcugguggcgcagcacccacgggccaggcauggccaugaacuggccacaguucgaggcauguguuccaggcgggguggggaugggaggugggaugggcucccacucagcucggccagggcuagggaugaaguaagugaaggugguucagauggccccaccugacuauaagcacuguccccacaggagugguccuuggacacacagaggacaaucagccggaaagagaaggguggccggagcccugaugagguuacccugaccagcauugugccuacaagagauggcaccgcacccccaccccaguccccgggguccccagggugagagccaggagcgcggcuguggcaaagaaacagcucugccucccgcccuccuuuccuuucuccuugguuucauuucuuucacaccugaaauggguugaaaauuggugccagggaccugagggccuacuuaguaguuguaaugauacugguucucauagugguuuagauuugcugggcauuucccacauucccucucguuuaugccuuaaaucagcugcguguggcaggaauugccucuuugcucacagucgggcauggcgagguagagcuagaaucuuuaguaccucaccugacucucccaggugccucuggggguagggaggccuuugcccugauccugggugagaucuccagccccguguuccuugcacucugagcugcucccuuugccuccccucuccagcacggggcaggaugaggaguggucagaugaagagaguccccggaaggcugccaccgggguucgggugagggcacucuaugacuacgcuggccaggaagcugaugagcugagcuuccgagcagguacccugggaccccuuuccuagcuucagccucugccuuaucugccugagcaggggugucagaaagggaagccaaauacccacuucuuaagggccaguccucugucccuucagcuguuccagguccagauagcuggugccugguggcugcauucagggucugggguggggcagcuugcugaccuugaccugccucugccugagccaugucuuugcuagcugggcucugggaccacaccaucccccucaguccuugacccaguugcaggaacagggccugggccagggccacuggcagugaccaauccccuuucccccaggggaggagcugcugaagaugagugaggaggacgagcagggcuggugccaaggccaguugcagaguggccgcauuggccuguacccugccaacuacguggagugugugggcgccugaguguccugacagcccuucugcaacguuuacccacccugguucagagcccagcuucuccuggagagccggacccucagggcccugaaccgucgcucucuggcugcuccucugucccuugagggaggaaguccugggacccagggaggggaggggccuuugucuagggaagggacugguagggaagggacgagucuaggcugagggcaagaugggaggucagaggugacagaagcguucaggggugccugggccuccccaggagcuguggacucaguuccugaccucugcuuugggguuccuggggugggcuuggggugaguguaguucuggccuagcagcacccucuuguggcuuguucuagcguguauuaaaacuugacacacacccacacacaaaaacaaaaacaccacugucgggcucaugugcauuuuuuugauaggacacccuugccaggccaccagagggcaucuagagagaggccuagcgucuguuauggggccgggguuggaaaaggguuugccugcuugguaccugcucuggaacuucgagauacuaaucuggaguggaggggacucgcugucaggcuugcuguuaaccgagaacggcugaaggcugggcgagacgcgggccaaugcgucugcccguucgggccggagggacgaggaguguuugggcagccuaauccuuauucaucgaucuguaauuagcuggaguggggguccccgcccccagccucccgcagccugcgcggcgugggggcgacuccaccuggggguugcggcgugggaggggcggggggaaggguacuacgcgcgcgaggagguuugggccgguccgcgcgccgucgccccgccccggcugcggauuggcccggcgcggcguugauucuugcggccgcgguugucgucgccgcccccgucccgccggcugcccauugguccagaucggacuccaaucaccccaccccucggcuggcccaggcaccgcugaggccggccuggugagcccg

SEQ ID NO: 13275 - RNA, 2571 nt, Homo sapiens
cuacuuuuguuuuucucccuuucagauuaaucagauuuuuuuuuucagcuuggaaaaaaggucuccgcagacacaccugugccuuguuuauaaaugggauucaggucucuuugauauauaaucucuagcgucacugaguaaauaguccugugucugcccgaccugcaggcugcuccccaaagcagagcugggguucucugaggaggggcugggcgcuucugcuauggggaggugguuucauguuggggcagggcugcaggcagggagggcuguccccuaccaugggaauguguaagagccauguuuugucgccauauuccugcucccugggauugaguccggcccugggaagucaaggcagagauggugaugccccuuccccucuggagccguguugcuaacagaggccagcugcucccuguguugugcggcaggagaggcugacggcugcuuagcucugacuuaccgagggcuugguugauuccacggugcuuugagagagccaugaggaauccauagaaggucagucucugaacauugcugagggccucuuugacaagugcugggggugggcagcuaagaaggagagaugccacauucagagccuagccagccucagggccaccucugcauccauacuuucagguucaugaggauacccacagccaagccagggaccugccuugggagccccaaggcccugggggaucaggccuucacuauggucaggaggggcuggcauguucacuaacuggugcuuucaccgggguggggagugggggugggaaauggcuacgggaaaccaaaccuguugcucagucccuaaggguacuugugccacacaggacagcuuaccccucucuuuguguagaaaaguuuuauacaaggaguacucuuuccuucucucuaaaauguuaaggccagucugucacccaguaaauuggucaacuacaguggucuugccugagugaaagcaguccuuuugaagugagcuaauugagagccuuucagucaacaacugguuugggggcaaauggcacuguuacauuaugaccagcaagggcccuagaaugccugggccgcgcagaacauccugcggagcucuguuccgcagccagcaguccgacccccuggggcuggggggcugggggcugcaugcccguuccucaccuguacuugugccgaucacacagguuuuccagacacugguagaacagcgacgccuccacgcccuccagcgugccggccccgcccaaggcaggucguuggcggugcugcccacuggacgacgucggcacaaucacuguguugggguucuugccugacagcagguccucauagauggcagccacacuguccaggaauucuggaaccguggggguggggguguggguguggacggcucaggcagggaggacauguuuugucuguucacuaugucuucccuucucugucagcccaguuccacaccagccucagugcucagggcaugguguccugagagcagaaguucucaaccuuguuugacaacacauugaugagagaugacacuaaucuguguuuuugcucaaaugucccauccuuggcucaguuguuccuggaccaggugagaccugccauugcacacuuucauagcaccauaggcuuuuuuuuuucuggcacuuagccagugaggagcuuucugugucauuaauugucuaaucugucuccuugcuggaaugcacaaaggcggggucaugccuuguuggccucuccugccuagcacugugcuuggcacauauuaaggccauaaauauuuuuuggaggagugaacaugaguaugcucccacugguaagccccaugguguguggccaccugccucucuaccucaagaaagcguguuggaauaccagcgaggaacagagaaagccugaaagcugcugaugagucagucauuugaaaugguuuucaaauuucguaguugagccauuguuagaacugcugacuuauggcccaucucgucucuacacacaccgcugggcagugucaguaaugcucccagcccaaugugguggcugucccaucccucugggggugcugugagaagagggcuggggagacagugagggaaaaauguucucccagacauggcugcuccuucucuagggcccaagagcuucagagaaaugggaaaugacuggugcugcuaagagcagguggcgagaccccaggcuccagccccuaacuguacagcccuugggcugccaucaaguaaacagaauguggcgcccaaaugaggccagggcuggcuggggacaccaguuggcaggaaggccaccucuaggaucuaaggacagccuucuauuuacuggaagagccuguuuuaagcaaguuuguuuaugaacacagucagcaauuuguaaacccggcacuccauuugaugucucugugcgugagcugguguauauuuauauuuauuugucuauauuuauuccaucugauuccagagagacuuaagggugcagcugugugaauuggggagcagagugggagugugacaaaggacugguguaugcuuuuuuaaagcugug

SEQ ID NO: 13276 - RNA, 61686 nt, Homo sapiens
cagcgucggcucuggcagcacuggaggcggcggcggcccgagggcgacuugcggggcgcgcaggccgccgugcacccgggacgcuucccccucggggacccuccgcgggcuucuccgccgcgccguccggcgggagccggcgggaccccgggcgagcggcgcgggcggcaccaugaggcggcaguggggcgcgcugcugcuuggcgcccugcucugcgcacacgguaagcggcgcccgccgggaaaguuugucccuggguccggccgcugcaggacucgccucccgggaccuggacggcgcgggccggggccugagaccccucgcccucgcuccuagccguggcccuggggcugcgugcaggggagaggacccggagcggccccggcuccagcaguccgagcgggggcaucagcggaggcgcuuccgcggguucgggucugggccggggcgcgggucugggccggggcgcggguaagguccggggcguucguucgcucgcccucccucgcugcucuuucaagagcgggggcugcuucccuuucagguuaggucgggggcucuguguccuuggugcgaaugaaugcgugcgaagaaagggaggcgggugaggagggucgcuaaacccauaaauuguaaauagcccuccuuccuggggcugggggcucgggcggguugcggagagaggccccgguagaaucugguacuugggcaccgggauuccucuacucggagaacgauucccggacuccaggucuugcucccaccaaggggcucuggggcacuguuugcgggcagcaucuccccucggcgguguuucggggucccucucuuggcugcggccagucagcuuccagcccuggaucguccuaaagggaggugguuggaaagggggcugaggaggaauauagggaagaaacugcuggaaggcucccgcagaucugcccuggcugggguaggggggcagggggccgguaacccugaaccccagaaggcagccgccgggcccucgcggcagggucccagcccucgggggagcuggacggcugcagcaggacuccuuggugcccguacccccuguugugugggacuagggcuccgauggaaucugcuucuccgcgggcucuuaacgacccugggugcaccccgugauugagcagcuuucccuaguuugugcccagagaucaaagaacuuugaucuuugaaccccagcccuauucacccaucgcuauucaucguggcgggaguuccgagucuccccauuugccucgcagccccgaugaagggagcuggggcucagaauggaggggucuggagacccugccuggucuuuuaccgguucuuucuuucacguaggacagcucguguggaaaaagucagugcagauuuccgaacuugccuggcagggcguggagaugucuaggcacucguuuuaaagauugguuuaccucccaaauccaaaacagaguuuucaugucucuuauuuaaacuaccuguggguuuucaggggcuuuuuuccgcguccucucuagcgcggacugagcucuuucucuccgaagagcgguagcuuggccggcccacguuccgcuccgcucugcgcucuccccuccccggcucucuccuggaagguuauuuguagccucuuuggcguguugggacagcggcccuacugggguaggaauguagcuguucuucccaccacaugggccccuuaaagggacagcuuugcuuuuugggggguuucccccuucggguugcaaggaaaggggauggaacuuuccucucagcccccuggaggaaguuuugaaaaagaucaagggaaauggcaaggcacugggaaaaaaaaaaaaaauuaggguuaaaacggauaccaacaaagccagagaggagauugucgccuucugcccuagggaagggggagcuggaagguuccgggcugagacuggccaagaagauuuuacugcuccagagcugucaacgcugcaaauauuacaugugcauagaggaugggggugagaauggggggagagaauugcguaugucuaauguuucacagaaaaagaaugggaggauucgcgguaacgcuuuuagguuucuuucucuuuuuuuucuuggagagggugucucacucuguugcccaggcuggaaugcaguggggcaaucauagcucacuacagccucgaccucccaagcucaagugaucuugucaucucagccuccugaguaacugggacuacaggcaugcaccaccauacccuacaaauuuuuguuuuuuuuucuagagaugggguuucaccauguugccaaggcuagucuccaacuccugggcucaagugauccaccugccucggccucccaaagugcugguauuacaggugugagccacuguguccggcccagguuucuuuuuaaggaaaaaaguuuaauagaaacgucuaagcaugggaagcuuucugugcacauguuuguaaggguaggcaguggggugaagguauacacaucaccuggccugauacugagccauccuuggaggucuggggggucagauucacaguucaccaguaagauugagcaguuucagagccuggaaccagcacaaccaaaaauaccaccaaaacaucuuuuggacugacacucaauuccaggggcucagggagacagcaguugugauaaauguaguaguagauccauuaggcagaccugaccucagcaaggcaugaauuaaagacacuaaaguuuaaggugauuuugggaggcugagacuagcggaucacuucaggucaggaguucaagaccagccuggccaacauggcaaaaccccaucucuacuaaaaauacaaaaauuagccaggcacaguggcacaugccuguagucccagcuacucgaauggaugaggcaggagaauugcuugaaccugggaggcagaaguugcaaugagccaagaucacuccccugcacucuagccggggcgacagagugagacucuaucuuaauaaauaaauaaaguuuaaggugcuuauuuggaugcugcuaguccuuggggcuuuuccuagagccuauugguuuggacucagcccacauaacucuccaaccuuaaagauuuuggaaggaaacuugauggcugguaauagcccugagugauuuucauccugaaguuugaaguaagggcauggaugacaaccauuggaagaguggaaaguguguuuguucuagaggucucauccagguaagggaaauguuaaaacuucugccuaggcgugcuuggguagauagaagguuguaucugaaaauaagugcagagcaauugagcugagacuggucuccuuuccaucucgcuguugucgugaccaggguugucauggugcuugagugaccuugucccugaucuguugggcuugugaaacauacuuggcuugucacugauuuuggauuuccucuucuguacccugaugaauaucagauaacaucuuuuggacuggcacgugguauuaagaaugacaggugcaagggaaccaagucuggccaugucugauacagagcacguuggguauguccaucuucugggccagcaaagaacacaggaggucacagaggacacgguguuuuauagcucuuugcucacucuuucuaccgauuaacugccagucuuaacuguuagaaggaaaauaggagaaauuguuuauguugcugccccuuuaaagaaaaaaaaaauacuggggguuccugaauaggaacagaauuucagggacuacuuuaagaaguaaucuugucuuuuuuaugauuggguaagauuacgagacagucugugcccuugguugacuaggucuguuagccuguuccagccauggucucucuacauuccuugaugcagcuuagccacgaguuuugucacaguugccuggacauggggcaucugggccccagacugugucuggacugccaucucaucuucagcagcggaagcccuccuccccuccucagccugugaggauucagugucccagggaagacucagugcugacugguuagcuggcagagccugaguuugaccuuauaaauaguucugaugacugcaugggcuugucacucucacuccagcuuagagcuggcaggaaugaguuccucguacaaucgggagcauuccucaaacuaggcuccacacccauucacuuguucauucauucagcaaacacacauaugucaagcauuaauauaaucacuguauacgaagcucagcaauuaagaagcacccacagaccuggguuugaaucuuggcucuggcaauucuuggugacccugugcaaaaucucccugaaccucaggguuguuaccugcaaaggcggguaggguaggggaagggaaguaguaauagauuaucacauaggaauaucauaaaauuuaccugagauaauagcauguucaaacuaugcagcacagagcuuggcaacuacuguguuacuguagagcuugauaaaaguuagcuguaagcaaagucaccuaaguggauccgagaugauucuuggcuuuagaacaugggagccagguaaauaauuaugcuaccguguucugugcuaaaauugagacuugguccuucauucauugcagcuggucuuuugcuugucucuuuuaaagaucugccccuucuuucuccccuugaaaacgugauagaaccgaagcauaguucccacuugugcccacuccuagaaaagaagucugcuaagcuauaacaucagucuaggggaacucaugucgccuuaguucucuugagagaggucuggggaaauggagcuuuuccucugagaguuucccuucuuaaguggucagggaugcagccuagcaacuucuccugcuaagauuccugugacauggggugagaggggcuggccagggacucuuguagcuggaacaguuuagaauuccaagcccucccucccauuggccugagaaaggagucaggcuccagagcucauaagguaguaauugccccaauuugggagcugggcuguuguggagccuucgcagcuaccauuuucaaucaggaagccugucagcuugcaggccuaauugaugugggucuccagccccgaauagcccccaaccccuaguuccuccaccucaaaguuugaccccuguugucucuuuuguuucuucuuuuuaaguuggugccagugaugugauuuuugggagcugcggaaaguugaccguaaccaagagcagcuguuaaaaagagccaauucucuagcuuccugacgguugucugccuccauuuucuguugugcguuuuugauuuagcaagaagcaaacauccuaggugcccuugggcgccucuuacgcccauccaagcagacuucauucuuucacugcucguaggcauucccauucuugcucacagaugagcggacuggcuguuagcgcucccugacacccuguuuccccaugcggaauaggacucccccaucauucagguucgaaugaggggaggggcgcugucugggacccaacuggggauagccuggcugggacuugcugcaagcccugacuuggccuaugggagcucccccucaccucuaugcacagcugaggaucagagcggcaagcagagccggaaacaaaagacugggagcaaaccucccaucuagcugagaggcagugacacagaggugcugcugcauaauuuaucaccggagguuuucuggagccgggaagcuccuggcuccaggcagugccuuuuugcgggagagggacccucccucugucuggguguagggcagagcagguacagagaaggguauccagagagacaccugauuagcaugugaaauaaagaagcugcaagguuguaagugccuccagggaucucuccaagcucggcagcuccacuuccugucacgccuugggggagguggggagggguaguggccugcaaccacgcgcuggcauggaugaggacaagagacagcuucucuguugaguugacuguagccuccuucuaaccaaguggagaggccagguuauggcauccacaagccuagcaaauaggaaaggggagccccagguuuuccacccuccuuccacgggcaguuuaaacaauaaguuucaacuacaggcucccagagccaauaaaagccaacaacucuacaauguaucuuccccaaaugagaauuucugcucuucuaggaaugaucuccuccaaugacaauuuuugcaaauugugggauauguggauuuacaaauugggauaugugguuuaaaaaauccaaauguauuucuggagcaguuagcauuuuugagagcuuugcugugucccugguacugugauaagcauuuaguauaugauaucauauuuauuccucacaauauccuuaugagguagguaacauuagauucccgucuuacauuggccaggugcgauggcuaacgccuguaaucccagcacuuugggaggcugggguggguggaucacuugacgucaggaguucgagaccaaccuggccaacauggugaaaccccaugucuacuaaaaauacaaaaauuagcugacgugguggcacaugccuauagucucagcuacucaggaggcugaggcugaggcugaggugggagaaucgcuugaaccugggaggcagagguugcagcgagccaagacugugccacugcacuccaggcugagcgacagagcgagacuccgucucaaaaaaaaaaaaaaaaaaagaagauucccaucuuacagaugggaaacaggcucagagcaguuuccugucauacaaauagugaguaacugagccaggauuccaggcuaucccagaagaucuagguugggaaggucuauauuucaucuuggauugaccucuccucuguuuucagacaucuucucagggagucugaaugcauaaggaauuacuucucaggugcuucuugagggagagagacuuuauuuuuauuuauuuauuuauuuuuuuuuuuugagacagguucucacucuauugccaaggcuggagugcaguggcaugaucauagcucacuguagccucgaacucaugggcucaggagaagagagagacuuuaaaagguuuccagaaaaaugugguuuguugcucccugaacagccauaaacaaaugugguuuguuacuguguggaccuucugauuugagauguagggggaagggaaagcaauauuuugagcagcccuucacagagcacagccauguuugagcccuguuggauuugugaaaucuguugacagcuuccagguagggcagguagaauuuugaggaucuauacaaagauagccuggcauuggcuacauuacuagguugagagagaggacauauccagaugaagauaaugggauuaguacaaauaacaagaaaaacaauaacagcugucuaguaugaaccucauacguauuauuucauuuagaccucccagcaacccuaugaaauagauacuguuauuacuccugauuuacaaaaguggaagcuaauccauuucuuaauugcucuguacuuuaguuucuggauucucucuccuguccuuggcuccucagaauuaguuggugauaaauuaggcaaagauuugcugggugugguggcucgugccuguaaucccagugcuuugggaggccgagacagguggaucacuugaggccaggaguuugagaccagccuggucaauguggagaaacccugucucuacucuaaaaauacaaaaauuagccggguguggcgguacacaccuguagucucagcuaccugggaggcugaggcaggagaaucgcuugaacccgggagauggaaguugcaguaagcugagauugugccagugcacugcagugugggugacagaacaagacuccaccucaaaaaaaaaaagggggcaaggauaaaggauaccaugugccucaagcucuuucagagaaaggcaauaaagcaagacucugcaguuauucaugccaccaacuuaacccaugguggugguacugcugccugguacacaguaggguuuucaaacaucucaaguccuaaaauagcaggucuuaaucauggagugguuggaugugacaguucugggguaagccaaaucuuuaauaguaauaacaagagcuauuauuuauugagcacuuaguaugugccaggcaguaaugcuaaguccuucuuaugaauuaacuaauuuauuucucauaacauuccuguaaguuaggggauuuuauuaucccaauuuuccugaugagaaaauuauauauaaagagguuaaauagcugcccagggucagacagcuaggaacuuagcagagucaggauuuuuauccuggggaguuuuguuccuccgugcuuaacauuauguucuucugccucauaacuuuggaggcuaaccauuaaggacuucuuuucuguauguaacaguagcaagagagggcugaacuugcuuggacccgcaaucaugugcccgacaugucccuuucgaaacgggccacugaggagaagacuucaccugguagauuuuccaaaccaaccaaguuaagcuggccucuaggaaucgggaauaaaagggaccaugggacagaaauaaguagaaacauggcgugucaguuucacagccggauaauacagcuggugaaaggaacucuuguaggagaaaggaguaaacaaaaccuggguaggacaaagaggcugccuugcaaacgagaagauuccuguucucuccagcacugguuagguaggaaauaacuacuuuuauuuaugauauucugagucucuuuuccuuugacuccagcuuucacaagauucuagaggaguguuucauucauucauucauucauucaacgaacuuguauuuauugcugccaguggauaaaaggagagaggcauaugcuaauaugcuuuagcauauuauaaacgaauggugauuccuccuuuuuuuuuuuuuuuuuuuuuuuuuuuuugagacggagucucgcucugucgcccaggccggacugcggacugcaguggcgcaaucucggcucacugcaagcuccgcuucccggguucacgccauucuccugccucagccucccgaguagcugggacuacaggcgcccgcuaccgcgcccggcuacuuuuuguauuuuuaguagagacgggguuucaccuuguuagccaggauggucucgaucuccugaccucaugauccacccgccucggccucccaaagugcugggauuacaggcgugagccaccgcgcccggccgauuccuccuuuucucauuguaauccuaauagcuuccacacugggguagccaccagacuccagaacacucacaggguacuccuuaagccuucucaucucugguucagcuugaaaaagcuggucuguagcugugaguagucacggucuacccaugugccuccaugugacagaugugguccaccuucagcugugcauucuauggaaugguggagagcagugccgcuagacacuugagugugcaucggugucacccggaaagcuuacugaaaguccagacucugagaucacacuaagagaagaauacuaguuuaagugucagaauggggcugccauccuggcucuccuacuuaccuugugaccuuggccaaagcgggugcccuuaccuguuggaugggcccugcagucauugcucaggauuauuguaaugauucaaugagaaugcaagugcauaugcaaaaguagcucacaaacuaaagagaaauugcaaaguauaauuauuuguuaugggaagcccuguucccuggaccaacaacacucgagugcugauucaaaagugcugggacgccagacuuuccccacuucauuacuuuaccuuccggcgagggaaaugaaucuuucuuuaccuuagcaguaaccagaaagaggucacuguuugagacccauaaacucacugcauauuugcuauuggagaacacauaaaagagagggacccagaaguuguaaauucccccuuuugaccuugggguuuuggagauucucacaacaguaauaccauuuauugggaagcaguauaaucaccugccugggugugaaugcuggccucaacccuuaguacuugugcaaucuaucuacagacuuaaccuuucugugguucauuguccccagcuguaaaguggugauaauauuagguuggcgcaaaaguaauugcaauuuuugucauuaaaaguaauggcaaaaaccgcaauugcuuuugcaucaaacuaauaauaacaguaccaccuccuaggguuguugagagccuucagugauguagcauaugaaaagcacuuagaaaaguacucggagggcaccugguaaguauuuaauaaaugauggggccaggcgcaguggcucacgccuguaaucccagcacuuugggaggccgaggugggcggaucaugaggucaggaauuuaagaccacccuggccaacauggugaauccccgucucuacuaaaaauacaaaaauuggccaggugcagugaugggugccuguaaucccagcuacucaggaggcugaggcaggagaauugcuucucgggaggcggagguugccguaagcugagaucgcgccacugcacuccagccugggcaacacagcaagauuccaucucggaaaaaaaaaagaugguuauauuauuaugaagcuuuugcuguguguuagcccugugcuaagcaguuuauauggguuaaucuuuacaaagcccuuugaguuagaacuguuaauauucccauuuuauggaugaggaaacugaggccuggagggauuaacuaacuugcucaaaauugcggaauuugugguagaaccaagauuugaaccuucaucucucugacuuuagaaucuauguugucuacuacuaaguuagugugucuuguauaccagauggauguuucccuucuuuccuuuauaucagggcuguccagacuuuuggcuucccugggcuacacuggaagaaggauugucuugggccacacauaaaauacaugaacauuaacaacagcugaugagcuaagaaaaaagaaaucgcaaguaaucucauguuuuaaggaaguuuacgaauuuguguugggccacauucaaagccauccugggccaugcaagucucagguuggacaagcuugcuuuauaugaaagccgugagaaagugguaagauggcgggagugggagagaugagauguaaaagguaagauuuuaguuaaccucuagagaaacauccuaugagcacauuaacauauaucccaaaagcuggauggcuucaugaucaaagauaccuugcggacagaccuuuuccauagugaauugcauuagguggaggggcuagagcccaggccccuggaggcuaagggagcuugcgauguggcuggcagcuuucaaggccagagcauagugaaguguucuaauucaacacuucuuaaaaugaaggcugcauuuugccacccacagucauuuguuuucuuucuucacucaccauucuuuuccuuaaaaaggguuaaaagcugccuuuaugaucacagccaggacuugagugaaaaggcagaauuccaccucugaggaccccagagggacagcaguugcccagaagagcuggcuuuuuggaguauaaugugucuguuuacuguaugaaugcccaagucaagcguuugccugaccgguggcugcccgcccuucacugcagcggacgcugagauguugauuugacaugcaggaagucgaggcccuucaacugccugcaacuaacuugaugcccaccgauggaaugcuuuguuccuacagucugcgcgggggaaaucgggacuucuguuaucacucagccaaaggcggggguggggcccuaaaaaaacaaacggagcuuaagguucuucccuaccaguaugacuuuucauuugcacgcagccccaggacacugcucuacuugcucuauucugguacucugauucuuaauaucaaggccuuuuggaaaaauuuagccuccacagcccugcaucugcacagcccugcaucugcacaccccagccuccauuauugaacaucuuuggugugccaaggcauaagauuaguuuuuuccaccuuuauuuucuugucuaaucuuuguugcuuuuuuuuuuuuucgagacagagucucgcuguguugcccaggcugcagugcaguggcgugaucucugcucauugcaaccucugccuccaugguucaagcaauucuuuugcuucagccucccaaguagcugggacuacaggcgugcgccaccacgcccagcuaauuuuuguauuuuuaguagagacagguuuucaccauguuggccaggcuggucucaaacuccugaccucaagugaucugcccgccucagccucccaaagugcuaggauuauaggcaugagccaccauguucagccccuuguggcuuuuuuacaaacaagaaaacugaagcuuaaggggcuacgugacuugcacaaggucaacuggcuggucgauggaacccaagucugucugcuccagguccagugcuuuguccucugccuaaccuccuccuccuauuccccccuacuuccucucuguccuuuccacagcuuucauccugaacucccgucugguacauccccacucccuacugugugugguuagcagcauuucucaaccucuguugauguuuugggccagauaauucuuugucauaggggccugucugcauguuauagauuuuuuuuuuuuuuuuugagacggaguuucgcuccuguugcccagguuggagugcaauggcaugaucuccccucaccgcaaccucugccuccuggguucaagcaauucuccugccucagccucccaaguagcugggauuacaggugcccaccaccauacccggcucauuuuuguauuuuuaguagagacggggguuucaccacauuggccaugcuggucuugaacuccugaccucaggugauccgcccaccugggccucccaaagugcugggauuacaggcguguaauccuguauagaauuauacacguuauagagucuuuagcagcaucccuagcuucuacccaccagaugucgguaagcaccgccaagcaggacaaccaaaaaugucuccaaacauugcuaaauguccuccgggggacaaaauauccccaguugagauccuuauuagccuuauccuuuuucuucaccaugauaccccaugaaggggaucuguguaccggggagucccaucacauggaguggaauuaaacaucuuugcuguucaauccagcuagaguucaccaaaagggugccuacagcugugcugagccugucauacuacugaaguuccucaggcuguguuguccaggaucugagugagaaaaacccuccucccuucucagaguucucaggccagaaaggauggagugggggcaggggcaccugggucuuuuagugcuuccuggggaagaauccucuacccugcauuuguagagagacccgaagagacaggagcacugggcuuggagcaaggccuuccugugaggucuagagacacugcaccucccaacuggaccucacuuggcuuccgcaggaaauccugcaucuuuuuuuuuuuuuuuuuuuuuuuuuuugagacaaggucucauccugucaccauggcuggagugcaguggugagaucauggcucacugcagccucaaccucccgggcucaagugauucucccacaucaugcucccaaguagcugagaguacagguguccaccaccaugccuggcuaacuuuuguaaauuucuuuucuguagagacaggguuuugccauguuccccgggcuggucucaaaacugcugugcucaaaggauccaccugccucagucucucaaagugcugauauuacaggcaugagccaccgugcccagcccaauccugcaucuuuucuagagcagcugauuaccauagcauguggagggagagggccaggccucaguugagaaucuggugaaagcugugaucccuuaccccagaaacguacauuauaccuguagcaucagggauucacagaacccaaaagccauccauccauccauccauccauccgucuguccguccauccauccauccauccaugcauugcaggcuaggaaguuuuaccuuaugcuugcacuuacucuugggguugagauggagagggaaaguucuagagcucucucccugcuuuuggagggcauggcagcacaccuuuuuauccuggcccuaagcccuaggcuaggccaaggaauuauaaugugagacaaggauguacaucaaggagaugagcugagagagaaaagcuggaccagguacagaguauaggaagaggggugacaauuucgagcugacuccuucucuguuucagcccagccugagggcaggguccagcugagggaaggaagaggagaagaaaggaagggggagagaugagccaugcgcugcggcccccuccuuccccagcugcgagcagagcagcccagcggguuggaugaaugcugggaggggggagagugacccuggcagaacccuuuguuccagcugaggcuggagcagggcacugagccauucacacgccaucccagggcauccugcugggcacgcuggggagggggcacagcagcuggucaugggacuuggccaggcagauagcucgaugcucaauagggaagcccagcugcgugcugcugaagccgggggagaggcugcaucugccagccuuccucaaggcuguggccugugccacagacaggaaggcccuggcaggucccaguuacucugcccugagguggccugggggacucagagcagcccacccugcuuccugcuccccuguguggauuccuuauccuaaagaggcuccagcauuuuaauuccaccauuaguucuugcccucccuggccaacaucccagggucugguccaagacagaggcagagcguccauaucucaaccuaguuuuagugagaaggcuauggaggccucucaacaucacccuuucugucccuuguuccucuucuucaaaagcaccaaaccucugaguggcaucauuuuuuuuuggaggggguuguuucuuuuuuucuuuuuugagacaaggucuugcucuguugcaccugcuggagugcaguggugugaucauagcucacugcagccuugaccucccagguucaagcaauccucccaccucagccucccaaguagcugggacuacaggcacaugccacuacccucagcuaauuuuuuaguuuuuuguagaaacaaggucucacuauguugcccacgauggucuugaacuucugagcucaaucaauccucccaucucagccccucaaagugcugugauauagguaugagccacugugccuagccuagguggcaucaucuguuucugggcccuuagaggugccaugcaaaaaagcccugucauagagcgggucaccuggacucuuuguaagcccaaagucagaggguaucugcugggucguuuaugcccuggaggaggcaugguuuuacugccugcaucucccuugaagugucacugugacucuccaggugacagugccccuggacuaggcuccucuacuuuccccucggaaugggcuuggguugagugggagcugagcccucacugauuccuuuucccuccgcccaggccuggccagcagccccgagugugcuuguggucggagccacuucacaugugcagugagugcucuuggagaguguaccugcaucccugcccaguggcagugugauggagacaaugacugcggggaccacagcgaugaggauggauguaguaaguaccuccccagaggcagugggaggugguggagagggaccuggggguggggggcaaggacaaggcugauggaguauuuucugcaucaacugugucggacucagagaguuggucuuuugcaagcuugauagauauugacauuuggguaguuucuucacuauauauggcuccaacucuccuguguuucuuuugguugguucaugcauauauguccaagaaaacaaacuugacaacacguguaagagaacacaacagggaguuucuuuaaauaggucucucuguauuuaugugaauauguuuguguauauguaccgcauauuugugcguuuuaaaauuuauauacuauacacaaauguggauuauuucuauguuucuuauuuugguauuuuguacaauaaaaccuuuuuuuuuuuuuuuuuuugauacagagucucauucuguuucccaggcuggagugcaggggcacagucuaggcucacugcaaccuccaccucccagguucaagugauucuccugccucagccuccugaguagcugggacuacaggcaugugccaccaugcccagcuaauuuuuuguauuuuuaguagagaugagguuucaacauuuuggccaggcuggucucgaacucaugacuucaagugauccagccaccucagccucccaaagugcugggauuacaggcaugaaccaccacgcccagccacaccuuucuuaguaacuuuguaagaaaucuuauauuuucuuaggccgggcgcaguggcucaugccuguaaucccagcacuuugggaggcugaggugggcagaucacgaggucaggaaaucgagaccauccuggcuaauacgcugaaacccugucucuauuaaaaauacaaaaaaauuagccgggcgugguggcaggcaccugaggucccagcuacuugggaggcugaggcaggagaaugguguaaacccgggagacagagcuugcagugagccgagaucgcgccacugcacuccagauugggcgacagagcgagacuccgucuaaaaaaaaaaaaacuuauauuuuccuuaagucucccuuuuccccuagcaugguaacaucugcacaguuggccagggugaccugucuuggauauauagaaauaucccugcuaagccaauagucuggauuagaggcgcaaucucugaccuaccuguagcaucuaugucugaggguggcuaauuagucuaaugggaacggagguacaaccuggaccucauuaacccuaaccaguucagcuaauuguguugaugauaaaugcuucacuuucauguagcauuuucauaggcauuauaucaaaaggccucuaugaacugaguauaauuauccccauuguacagccaaaaagacuucagcucagagaggguaaaugacuugcucagaguguuacguaaugaacuggaaauugagcccgggugugucaaucaucauuuaacaagaggaaaggaggggaaaaaggcgcuucuuucucuugcucauguuuuucuuauguuuucuuagcuccugugaguucuuuggguuguucuuccccuacccugugaaccccucaccacaauuaccuuuugaaucucugucuuagcugcaguuucugcuuagcuucuccaucagcuggggaugggccuaggagucaguaaggaaggacuauaaaacagacaagggggcugggugugguggcucacgccuguaaucccaacaguuugggaggccaaggcagguggaucucuugaggccaggaguucgagacuggccuggccaacauggcgaaaacccaccucuacuaaaaauacacacaaaaaaaaagauagcuggguguggcagcgggcaccuguaacaccagcuacucgggaggcugaggcaugagaauuccuugaacccaggaggcggugguugcagugagccgagaucauaccacugcacuccagccugggugacagagucagacucuguuucaaaaaaaaaaaaaaggccaggcgccauggcucaugccuguaaucccagcacuuugggaggcugaggcaggcagaucaccugaggucggggguuugagaccagccuggccaacacgacaaaacccugucucuacuaaaaaugcaaaaaacaaaaacaaaaaccaaaaaaaccuagccagguguggugaagcaugccuguaaucccagcuacuugggaggcugagucagaaucgccugaaccaggaggcagagguugcagugagccaagauugcgccacuguacuccaaccugggugacagaguaagacucggucucaaaaaaagaaaaaaagacaaggggauuuggagcaaaaggcuaucuggccuaguugagccugaguaagaauaccagguugauugacuuuucuuuucuuuuccugggauucaguacuaccuaccuguuccccucuugacuuucacugugacaauggcaagugcauccgccgcuccugggugugugacggggacaacgacugugaggaugacucggaugagcaggacugucgugaguguuggcagaggcugggcggaacuccauugaguuccacugggaaaggauuuucaaucagaaagcaaugccccagguccacaugagcccuuguguuuucagcacuuuguccuguccuuucacuuccucucgaagucagauaagcugcugagaggcagccaccuccuucggagcccucagggcagcacuggagcuacuugacugcuccggagggcuuuaagucaggcuuccaggcaccagacccccacugccugcagcagccugacugcucugugcccacagccccccgggagugugaggaggacgaguuucccugccagaauggcuacugcauccggagucuguggcacugcgauggugacaaugacuguggcgacaacagcgaugagcaguguggugggugaccccaacgggggaaggcaggcaagguggccaguggguggccuggccaugggagaagauagcagcaauggcccuagcacugccaaaccuccaacugcccagauaucuggagcagcuagaggaacgcagagggggcagagccgcucagaccccccagaaacuguggaccaggaggcugaggcccagucucuccagggccuccguucucccuggagagucugcacugacucuggggugccuuucgggggcuaggucagacccgccaaagccagugagguugggagucagagaggagggugagaggguugccuguggggcccccucagaacugcugucccaucgcauccccccagacaugcgcaagugcuccgacaaggaguuccgcuguagugacggaagcugcauugcugagcauugguacugcgacggugacaccgacugcaaagauggcuccgaugaggagaacugucgugaguggccccagaccucaggcuguuggguuggaugagggcagacaguucugcccauuggcuaagggcgaggcugaggagugcauguaccaagggcaaggagcaugggugccucagcagcagcuccuccuaggcugagcuagggagggagcaaguuccccaggugggaagggaaggcuuccuuugguccaccugaauaugggcgucuauaagggcugucccagaugaaaccugguuacaucucacuugaagaagcucuccugccugagcauccugccugcuugaggaaucagggccccucuccuucauccaggccugagugugugccccuccccaccccugccuucccuccagccucagcagugccagcgccccccugcaaccuggaggaguuccagugugccuauggacgcugcauccucgacaucuaccacugcgauggcgacgaugacuguggagacuggucagacgagucugacugcugugaguacucuggccagcugggagguggggaggccaggcugggaagaacugcuuggguggcaaggcacagucgccagcuggggcaggaguucagagaggaguuucuggauuuucuggucccucuugggaagagauggaggaacugggauucuggggcuguggccuucuagucugccaugggacacugcacagacuggcuagagacagaagucuuguguuucccuagccucccaccagcccugccgcucuggggaguucaugugugacaguggccugugcaucaaugcaggcuggcgcugcgauggugacgcggacugugaugaccagucugaugagcgcaacugcagugaguggggaaauggaauuagguugggcuugaacuaaggagaaggcuuguggagccaaagaggccacuaccggcugggcgcgguggcucaugcuuauaaugccagcacuuugggagaccaagguggguggauugcuugaggucaggaguucaagaccagccuggguaacaugguuaaaccccaucucuacuaaaaauacaaaacuuagcugggugugguggcgcaugccuguaaucccagcuacucgggaggcugaggcaggagaaucgcuugaaccuaggaggcagagguugcagugacccgagacggcgucccuguagcagagugagaugacaucucaaaaaacaagacaauccgggaggugaggggcgccucugccuggccgccccuacugggaagugaggagccccucugcccggccagccgccccauccaggagggaggugggggggucagccccccgcccggucagccaccccguccgggagggaggugggggggucagccccccgcccggccagccgccccguccgggagggagguuggggggucagccccccgcccggccagccgccccguccgggaggugaggggcgccucugcccggccgccccuacugggaagugaggagccccucugccaggccaccaccccgucugggagguguacccaacagcucauugagaacgggccaugaugacaauggcgguuuuguggaauagaaaggagggaaagguggggaaaagauugagaaaucggaugguugccgugucuguguagaaagaaguauacaugggagacuuuucauuuuguucuguacuaagaaaaauucuucugccuugggauccuguugaucugugaccuuacccccaacccugugcucucugaaacaugugcuguguccacucaggguuaaauggauuaagggcggugcaagaugugcuuuguuaaacagaugcuugaaggccgcaugcucguuaagagucaucaccacucccuaaucucaaguacccagggacacaaacacugcggaaggccgcaggguccucugccuaggaaaaccagagaccuuuguucacuuguuuaucugcugaccuucccuccacuauuguccuaugacccugccaaaucccccucugcgagaaacacccaagaaugauaauaaaaaaauuaaaaaauaaaaaaaaauaaaaauaaaaaaauaaaaagaaaaaaaaaaaaagacaaacaggccacuacccauaaaucuugaagacacuggguaagaccaccaccauguacaguuguguagguugugcacugugcagaggcaauauguccaaagggaagccagucacauaauagauuuauauacucaucauggcaguuuuccagcagauggcaguaaagugucuugaggaaaggauacuuuuuucugauucacacaaagacacuauauagaccagcugugaucccggugucaagaguggcauggguacugauauaagcugcagauuuggguggcagggagaauuucaggcugaaauggggcccaccuuucauuaagccuuugcuuugcccagccaccuccauguguacggcagaacaguuccgcugucacucaggccgcuguguccgccuguccuggcgcugugauggggaggacgacugugcagacaacagcgaugaagagaacugugagaauacagguggugucucccggggugccccagaacccuuagccuauaguugggguggaaggguggaaaagagggugcuuugguaucuuuccaguuggguugagguuuuaccaguguaaaauccaggugcaucauugaccugcggccuuauggccuggagcacaguaucagagcugcgaguuucaauugccacuccuauucuaacucacacacagccagugccuuuagcucuggucuagugaggaaggacuacccuccaucuggcagcccccaugugugcuccccuggccacacccaguauugagcaugugguugcacuuuuucauucuguuccauauuccucaccaucccacuguggaguccuggggagaaagcaaaugcagacauucagccagcccugucugagcugcuuccugcccaggacccucacccucccaccuugagucucaucugucuccagcuuacccuagaaaaugacaggcucccaucucuuuguuggcccaagcccugccuugcuaugaccugacccuccaucucucuaggaagcccccaaugugccuuggaccaguuccuguguuggaaugggcgcugcauugggcagaggaagcugugcaacggggucaacgacuguggugacaacagcgacgaaagcccacagcagaauugccgugaguguccccagugggcggaccuggcccaugguuuguggccgaaccccacccauaggguucaaagggaauccucccucaggacucuugcagcuuugggagcuguucuuugugguccagguggaaugccaaguuggcucucugggggaggauucugggcucaacucccaacucuggcuuggcuggcacagggccccggacgggugaggagaacugcaauguuaacaacgguggcugugcccagaagugccagauggugcggggggcagugcaguguaccugccacacaggcuaccggcucacagaggaugggcacacgugccaaggugagcuggggccugguuugcagcagagucgggguucugagcaggggcagcagacaggcagcuguguuuccuaugggucaggcauuugaacggugugaccucauuucguccucacaauaacccuaggagguggggaucauccuucccauuucacagauggggagacugaagcacagagaggauaaguagcuuaccaaaggccacacagcuggcgaguagcagaguugggauuccagcccaggucugcaugaccuuaaagcccuuaaccauuucuucuuuuuuauuuuuuauuuuuauuuuuuugagauggagccucgcucugucgcccaggcuggagugcaguggugcgaucucggcucacugcagccuccgccuccuggguucaagccauucuccugccucagccucuugaguagcugggacuacaggugugcgccaccacgcccggccgcccuuaaccauuucuuagacagccuucccacuaggccuggaaaguagauggggaugugggcagaaaagcagcucggcagccugggagcgggagugggaggacgacagaagggagaucucuugaccugccugguguucccagaugugaaugaaugugccgaggagggguauugcagccagggcugcaccaacagcgaaggggcuuuccaaugcuggugugaaacaggcuaugaacuacggcccgaccggcgcagcugcaaggcucuggguaagggcuguuggcacuuggcugggugggcagagggccgagcauggaggaaggccagguacucuggugcucagggauuugcagagagguagagagauuucugucacaguaaaaugcagcaacaguugcauucugagccccaagaaaaaugcugcugggguggagugggguggggagggguggaggaauauaguuuaaagguugccacucuucugguacugaugcugacagcuuggggcauguccuugugagcaaguggcuccaucggucagcugaagaccugcugauggguaccaggggcggcucugaaacccaguggguaucccauguuuauacuguuucccagggccagagccugugcugcuguucgccaaucgcaucgacauccggcaggugcugccacaccgcucugaguacacacugcugcuuaacaaccuggagaaugccauugcccuugauuuccaccaccgccgcgagcuugucuucuggucagaugucacccuggaccggauccuccgugccaaccucaacggcagcaacguggaggagguugugucuacugggcuggagagcccagguagggaacaaggccccauggagaggggcagagccaugccacaugcgcagcaacggugggaggaauaggccagugguuugcaaaccuuaggcagcaggacaucuuuuucuuccagggaaaucuuaguuggagcccuaauauagaaaacauuuguuaauguauaucaauuuuauagguucaaauauaacauuugcucaugauugagcucaaucagugagaauaaugagaccacguuggugguugugaucaugggaaucagauuuauggaugacagaguucuccaucagccuuugcaucuaguuuauuucugaguuuuguuucgauugcuuaguauuaagaauauucugauugaccuggauaaguauaucaaaauguuuuauagauuguuaaaaaaacaggccaggcacgguggcucacgccuguaaucccagcacuuugggaggcugaggugggcagaucaccugagguugggaguuugagaccagccugaccaacauggagaaaccccaucucuacuaaaaauacaaaaguuagccgggcgugguggcgcaugccuguaaucccagcuacuugggaggcugaggcaggagaauugcuugaacucaggaaguggagguugcggugagccgagaucacgccauuguacuucagccuaggcaaaacuccgucucaaaaaaaaaaaaaaaauaguucaagcgugguggcuuacgccuguaaucccagcacuuugggaggcugaagcaggcggaucacgugaggucaggaguuugagaccagccuggccaacauggcaaaaccccaucucuauuaaaaauacaaaaauuagccaggcaugguggcaaaugccuguaaucccagcuacuugggaggcugaggaaggagaaacucuugaacccaggagguggagguugcagugacccgagacugcaccacugcacuccagccugcgcaaugggagugagacuccaucucgaaacaaacaaacaaaaaaccacagaaacagcucacuugucaaucucaggcuauuuuacaaauaggugaaguggucaaauucuaauuugguaucaagcacauuggacucaaaugccuagggaauuucugaaaugccucugcaaaaccccagaugacaauuuacaaaccccugggucagugcagugggggacccugggaaugcgucagggagacagaauucagaaagugauguaugguugacugugaggaggaagugcaugcccuuggacaguuacuuaacucuuuugugccucaauuuccucauccucauggaaauuacaguaucuagcucacagaguugugaugcuuaaaugaauucauguaucugaagugaugacaauagugccuggcccaaaaaauugcuuccuguaagaguuugcuccuauuacuaugggacaugggggccuggguugacuccuugacauuuuuugcugcugcuucucaccagggggccuggcuguggauuggguccaugacaaacucuacuggaccgacucaggcaccucgaggauugagguggccaaucuggauggggcccaccggaaaguguugcuguggcagaaccuggagaagccccgggccauugccuugcaucccauggagggguaaguuguaucucaggcucccgaacuuucuugcaaccucucgggacagcucccaggcuaccuggacuagacauucugggaguacauccucaaagugugguguagcugggcgcgguggcucacgccuguaaucccagcacuuugggaggccaaggcgggcagaucaccugaggucaguaauucgagaccagccuggccaacauggggaaaccccaucucugcaaaauacaaaaauuagccaggcaugguggcgggugcuuguaaucccagcuacucgggagguugaggcaggagaguuguuugaacccaggaggcacagguuacagugagcugagauugcgccacugcacuccagccugggagaaagagcaagacucugucucgaaaaaaaaaaaaaaaaaaaguaugauguuaauaacaugggcucugucccccacacacuugagucuagguccuggcucuguaauaacuggcuguguggccuugggccaguuaaucucugucugccuuguuuacucauuucuaaauuggugauuaaaaaaaaauaccuccaucauaguuguaugaagauuaaaugaggugaugcauuuuaaauugcauauaacacacauuagauaaguuguagguguuucguauuuuuauuauuagcucauaagguugaccuaauuaauacaaauuaauaguuauuaguaauucauaagaauuguaauuaauuauuauagccuaaaaauuaauagaggggccgggcacaguggcucacaccuauaauuccagcacuuuuggagaccaaggaaggaggaucacuugaguccaggaguucaagaucagccugggcaacauaguguggccucaucucuacaaaaauguuuucuaaauuagccuggcauaguggcacaugccuguagucccagcuacgugggaggcugaggugcaaggauggcuugagacugggaggucgagguugcagggaaccgugauugcaacagugaccuccagccugggugacagaguaagacccugucucaaaaaaaguuaaauaaauaaaauugagaaaucuggucagguucaguggcucaugccuauaaucucagcacuuugggaugcugaggugggcagauugcuugagcccaggaguucaagaccagcuugggcaacauggcaaaaccccaucucuauaaaaaguacaaaaauuagcuggacuuauugaugcaugccuguagucccaacuacacaggaggcugagguaggaggaucaccugagcccuggaguucgaggcugcagugagccaugauuauggcacugcacuccuggaugacagagugagacucugucucaaaaaaaauuaaauuuaaaauucagaaaucugaauuaaagaaaaacuccugaaaugaaguucucaccucuggcuuuuaaaaauucuaugcaaucaauggagggaguaucuuauaagguccuacaguauguaucaacuguuuuagaaacuguguguguguaugugugugugucuguguguguguguguguguguguguguguguguguguauaaaauacaaaaggagccgggcauggugacucaagcuuguaaccccagcacuuugggaggccgaggcagguggaucacuuggggucaggaguuugagaccagccuggccaacauggugaaaccccaucucuacuaaaaauacaaaaauuagcugggcaugguggcgggugccuguaauuccagcuacuugggaggcugaggcaggagaaucacuuggguccaggagguggagguugcagugagcugaaaucgugccacugcauuccagccugggcaacagagcgagucucaaaaauaaaagaaaauaaaauacaaaaggcaguggaagagauugugacaaagaagaaagugccuguccuaauauuacauuauauugucaauucugugagacuuuugucuguuuuguucacugcuagauuuccagugccuaagauaguauguccugccuguugccaguaugaaaaaaaaaauuauuaaaugaauaaaugcccugucuaaagacauuuaaacucagacacuuaaaaagcauucugaggcugggcauggugacucaugccuauaaucccaguacuuugaaaggacaaagcaggaggauugcuugagcucaggaguuugagaccagcuuggguaacauagcaagaccucaucucuacuacaaaaaaaaauuaguuagguguagcgauacuagcugcucagaaggcugaagugggaggccuucugagcccaggagauugaggccgcagugagcuguaaucucaccugcccuccagccugggugacaaaaugagaccccgucuaaaaaaaaaauucauucuguggaccaaacauuggaguccccugaguuaaauggauaaaagcgcccuaccugauuauucuccugguuaccuaccuguuuucugcugcccacuucccaauuuacuuuucucuuccuaguaccauuuacuggacagacuggggcaacaccccccguauugaggccuccagcauggauggcucuggacgccgcaucauugccgauacccaucucuucuggcccaauggccucaccaucgacuaugccgggcgccguauguacuggguggaugcuaagcaccaugucaucgagagggccaaucuggaugggagucaccguaaggcugucauuagccagggugagccccuuccuucagucuccuucaucucuuguccuccugcccccgucccugccccccaggagccuugguagagguuuuguguaguugccaggccugggcccaggggacauggcagaccacguccagacugaggucuuccuggacuuuccccaggccucccgcaucccuucgccaucacaguguuugaagacagccuguacuggacagacuggcacaccaagagcaucaauagcgcuaacaaauuuacggggaagaaccaggaaaucauucgcaacaaacuccacuucccuauggacauccacaccuugcacccccagcgccaaccugcagguaaaaaacugcccaccgggugagccaaaguagccucaugguugagguggccucuggugccucugagaaccuuccuuccccuuagaguugccauuucuucugauggggaaauccagcagggcacugacaugggcuaauuccucccucugcuggacauucggggcaguacaacaagauucacgaaaagauucauuagacuucaccguucccaucuaauucaggcagacauuuacagggcaucuccucugugccggguacucacugugcuagcagcaggggcagaugucaaaaauauaagacauaguuucucccuucagggaacuaucacccuaccuaaaccccuauucccuagucuuggggucacuuuugcagaccuucgcugauccucuugcccugggcucuuugagcagggaaaaaccgcuguggggacaacaacggaggcugcacgcaccugugucugcccaguggccagaacuacaccugugccugccccacuggcuuccgcaagaucagcagccacgccugugcccagaguaagugggucugcaacaccagccuccauggaggcuguugugaggauggggagaaggaacaagggauaggacguggagggauugccugucaugggaaaaaccacauuccucagggagcccuggagaggaagaacuuaagaggcugagggaucuucuaucaaagcugaggacugaggacccagcacuaguggcugaaggcucagcaauaccgcccggucgagugugaacaccugcagugaggcucauguaucauuuuaccaggcaggauugccuucucuauaggcagcaagaggguuuuaugcucuucuagaaaacaggggaaugauuuccuaccuuuuuaccuuuagcgucacccuguugaagacuuucuuucggcccuuaaaccaggaagccaaaauuagaaucucugaugauguucuguguaagcggguccuggauaaauauguguuaaacaaguggaagaucaugggaucuucccuggucugucccugaacugcuacuuuggcuuccuuugggcuccuuaggaguuauuguuuugagaggguaacccuggagagcccagcacacgaugacuuuuucuaagaauaguccagagaggagcgguccgggcauauggcacgaccagcagggcaccuggggugauuccucacacaucagcagcuguucuuguuuacugcuguguaccccacugacccucugaaaucuggguaaaauaaaauucuccugggaccuggguccuuucuagagagugugguuagggaaaacauucaaaaguuucauucauacacauauuaacuaagaaccuaauuucauucucugaguuuuccccuugcauucuuuuuuuuuuuuuuuuuuuuuuuuugagacaguuuugcucuuguccaggcuggaguacaauggcacagucucggcucaccacaaccuccacuucccagguucaagcuauucuccugccuuagcuuccugaauagcugggauuacaagcaugcgccaccacaccuggcuaauuuuguauuuuuaguagggacgggguuucuccauguuggucuggcuggucucgaacuccugaccucaggugauccacccaccucagccucccaaagugcuggcauuacaggcaugagccacugugccuggcauuuuuuuuuuuuuuguccgccucccggguucaagugcuucuccugccucagccuccugaguagcggggauuauaagugugcacuaccacacccagcuaauuuuuguauuuuuaguagagaugagguuucaccauguuggucaggcuggucuugaacuccugaccucaugaccugcccgccucugccuuccaaaguguugggauuacaggcauaagccaccgcccccggccuuuuuuuuuuuuuuuuuuuuuuuuuuugagacagggucuugcucugucaccuaggcuggagugcagugguguaaacagugcucacugcagcuucgacuuccugggcuuaagcaagccucccgccccagcccccuaaguagcugggacuacaggcauacacugucacaccuggcgaauuuuguggaguuuuuuguuuguuuguuuuguuuuugagacagagucucacucugucacccaggcuggaguguggcggcaugaucucggcucauuguaaccuccaccucccugguucaagcgauucuucugcuuugggcucccaaguagcugagauuacaggcaccugccaccaugccuggcuaauuuuuguauuuuuaguagagaugagguuucacuauguuggccaggcuggucucaaacuccugaucucgugaucuauccaccucagccucccaaagugcugggauuacaggcgugagccacugugcccagugaauuuuguauuuuuaguagagacgggguuccacuauguugcucaggcuggucucaaacuccugagcccaagcaaugaccccaccucagccccucaaagugcugggauuacaggcaugagccaccaugccuggcccuuuccucuugcauucuuuuguguccagcgcuuccccuguugucuuagugagaugcaagaaguaaagcccccuguccccugacagcuuccccuuaaggauuucccagcccuaggaagaagacauuuggcaacauuagucaggaagugccuuucuggauagaaaagucuacugagaaaguauucagacugaccagaggaaaggcagaggauggggaagagcuggcuggaaguaaacuacguagaggaguggccagagcucuuucucuggagucagaucugaguccuagcucuggugcuuuguagccaugggauccugggcaaguuucuugaucucuauuagccucaggguugcucgucuagaaaaugggaauaagaauaacacacgagagaggcuuggugugagaucaaaaaagcaccaagcacagugccuggcaaggaaagugcucagcuuaagcuacuggcuuaaaguuguaaagaggagagcaagaggaagggauccaggugauggaguggaggggcaggagcccugacacagucaugaacaucagggaaguaggggucagggguuggcagugggcaagccaggacaccagaagagguggagaaaaguaagaagagagaaaaguugagaugaagccgacagaugcuuaaacagcaugcacuucugggaccuuaguagagucuguuuccauuugauuuagaagucugauucugcuagcauggcagugcuuaaaagaagccugagguauaaaguauagggggcaaagggcaccagaucccaggaagugugauugaaccagaugucacgcaggugagcgucugugucugucacuguucuuggauuuagagcauuaaaagaagaccccuuucggccuuugaucaggucuugacaaguuccugcuuuuugcccgaaggauggacauccgucgaaucagcuuugacacagaggaccugucugaugaugucaucccacuggcugacgugcgcagugcuguggcccuugacugggacucccgggaugaccacguguacuggacagaugucagcacugauaccaucagcagggccaagugggauggaacaggacaggagguagggcccagcguggggagguugaaggguggaauccacccucuccagggaagggcuucccauaccuuugccaaccuugagaauugguggaguuugggcuccagaacuagaguggaaguacaguuggugauacagcuuugcuuccugcccaggugguaguggauaccaguuuggagagcccagcuggccuggccauugauugggucaccaacaaacuguacuggacagaugcagguaugcauaggggagccguggccugccuggcucccugggauuccucuuguuuaaaacccuggccucagauagaaggagcccagugucucuccuggaccacuucugucuucacuucaaguccuugguaggucagaagccggagggcugcugcagagccgaagugagaagcucccacgugagaagcucacauuguggcagcugcuucugcuguguagcugaugcuggggaguguuuuaaggcauuucagaucaugaaccuaugccuuguuuucuuuccaucgcuuucuggguaaaucagccuuuuuuuuuuuuuuuuuuugaggcggagucuugcucugucgccaggcuggagugcaguggugcgaucucggcucacugcaagcuccgccucccggguucaugcuguuuucuccugccucagccucccaaguagcugggacuacaggcgugcaccaccaugcccggcuaaguuuuuguauuuuaguagagacgggguuucaccauguuggccaggauggucuugaucuccugaccuggugauccacccgccuuagccucccaaagugcugggauuacaggugugagccaccgcgccuagccaaaucaggcauuuuuaauuagccagguggguuugggaggcaaggggauacccugaacaagugcuacucagagcgugguugcuggaccacagaggcugaugacaaccuugccuccucugcguggcagcaucagcaucaucugggaaguuguuggacaugcagauucuugggccccacccuagacuuacugaaucagggcugggcaugguggcucacaccuauaauccuagcgcuuugggggaccagggcaagaucucuugagcuuaggaguucaagaucagccugggaaauauagcaagacccccacacgcauacacacauccccaauuuuuuuuuuuaauuagccugguguaauggcacauaccuguagucccagcuacuugggaggcugaagugggaggauugcuugaauccgggaguucaaggcugcagugagccaugaucacaccacugcaugccaaucuaggcaacagagcaagagccugucuccaaaaaacaaaagucaagacuuacugaaucagaaucuuuggggguuagugagcaugaaauggacuagaauuuuuuuuucuuuuuuaaauuuugagauggagucucgcucugcugcccaggcuggagugcagcggcgcaaucucagcucacugcaaccuccaccucccuggguucaaaggauucuucugccucagccucccgaguagcugggauuacaggcgugcacuaccacacccagcuaauuuuuuuuuuuuuuuuuuuuuuuuugagacggagucucacucugucccccaggcuggagugcuguggcacgaucucggcucacugcaagcuccgccucccagguucacgccauucuccugccucagccucccaaguagcugggacuacaggugcccgccacgacgccuggcuaauuuuuuguauuuuuuaguagagacgggguuucaccauguuagccaggauggucucgaucuccuaaucucgugauccacccgccucggccucccaaacugcugggauuacaggugugagccacugcgcccggccaauuuuuguauuuuuaguagagacgggguuuuaccauguuggucaggcuggucuugaacuccugaccucaugauccacuugccucggccucucaaagugcugggauuacaggcgugagccaccacgcccggcugaauauuuuuauuuuaaaaaaaaucuuuggguguuagguucagaaaucuguguuuuaacaagcucuccugauucuuacgcacacuaaaguuugagaaucaucgccuuaaauuaugguugccuauguuugggaagucuugcucuuucaagaaauccaacugaucacauccuugaauuucuucuugcaguucaagucacuaaauuuccguugugcaucugucacaaaauaucuuuugagccccuacucugugcucugcuggcgcauaccaggcucuuguguuggccauggaagguaagagggugaaugaacaagacuagaauuaaucucuguaucccuucuugauagguacagaccggauugaaguagccaacacagauggcagcaugagaacaguacucaucugggagaaccuugaucguccucgggacaucgugguggaacccaugggcgggugaguggcugccccuugggaaugagcuccauccaccccucccaagaucugagcuccagagaggagucuaaagauuaggaagagugaccagaucuuauggauaugcccaaggaagcaagagcagcuguagaaaccagaggcugguugccaagaccagcucugucggggagacccuaacccaguggugcuagaggaauuaaagauacacacacagaacuauagaggugugaaguaagaaaucaggggucucacagccuucagaacugagagcccccaacagagauuuacccacauauuuauuaacagcaagccagucauuagcauuguuucuauagauauuaacuaaaaguaucccuuaugggaaaugaaggggugggccgaauuaaagaaauagguugggcuaguuaaaugcagcaggagcauguccuaaggcacagauagcucaugcuauuguuuauggcuuaaaaaugccuuuaagcaguuuuccugcccugggcaggccagguguuccuugcccucauucggguaaacccacaaccuuccagugugggcguuauggccaucaugaacaugucacagugcugcagagauuuugcuuauggccaguuuugggggccaguuuauggccaaauuuuggggggcuuguucccaacagcuggugacaacuuuguauucucuguggacaaggaaacuuuucaauucuuucuuuccuuaucuuuuuuuuauuguugguuuacuugcaaaaguaacucauuguuaaaaaaauuuaaaucuguagaaaguaaaaauucucugugaucucacucuccagcaauaaguuaacaguucaggauauuuuuuuccagguuuucuucuaaauguauguaaacauuuguuguugguggugaugguuuugguuuuacaaaaauagcauacuuuuugugacuuuuuuucugcuugcccuuauaucuugugugucuuuccaguugaguguauagaucuaccuuguuuuuguuguuguuguuuguuuguuuugagacagggucuugcucuguggcccaggauggagugcaguggugcaaaucacggcucacugcagccucaaccuccugggcucaagcaauccuccugccucagccucccaaguagcugggacugcaggcacagaccacaaugccuagcuaauuuuuacaguuuuuuuuuguagagauggggucuugcuauguugucuaggcuggugucaaacuucugagcuaaagcaaucguccugcuucagccucccaaaguguugggauuacaggugugagccacugcaccuggccuauguuguucuuacugguuuuauagaguucuguuaacuuauuuaacccauccagucaagaaacauuucucuuuuuguuuuuuucuuuuuuuuuugaaacagagucucacuuguugcccaggcuggagugcaguggcccagucauggcucacugcagccuugaccuccuggauucaaaugauccuccuaucucagccucucaaguagcugggaccacagaugugcaccaccauaucuggcccuuuuuuuuugguagagaugggauccuacuauguugcccaggcuggucucaaacuucugggcucaagugauacucucagccucccaaagugcugagauuauaggcaugaaccauggcgccuggccaaggaaauguuucuuauucauuuucaccccuccucuuucuuuauucccauguacacuuuauuuguggaguuuugcuuaagcugugggcucugcuuuuauuaagacucuguaccuuuugauaguaauagaagacaaggcauucagagauagugcugagcccagagcugggcuggacacugaugcaggaggcugaggcugaugaggaucugcuucaggcagaaacccugaaauccuagguacucugagucccugcuggauauuaacuagcuuguaagaccugccuugccuugccuuugcccagguacauguauuggacugacuggggugcgagccccaagauugaacgagcuggcauggaugccucaggccgccaagucauuaucucuucuaaucugaccuggccuaauggguuagcuauugauuaugggucccagcgucuauacugggcugacgccggcaugaagacaauugaauuugcuggacuggauggcaguaagaggaagguaaggguggcaguaagaggaagguaaggguggcacuaaaacaucuucccacagccuugacagccuccaggacaguacuuuuuggcuggcagcugauuggagauaaggggaucuggagguuaugggaccagcauggggcaugugcuguuucucugaggcuguaggugcuguccagagcuugggggcaggggugggaaagggcugcugguugaugaugaaaagaaacuagggacuuguguggauugugagcuggggguguaaaugcacagaauuuccuguuaaccagcacaacuaaugcuuguuaaauuaccaguugcacugugggccugugauucaucucuuuuuguuuuuguuuugguauaauuucaaacuuacagaaaaguugcaagaacagguaaaaagaauaaauaaaauuuugccacauuugcuuuaucauucuguuucuguacacacucacuauuauuuuuuggaacugucugaaauuagaguggagacagccugcccuugacuccagacuauuccugugcacauuuccuaaaagcaaggauguugucuuacaucaccacaguacaaugaucaaaaucaggaaaucuaacauugauccaauauuacugucuuuuuuuuuuuuuuuuuuuuuuuuuuugguuuuuuagaggcagggucaugcugugucacccaggcuggagugcaguggcacaauauugggucacugcacccucgaccuacuaggauccugaguagcugagacuacacgcaugagccauaacgccuggcuaguuuuuuucuuuuuuuuugguagagacuuccuguauuacccaggcuagucucaaacuucuggccucaaacgauccuucugccucagccucccaaaguguugggauuauaggcacgagccaccaugcccggcccaauauuacugucuaaucauaguccuugcccaauuucacuaccaauugccucagugauguccuuuauagcuccucccaccccacuuuuuuucuuuguuaaucuaggauccaaucaggaucacccauuguguuuaguaauuacgucucuuuuaauuuuuauuuauuuauuuauuuuuagacacucacuccguggcccaggcaggaguguagugccacaaacauggcccacuguaacugcgaccuccuggcccaagggauccucccacguagcugggaccacaggcaccuacuacugcacccuagcuacucaggagccuacggguuugaggccacucggcugauuuuuuuauuuuuuguagagaugggggucucacuuuguugucuaggcuagucuugaacuccuaggcucaagcaauccuccugcuuugaccucccaaaguguuggguuuauaggcaugagccaccacacauagcuuuuuuuuuuuuuuuuuuugagacugcagucuugguguguugcccaugcugaccugggcucaggugauccucccaucugaggcuccugaguagcuggagcugugcgccaccgggcccaacuaaucuagucucuuuacucucuaaucuggaacauuuccucagcuuuucugugacuuuauugacauuugcauuuuuuguuuguuuguuuuguuuugagacaagagucuugcucugucgcccagacuggcgugcaauggugcgaucucagcucacugcaaucucugucucccggguucaagcaauucuccugccucagccucccaaguagcugggauuauaggcacccgcuaccacgcccagcuaauuuuuguauuuuuaguagagacaggguuucgccauguuggccaggcuagucucgaacuccugaccucaggugaucugcccaccuggaccucccaaaguggacauuugcauuuuuaaagaguaaaggccaguuauuuuuuauaaugucucucaacuuggauuuaucuaauguuuccuugugauuggauucagagugugcauuugcagcaggaauacuacacuaagugaagucauguccuugaguucucagugugucucaucaguagacacagguguuggccuguuccguuauugugauacuuacugccauuguaugguuaagguaguguccacuguaaaguugcuauuuuuuaauuuuguacuuaauaaguaauuuguccagagauacuuugagaugaugugaguaauagaugacuuccaacaucuuccaauaaaaccaucacacgacccuuagagccaggcaugaucaagucacagauugauagagcaaggcucagagagauuuuauaaguagcucuuacuggaggucacccaguagguguuagugggagagcugcuuucugaguccacagugagcucuuugccacugcucuguacugucagacuuuguugaagaugacacaguguuggggcccuggcaggugcugauuggaagccagcucccccacccauuugggcugacccucuauggagagcgcaucuauuggacugacuggcagaccaagagcauacagagcgcugaccggcugacagggcuggaccgggagacucugcaggagaaccuggaaaaccuaauggacauccaugucuuccaccgccgccggcccccaggugagcagcccuuggcucgcauuggcuucuccguggcccuccuaugcccuagcucuccccauugaacauccccuccucucuacccagugucuacaccaugugcuauggagaauggcggcuguagccaccugugucuuagguccccaaauccaagcggauucagcuguaccugccccacaggcaucaaccugcugucugauggcaagaccugcucaccaggugagugaaagcaucacagaucuagaugcagccucucugggagggggcaauggcucucuuccuuccuugcagaugggcuccaauguggucugagaaaccaugaguccugcugcuucuagaggcccaggggagagacucacggcuuuuagaaaaggggacgggccuggggagaggcccuggggagcaaguagaaaggacuggaggcaggguccaacuaguucuuaugaugucuucaugcauauuagauaaagaugcuccuuucucaagacacuuuccucucaucucuuaguacauugucauaauauacugauuugguuggaauaagacacuucuggcugggcacgguggcucaugccuguaauccuagcacuuugggaggccaaggcaggcaaaucacuagaggucaggaguucaagaccaaccuggccaacauggugaaaccucgucucuacugaaaauacaaaaauuagccaggcaugguggcgcguaaucccagcuacuugggaggcuaaggcagaagaauugcuugaaccugggaggugaagguugcagugagcagagaucacgccacugcacuccagccugggugacagagugagacucugucucaaaaaaaaaaaaaaaaaaaaaaagacacuucuaacugcccaaaauugguauaauaaaaacagaaauguaugauaucuacaaugucacaguacccuccuccuuagaugugccacuuuugugagugcacaaccuaugugacaaccuuauuggagggucccagaagcaguaccuggcuacccagaugucggaagucaaggcuucucccuaggagaugcugcaggguaggcugcauuugaacucuaaccucccugggaauuugagugagaaaggagcugugaacugugccucucagguugugaguaaagcccccuggggucccuuuauucccuuucuuuuuuucucuuucuuaaucuucaugguaaaggguccuucaaagagagccacuuucauaauauuaauaaagaggcauuauuuaugaauaugugugagaccuaaugguaagugcuuuauguacaugaucuuuuaacccuuacagccaccccauuauuguccccauuuuauagauaagaaaacugaggccuaauaauuuaagcugagaguaguggcucaugccuguaaucccagcacuuuaggaggcugaggugggcagaggcuugagcccaggaguuucagaccagccugggcaauaugacgaaaccccaucucuacaaaaaaauacaaaaauuagcugggcaugguggugugugccuguagucccagcuacucagggggcugaggugggaggaucgcuugagcucaggaggucaaggcugcaguaagccaugaucaugccagugcacuccagccugggcgacacagcaagacccugucucaaaaaauaauaauaauuuaaauaacuugccuagaauaacauagcuagaaacuagcagggacagggcaugaguuucaguuugccugauuccaaauccauuuaauggcugugcucgagugauccucuucccuccucuccaccuggcaggcaugaacaguuuccucaucuucgccaggaggauagacauucgcauggucucccuggacaucccuuauuuugcugauguggugguaccaaucaacauuaccaugaagaacaccauugccauuggaguagacccccaggaaggucuguauggcccucucuucccaccuggccuucugucccugcccuucaacaauuacugucuuuccucucccaccaccuuugucuccugccaagagccaggguguuuguuccccauucccucuggcauagccccugucccugucucucuagcacucucucuuugguugugagagcaugguuuggggcccucuucucuccgucucugccaagagcuauccugcuaugauauuucugcguuuuccuugauuuccucugcuagaggcuccagagcucucugacaugcucugguguuucaagacaugaaucagcugugugugucccauuguaggcggugagggucuagguugagccaagcuuucccucuccaggaaagguguacuggucugacagcacacugcacaggaucagucgugccaaucuggauggcucacagcaugaggacaucaucaccacaggugggccuuccuccuagcccagggaccaccugucuggcaacagggcuggggaaauagcccaucuguuuuaaaauaggagccagugugcucuuuugacuucccacagggcuacagaccacagaugggcucgcgguugaugccauuggccggaaaguauacuggacagacacgggaacaaaccggauugaagugggcaaccuggacggguccaugcggaaaguguugguguggcagaaccuugacaguccccgggccaucguacuguaccaugagauggggugagagcuggcuguaucgcacuggguaguguggggggccagcucagcugggguuaugacgggguaaagguggguaguggagaggaagcuugcaucacagaaacaaggugaccucccuggggcucuuccacucucuugugacuucucgcagggugacaguacaguguagaaguuaaaagcaugagccuugaaucagaauaccaggauugaaauguuuucaucauguauuagcuauaucacuuggguccgguauuuaaccucucuaauucucagcuuccuuaccuauuaaauggaggugguagugaaaauacauaccuuguggcccuuaugaagguugagauaaugcacaugaaguauuuugcaaaguacuuugucaagcaaaaauuuugccugacauacuguaaguacucaaguguaucugacauacuguuaaguauucaugguaugugguagcugcuggaauaacuagcuaauauagcuaauauucuuccucacucagguuuauguacuggacagacuggggggagaaugccaaguuagagcgguccggaauggauggcucagaccgcgcggugcucaucaacaacaaccuaggauggcccaauggacugacuguggacaaggccagcucccaacugcuaugggccgaugcccacaccgaggugagagccgugucccugcugcuucccaggagccugggaagaugggaaaggccugccuaggaucuccauggagaguucccaaucugcugaucaccaccccccacccucuccuuccucugcagcgaauugaggcugcugaccugaauggugccaaucggcauacauuggugucaccggugcagcacccauauggccucacccugcucgacuccuauaucuacuggacugacuggcagacucggagcauccaccgugcugacaaggguacuggcagcaaugucauccucgugagguccaaccugccaggccucauggacaugcaggcuguggaccgggcacagccacuaggugagagucagagggcuggggcugugagucagagccucuggcuuucuggggccaucucaacaucagagauauauccagagcacagagcuccuuuacagccagaaagacggugaccuguuuaagcucccuuccagauugggcuguguucucucuggguauggcugguacuacagcugucaccuucaaaggacuccuggagauccuccugcagacccuccuucuaccucacccugccaggcacugaauccugucacuuagaacagcaaagagccagccacaaacaacugggaccuuuguaagauucagaugauguuccaggcuaggugugaauacuugugcuucucaucaccagguuuuaacaagugcggcucgagaaauggcggcugcucccaccucugcuugccucggccuucuggcuucuccugugccugccccacuggcauccagcugaagggagaugggaagaccugugaucccucuccugagaccuaccugcucuucuccagccguggcuccauccggcguaucucacuggacaccagugaccacaccgaugugcaugucccuguuccugagcucaacaaugucaucucccuggacuaugacagcguggauggaaaggucuauuacacagauguguuccuggauguuaucagguaugagcaacacugaaaccuccagaagacacagauuugcuucuggucgcccaugggugagguuguguucugaccacuaaauggaugagugauuuggcacuuuggauagugaguuuuaauccugacuuguucacuuuguaguguugucacuuacagcagaguuucaaacuuucauuuguuuagagauuauauggaagccuaguauguaaaacaaacaacaacaacaaaaaaaacagguaaagucaggggaccuggagacuuucacaucuaccauugugcccugagggagcuccaagaauccccuaggacuuacugaugaguaggccauauaaccaguaucuguauugcaguaaaggagccccaaucaaaugccaagucuuauggugguuuacaaagcuguuguuuuuuauuuuuucguuguuuuauuuuuagucuuuaaauuuguggcccuaacacagcuuaggaauaugauguccugccaccaguaagagugguuuaccauggcagauauucucacauggaggaacagggaacauuccccuuugcucuccccaagggauguauuagaaucucaaacuggggacagguaggcauauacaguuuagggaaguccccuaggugacagugacaugcuccccauucugagguagaguucccuccugcccauagggccuuugcaaaagugcacaauuagggucuggcgugguagcucgcgccuauaaucccagcacuuugggaggccaaggcgggaagauugcuugagcccaggaguucaagaccagccuaggcaacauaaugaaaccucauaucuacuuguauuuaaaauuguuuuuaacuuuuaaaaaaugcacagguugguuuugacaaaucugcguuucuuaucaucaccaccuagcaauccuugucucuucccaaagguauguggggaaugauaaacuugucuucuagcaagacauccccuggcaaccgccacuauguccaguuagcaggaaauacuguguccuccuaagaacugguuccuucauucugcaauuauuuuauugaacaucuaucaugcugggugcugaggaauguacucauagauaccuggucucuaucccuguggagcuuacaguucagugggguccaguuaugggaacauggguuaaaguucuacucuauucugggucagucugguugcucauccaacacugggcucuccccaaggcgagcagaccugaacggcagcaacauggagacagugaucgggcgagggcugaagaccacugacgggcuggcaguggacuggguggccaggaaccuguacuggacagacacaggucgaaauaccauugaggcguccaggcuggaugguuccugccgcaaaguacugaucaacaauagccuggaugagccccgggccauugcuguuuuccccaggaagggguaaguuuauggccagcagaagagagauccagggaagaagggcuggguggaaagaugguguuaguggguccucuguguucucucaaccucugggugcugucuucccaugccuugaugaugauggcacuguugugucucagguaccucuucuggacagacuggggccacauugccaagaucgaacgggcaaacuuggaugguucugagcggaagguccucaucaacacagaccuggguuggcccaauggccuuacccuggacuaugauacccgcaggugggagucuugcaucaaacagccuccuggaaaucgggugggcagaagagagaaugguugagauuaaccuuggaaaaaugaaaagauagaaagcuucuugguauguggggaagaggaaucauugagaaggauaagggaauauauucuuagagcagcgauugcuaaauccagcccucaacccuuauguggguuuuguuuggcugguuuacauguuccuaauuugagugccuuuggcagagcaugucuucuggcuggaccacaggucucacaccccuacucauuuaagggcugauucuuauauuuguuauaauauaacaaauccugaucccuucaggcucuggaacuuuguuguuguugagacagcaucuugcucuguugcccaggcuggagugcaguggcgcagucacagcucucugcagccugaaccucccuggcucaagccaucuucuuaccucagccucucaaguagcagggacuauaggcacaugccaccaugcccagcuaauuucuaaauuuuuuguagagacagcaucucgcuauguugcccaggcuggucucgaacuccuggacucaagcaauccuacugccuuggcuucccaaagugcugggauuucaggcaugagccaccacgcccgacccaggcuccggaauguacaacuccuugucuagauaagaaaugcuaagggcagggggaaggggcucuaaagcagucugugcccccuucugauccaaaagaaggggaagggaauccaagacuucuggaaaggugguagaaugccuucuucuuuuaaccucagcaagguccauguagacugggcucacuuccuuuuuuguuguuguuguugagacagagucuaacucuuuugcccaggcuggagugcagucgcacgaucucggcucacugcaaccuccgccuccuggguuuaagccauucucgugccgcagccucccaaguagcuaggauuacaggcacgugucaccacgccuggcuaauuuuuguauuuuagcagagacgggguuucaccauguuggccaggcugaucucgaacuccugaccucaagugaucccccgccucggccucccaaagugcugggauuacaagcgugagccaccaugcccggccgagugagcucucuucuuaaagaccauuuguaagaaauugggcuuugauuauuggguaggagucaaagggcaaucaaauuccugaagaugaggcuggguggugguuccucugaggucacuagacuuucuaugccuccccagagcagcccugaccuccccacucaugaaccaccagcucccuucuucagcuuugggacucacaaugaccccucaucgagggugcuucuugaguucucauagcaucugccagucagcucaggaggggacaaacagguucauagggggaagagcugggcucccuggcaagcguuuggagcagccacucuuuucauuuucuucgcaggaucuacuggguggaugcgcaucuggaccggaucgagagugcugaccucaaugggaaacugcggcaggucuuggucagccaugugucccaccccuuugcccucacacagguacuggcucaggagagagguaacuaaaccuccuugacugggauguuucuuugggguucuaagucagcagucucagcuauagcugcuacugaacagacgugcuauugcagcucauuuuagggauuuuuccugugcccugaagccuugguagguugguagggccaccgagugccuugcuacucuuauccugccauucccauguucuagcauucaaaggaguggcucucaaagagugguauacagaauccgauauggugcuuguuaaaaugcagguuccuaggcccugacuauagagauuauagagaagcugcuucaugagggcugggcacaguaaaauacauuuugacaaguuccccaguuaauccuaaugcugcggucccagcaucugggcauagggagcucacuuaguggcaacaggguggaguggcuaaaagccagaguuuugaggcaucuagccaguuuguaaguauuuaaugaguaccaucaauuugccagguaccuggauucaaguucuaucuguauuauuaaauaacuguguaacuuugaacuagagugacugaaccucucucagcuucaguuaucuauaaaauaaaucagccuaauaauaguauccuccugaaauagacacaaagcauuagcauaguaccuggcacacaguaagcaccacauacauguuaucgcuacccauuuuaauuauuauuagcugucacuuuugaguucuaacacaaaaaauaauuugggccaggaaaagaagaucuaccaagccugaggccaacaggaauucucgaucauuuaaaaaucuuggccagguguaguggcuuaugccuguaaucacagcacucuggcugaggccagaguaucacuugagcccaagaguuugagaccagacugggcaacauggcgagacccuaucucuauaaaauuuuuuguuaaauuagccaggugugcugguacacaccuguagucucagcuacucaggaggcugaggcaggaggaucgcuugagcccaggaggucgagcugcagugagcuacauuuguaccacugugcuccaacuugggcaacagagcaagaugcuaucucagagaggagagucagagaaagagagacagaaaggaaagaagaaaggaaagaaaagaaagagaaauaaauuugacccuuuuuugccaaauauugucaacucugucuguauucuauauuaugucccacuagccaaaaagcauuuuuuuuguuuguuuuguuguuguuguuguuuuuaagauggagucuugcugugucgcccaggcuggagugcgguggugugaucucagcucacugcaaccuccgcuuccuagauucaagcaauucuccugccucagccucccgaguaggugggauuacaggcaugugccaccacaccuggugaauuuuuuuuuuuuuugagauggagucucgcucugucacccaggcuggagugcaguggugcgaucuuggcucacuacaacccccaccuccuggguucaagugacucuccugccucagccuccugaguagcugggauuacaggugcgugccaccauacccagcuaauuuuuguauuuuuaguagagacaggguuucaccauguuggucaggcugguuucgaacuccugaccucaugaucgcccaccuuggccucccaaagugcugggauuacaggcaugagccaccgcaccuggccuagccaaaaagauuuuaucugguuuuacuuaaugauagucuuuuuuuuucauauucuaaauguaaaacuacaggguacuacugcauauagguuuuucagucuacagguuuccccacaguuucugauauauacccuuggaugaggaugagaacaccuucauugccccucccuccccuugauugagaauuucaccaucauugcuuuagaagaaagcugccuacagaaguaaagagaggauuuggggcagugcucugagcaaagggcccagaggaacaggaaccuauaagaaccuucaaauuuccuccuauuugcuagagagggagucauucaaucaacuaaauggggacugaguguuaggugcuagaauucagagaugaauagaacacauucuuguccuugaagaacuaaacugguaggauggacagaccaguaaacaaauugcuugaguguaaaaauguacuugggcaagugacuauaaggugcagaacuguauagaggagagaauggugaagucuauauggauuuggggagauuuccuugacaaugucaugucuguugaugcacagaaaugaggaagagaugaagagggcauuucagcagaggcaguggcacauggugaggcacagaagcuguacaggaaggagucugcuugcugaauaauauuuacuguuuuugggcuuccccuguugaguagcaagacagguggaucuacuggacagacuggcagaccaagucaauccagcguguugacaaauacucaggccggaacaaggagacagugcuggcaaauguggaaggacucauggauaucaucgugguuuccccucagcggcagacaggugggcucccggguacugagccugcuuccuuaacaucugugggauuggucggucaacccaaggacuguuagggaccaagacaguuagggccacaagagagcuucuugguucacauuuuaaacgcuuagaacuuuuuacucccucgcgguuguaucucuccuccuccccugucccugggaguaggguaauccuggauuuccucuguuuuugagaagccuuaaauugggagaccugauucugucccagauaagacauucaucuacuuugccuccagggaccaaugccuguggugugaacaaugguggcugcacccaccucugcuuugccagagccucggacuucguaugugccuguccugacgaaccugauagccggcccugcucccuuggugaguuggacuguauggcuggagccacucggcagagccccuggaagggcugagagucagcagccucugauacuggucugaucuguccuucugggugggauccccauaaagaaggucuuauuaguggagugauugguagcagucugcuuggguuuugggaauugcucaaaccuggguuugucugcccucuggcauuugcaggaacagaauucaggucucuugauucccaggucccugcugugggauaaucaguggccugugcaucacucucucuuccugacuggugagccagcugucccauccagagcuauuauuauugaauccaacuccuuuuuauugauaguauuaagaagggcuacuaaugaaggugccugggacuagggcagcuaaaagauuguuuugucaaguucuccagcugcuacucuugggccauauguagauguuuaugguuccaguggcccacuccaauccucuuuuuugucuagugccuggccugguaccaccagcuccuagggcuacuggcaugagugaaaagagcccagugcuacccaacacaccaccuaccaccuuguauucuucaaccacccggacccgcacgucucuggaggagguggaaggaagguaaauagguucaaugcaggaucaugggcccuuugauucaaaucaccaucccaugaccaacucauagucccagcuugauaaggcaguugggagauagauuaugucaggagcuaccagucccuguuauuugggacagaaggugauauucagacuuguagauuguuacaagugauucccuuuuuagcucugagggcaagaagcuuuaagaacaacuuuaaggcugggugugguggcucacgccuguaaucccagcacuuugggaggcugaggcggguggaucacuugaggucgggaguuggagaccagccugcccaacauggagaaaccccguuuccacuaaaaauacaaaauuagcugagcgugguggcacaugccuguaaucccagcuacucuggaggcugagacaggagaaucacuugaacccaggaggcggagguugcggugagccgagaucgcgccauuacacuccagccugggcaacaaagagcgaaacuccaucucaaaaacaaaacaaaacaaaauaaaacaacaaaaaaaagaacaacuuuaaacagaaaucacuuaggaggacccucccacgugguauuccuccuucuucucucugugacauuugcucucacaucauagguuuggcauauuggcuuguccaacaguagucucugggcuguggcuuuaugacuuggaacaaaaagguuuccccagagauaugauggccuuagcuuauaaugucaugugcacccccccgcaacacacacacacacacaaacaccauuaugaaauaagcaagcauaaacacgaacaguucucaaaucaaguauaaaguaucuuauuucauuaaauuaaaggugcuauucauuauaaaaugcuuccugauuugagaaauuaaacugaaaagauaaccaacagcaaaugugaaaugcuauugauuguaagucacaugccuguuuaagagaugguaggccauagaaaaaacaaacaucuuaaaauugauuaaauaugauguuacauucaauucagagacauucuuuuuuuucuuuuuucuuuuuuuuucuugagacaggaucucacucugucacccaggcuggagugcaguagcaugaacacagcucaagcucacugcacccucgaccuccugguuucaugugauccuccuacuucagccacccagguagccgggacuauaaaugugugccacuaugccuggcuaauuuuuuguacuuuuuguagagauggggcuucaccauguugcccaggcugguuuuaaacuucugggcucaagugauccacccgccuaggcaucccaaagugcuggcauuacagaugugagacacugcaccuggcaaaaaauucuaaugacuguguuuuccauuuauauuuuauaaaaaauaaucugggccaggcgcaguggcucauaccuguaaucccagcacuuugggaggccaaggugggcagaucacaugaguccaggaauucaagacaagccuggguaacauagugagauccuaucucuacaaaaaaguuuuuuuuuaauuagccaggcaugguggcccaugccuguagucccagcuacuugggaggcugagguugggaggauugcuugagcccagguuuaggcugcagugagcugugauugugccacugcacaccagccugggugacagacugagacccugucucaaaaaaaaaacaaaaaacaaaaaauaaauaaauaaauaaucuggaaauacauaugugaauaaagaagaagggaauauccuauaccuauauauaauuuacucuuaauguuuugaugucuaucuuuucuagacauuuuucuaauuagaacaguuuuuuuuuuuuuccacugcaacauacuggucucuuuauuuuuaauaucaucaguagcuuacaagguaguuaacacuugauuucaauucugaaagcagaaacauaauaaugaucccaaauaaaaacuuuagacucaaugucccuaaaguuacaagauuugcacaugaucaaauucauaugcugugugcccccauucucuguuuuuacuacaguuuguaaagaaaaggaaacacccagguauaaacaugugccuuucucacuaacuuuuaaguacuaucagucauuauuacucucggauuuucuuuagguuuauuuagaaaacuuuugaccccgcucggaccuuuucuuauugucagaguucuauuugaaaauucagugcaucuugguuccaaaugcucuugcaaguagcuuuccucuggcuguuuaggagaugccuuugauugccugcucauaauguaccacaaagaagucaccuucugagcauuucaaguuaguuaucugagcacucccucuggaugucuugcauauucccuugugaaagaaugaagagaagaaaaacauuuuuugaccuugggauauuuagcucuugugauaauuuuuauccaaucagauuggcuuggcuagcagcugcuucugacucauccugguaguuuaagaaagccuaauauugauguccuuaguauucuuucugcagacuuccaacucacucccaaaccugcuucucauuuuuaaagguacauauuuuauaacacacuuaaacaugguauaacggcuugaaaacagugccuugcacggauuucucuccauuuccuguuguugcccucuccaugcuucugaugucuuccaucuuguacauucucauaccugaaagcccccacuuacaggccuuucccccuuuccuggaggaaggcaugaccuucacugaguaugaguaggcuucacauccaguuuucugugccccacagaugcucugaaagggaugccaggcugggccucugugcacguuccaaugacgcuguuccugcugcuccagguaagcccugaguaccccacuguuccggaaaagaagauguaaugaaucuaagucuccacugauaucuuucauaaccuucauugggacucugggguugaugaacucuuuuuaaacuaaguccauagaaauaauaaucauaauagcucucaccacuuacagugacagcuuaugguaugcuuuccguaugccaggcaugugauaagccauauauaugccacauuauaugugugugcacaugcauauauacauacucucauguaauuuccuccaguccuaugagcaauuuauuauuuacauuuaacuaaagagaaaauguaggcuuacaaguuaagcaucuugccuuaugucagauagcuaggaaguggucgaaaugggaucagagaugcuggcagagugacagauuucuucucagccuccucccugcaccucccauuuaccuaucugaaaaggaggcccuuagccauccucagaugguaugggguccaacaccuacaaaaggagccuuucagcuuuccauuccucacaccagcaccgcuagaaaguugucgguggccccugccuaguguuucucuauucuuccuaggggaaggacuucauaucagcuacgccauugguggacuccucaguauucugcugauuuugguggugauugcagcuuugaugcuguacagguaacuucagucuugcuacaggggccacaugcucauuggucuucaugagcaugucugggaucucccgaagcucugcaguucacugaaucaagcucugaccagccuuauugcaagguugggugccuggucagggcagcagaaggaaaggguggaaaccuaaauacuuacucuucuccagucacagccuaagcauuuuccuuauugaaugacuguaacaacccuucggauuuucuuuauagacuaggaugcugagugcacagaggauauuacccaaggucacaaaguaagaggcaaaucuaagacugacucuuaacaucuuugcuuuuuccaguacucccugcuucaaaccacugaaauuggaaaugauuuuccccuuauacaaacacagccuuuuacuacaauauugguuuguacaucuuugcucaguagcaaucauucuggaaagguagaaugugucauuuauaaucuuuuuaugucccucuuucuuuauauuuucccccaaaugcuuuaaacguagcuuacaguuugcugcuguuguucuucaucaucaucaucguaacaguuaccauuaauggauauauaucaaugucaugacaaccucguaacacagguauuauuauuccucacuuuacagaugaggaucugaggcucagaaaguuuauuuuuuuuaauuuuugucuuauuuuuuugagauagagucucacucuguugcccaggcuggagugcaguggugcaaucuuggcucucugcaaccucugccuccuggauucaagcaauucuugugccucagccucccaaguagcuagaacuacaagcaugcaccaccaugcccagcuaauuuuuuuuuuuuuuuuuuuuuuuuuguauuuuuaguagagagaggguuucuuccauguuggucaggcuggucucgaacuccuggccuugugugaucugcccaccucagccucucuaagugccaagauuacaggugugagccaccgcacccagccagagaguuuagauuauaucuaucaaggucccagcuaauaaaucacagagguggaauugaaacagaucugucugacucuaaagcucagugcaucaguucuccauugcugcauaacaaauuacccgaaaacuuagugacuuaaaaugacaaccauuaucucacaguuucuaugggucagaaaucuggaugcagcuuagcuaggugccucugccucaaggugucucacagacugcaauccagauaucagcugggguuacagucucaucucaagguuugaccggggaaggauccccuuccacacucacucacauaguuguugguaggauucagcuccucauaggcuguuggcuggaggccuuccucauuaguuucuugccuugugggccucuccauaggacaacuuacaacauggcagguugcuucucccagagcaagagcaaaagagaaugagggagggcaacucaagaccagaaccaguuucuugguaaccuaaucuaguagccaucacauuugcauaaucuuuucauuagaaguaagucaccagaacaguccacacucaaggggaggggauucuuaagggcaugaguaccaggaagugggagucacugggaucaucuuagaggcugccuaccagacucaguuuacagcuuucccagguaucauccccuuaaagaucucgacuaauuucucaucaccuucccuccuaaagacacaaaaaauccaaguucacugauccuggaauggggaaccucaccuacagcaaccccuccuaccgaacauccacacaggaagugaagauugaagcaauccccaaaccagccauguacaaccagcugugcuauaagaaagagguaaaaauugaaauuuauauucaagggucuuuuuggcgagguguggggagggauuuuacuccaaaugcccaaauaagucaguaacggcugcugaguaaucccaucuaccauuuuggaaguuauagugaacagaagaacugaauguaauuuggguuucugggaaguucuagaaucucugagggauuaguuugagggaccuuagugagagccagguuagaaggcagaucucagaagauuuaggucugaaagcaguugcccugccaugagauauuuuuccaagcuuauagguucuuucccuccaggaacugucauuccccugcaaaaggcuaugugcuucugaaacaagggagcucucccagacaacacccaaaaaacccaagagcuccuggacucgcccauuacuaaccuccaguccaagcuaguagcaccuaugguugggaauggcuuguuuuucacuauucuuccucuuaucacaaaaauuucucuagaauucugaagguuuaccugcuuuugcuuuuuuuuuuuuuuuuuuuuuuugagacagaguuucgcucuuguugcccaggcuggagugcaauggcacgaucucagcucacugcaaccuccaccucccggguucaagugauucuccugccucagccucccggguaacugggauuacaggcaugcgccaccaugcccggcuaauuuuguauuuuuaguagagacaggguuucuccauguugaccaggcuggucuugaacuccugaccucaggugauccaccugccucggccucccaaagugcugggauuacaggcgugagccacugcgcccagccugcuuuuguuuguuuguuuuuuuuuaacuucuuugucacuucaauggaaaauuauuugcucaaugugaaggcaugaaaaauagucccauuucaaugagcugguugugguggcuugugccuguagucccagcuacacaggaggcugagguaggaggaucacuugagcucaggaguuggaggcugcagugagcugugaucaugccacuacccuccagccugggugacaaugagacccugucucaaaaaaaaaaaaaaaaaaaaaagucccauuuccacaaggaaacuaacuauaccugguauuucagauuuuccuaauccaauauaagccuuguuuuuuuccuaaaauccuguaacucuucaucagaaguuauuccuuaugaagauccucaucagucuacuucuuuggccuaucuagcacagucagaaccugcucucacaccugcagggcucucauguguaauaaacacauuucacauaauaaucaugugcuuucuggauccaugaauucccguauuuaaauagcuuccacuacuucugguucaaguugguguuugaaaaaaaaaauugaaauuaaaaauuuuuuaaaagcuucuacugcagucaaaacagaaugugcagggauggcuuguaguucuaggaaugguagaccccuccccaauaucuuugagagaaagacucuugaagauucuuggguuccuggaguaucugaugcuccagaaaagaaccacaaugaaggccacaggauagcaaugaaaauagugugaccucuuucuucuguuguguguuucuuccucagcagcucuuucaccccucugauagucuuucaccuuuucucuucugauuuccucuugauuucagguaccuguugcuguguguuuguagagggagugguguuucccaaauugcaagugccauaucccccaccucucccuaacuuacccagcgugucucuuaauuaagacauugaguggucugcaucuuauacuaauuucaucuuggagggugugcugggugaacagacaucuguguguuugcuugugugcuaugucccacucugcauggcugaggggacugucacucucagagggcagggaccauguuuuauauuguauaaucaucaaagcaccuagcacagucuucugcuuaacauaggggcucaguaaauaucuguggaauugaauuguuacaaaaauagagccacagccacaguugcagaacucuuggcaggaauacuaucccagggacagaacccaagaugauccauuuucuucuagcaguggugguaugucgguugguauaccccagcagccaggagugaggcugcucuuugaagaagccauaaagggagaggcccgagcagaacuccaggcugugccuggaagagucccagguuuugcuugggaauggucccaggacucauggcagcagagcgagaguaaccucccaaaaaagguuauaaguugcaggaccccacuauauugacguuuaggacccagauaagaagauuuccuuuuuuuuaguuuuuuuucuuucuuucuuucuuuuuuuuuuuuuaauggaaucuugcucugucacccaggcuggagugcaguggcaugaucuuggcucacuguaaccucagccuccggaguucaagggauucuccugccucagccucccaaauagcugggauuacaggcacccgccaccaaacccagcugauuuuuguauuuuuaguagagaugggguuucaccauguuggccaggcuagucucgaacuccugaacucaagugaucugcccgccugggccucccaaagugcugggauuacagguguaagccaccacgcccggccagauaagaggauuuucuagaguccccugucuuaccucccaaguuuucuccuuaacaaaauuagaaaaaagagauacaaacuagcacccgaaguagcuuaaaauccugaauaaauguacauuuaauugcucuugccaauugcuuuugaugauuuauaucagcaugaugucccauuaauaaaccacaguaacaauguaacauagcuaacauguuauagugcaucuugugucaagcucccugauaacugcauuccauguaucaucucauuuaaggugacagcaguugguugugagguguggauacuguuacucuccucacacugcagagucuuaagagacugaguuuuagaaaugugaaauaauuugccuaaggugacaaagccagugaguggcugcugcaggaccggaagccaugguuuucccuccuccuguaugguaaugguaauaauuaucacagcugccucuccccuuuuaggcuaggccucauacacuugucuuaaucacauuuccccauuuguuugugggauuuuugugcgcuucacuccuacucuuaccccauccacuuccuuuuucaguuuaccaugggauccuuuguagaaggccaacugacugaccauaucugcccacucuccacccuagggagggccugaccauaacuacaccaaggagaagaucaagaucguagagggaaucugccuccugucuggggaugaugcugagugggaugaccucaagcaacugcgaagcucacgggggggccuccuccgggaucauguaugcaugaagacagacacgguguccauccaggccagcucuggcucccuggaugacacagagacggagcagcuguuacaggaagagcagucugaguguagcagcguccauacugcagccacuccagaaagacgaggcucucugccagacacgggcuggaaacaugaacgcaagcucuccucagagagccaggucuaaaugcccacauucucuucccugccugccuguuccuucuccuuuauggacgucuaguccuugugcucgcuuacaccgcaggccccgcuucugugugcuuguccuccuccuccucccaccccauaacuguuccuaagccuucaccggagcuguuuaccacgugaguccauaacuaccugugcacaagaaaugauggcacaucacgagaauuuagaccuggauuuuaccaugaaccucacaucuuguacuccauccugggcccccugaaacugcuuauucgugauuccucaccagcguagagcuccaccuccccuuuccccaguacccucagugccugcuucucagugcugaugcagcugaugacccaggacugcgcucugccccaucacagccagcaugacugcuucucugagagaacuugcccaucaggggcugggacauggggguguggguaaagacagggaugaaggauagaggcugagagaagaaggaagaaucagcccagcagguaugggcaucugggaaaccuccagccucaaguguguuaguaacaugaaaaagcuuugggggguaguuggaucugggugucugguccauugcuggcaguggacauuauucuugcccuaagagacacugccuuuucagcagcagauacuggugagauggggguggcucaggcuguucuuccuccuccuagaaugucuggagcuguuucuacauucagauaacuggguccccuaucacaaggcuacuggcuaauaggaauucccuccuggugccaccacuggccaguaccuuuccuaagucuuugcucaaauuaaccagguugugagccaguggcuugagugaauguuaggccuugggggcugagucucugaaaagucuaagaagcucugccuagaccaaauaugguauaccuccugaccccucucucccucauguccugggauucuggggaagagaccuagaaacaagcuuucaaagaaaaaccagaaguugucauaaauggucagaaagaacgaucagguuggagacuugggaaacccagggccuaaagagaaguauccaugagggucaaacuuccuguugaacuuccuauguucuuucucaagugcucagggaucuaaguuaguggacagcaagccuguggcuacgggguggugauguuccucuuccagcuguccccucagcuaaggggcuuaguuuccaugugggaugccaucacuugguucaugcucauucacacaaagggcacgugucucagccugguaucagggaaauugagacuuauuuuugcccuaaaacgucucccuagcuguucuucgugggguuuuuuuguuuguuuuuuugccuaauuugcuuuuucugaccaagccuuguggcaccagcaaucuccaaaguccuguggugggagggcugaauaaauaaaaauacaaagagguggguaaggaguaggaagguagagagcaccacugaugaggcccuccuagcccauggcagacccagaccucuucucccccaggaauuagaaguggcaggagagaacaacaggggcugggaauggaggggagaauuucuaggggaaguuuccugaguugaaacuucuccugugguuacugguauugagaaaucagcuaccaaagugaaaaaggacaagaucaauucuuuucuagucaguucuaagacugcuagagagagauaccaggcccuuagccuugcucucaguagcgucagccccaguucugagccuccccacauuacacuuaacaagcaguaaaggagugagcacuuuggguccuuagacucacgucuggggaggaagagcaaguagaaaaguggcauuuucuugauuggaaagggggaaggaucuuauugcacuugggcuguucagaauguagaaaggacauauuugaggaaguaucuauuugagcacugauuuacucuguaaaaagcaaaaucucucuguccuaaacuaauggaagcgauucucccaugcucauguguaaugguuuuaacguuacucacuggagagauuggacuuucuggaguuauuuaaccacuauguucaguauuuuaggacuuuaugauaauuuaauauaaauuuagcuuuucuuaaucac

SEQ ID NO: 13277 - RNA, 20339 nt, Homo sapiens
uaguucaacauuaacccagaggggucaggacagacaauuccucagugacccaggagcugacacacuauggcgcacguccgaggcuugcagcugccuggcugccuggcccuggcugcccuguguagccuugugcacagccagcaugguaagggagugcuugcaggcuggaacaggcuggaggacuggggugugggcccaugggcuggggucuccuggcuggacagagcacacagagcuggccccuaaguaggucucagccccaggcggccagcuuagggaagaagucaggagcucagggcuggaaagagaauggcugcuucucucuuccaauauagggagcaggcugggggcaaggggcaguguaggaggggcacagggggccacauuuagcagccuuccaggcacuuccaccagcccagacagccucucucagaagccagcaggggagggugggcuugcuucaugcccccagaauggccaagacugccuguuccugaggccgcugucccaugacccccccaccgccuuacaguguuccuggcuccucagcaagcacggucgcugcuccagcggguccggcgagccaacaccuucuuggaggaggugcgcaagggcaaccuggagcgagagugcguggaggagacgugcagcuacgaggaggccuucgaggcucuggaguccuccacggcuacggugagccugggcugcucggacggugccggggccucagaccgggcccaacucuagacacuuccacagagaagcaagcgaggaacgccacagccccuucgcugcucacagccucauuucaacucugagccccuccucacagggcuggcaagaggagcggccucagccuuuccugggggucucugugccuggacugugucccugugcagcuccaugacauggggaggccuccacagucuucagacauccaccugcccuggagcucuguguccacauggccuccucagcggcagacucccacaccacccuugaggggugggacucuggggaggccaccacaagcccccgggcucaagacucaguguuccuggagcucugugucgccuuuccugucuguagggcucugccagggucccacugcccccucuccucccaucucccccagccucuuucagucucgguguguguguuggaggaacuccccuauccucaaauauucuucuccuuuuggaaacaaaaguaggaaacucugccacaaaccuccccagagccugcccccugcgugaccaggguaaaggaaagugugaggaggagacauaacauuuacuaaaacaacacaaaacaggagcugccguagccucacucccagcccuuguuuuucaggauguguucugggccaaguacacaggugagcaccgggaaggauuugccccaggaagggaggccuggggaccccagugagagaauucuacccagagaaucuucugcugcaccuagccauccacccauccaccccuuccccacuccuuccuuggucccucccaucuguucauccaucuuucuguuucucaccaacaucccauccacccugacuccagcucauccuggccauaccccaaucccaaagguaaacaccugggucuuuuccagcuugugagacagcgaggacgccucgagauaagcuugcugcaugucuggaaggugagcaacugacacggguuuggggagcaggacauggaggggagccugggagaagagcucagggguggguuuggaguguggcugguggaggccgaggcaguccccagcaucugacauugcucccauuccuggggucaagaugucucuuuguaccuggcucugugucuggcaugcgaacgaaugaaugaaugaauggacuaaugaauuaauguuuuuuuuuuugagacagagucucgcucuguugcccaggcuggagugcaguggcacgaucuuggcucacuguaaacuccgccucccggguucaagcaauucucugccucaaccucccaaguagcugggauuacaggugcucgccaccacgccuggcuaauuuuuguauuuuuaguagagacgggguuucaccauguuggccaggcuggucuugaacuccugaccucgugauccacccaccucggccucaaagugcugggauuauagaagugagccaccgcgccuggccaugaauucauguuuaaggcuucauucuccuuugccugacccgagucucugcccccaccuagucagagcuuugaugaugucacauuccccuucuagcuuuaggugucacugaaccaaacaggaacccaaacccccagcugcucugacaccaaggacuucccuaagcaugccaagguguuucuagcaccuggccuugcauauguugucaauuuccucuggagcgaccaucacaucuacugaacacuuuccuauccuucaaggacugcuucaaaugucaccacuuuugcugagacuucagggagcacccucccuccugcacuguguucugaaggcaccuuuagcacgacaaaaauggaacucuuuguuuauuuauaagagacagggucucccuuuuuugcccaggcugaucuugaacuccugggcucaggcaauucucccaucucagucucccaaaggaguaggauuauaagugugagccaccaugccuggcugccauacuuucauuuuuuuuuuuuuuuuuuugagguggagucucacucugucgccuaggcuggagugcagcagcgcgaucucggcucgcugcaaccuccgccuagcggauucaagugauucuccugccuuagccuccugaguagcugggauuacaggcacacacuaccaugcccagcuaauuuuuuguauuuuuuaguagagacgggguuucaccauguuggccaggcuggucacaaacuccugaccucaggugauccaccagccucagccucccagagugcugggauuacagguguaauccacugcgcccagccucauuuguuaaauuacguacucaacagacauuuuacaaaguuccugcuacgugccaggcacuauaucaggugcuggggauuuuaagagaaucaaauacagucucugccuucaaggaauucaaaaucucaaaagagaacaaaaauacaaaauauuaaaaugauugcggccgggugugguggcucaagccuguaauccuagcacuuugggagcugaggugggcgcccaggccagggguuugagaccauccuggccaacauagugaaacccccaaccucuacuaaaaauacaaaaauuagcuggggugugguggcacgcgccuguaauccuagcuacuagggaggcugaugggggagaauuucuugaaucugggaggcagagguugcagugagcugagaucaugccacugcacuucagucucggcaacagaacaagacucaucucaaaauacauaaauaaaaauaaauaauucaauaaagugauugcaagaaaaguucuguucaaggcaccaagagaccacaggaaaaugagugucugguuugccagaaaaaugagagauggcuucccaggagaggcagaguucugccuggccuggugggaugcauggaugaacaaacaagugggcauuccagucagaagaaacaauccguggaaagacccagaggcaugagaagcugagcuagcagggacagguagaccagggccaguugaaaaggaccuucaucacuuuuucauccugcuggccaagagaagccacagaauggaagcuccaugagggcagggcugugacuguccuauugguugauguguacugagcacccgacagugccugucauaugguaggcacuuagcgaauauuuggaggccacuguugagugaaugggagaacugcugguugcagaggaagaggggcugggugaaugcagguucaggauuguggaccugcaugagcugggaggugggggauagacaacuuugcagggagagaggaaauaaguccccaggcuccaaggcugaccgggguggggucuccgcagguaacugugcugagggucuggguacgaacuaccgagggcaugugaacaucacccggucaggcauugagugccagcuauggaggagucgcuacccacauaagccugagugagugaggggccggccuucccaccaugggcugagaacagggagcaagcguaccucaagcccaacagccuccuguugggcaauuuccuguuccagaaucaacuccacuacccauccuggggccgaccuacaggagaauuucugccgcaaccccgacagcagcaccacgggacccuggugcuacacuacagaccccaccgugaggaggcaggaaugcagcaucccugucugugguaagcugggggcaguggggcggcccauggccaaggcccgggggcuucauggggccuggcagccugggaugggaaccaagaauacuggcuacccaggcacaguggcucaugcccguaaucccagcacuuugggaggcugaggcaggcagaucaccugaggucagggguuugagaccagcugggccaacauggcaaaaccccgucucuacuaaaaauacaaaaauugccaggcgugguggugggcgccuguaaucccaacuacucuggaggcugaggcacgagaaucgcuugaacccgggaggcggaguuugcagugagcugagauccugccacuguacuucagccugggcgacaagagcaaaacucugucucaaagaaaaaaaaaagaugcuggccaccuucagagcuggcgucagucauucagaucauaucugugccuauugcucaguaaagucagggaaucaggggaucugaguggggggaucugccagccuccuccucccccuccccacucuugacuuccuuaugguccaggcuguggcucauuccaaacaugccuccuuucugaucaaggcacuccucccuccgggaagcccucccuagccauuucaguccacacacccuguucugaguaucacagagcaagccuugugcaguuuggcccugcgggauucugucauuauuauuuccuugguguguuaaguagcuauagccaccccuucccugaggcagaccacaauaagcauuucuuuuucccaugaggguuggcagguguggcugcacucgcuaaugcgucuguagggucaacugacggagguuggcccuggcuggguggcucugauucaaauaauggguccagcugagucuggcuccucguugaggguugggccuagaucugcuccacgugcguucaugcuggggcugaggcugaaagaagguaccugggaaaacucuucuuaugcugaugacagacacagaaaacaaugaacagaaaagcgucuucuguccugaaggccuggcucagaacaggcacagucagcccugcccacguuccauuggccagagcaaguauauguucaaggccagggucaagagguaaacuacaccucagccuguaaaaucacagagcaagggauguggaugcaggcagggguaaagaauuugugccgauuaccaguccacaaacauggguuaguguuuguucucuaggcaucccugucgggcccauugcucauuccugggguuggucuuuuuuuuuuuucuuucuaagauggagucucacucccuugcccaggcuguuggagugcaguggcccuaucucagcucacugcaaccuccgccuccuggguucaagcgauuccccugcuucagccuccugaguagcuaggauuacaggcgugugccaccacuccuggcuaauuuuuuuuuauguuaguagagacgggguuucaccauguuggccaggcugaucucaaacuccugaccuugugauccucccgccucggccucccaaacugcugagauuacaggggugaggcacugcgcccggccuuuuuuuuuuuuuuuuuugagauggagucucacucugucacccaggcuggagugcaguggcauaaucuuggcucacugcaaccuccaccuccuggguucaggcgauucucugccucagccucucauauagcugggauuacaggcacacgccaccacgccuggcuaauuuuuguauuuuuaguagagacgggguuucuucauguuggccuggcugaucuugaacuccugaccuccggugaucugcccagcucggccucccaaaguucugggauuacagguguaagccacugcgccuggccccuggaauuggucuuauagcaaguuuaucccaacaaaaacagcuacuauuuacuccccaacccccauacacacgcacacacauugaugauaaauaaguugcaggcuugcagaaauugacccauccaggugaacagccuagugaucccagcaagcguccugcugugcagcuauaaaaacaugacuccuccagcagcuccaggcagccacuaccaguuaauuacagauggccuaggaggccaaaccugguuacuaucucugguuuauuaugugccagacacuuaugcuguauauuuuguuuaauccucucaacaaaccugcaaaaguggcauuaguaaccccuuuaaaggcaaacggucagaagcccagagagguuaaguaaccugaggucacacaggcagaaagcagcaagaccgggguucacaccccugucuguuccgguccauguguggucucacucacucugcugccuccuugccccucacccaccaggccaggaucaagucacuguagcgaugacuccacgcuccgaaggcuccagugugaaucugucaccuccauuggagcagugugucccugaucgggggcagcaguaccaggggcgccuggcggugaccacacaugggcuccccugccuggccugggccagcgcacaggccaaggcccugagcaagcaccaggacuucaacucagcugugcagcugguggagaacuucugccgcaacccagacggggaugaggagggcguguggugcuauguggccgggaagccuggcgacuuuggguacugcgaccucaacuauuguggugagcugccuggguagggggccugaguugcagggacaaauccuggugggaauaacaacagccgcuucugcuuaucgaacgcuuaccucauugagugcgcucauuacagccuuacaguaaccaggugggggguaagguccugugcccauuucacagauaaguacacugaggccccaggagguuauugccuaguagcccaacugugcaugcacgcuuaaccucugcaccaaauggccuccaaggcccguaggggaauuggggggaucuaggggaugggugaggaauggcccagcccagucccagccggugccugggucccaacagaggaggccguggaggaggagacaggagaugggcuggaugaggacucagacagggccaucgaagggcguaccgccaccagugaguaccagacuuucuucaauccgaggaccuuuggcucgggagaggcaggugagguagugggcauccgaggggaugcggggcugcggggcugguggccaggacuugccccucacugcuuggcuugcucugcagacugugggcugcgaccucuguucgagaagaagucgcuggaggacaaaaccgaaagagagcuccuggaauccuacaucgacgggcgcauuguggagggcucggaugcagagaucggcaugucaccuugguguguccuggagcccugcgcuaccauucacuccugggggcaggugugcugcuggacccccacccucaggcccugccugcaggccugggcuuuacagaugacaacagcugagcauccaggaucccaccaacuccacacagcagccacaugagauggguuguuuacuucuuuuuuuuuguuucuuagauggagucuugcucugucaccuaggcuggagugcagugcugcaaucucggcucacuaccucgaucucagcucacugcaacuucugccuuccggguucaaacgauucucuugccucagccuccugaguagcugaauuuacagacaugcgccaccacacccggcuaauuuuuguauuuuaaguagagacaggguuucaccauguuggccaggcuggucuugaacuccugaccucaagugauccaccugccucagccucccaaagugccgggauuacaggcaugagccaccacacccggcccauggguccuuuacuucuaagcagaugguaaagcugagacugacggagcugguggcucaccuccgcgcacagcuaauggguuugaauccaguucuucugauuccagagcugugcuacgcuaugugaacucuggacuggaaggaccuaguuagggggugcaaaaagcaggaggcaggucaggugcaguggcucaccccuguaaucccagcacuuugggaggccaagacaggaagaucacuugagggcaggaguucgaggccagccugggcaaaaugguaaaaccccgucucuacuaaaaaugcaaaaauuagccagguguagcagcaugucccuguagucccagcuacuaaggaggcugaggcgggaggaucgccugagcccaggaggcugaggcuucaguaagcugugacuguaccauugcacuccagccugggugacaagagugagacccugucucaaaaauaaauaaauaaauaaauaaaaaagugugaggcagccccucagcaucacacggaggcuccaggccccaaaggcggccagcccaagcuuggaucugggccccggaggcagcucugcccagcuggguucuuagaccugggauuguuacuucuagggcugguguagaggcagcccccucauccucagcuccuaaugcuuccugcugccccucccaggcaggugaugcuuuuccggaagaguccccaggagcugcuguguggggccagccucaucagugaccgcuggguccucaccgccgcccacugccuccuguacccgcccugggacaagaacuucaccgagaaugaccuucuggugcgcauuggcaagcacucccgcaccagguacagaacugguggcccgugggugucuggcaggggucugaguccuccaaagcgaucaugaggggcccugguggcuccgggacacauaggauguucuguauaccccccagaauauaacaucccagcagucucugcuggaaagcccauuuggucacguccugacugaggcuuggagcugcggggagaaauccgucugucuccuggucccuccaacacuaggauauagcccaugugggagucucugaaaauagagucugucuggacuagggcgugcagccugugccccuguccccguccuccaggcugucugacuccaaagcccugcacggcuuuaggcccaggaagaaacacccagggggcugccauggcaggaaccagcccuauccccucccugguggccugcaggacacacugucucccagaccccaagggcaggcaguuuccugcuccuugcugggugaaccugcagcuucuccauuucuuucuuggggucucugcagguacgagcgaaacauugaaaagauauccauguuggaaaagaucuacauccaccccagguacaacuggcgggagaaccuggaccgggacauugcccugaugaagcugaagaagccuguugccuucagugacuacauucacccugugugucugcccgacagggagacggcagccaggugggccaccagaugcuuguuagcugaggggcagaagccaaguucugggccuggcucugauaccaaguagccuugcaagagccccuuucccuuuuccaggccucgguuucuuggagugaacccaaaaguucuuuucaguacuggcguuuuauuuuuuauuuauauuuauuuauuuacugacggaguuccacucuugucucccaggcuggaguguaguugugcgaucuuggcucacugcaaccccaccuccuggguucaagcgacucuccugccucagucuccugaguagcugggauuacaggcuaauuuuuguauuuuuaguagagacugguggguuucaccgugucggccagguuggucucgaaccccugaccucaagugauucacccgccucggccucccaaagugccgagaccacaggcgugaacgucugugcccagccagcucuggcguuuuagauucuggucucuaagaaauggcguuggggccaggcggcuccuguggggguuggcucucacuaggcccuucuuccuuccccaaagcuugcuccaggcuggauacaaggggcgggugacaggcuggggcaaccugaaggagacguggacagccaacguugguaaggggcagcccaguguccugcagguggugaaccugcccauuguggagcggccggucugcaaggacuccacccggauccgcaucacugacaacauguucugugcuggcaagucugugcagggcgggcugagggaacaguggggcccaagcugggagaacugaguugugccuggguucaagccaugugacuuugagcaaguugccuaaccucuugguggcucaguuucuuccucuguaaaauggagguaaaagucucuaucccauaagguuaugggaggguuaaaugaaguaguauauauuaauguacuuggcauaguaucagucaccagugagcucagauagcagcaagaggcugcggguagggaaaugccauucauucagucacucagcaaauauuuauugagcgccuaucacguuccaggcagcguucuaggguauacagcagggacccagacggacaaugucugugcccucagagagcuuccuuccuaggagggcacauccauaaacagaucuaaaacagcaaucccugaccagugcugugaagaaaaaugaagcacagggagagagaacggcugaugaagugggcuucuaaauaggguggccagacaaggugggcagaucacuugaggucaggaguucaagaccagccuggccaacauggugaaaccccgucucuacuaaaaauacaaaaauuagcuggucauggugacgcaugccuguagucgcagcuacucaggaggcugaggcaggagaauugcuugagccagggaggcggagguugcagugagcugagaucgggcaucauugcacuccagcugggcaacacagcaagacuccauugaucgaucgaucaaucaaucaaucagguggccagagaagguuggagaaggccucccugagaaggugaugucugggcagggacuggaagaggggaaggaaggagugagcaggcauaucuaggggaggagcaccgcaggcugggggcauggcaggcacuaaggcccugaggugggagcacucuuggcuugucuggggagcaguagggaggccuggggggcugaggaggggcagcagugggugaggggagagaggggggcaggcagaggacagccacuuccuuuagggccuggaaggacuuuauugagugagaugggaaguuauugaggggcuugaggcagguuaagaaaugaugugacugacuuuaaaaguaaaaaauaaaaaaauuuaguguaauuucagacucacagaaaaguuguaaaaauaauacaaagauuuccuguauacugucauccagauuguccuccauucuguggaugugugggaauuuuuauauauauauaugcauaguuugagagcaaaucaugaauaugguuucuuuuuacccauaaauacuugaguauuuccaaaaaaaaaaaaaauacccaaggauguucucuuaugcaaccacaauacaaauauuaaaacccggaaauuuuuuuuugacauagcuucgcugucacccaggcuugagugcaguggcacaaucucggcucacugcaaccuccugcucccagguucaagugauucuccugccucagccuccugaguagcuggaaucacaggcauguacuaccaugccuagcuaauuuuuguauuuguaguagagacaggguuucaccauguuggccaggcuggucuugaacuccugaccucaggugauccaccugccucggccucccaaagugcugggauuacaggcgugaaccacuguacucggccaaaaccaggaaauuuuuuuuuuuuuuugagauggaaucuugcucuguugcccaggcuagagugcaguggcauggucucggcuuacuuggaauuacaggugccugccaccacgcccggcuaacuuuuuguauuuuuaguauuuuuaguagugaugggguuucaccauguuggccaggcuggucuugaacuccugaccucggguaauccacccaccucggcuucccaaagugcugggauuacaggcgugagccacagcaccuggcccaaaaccaggaaauuaaugaugauacaauauuauugucuaaucuauagaccuuauucaaauuuuuguuagucuugcuaaugucuuuuauagggaaaaaaaaaaaaaaaagcguguuucucacccaggauucaaugaaggaucuuucuuugucuucuaugaccuugacaugucugaugagugcagucugguuauuuuguacacuggcccugaauccggguuugucuaagguuuccucacggucagguucgggcucaguggugccauguccuucuuggugcauccuguuaacuggcacaugagaacaauuugucucauauguggugagucuaacucugaccucuugaggaaggcaaugucugccaaguuucuugcuguaacuucuguuuuucccuuuguaauuaauaagaaucugguaaagagacacuuugauguuuuuuuuuuuuuuuuuuuuuugugauggagucucccucuaucacccgggcuggaguguguggugcgaucucggcucacugcaaccuccaucccccagguucaagugauucuccugccucagccucccaaguagcagggauuacaggcaugugccaccacacccagcuaauuuuuguauuuuuaguagagaugggguuucaccauguuggccaggauggucucgaacuccugaccuugugauccgucugccucagccucccaaagugcugggauuacaggugugagccaauacgccuggccuacuuugauauuuuguauucuguuugcaucaaaaccuucucccaacuagggugacuaccaaauggcacuuaucuaauucugucauuccuucuacauuuguuaguuacuuuauugcuuuccuuccuuucauucuaucaguguggacuuaaggauccuuacuuuauucuaaggguucaccuuuuuuuuucuuuuuuuuugagauggaguuucgcccauguugcccaggcuggauggagugcaauggcgugaucucggcucacugcaacguccuccucccagguucaagcaauucuccugccucagccuccugaguagcugggauuacaggcaugugccaccacgccuggcuaauuuuuuguauuuuuaguagagacaggguuucaccauguuggccaggcuggucucgaacuccugaccucaggugauccgcccgccucagccuuccaagguucugggauuauaggcgugagcucuaccgugccaggccauacuuuguuacuacuguuauuuuuucugaugcucagaugaucccaaguuuggccuguggaagucccuucaagcuggcuucugugacuuggggagauguucugucauucuuugaguacuuucuuucuuucuggcacagcaaaaugauucagguuaauccuacuuuccuuacuguaguguuggaaccagccauuucuccagggaacccuuguagucaagaguggaauuuagaacugagaucugggugcuggcgugugcacauugcuagugggaugucauuacuucuaggcucucuuaguggacagaaccagaaaaaaauuauaugaugcauauaccaauaucucuaucaucuauauaaaaaaccaugaguuccuacugaaaccuccaauuccauucuaacaccacaggauuaauuuuagcuuuuccuuuuccauauuuguaacucucucuguugacagugagaaaccugacccucauuaucuguaaugcauuugccuauuugaacaauacuagaauauaguuucaaaauccuccauccauaacacuauuaaaaccaauccuauggcugggcucagcccacugcaaccucugccuccuggacucaagccagccucccacuuuagccucccgaguagccagggcuacaggcacacaccaccaugcccagcuaauuuuuguauuuuuuguagagacugggucucacuguguugcccagacaggucuugaacucugagcucaagugauccauccaacucagccucccaaagugcuaggauuacaggugugagccaccaugccuggccucuccuaguaaauuuuuagaagugguguuguuaggucaaaaggcaaacauguaugucauuuuuuagagauuuuuaaauuucuuuccauaaggguuguaccaguuugcauuuccaucacaguguaugagaaugccuguuuccccacaaccuugccaaaagaaugucacaguuuuaaauuuuuaccaaucugagaggugagaaauaguaucuugaaauuguuuuaacggacaucuuucaaauugaaaaugagguugaacaucguaucauaugauuaaggaccuuuuuuuuuuuuuuuuuuuuuuuugagauggagucucccucugucaccuaggcuggagugcaauggcacgauuuuggcucacugcaacuuccgccuucuggguucaagcgauucuccugcuucagccucccaagcagcugggacuccaggcgcgagucaccaugcccgcuaauuuuuguauuuuuaguagagacaggguuuuaccagauuggccaggcuggucucgaacuccuuaccuugugauccucccgccucggccucccaaagugcugagauuacaggcaugagccaccacgccuggccuaaggaccauuuuuauauaauuuuuuuuuugagacagagucuugcuuugucacccaggcuggagugcaauggugcaaucuuggcucacugcagccuccacuucccugguucaagugauucuccugccucagccucccgaguagcugguuccacaggugcgugccuggcuaguauuuguauuauauaauuuuuuugugaauugucucuucaugguuuuuugcccauuuuuuggucccuuucuuaucaauuuuugugaguucuucguauuuauauuaggccuuuauuugugauauacauugcaaauguuuucuccuaguuugucaguuuuuuuaaccucauguauaauuuuucuggccaugcaguuuaaaaaauuacuagguagucaaauuuaucaaucauuuauuuuauuaaaucuggauuuugaaucagagauaaacuuuuccuggccagguguggugucuuacaccuguaaucccagcacucugagaggcugaggugggggaucaccugaggucagaaguucaagaccagccuggccaacauggugaaacccugucucuacuaaaaauacaaaaauuagcugggcgugguggcugaugccuguagucccagcuacucaggagacugaggcuggagaauugcuugaaccugggaggcggagguugcagugagcagagaucgugccgcugcacuccagccugggugacagagcaagacucugucucaaaaacaaaacgacaaaaaacaacaacagaaaagccuuuccugauagcuaggucauugaggaauucacucauguuuucuucuaguaccugauuucauuuuucugcacuuagauuccugacucauauggaguuuauuuuuguaucugaugugaggcauagaucuaauuuauuauuuuccaaauggcuaacuagcugucucuaaacccuuuauuaaaaauuauuggccaagugcgguagcucacaccuguaaucccagcaguuuggaaggcugaggcaggauugcuugaggccaggaauucaaaaccagcccagacaacauagcaagacccugucucuacaagaaaauauuggucaggugugguggcucacgccuauaaucccagcacuuugggaggcugaggcagguggaucaugaggucaggagauagagaccauccuggccaacauggugaaacccucgucucuacuaaaauacaaaaaauuagcugggugugguggcgcaugccuguaguaccagcuacucaggaggcugaggcaggggaaucauuugaacccaggagguggagguugcagugagcugagaucacgccauugaacuccagccuggcgacagagcaagacuccaucucaaaaaaaaaaggaaaaagaaaauauuuuaaaaauuagcugggcaugguggcaugugccuuguagucucagcuacuugagaggcugaguuaggaggauugcuugagccuaggaguucaauacugcagugagcuaugaccgcaccauugcacuccagccugggcaacagagugagacccuguuucuauuaaaaaaaaaaaaucggcugggcgcgguggcucacgccuguaauccuagcacuuugggaggccgaggcgagcggaucaccugaggucaggaguucaagaccagccugaccaacauggaaaaacccugucucugcuaaaaauacaaaauuagccagacauggaggcacaugucuguaaucccagcuacucgggaggcugaggcaggagaaucgcuugaaccugggagacggagguugcagugagcugagaucccuccauugcacuccagccugggcaacaagaguaaaaacuccguuucgccaggugcgguggcucacaccuguaaucccagcacuuugggaggccgagguggguggaucacaaggucaggaguuugagacaagccuggccgacauggugaaaccccaucucuacuaaaauacaaaaaauuagccuggcaugguggugugcgccuguaaucccagcuacuugggaggcugaggcaggggaaucacuugaaccugggaggaggagguugcagugagccgagauggugccacugcacuccagccuggcaacagagcgagacucuaucucaaaaucaaucaaucaaucaaucaaucuuugaacuagugauuugagauuucaccuuuaucacauucuagauuguaucuuauuuucauuuauuuauuugaaauauagacaagucucccugugcugcccaggcugauuucaaacuccuggcugggcucgagcaagucucccgccuuggccucccaaacugcugggauuacagacgugagccaccauaccugaccuagguuuuauuuuuuaguuuuauuuuuuccugcauccagcuaauuugauuugauuuguagagacggggucuugcuauguuaccuaggcuggucucgaacuccugggcucaagugauccuccugccuuggccucccaaaguguugggauuaccagcaugagccacggugcccagccccacguucuagauuucuauggauagaguaugcuuaaggaugaguauguuucuggauguucgacucggcuuuccuggucuguugucugucuguguacagcgucacauuguuuuaaugauagaggcuuuagcguacauagcugggaaggcuaauguucucuuuuaguuuuucuuuccagugguuuccuggcaauucuugcauguuuguuuuuccauaugaacuuuagugucaacaugccuaggucuauaaaaaagcuuggugguaauuuuauugggauuaugacacuucaacaaauuaacugggagaauggacauauuuuugauguugagucauuuuauccaaggauaagaaacguuuuccuauuugcucaagucuauuauuguaucuuucuugacugcugcaauguauucucuuauaauuuuuucuauugguaucuuauuuuauguauuuguaauaucuuauuuuucuugaguaaauuaguuaauggcuugccgguuuucucaaaacaaauaucuagggauuugauuuaugaaauuauuaggccuauuauuuuucuuuuuuuugagauggagucucacucugucgcccaggcuggagugcaguggcgugaucucagcucacugcaaccuccaccuccuggguucaagugauucuccugccucagccuccccaguagcugggguuacaggugcacgccaccaugcccggcuaauuuuuuuauauuuuuaguagagacgggguuucaccauguuagccaggcuggucucgaacuccugaccucaugauccgacugccucagccucccaaagugcugggauuacaggugugagccaccgugccuggccuuuuuuuuuuuuuuuuugagacagagucuugcucugucacccaggcuggagugcaguggugcgaucucggcucacugaaagcuccaccucccggguucacgccauccuccugccucagccucccgaguagcugggacuacagguguacacugccacgcccagcuaauuuuuuguauuuaguagagacaggguuucaccgcguucgccaggauggucucgaucuccugaccuugugauccgccugccucagccucccaaagugcugguauuacgggcgugagccacugcgcccggccaggccuauuauuuuucuauugugguucauuaauuucugcuuuuuucucuuaaaaaguuugcuuacguuuuugucugguuuacuuugcuguucucuugcuagcuuuuuuuuuuuucagauagggucuugcucuguugcccaggcuggagugcaguggcacagucauagcucacugcagccuugaacuccugggcucaagcaauccucuucuugcuucagccucccacguagcuaggaucagagguacaugccaccauguccggcuaauuuuuuuuuuucgagacagagucuuguucugucgcucaggcgguagugcaguggugcaaucccggcucacugcaaccuccaccuccaccucccagguucaagcaauucuaccucagucuccugaguagcugggauuauaggcgcacaccaacaugucuggcuaauuuuuguauuuuuaguagagacaggguuucaccacguuggccaggcuggucuuaaacuccugacuucaugauccgcccgccuuggccucccaaagugcugagauuacaggugugagccacagcaccuagugaaggugugguuuuuuuguguagguuuuacuguuguuaguguuguucuguauuguuuguagaggauacguggggagauuuggauaaaagcaacuaucauuauuauccucaucagacuuguaggucuaacuuuuuaauuuuuuaauuuuuaauuuaaauuuuuuucuuggucuuuuaucauuaauuaauuuuuucgagacagggucucacucuguugcccaggcuggaguguggugacaugaucacggcucacugcagccuuaaccucccaggcgcaagugauccuccucucuuagccucccgaguagcugggacuccaggcaugugccaccaugcccagcuaauuuuuuguagagagaggguuuugccauauugcccaggcuggucuugaacugcugagcucaagugauccacccggcuugggcaugagccaccuccccuggucugguccaacuuuuuaaaagcauuauucugccuguuggguggagaauagacuguaggugggcaaagaaugaaggaaacuaguggguucaggagcucgagcuagaaguggugagaaggguuuggauuuggggucuaugcugaagguagagccgacaagauuugcuaggauuggauggguagggugaggaaguggggacagcaagaaugacuggagggguaaguggacucucaccagcugugucucgugaaggggcguggcugggcuaugagcuaugcuccugagcacagacggcuguucucuuucaagguuacaagccugaugaagggaaacgaggggaugccugugaaggugacagugggggacccuuugucaugaagguaagcuucucuaaagcccagggccuggugaacacaucuucuggggguggggagaaacucuaguaucuagaaacaguugccuggcaggggaauacugaugugaccuugaacuugacucuauuggaaaccucaucuuucuucuucagagccccuuuaacaaccgcugguaucaaaugggcaucgucucauggggugaaggcugugaccgggaugggaaauauggcuucuacacacauguguuccgccugaagaaguggauacagaaggucauugaucaguuuggagaguagggggccacucauauucugggcuccuggaaccaaucccgugaaagaauuauuuuuguguuucuaaaacuaugguucccaauaaaagugacucucagcgagc

SEQ ID NO: 13278 - RNA, 8476 nt, Homo sapiens
cacagcgccgggagcugcgggcggagcaggggccgccccucgacaccccguccccgcccccggcccucggcccggccgcccgccccgccggcccgcggggccgcgcguccgucccgccgucugucuggcgcgaggggagcugggcagaggcggcggguaaguggcuccgcggcggcgcgggggcggggggcucgccgggaagagcaggaagcagguccccgggacgcucugaggcuccccagagguggguucgacugggacagggcgccagacccccuccggggcgagcgcgggccgggagcggcagugggccggggcugggggaccccgcuggaagcaaggccgggggcucucggaggcuucuccaggugcgcccgggugcgcccgugggaaggggugggcauccaggaugucgggggcgggggauugcccgcccacagaccccacggagccaggggcagccgucgggggugggacccuguacuccagcccucccacuggcggcucagcagggcgccgggcgcugaagccccaaagagcccuuuucccgccgucuccccgcccucccucucccuccaccccuuugcccccgcgcugccagcccacuccggccccuggaguccuccaucuacgaccuugagccccgacggaaaacaccccugcccuccccgacaccccucccccgcuccgguacuaccccccuuugcugcccagccuccaagccgggguccuccagcuccaggcccccuccuccggccccgcaacggaaguguugggcacaaugucggugccaaaucuucgccucucccucccuuggacucuggagucuccucucccgccccagggacagauccaggggccacagccuucccagagccauggagugaaugcccaagaaccgaagaccuacaccccaaaccaccccacgggcgugcggagcacccccuccggucucgcccggggaagaggggugucgaggacucgggaaacacagugcccacgcccagaggcugcaggaacugcgugcuaggggcuuggagggagggcggggcacccgagagccagggcuccuucgaccacggcggagacauggaggagccuccagauggccuaggaaaacacggcccucgaggcccgcccgacccuagcgugagaaacuggguccccacuuuggucacaggggcuagacagugccucugggguagggugcagggugaggagagaaggaggacaagagucuugcacucgccugacccgagcucuguccgggccuccgccuugugggugcacugcggaugcccucucgccgcgagaaugggcggcuuuuggcaauaacgccucuuaggggaguuauuagagcugagcgugccuggugucccucaaggccagguugggcgacucucgcagaggccccucgacagaugucagucagaggcuaggacucugccacaucuuuaaggacuuggacaccucugggcaccgggcuaagacggcgucccaaaguuagguggcccgucgcaggcagccccuaguagucuggccuccucgcccgcacaacccuucacccacaggccaggugcaaucccgaugcaggcuccuggcccgacccucuacgcgcucaggcggacagcuaaggucuggcugagucuccggcaggggcguuuggaaugugaccggucacccacucucggcccugcauuugcuugugcaugcaaguccacagguguagaggcacccgaaccgugugcauccucccggccacagcacccuaggcacgcacacgcaugcacaugcacgugugcacacggcgcggcaugcucacgcgcucucacgggcggacugguauccaggcguggccgugcgcacacacacgcacaugcauacagcuacuagcgucuacucgcgcucccccguaggcacacacaaacagaacucgcacucgcgcucccgcccacacguuccucgcagggugccggguggaauccgggcucccucaacuuucccacccgagaaccccgcgcggagccgagggcagcucuggggcggcguccgacggggccuggcgaggggaccccgcgucacuuccccgggaggcugugccugagggcuccucuggguucgcagucgcauuggaguugggggcgguggccaacggcggccgcacggucuagguccggagcgggcaccagggaccgacauugccaucuagcggugcgcacagccccggcggcggcggcucgcuccccagaugccaggcguaucuggauuccagggaaggcgccagagggggucggaaugucugcgggugaccccgagguguccaaaacgacgacagcuggggcggggcggagucggggagacccugagccucgcccugucagcaccuggcagcucccucacgcgggccaagagcaggacuuaaucaccggccauccaguggucccggcucagcccagccgccaggaucugggagaagacaagacaucgcuugucuucugggaaagcuaagucgagaagccagcaggaaugugaggggacccuacccaagccucaccuggacagucccucaguugugugguuuucgggucgaggggagcagaggcaggaggucaacucugagcaguagcaccuuggacuuuaagaaggagcuucccggguucuucugcccccacccguacuuccuaaccuggugacuuugggccaguugauuaacauuauccucaucuauaagaggauauuuacaucuguaagaugaggacacuaauaauaccugccuuuucaggcuguuguaaggauuaaaccagauaaucuauauuaaaagcucagagggguuccugacacgcaguuaacacucaauaaacaagagcuauuauguuuucacauucugcacuucuagccccguuuguuaucauccugcugcccuguauccugccuugggaggcugaagugaguuuccuuggggcuggcugacugauuacuccugccugcccuguccccuccuccacgugagugauugggggagggcagccuccuggugcuggaggggacagcucagagagugacaccugagcuucuauuucagaggcucucagagccaaaugggguugucagggaccccaagagagggcaguauguggucuuugcccuugacucguugugugaccuugggggugacaacacuugcucucagccucuccuccuacgaaccaaggauuuagaacaggagaacuugaacuaucaggcuaggaggcugggucuguaucugcgacgguggaauagaagggcuggggucagacuuggggcaguuacccuggcccuuggccccagccugcaguacauuuuuguguuuauguauagagaucaaguuuaggugccaaucccuauagcugcuggggaggaugucccaggacaggauccucucuauucugcaaaugagaaagaggugcaggaaggggcaguggaucgucucaggccacagagccagagcccaggcugcggguuagugcuccuuccuccacagccggcugccgcgcccucucuuccucucacacacagacgcacagaacugcguauccgaccaugccugcugggcuggcguggcugugaugggcccgcgugcgucuguggagcgguguguguguuggcgggugugaaggaggcugggcugagcggcugcccuggcacucagagcuggcgugggccucccucacauggagggaagaggaagagggggaggagagcuaagaggagccuggugggagggagggcaggcucagggaagggccugugguggggacuccagcuagggcgccgcccggugugcggaguggacuguggaggggagaggcggcccuggcagcccuucucuucccucugggacaauucuuucaccucacggguccccaguugggccucaggguucucugacaaccuagugaccccugcacugccucccucccagcugcaugcccuguggcuggagcugaggacuccuugaaggggaugugacaguugcagguaccuccugaagccccuucugcagggacucuccuccucucuggggugcccagcuccaugcaccgccucugguccccugcaaagccuucuggcuccuggagcucuuuggccuccuucagccagagcucuuaaguuacgggacugccuuccucucaccaccucaccccgcacuuaaucccaccagcaacauagugcaagaagccgugaaaccuuggucaggcuuuuaacagcuccgugccucaguuuccccaucuguaaguaguagagaaaaaaugguaucuaccucauagguuuguuaugaggaugaaaugaguuaacacuauaaaaaauguugccaggcaugauggcgccuggagucccagcuacucaggaggugagaggauggcuugagcucaagaguucuagaccagccuggacaacauaccaagacccugucucuacaaauaaauagauaaauaaauagacacuuuuuuuaagugucaaaagugcuuggcacuuaguagaccaucaguguuaggugcucauacauaccccgauuauugccuuugucccagugucuucuacagggguuggagagcagguguuaagaaaugaccgaauggguaaauggaugaacagaacaccucccuccagagcccacaugcucgugggccucugggaccacucuccuccuccucuugcuucccugagcucccccagcacuggccucuguccaggccuugcgcugccuccaggccuuugcuguggcuacugccccuggcagggccacucuccacagcuccuccuguggcuggcuccucaucacccagaugaccuggugggugaggccaccuagcaaggagucaugccuguccugccuucugacucacucucucaucacccugccuuuuuuuucuuuuguggcucacguguuugcaugucuccccccaugaggcagggggccaugugugucuuauucacuucuguagccacagcacccugagcaaugcuugccacauaguaggugcucaauuaauguugaaugaaugggcaaaugcgggauggcgggacagaguucucucaaggcauucugccagagaaugucccucugucaccuugaauccaguguaccuccagaugacucccccauucccuccuguaguucaugcuuuucucuccccuuccuccccagacacggccuacccaccccuggcaaccaacauggccaacuucacaccugucaauggcagcucgggcaaucaguccgugcgccuggucacgucaucaucccacaaucgcuaugagacgguggaaauggucuucauugccacagugacaggcucccugagccuggugacugucgugggcaacauccuggugaugcuguccaucaaggucaacaggcagcugcagacagucaacaacuacuuccucuucagccuggcgugugcugaucucaucauaggcgccuucuccaugaaccucuacaccguguacaucaucaagggcuacuggccccugggcgccguggucugcgaccuguggcuggcccuggacuacguggugagcaacgccuccgucaugaaccuucucaucaucagcuuugaccgcuacuucugcgucaccaagccucucaccuacccugcccggcgcaccaccaagauggcaggccucaugauugcugcugccuggguacuguccuucgugcucugggcgccugccaucuuguucuggcaguuugugguggguaagcggacggugcccgacaaccagugcuucauccaguuccuguccaacccagcagugaccuuuggcacagccauugcugccuucuaccugccuguggucaucaugacggugcuguacauccacaucucccuggccagucgcagccgaguccacaagcaccggcccgagggcccgaaggagaagaaagccaagacgcuggccuuccucaagagcccacuaaugaagcagagcgucaagaagcccccgcccggggaggccgcccgggaggagcugcgcaauggcaagcuggaggaggcccccccgccagcgcugccaccgccaccgcgccccguggcugauaaggacacuuccaaugaguccagcucaggcagugccacccagaacaccaaggaacgcccagccacagagcuguccaccacagaggccaccacgcccgccaugcccgccccuccccugcagccgcgggcccucaacccagccuccagaugguccaagauccagauugugacgaagcagacaggcaaugagugugugacagccauugagauugugccugccacgccggcuggcaugcgcccugcggccaacguggcccgcaaguucgccagcaucgcucgcaaccaggugcgcaagaagcggcagauggcggcccgggagcgcaaagugacacgaacgaucuuugccauucugcuagccuucauccucaccuggacgcccuacaacgucaugguccuggugaacaccuucugccagagcugcaucccugacacggugugguccauuggcuacuggcucugcuacgucaacagcaccaucaacccugccugcuaugcucugugcaacgccaccuuuaaaaagaccuuccggcaccugcugcugugccaguaucggaacaucggcacugccagguaggcaggcaggagugcccuaggaggugcugguguugcgugcgugugcuggggggaccacacggcucacuugcuguggggaagaguugcaggcaccauucugcguucacguuugcugaggaggaaguucagaagaggcucuguggcugcauucagagaccagaucucugcucaggcugaggaggcucaccccagggagugucugaacuggggcugccuggcccaccucuguggcccugcuucagcgagcugcggggcacuggccugggugggcaccugccccacugugaccaaccaucagcagugcuggaagaauggacaucuggaugggggccgaagcccagggcccccucaggaagaacaaaggggccagugcuuggaaaaggaggcuugggaagggaguagaaggguggggucccccauucugcuguaaucggugcuuucugcccccuugcaccccgcauguaggcucagcccccucuccccaaaucccacuccaggggcagaaaucuccucuggcugcagcuacuuagccagguucuggguggguaugauggaggccaggucccccccgccccagcagcacugcccuugucacauuaagauggggcagcugggaggucagagguucugucucaggaacugaggucuggccuucugcgaucccaggcugagccgugagugguccacguauucagaagacagcccccugcagccccggccuuagaaggcugucccaggucacacaucgagucagggugaggcugugguggauggcauucccaucugcccucuucaaaccucucacccccuggcuucugcaggguggaggccugggucacacaggcaagaggaaaggggucaaccugguggcucacucggguuuccaugacagugggaaggggggaggugggcagugagguaggcacgcagcccucgcaucugcucucccccauggguagaaccuuccugauuggcuguggguuguaucaaaagaccuuugacugggugaggcugagauggguguggugguuccagugagucagccagguucccuuccccagcccuggucccugagggagaugaggaccgaaaggcuuaggugacuugauggggagcacccuuucaggggcccuggaagaaauguuuguaauuguucugcuuuuuccaugagcucuggagagcacccaccaccaagcccccugaaacccaccagucccuacagccuggucuuucuccccaccuucccacucccaaacacauuuccacagcaaacuccuugggaaggggcuuuuauauauuaaaaaagaagagcuuuuauuggggggaaaaagucaguuuauuugauguguuucuuaguaauggaauuguggggaagaacaaaagcgggcucugggacucacauugcuuugggggaggcucaagcuucccagaaucccuugucccuccccacuuugggcacuuagggguggggcuggggagugagagggacaaggcagggcaugauugauuaaagcuaacgagcagacagaaggcacuggugggucacaucucgggccugggagagggagggcgugggccaggccccaugugacaccaggggcuccuuggcauccaggcuuggcgucuaguccuuucccuucccuuucuuggcuguaaaacaagaaagaaauauuaauaccauaucagcaguuaggcugacccauugcagaccgccggcuccacaaacacccgggcaucagggaaggagaagauucugcccccuagugguuuccaaucagcugacucggaagcaggggauggggcagccauugugaugugga

SEQ ID NO: 13279 - RNA, 8476 nt, Homo sapiens
uccacaucacaauggcugccccauccccugcuuccgagucagcugauuggaaaccacuagggggcagaaucuucuccuucccugaugcccggguguuuguggagccggcggucugcaaugggucagccuaacugcugauaugguauuaauauuucuuucuuguuuuacagccaagaaagggaagggaaaggacuagacgccaagccuggaugccaaggagccccuggugucacauggggccuggcccacgcccucccucucccaggcccgagaugugacccaccagugccuucugucugcucguuagcuuuaaucaaucaugcccugccuugucccucucacuccccagccccaccccuaagugcccaaaguggggagggacaagggauucugggaagcuugagccucccccaaagcaaugugagucccagagcccgcuuuuguucuuccccacaauuccauuacuaagaaacacaucaaauaaacugacuuuuuccccccaauaaaagcucuucuuuuuuaauauauaaaagccccuucccaaggaguuugcuguggaaauguguuugggagugggaagguggggagaaagaccaggcuguagggacugguggguuucagggggcuugguggugggugcucuccagagcucauggaaaaagcagaacaauuacaaacauuucuuccagggccccugaaagggugcuccccaucaagucaccuaagccuuucgguccucaucucccucagggaccagggcuggggaagggaaccuggcugacucacuggaaccaccacacccaucucagccucacccagucaaaggucuuuugauacaacccacagccaaucaggaagguucuacccaugggggagagcagaugcgagggcugcgugccuaccucacugcccaccuccccccuucccacugucauggaaacccgagugagccaccagguugaccccuuuccucuugccugugugacccaggccuccacccugcagaagccagggggugagagguuugaagagggcagaugggaaugccauccaccacagccucacccugacucgaugugugaccugggacagccuucuaaggccggggcugcagggggcugucuucugaauacguggaccacucacggcucagccugggaucgcagaaggccagaccucaguuccugagacagaaccucugaccucccagcugccccaucuuaaugugacaagggcagugcugcuggggcgggggggaccuggccuccaucauacccacccagaaccuggcuaaguagcugcagccagaggagauuucugccccuggagugggauuuggggagagggggcugagccuacaugcggggugcaagggggcagaaagcaccgauuacagcagaaugggggaccccacccuucuacucccuucccaagccuccuuuuccaagcacuggccccuuuguucuuccugagggggcccugggcuucggcccccauccagauguccauucuuccagcacugcugaugguuggucacaguggggcaggugcccacccaggccagugccccgcagcucgcugaagcagggccacagaggugggccaggcagccccaguucagacacucccuggggugagccuccucagccugagcagagaucuggucucugaaugcagccacagagccucuucugaacuuccuccucagcaaacgugaacgcagaauggugccugcaacucuuccccacagcaagugagccgugugguccccccagcacacgcacgcaacaccagcaccuccuagggcacuccugccugccuaccuggcagugccgauguuccgauacuggcacagcagcaggugccggaaggucuuuuuaaagguggcguugcacagagcauagcaggcaggguugauggugcuguugacguagcagagccaguagccaauggaccacaccgugucagggaugcagcucuggcagaagguguucaccaggaccaugacguuguagggcguccaggugaggaugaaggcuagcagaauggcaaagaucguucgugucacuuugcgcucccgggccgccaucugccgcuucuugcgcaccugguugcgagcgaugcuggcgaacuugcgggccacguuggccgcagggcgcaugccagccggcguggcaggcacaaucucaauggcugucacacacucauugccugucugcuucgucacaaucuggaucuuggaccaucuggaggcuggguugagggcccgcggcugcaggggaggggcgggcauggcgggcgugguggccucugugguggacagcucuguggcugggcguuccuugguguucuggguggcacugccugagcuggacucauuggaaguguccuuaucagccacggggcgcgguggcgguggcagcgcuggcgggggggccuccuccagcuugccauugcgcagcuccucccgggcggccuccccgggcgggggcuucuugacgcucugcuucauuagugggcucuugaggaaggccagcgucuuggcuuucuucuccuucgggcccucgggccggugcuuguggacucggcugcgacuggccagggagauguggauguacagcaccgucaugaugaccacaggcagguagaaggcagcaauggcugugccaaaggucacugcuggguuggacaggaacuggaugaagcacugguugucgggcaccguccgcuuacccaccacaaacugccagaacaagauggcaggcgcccagagcacgaaggacaguacccaggcagcagcaaucaugaggccugccaucuugguggugcgccgggcaggguaggugagaggcuuggugacgcagaaguagcggucaaagcugaugaugagaagguucaugacggaggcguugcucaccacguaguccagggccagccacaggucgcagaccacggcgcccaggggccaguagcccuugaugauguacacgguguagagguucauggagaaggcgccuaugaugagaucagcacacgccaggcugaagaggaaguaguuguugacugucugcagcugccuguugaccuugauggacagcaucaccaggauguugcccacgacagucaccaggcucagggagccugucacuguggcaaugaagaccauuuccaccgucucauagcgauugugggaugaugacgugaccaggcgcacggacugauugcccgagcugccauugacaggugugaaguuggccauguugguugccagggguggguaggccgugucuggggaggaaggggagagaaaagcaugaacuacaggagggaaugggggagucaucuggagguacacuggauucaaggugacagagggacauucucuggcagaaugccuugagagaacucugucccgccaucccgcauuugcccauucauucaacauuaauugagcaccuacuauguggcaagcauugcucagggugcuguggcuacagaagugaauaagacacacauggcccccugccucauggggggagacaugcaaacacgugagccacaaaagaaaaaaaaggcagggugaugagagagugagucagaaggcaggacaggcaugacuccuugcuagguggccucacccaccaggucaucugggugaugaggagccagccacaggaggagcuguggagaguggcccugccaggggcaguagccacagcaaaggccuggaggcagcgcaaggccuggacagaggccagugcugggggagcucagggaagcaagaggaggaggagaguggucccagaggcccacgagcaugugggcucuggagggagguguucuguucauccauuuacccauucggucauuucuuaacaccugcucuccaaccccuguagaagacacugggacaaaggcaauaaucgggguauguaugagcaccuaacacugauggucuacuaagugccaagcacuuuugacacuuaaaaaaagugucuauuuauuuaucuauuuauuuguagagacagggucuugguauguuguccaggcuggucuagaacucuugagcucaagccauccucucaccuccugaguagcugggacuccaggcgccaucaugccuggcaacauuuuuuauaguguuaacucauuucauccucauaacaaaccuaugagguagauaccauuuuuucucuacuacuuacagauggggaaacugaggcacggagcuguuaaaagccugaccaagguuucacggcuucuugcacuauguugcuggugggauuaagugcggggugagguggugagaggaaggcagucccguaacuuaagagcucuggcugaaggaggccaaagagcuccaggagccagaaggcuuugcaggggaccagaggcggugcauggagcugggcaccccagagaggaggagagucccugcagaaggggcuucaggagguaccugcaacugucacauccccuucaaggaguccucagcuccagccacagggcaugcagcugggagggaggcagugcaggggucacuagguugucagagaacccugaggcccaacuggggacccgugaggugaaagaauugucccagagggaagagaagggcugccagggccgccucuccccuccacaguccacuccgcacaccgggcggcgcccuagcuggaguccccaccacaggcccuucccugagccugcccucccucccaccaggcuccucuuagcucuccucccccucuuccucuucccuccaugugagggaggcccacgccagcucugagugccagggcagccgcucagcccagccuccuucacacccgccaacacacacaccgcuccacagacgcacgcgggcccaucacagccacgccagcccagcaggcauggucggauacgcaguucugugcgucugugugugagaggaagagagggcgcggcagccggcuguggaggaaggagcacuaacccgcagccugggcucuggcucuguggccugagacgauccacugccccuuccugcaccucuuucucauuugcagaauagagaggauccuguccugggacauccuccccagcagcuauagggauuggcaccuaaacuugaucucuauacauaaacacaaaaauguacugcaggcuggggccaagggccaggguaacugccccaagucugaccccagcccuucuauuccaccgucgcagauacagacccagccuccuagccugauaguucaaguucuccuguucuaaauccuugguucguaggaggagaggcugagagcaaguguugucacccccaaggucacacaacgagucaagggcaaagaccacauacugcccucucuuggggucccugacaaccccauuuggcucugagagccucugaaauagaagcucaggugucacucucugagcuguccccuccagcaccaggaggcugcccucccccaaucacucacguggaggaggggacagggcaggcaggaguaaucagucagccagccccaaggaaacucacuucagccucccaaggcaggauacagggcagcaggaugauaacaaacggggcuagaagugcagaaugugaaaacauaauagcucuuguuuauugaguguuaacugcgugucaggaaccccucugagcuuuuaauauagauuaucugguuuaauccuuacaacagccugaaaaggcagguauuauuaguguccucaucuuacagauguaaauauccucuuauagaugaggauaauguuaaucaacuggcccaaagucaccagguuaggaaguacgggugggggcagaagaacccgggaagcuccuucuuaaaguccaaggugcuacugcucagaguugaccuccugccucugcuccccucgacccgaaaaccacacaacugagggacuguccaggugaggcuuggguaggguccccucacauuccugcuggcuucucgacuuagcuuucccagaagacaagcgaugucuugucuucucccagauccuggcggcugggcugagccgggaccacuggauggccggugauuaaguccugcucuuggcccgcgugagggagcugccaggugcugacagggcgaggcucagggucuccccgacuccgccccgccccagcugucgucguuuuggacaccucggggucacccgcagacauuccgacccccucuggcgccuucccuggaauccagauacgccuggcaucuggggagcgagccgccgccgccggggcugugcgcaccgcuagauggcaaugucggucccuggugcccgcuccggaccuagaccgugcggccgccguuggccaccgcccccaacuccaaugcgacugcgaacccagaggagcccucaggcacagccucccggggaagugacgcgggguccccucgccaggccccgucggacgccgccccagagcugcccucggcuccgcgcgggguucucgggugggaaaguugagggagcccggauuccacccggcacccugcgaggaacgugugggcgggagcgcgagugcgaguucuguuugugugugccuacgggggagcgcgaguagacgcuaguagcuguaugcaugugcgugugugugcgcacggccacgccuggauaccaguccgcccgugagagcgcgugagcaugccgcgccgugugcacacgugcaugugcaugcgugugcgugccuagggugcuguggccgggaggaugcacacgguucgggugccucuacaccuguggacuugcaugcacaagcaaaugcagggccgagagugggugaccggucacauuccaaacgccccugccggagacucagccagaccuuagcuguccgccugagcgcguagagggucgggccaggagccugcaucgggauugcaccuggccugugggugaaggguugugcgggcgaggaggccagacuacuaggggcugccugcgacgggccaccuaacuuugggacgccgucuuagcccggugcccagagguguccaaguccuuaaagauguggcagaguccuagccucugacugacaucugucgaggggccucugcgagagucgcccaaccuggccuugagggacaccaggcacgcucagcucuaauaacuccccuaagaggcguuauugccaaaagccgcccauucucgcggcgagagggcauccgcagugcacccacaaggcggaggcccggacagagcucgggucaggcgagugcaagacucuuguccuccuucucuccucacccugcacccuaccccagaggcacugucuagccccugugaccaaaguggggacccaguuucucacgcuagggucgggcgggccucgagggccguguuuuccuaggccaucuggaggcuccuccaugucuccgccguggucgaaggagcccuggcucucgggugccccgcccucccuccaagccccuagcacgcaguuccugcagccucugggcgugggcacuguguuucccgaguccucgacaccccucuuccccgggcgagaccggagggggugcuccgcacgcccguggggugguuugggguguaggucuucgguucuugggcauucacuccauggcucugggaaggcuguggccccuggaucugucccuggggcgggagaggagacuccagaguccaagggagggagaggcgaagauuuggcaccgacauugugcccaacacuuccguugcggggccggaggagggggccuggagcuggaggaccccggcuuggaggcugggcagcaaagggggguaguaccggagcgggggaggggugucggggagggcagggguguuuuccgucggggcucaaggucguagauggaggacuccaggggccggagugggcuggcagcgcgggggcaaagggguggagggagagggagggcggggagacggcgggaaaagggcucuuuggggcuucagcgcccggcgcccugcugagccgccagugggagggcuggaguacagggucccacccccgacggcugccccuggcuccguggggucugugggcgggcaaucccccgcccccgacauccuggaugcccaccccuucccacgggcgcacccgggcgcaccuggagaagccuccgagagcccccggccuugcuuccagcggggucccccagccccggcccacugccgcucccggcccgcgcucgccccggagggggucuggcgcccugucccagucgaacccaccucuggggagccucagagcgucccggggaccugcuuccugcucuucccggcgagccccccgcccccgcgccgccgcggagccacuuacccgccgccucugcccagcuccccucgcgccagacagacggcgggacggacgcgcggccccgcgggccggcggggcgggcggccgggccgagggccgggggcggggacggggugucgaggggcggccccugcuccgcccgcagcucccggcgcugug

SEQ ID NO: 13280 - RNA, 2726 nt, Homo sapiens
uauauuaaaaaagaagagcuuuuauuggggggaaaaagucaguuuauuugauguguuucuuaguaauggaauuguggggaagaacaaaagcgggcucugggacucacauugcuuugggggaggcucaagcuucccagaaucccuugucccuccccacuuugggcacuuagggguggggcuggggagugagagggacaaggcagggcaugauugauuaaagcuaacgagcagacagaaggcacuggugggucacaucucgggccugggagagggagggcgugggccaggccccaugugacaccaggggcuccuuggcauccaggcuuggcgucuaguccuuucccuucccuuucuuggcuguaaaacaagaaagaaauauuaauaccauaucagcaguuaggcugacccauugcagaccgccggcuccacaaacacccgggcaucagggaaggagaagauucugcccccuagugguuuccaaucagcugacucggaagcaggggauggggcagccauugugauguggacaugggacauccccagcuuccuauuuccacuugggaucagaaaaccuucaaguuuccaguccuaguccuggucacagcagcccugggcauccucagccuccucaccugagaagcgggcagauucaccccugcccugcuggccucgcugggcugagucacgagugagcugagaggcccagggugggccuugaccuccucccaacacuagaaagggcagagcugaccaaaugcugcccguggcuggagagcugacaaaggcaagccguuccaggacacucucccuggguccuaagccagaugcuccaauggaguaguuugaguuggucccuauuugggccagggaggauuuauguccccagcaucaccugcggccucucuuguagugcccaucuucagacuuuuccaggcagggaagccaagugaggcgaugucaggaagccacuggccaggacucaaaacuuaagguuuaacuuggaauuguccccucacaggcgggggggggggggggcagccccccgcgacagccccacccccuucuccuuucgcugaccuuuggccuuugcuuuggucuugggggugcagggcuuggugacgcggauggucuccuggcacugagcauuguagcgcgccuucuucagggugccuuggcggacuuuggugccugugcccccaucacacgcaccccaguucucaaacuuguacuugcagucggcuggcgagagagcggcccaggucagcgcugcgcggcccgcggccccgcccuccgccaaggguccgcccaggcuucggcgaggcugugccccccgucuccugcccucugacugcgccccgccucaccuccaaacuccuucuuccaguugcagggcacccugcaccggaugcgcugggucugggccccgcaggugcccucgcggaaacccacgccgcaauccuugcugcugggggugcagggcccccaggcccacucagcgcacucgcuccccgggccgcccuucuucaccuuaucuacaacgcgcgaggaacagaguucaggacuggggcacggggagacucccucgggagccgccuuccugggguuccaggcuaggaacccaggcggcccagcccagaaguggaggggccucgccugcccguccccagcccuccuucgaucaucccccaucaccuuucuuuuuggcgaccgcggaggugagcgccagcagggcgaggagggugaggaggaggaagccucggugcugcauccugaggggagagcccgagucugaaucccuggcccguccccuuccccaccgggggccgcgugcagggcccucccaccuccgcgugcuccacuuuccaggccccaagucgggcugcuaagguggcggcggugggaagacuuggggcggccccucgccgcuagcccggacgcaccgcuaagaggcgacuccccgggggacgccucgagcccaggacgcagcucagacccccacccccgccuccagcccccagccccuagaucggccgcggccgggcggaccaggggccgccgcgcgcucacucgcucgcugcccgcgcugcuucgcucccucccgcgccgggcccgucccgcuccggccgccgcggccccuuuugucuccagaaccggucugagccggucacaugggcccccgcccccucuccccacccccccagggaaggacccgccccgcccccuccccucaaacccgcaccgcccccgaccccggcguccccgcccccgcuccagcccgcgccccccgcgcuucuacuccggcguccguguucccggccccgcguccucgcgucuccccgccggugcccucugcgcugcgacggcggccucucccggccccaucuuccgagcgguggucucccgaccccgggccccgucccgcccgcgcacaccggcccccggcccacucccugcgccgccgcccgcugcccccaucccaggucguccccugccguacgccaaggcccgggccguucucaggccucagcuucucuugccugccgcggagccccggcgccuguauaacccgcgggacccgcuccccuccacggccggcucagcccuggcgcccugcuggcugcuggggagggggcgcggcccaccuggggcgguuuccgcgggugggcagggaagcgcucugcugugcuggggggagucugggacccggucgcccagagaaagccacg

SEQ ID NO: 13281 - RNA, 2726 nt, Homo sapiens
cguggcuuucucugggcgaccgggucccagacuccccccagcacagcagagcgcuucccugcccacccgcggaaaccgccccaggugggccgcgcccccuccccagcagccagcagggcgccagggcugagccggccguggaggggagcgggucccgcggguuauacaggcgccggggcuccgcggcaggcaagagaagcugaggccugagaacggcccgggccuuggcguacggcaggggacgaccugggaugggggcagcgggcggcggcgcagggagugggccgggggccggugugcgcgggcgggacggggcccggggucgggagaccaccgcucggaagauggggccgggagaggccgccgucgcagcgcagagggcaccggcggggagacgcgaggacgcggggccgggaacacggacgccggaguagaagcgcggggggcgcgggcuggagcgggggcggggacgccggggucgggggcggugcggguuugaggggagggggcggggcggguccuucccuggggggguggggagagggggcgggggcccaugugaccggcucagaccgguucuggagacaaaaggggccgcggcggccggagcgggacgggcccggcgcgggagggagcgaagcagcgcgggcagcgagcgagugagcgcgcggcggccccugguccgcccggccgcggccgaucuaggggcugggggcuggaggcgggggugggggucugagcugcguccugggcucgaggcgucccccggggagucgccucuuagcggugcguccgggcuagcggcgaggggccgccccaagucuucccaccgccgccaccuuagcagcccgacuuggggccuggaaaguggagcacgcggaggugggagggcccugcacgcggcccccgguggggaaggggacgggccagggauucagacucgggcucuccccucaggaugcagcaccgaggcuuccuccuccucacccuccucgcccugcuggcgcucaccuccgcggucgccaaaaagaaaggugaugggggaugaucgaaggagggcuggggacgggcaggcgaggccccuccacuucugggcugggccgccuggguuccuagccuggaaccccaggaaggcggcucccgagggagucuccccgugccccaguccugaacucuguuccucgcgcguuguagauaaggugaagaagggcggcccggggagcgagugcgcugagugggccugggggcccugcacccccagcagcaaggauugcggcguggguuuccgcgagggcaccugcggggcccagacccagcgcauccggugcagggugcccugcaacuggaagaaggaguuuggaggugaggcggggcgcagucagagggcaggagacggggggcacagccucgccgaagccugggcggacccuuggcggagggcggggccgcgggccgcgcagcgcugaccugggccgcucucucgccagccgacugcaaguacaaguuugagaacuggggugcgugugaugggggcacaggcaccaaaguccgccaaggcacccugaagaaggcgcgcuacaaugcucagugccaggagaccauccgcgucaccaagcccugcacccccaagaccaaagcaaaggccaaaggucagcgaaaggagaaggggguggggcugucgcggggggcugcccccccccccccccgccugugaggggacaauuccaaguuaaaccuuaaguuuugaguccuggccaguggcuuccugacaucgccucacuuggcuucccugccuggaaaagucugaagaugggcacuacaagagaggccgcaggugaugcuggggacauaaauccucccuggcccaaauagggaccaacucaaacuacuccauuggagcaucuggcuuaggacccagggagaguguccuggaacggcuugccuuugucagcucuccagccacgggcagcauuuggucagcucugcccuuucuaguguugggaggaggucaaggcccacccugggccucucagcucacucgugacucagcccagcgaggccagcagggcaggggugaaucugcccgcuucucaggugaggaggcugaggaugcccagggcugcugugaccaggacuaggacuggaaacuugaagguuuucugaucccaaguggaaauaggaagcuggggaugucccauguccacaucacaauggcugccccauccccugcuuccgagucagcugauuggaaaccacuagggggcagaaucuucuccuucccugaugcccggguguuuguggagccggcggucugcaaugggucagccuaacugcugauaugguauuaauauuucuuucuuguuuuacagccaagaaagggaagggaaaggacuagacgccaagccuggaugccaaggagccccuggugucacauggggccuggcccacgcccucccucucccaggcccgagaugugacccaccagugccuucugucugcucguuagcuuuaaucaaucaugcccugccuugucccucucacuccccagccccaccccuaagugcccaaaguggggagggacaagggauucugggaagcuugagccucccccaaagcaaugugagucccagagcccgcuuuuguucuuccccacaauuccauuacuaagaaacacaucaaauaaacugacuuuuuccccccaauaaaagcucuucuuuuuuaauaua

SEQ ID NO: 13282 - RNA, 43755 nt, Homo sapiens
gaguugaugcugcaucuuuuuuuuuuuuuuuuugguuuugcuuucuuaaagcaugugcugagcugaugaagagagcaguuuggcaauuaaaaaggcccagcggcuugggcagcagcaggggggugccaggugagggucagguagucccucuuuccugggccagggagcagcaaagcccgcacuaacuucauaaaauauaaaacaagggaggggcgaagggaagagggagauuuguaaaauacaauaucuuaggggauuggcaauaauaaaaaauaagguucauuauuuacaaacaauuucuguucuuggucucuguacagugggggugggguaaggggugucugugaguggggugcguugaugugucuguuugggugcaggugugggggcagggaggcaguggucguguugggcauaugagagaggaggugggguacccagugagugguuugucugagaaggacggauggauguuggugggaaggagaaugagaacagaguggucggcccaagggaagaguccaaaugucaggggcaaggaagggcugggaaguggagccuuuucuccuggaaugggaagcuccaggaggcaggggcacgaggcggauccggguuagugagcaagaacuccucuucuggguaccagggguccguccuauguccugggucuuggcauggccuaggagaguuugauggugguguuggggcccagauccuggagagagaagagaggccagcgaugacuguccagcaggaacccucuuacccucugcaagcuggaucuagaccaaguagggauggggccuugggaggguguggccaauguggggaccaagggugggcaggaggcagguggagccugagaccucaggagggaaaggggccacacaccccaccugucguggaaccacuccuuggagugggagaagucggggcuggugccguuuccaccgucuuuaggccaggccucacucagguacuugguggucucgugggugcuguccaggugaucaugcugcagguggucccggggccgcugcucugccggccccccgggguugauuucccagccaucugggggcuccaugggcagcagggugcugcggccaucuucccauaagccugccccgucaucguagaauaggaggcuucgggagggcacuggagagggaguguaggaugagcggugugcccaagauucccucaacauccuggccacauucauggccuagugguuaaggacgcaggcccuggaucugagucccagcucugacacuucccggaugugugaccucagguaagccacacacuuugcuuuaaacuuucugagccucagugugcucuucuguaaaauagggauacuaggaccaaccucauguaaaugagagguuuaaaugagguaauacaggggaagugauugaaacuguguucaggaaauacucagaaaagucaccucuuccuagcagaggguacugaguuugggcaucugggagcuguguucuaaccuccaccacuuacuugcucuaucucccuuuuuuuuuuuuuugagacagagucuugcucugucgcccaggcuggagugcaauggcaggaucuugacucccugcaaucuccgccucccgagcucaagcgacucuccugccucagccucccgaguagcugggacuacaggugugugccaccauaccuggcuacuuuuuguauuuuuaguagagacgggguuucaccauguuggccaggcugaucuugaacuccugggccucaagugauccucccaccuuggccucccaaagugcugagauuaccggagugaguuaccgcacccggccaguccaccacuuacuuucugugagaccuggaauaagucucuuccccauucuagauccuaauuugcccuucagagaaggaaaacaaacauuuguuggacacccaucauuuguuaggcauuauccaaggcccauagaccuaaguagagugguuaaaaucuuagagaaacucuagggaaugagguuucuuuagccccgcuucccagaggaggcagcugaaguuccaggcacucagggaaauuguccucccugaagggaggaugcgaacccaggucugccuggcccugggaucugcugccccuccggcucugcagccaugaccucauagucugugugaacagaggucccuggaacugcgcagugcgccagcucugcaaaccagccugcuccaaagccaucugccugcugggaugugucuuccucuccacccagcccagguccugggccuaaaacccacugccuucccuccaaggggcucauucauugccuccucucacuguggcuuuauccaucaaccccagcucucuuuccacuccuuuuucuccaguggcuucuguggccuuggaaaagcagacacauggcucuccagaccuugcauugcugcugcccacccgccuuuagugaccaccccguucucuccuccucagccugcacguguccggggaggagcuuucacucucccugucucuacuuccucuuucccuaacccuccccacaccagcuuccuccccucaaggcccucaacgucuagcucauccucccugcuauaucccuccuucuugaaacucacuccuuaaucuucccuccucugaccucccaucuguuuccucuuccuccuccuguccugccagacacgugguucuugguaagugacugacugguaagugaugagggacagccaggaaguuccucuguggguccaccugaaggauucucugcgucugaaauccacacucuucuuugcugggcccuacccugguucucccuuugccagcuacugugauguagcuauucucuccuccgugagcucuaagagacugagugugcucauuucauaagcacagacacugugcuauuucaugcacugucucacagccauggcucaguaagugcaaaauugccacucccauuuucuagaugaagaaaugaaagcuuaagacacaugccccuggucacacagcagguggcagugccaguuacgauggacuugacauccccaugcuccuaaccacuguacguuuacuaucccccuuggaaacaguagauaucugaacccacaccaccgcuacccuucuucuguccaugguagacauuaucaguggaucaugacacuccuuccugucaauucugaauggugccucaggauccuucuuuuuuuuuugagauggagucucacucugucacccaggcuggacugcaguggcgugaucuugguucacugcaacuucugccucccaguuucaagugauucuccugucucaccccucucaaguagccgggacuacaggcacaugccaccaugcccagauaaguuuuguauuuuuaguagagacgagguuucaccaugcuggccaggcuggcgucgaacuccugaccucaggugauccaccgccucggccucccaaagugcugggauuacaggcaugagccaccgcgcccggcccaggguccuucuuaacucaguguuucaggcagcuaccaccaccuuauuggaaauggcuuuugagcugaaacucacuugcugucccuaucaugagauacugauggugccuagcagaugccccauaagcacuggcaccauaaugcauggggcccagggcuggaacauuccuguuauccccuaaacccaccuccugcaagccacuccugagcucucugggagcuaggcugggcaucgggagcucuguauuuuagucccaauucuaccacaaacacugagcaaagcauagacucucuuugggccucgguuuccccaucuggaaaaugaggcaaaaugagauaaugcugaccccacacuuggcuucucucuuaugucuggcuucugccuggacacuggggcuggggcagggcagccucagcccagggagcuggcaugacaggcgggcacucacucuggcuggccguguagacgccgucugcggccagggggucuuccuucacagucugggagccggaggagaacucgggaaggcagggcacgagggagcccagcaccagaacaaagcacaaggcugccaccugguagcaaagagagaguggcaucagaucugggguaaggaggggccacggcccugaccaccccacuccuccucucccaaaccaacaggcacaaaagucuuagcguuuucccaaggaagcagcugcuccagucgaccacucccuccuacauguggggucuccuauccucucuggggaaggcagggacagcccaggccaucccagcccauuguaggggggucgccacaggcagugcuagaaguaagagggaaguggccaauguggaguccccuuacgggguagaggaaucaggaaaggaaggaauaggugcagguggggcuuggggcugggacgagggagggggacacaccgccacaucacguucucagcaggauucugaggagccuggcuagcgggaggugcugagagccacggagcccacacuaccccugcccauagccugguucugcugccugacagcucgagggucucggagggccggggcaugcugagccaggcggcaagagacuggccauuuccagaagaagauagaagagggacuggaagaggucugaaacacgcccugggagccuuccggguuuccagggguuuccucagccuuuucacugccaucuguuccagaaagaaccauguccguucuucccugagucuccccaagcccuucccugcacaaggccuguggaagccgccuccucaaggaaccugcccagcuguccccuagcuggggccacuggagucaccuacacaucuacacuguguuaaccagucggggaccggugugaggcagaaggcaccaugggcuuggagaaggagucuggagucugcuagaaccagcccaccaggcgccaggaugguguacccugggacgcugcccacgauguuaccgauccuuaaagcucugcccaacccuggaaaaagccagccuugggaagaacucuccuccugugggucugugguggagggagccacaccuaccaugaggcaggucccagucuggguggcggccaucuuguaaggucuggagaucuuguuggugaccagagucuggaguuucugcagcugcuggagcaggguccugaggagggcacagcagucagcuggcaggcuuugaccccgcaggcaucucugccuccuggagcucuccuagggggcuggcuccagacuuggccuccacgccaggugcccguuucagucaagauaggaaaggucaccuccugcguggcuccucugcagaguggccuggcgccuggggccugccucauggugacuggcugggucaccuuguggaagcucaggccugcccugugaugcuccuggccaaggggguuggaggagggaaggccugcccccagcugcacagaugccagccuucuuuugcuuaaccgacaccugccacaguuucacugaccuucccucccuggcacccccagcacccugagcugauaagaaggagcuguuuggcacagugccugguauguagugagugucuaguaaaugguagcuauuguuuuuguuagguuuuuuguuuuguuuuguuuugagacagagucucgcucuuucacccaggcuggagugcaguggugcguuugcgacucacugcaaccuccgccuccgagguucaagugauucuccugccuuagccuccugacuagcugagacuacaggcgugcgccaccaugccggcuaauuuuuguauuuuuaguagagacgggguuuugccaggcuugucuggaacuccugaccucaggugauccacccgcuucggccucccaaaguguugggauuacaggcaugggccaccgugcccagccauuuuugcuuuauugcuguguuugcuuuuaucacggcacuucguuuauuuauauaucuccacaucagucuccuuuauuaacuguggccucccugagggugaggaccgggucccacucagcguggaaucuucugggugcauacagaaugcguucagcacaggcuuggugggcaaauguuuaaucucucuccacccaaacgggcacguagggguugcaguucccacaauguacagcagguggcgaaauaacuacaagggcuuggaccuacuuugggccagaaaggaaccccagccagagacagaggggugggguggggggucaggugggauucuccaggccaaucagggaacagaggaguggcuggaucccgcuggagaagcugggggagaaggaaggaaagaaggaaaaagucuuguguugagcaccugcugcauaccaaggcuguugucuagguuauuguaauuaaucccagcaaauaauuauuaaagaccuaccacaggcucauggcugggcacuaucaggaauuuggaaugaaaauaaugguggggugugguggcucacgccuguaauuucagcacuugugggaggcugaggcaggaggauuacaugaagucaagaguucaagaccagccuggccaacauagugaaacccugucucuacuaaaaauacaaaaauuagccggguguggugguacacgucuguaaucccagcuauuugggaggcugaggcaugagaauugcuugaacccaagaggcggagguugcagugagccgagauugugccacugcacuccagccugggcgacagagcaagacugugucucaaaaaaaaaaaaaaaguaaauaaaaauaaaaaaguaaaaauaaugaaagaaggccaggugcaguggaucacaccuauaaucccagcacuuugggagccaaagcaggagguaugcuugaguccaggagcuggagaccagccugggcaacacagcaagaccacgucucuacaaaauacuuaaaauuagccaggggugguggugugcgccugugguccuagcuacuuaggagguugaggggggagaaucaggaguuugaggcugcagugagcuaugaucaccccacuacgcuccagcaugggcaacagagugagacccuaucucaagaaaauaaauaaauaaaaauaaugaaagaagaauaaaagcuaacaugaauugcacauuucuaaaugccaagcaucaggcuggauccuuuauucgcaggaucuuauuaauacccucacauccauccuaugagauaauguuucuuuucuuucuuuuuuuuuuuuuuugagacagagucucacucugccacccaggcuggaguacgguggcaccaucucagcucacuguaaccucugccucccggguuccagugauucuuuucccucaaccuccugaguagcugggauuacaggcaugcaccaccacauccggcuaauuuuuguauuuuuaguagagauggggguuucaccauguuggccaggcuggucucgaacucuuggccucaagugauuugcccgccuccgccucccaaaaugcugggauuacaggcguaagccacugugccuggcccuaugagauaauguuucuaucauccccauuuagacgaagaaacaggggcccagagauauuuaacgauuucuccagagucacaaaaauggcagagcagcguaagaacccagagcugugacuugacguggcugcuaccugccaggcacuguccugcugucucuauacuccuguuucucaaacuucauaguacaugugaaucacccaaggaccuugugaaugugcaguuuuuagcucaguaagucuggagagaguucugaaauucugcauuuuuuuuuuugagacagagucuggcccaggcuggagugcaguggcacagugucagcucacugcaacugccgccucucggauucaagugauucuucucccucagccucccgaguagcugggauuacaggcgcccaccaccacgcccagcuaauuuucuauuuuuaguagagaugggguuucaccauguuggucagucuggucucgaacuccuaaccucaaaugauccaccccccucauccucccaaagugcugagauuacaagcgugagccaccgugcccagccugcauuucuaacaagcuccuaggugaugcugauguugccugucugggucagcuggcuuugaguaacaaggauuuacaccagugguucucaaacuugagggugcaaccuaauuacguggagggcuuauuaaaacacagggcgcugggcccuaccccuggagcuucugauucaguagaccuggcauggggcccgagaauaagcauuucuaauaauucccagggauuguugcuggucugaggaccacacuuugaaaacaucugcucacuuaagcaacuccccagcccugccagguguaggugaggaaaaaugggaacacagagaggggcaggauguaaguggcccaaggcugcaggguguguuucuggggucccugucauccuaaacuuaguucucucuccucuccccugucucccagagcuaugcagagccaggcacggguugcagaggggcagggggccagguuggaugcaggaggcacuacccaccuguuggcauucuccagggucuccaccuucuuccacaguucauuguucucagauguaaaugucuccacccuguaggggccaagcaggcacaggcucaggggcagcccccagacucacaacagcuccucggcccagcccaccaccaucacacucccugugcccccugccucugcugcccccugagggagggccuaggggagggcaggucaggcaagggaguggauugcccaccccucccaagccccuuacuucuuuucuagacacuccacauacuccuucuucuuacgacggcucuccugggcugagaucuagagggggaggcccgaaaacaaggguuagcacugccacauauucacuuccugggccccccaauuucagagcugguaugccaggggagcccacccaccaaggaagcccucugaagccccaggguggcaggcuuuaccuuguucuugauuuuccuccggacucucuucaaggccuucuccucggcuuuggugagggggaguuuuguggggaugggguagcccucagcaaucaggguccgcuucuccuccucugucaggagcaguggcccugauguccccuguaauuucuguaggaaguaugaugugguaguuaggagccaggcagcccuggguucaaauucaagcucugccaugugcuaucuauaugaccugggcaaggcacacaaugcucuaugccucaguuuccucaucuggaaagggaguggaucugggugaaauucaguaacaugugucaggugccagggccaugcugagagcucagguguuaggcucuuagugcauuguucgggagggcuuccuggaucccaucccugagacugcacccucaaagcuuacuuguccagggugccccaaacagcaucucccucagaccccucccuacaaucuuggcuugggagacuccacacccaucccagggcucagggccuagcuccauguuuccuggggauucuggaccaucugggcacuuccccucacacagcgcuccuuggaggcagccugggucauccccuggaggucaggaaugucaaguucuaguccuggcucugcaauagucuccuguucaccaugaggcagggcgaaaggauuugaauuccugaccagaugcgguggcucacgccuguaaucccagcccuuugggaggcugaagugggcagaucaagaggucaagagauugagaccagcuuggccaacauggugaaaugcugucucuacuaaaaguacauaaauuagcugggugguggugugcaccuguaauaccagcuacucgggaggcugaggcaggagaaucacuugaacccuggagguggagguugcagugagccgagaucgugccacugcacuccaggcgacagagcgagacuccaucucaaaaaaaaaaaacaaacaaaaaaaagccagacacgguggcaagugccuguaauuccagcuacuugggaggcugagacaggagaauugcuugaaccugggaggcagauguuucagugagccgagauugagccacugcacuccagccugggcaacagagcaagacucaaaaauaaaaggauuagaacucccaucugccagguaagcaucccucugaauucugaugaggguggggaucagucucggggcuccccaaacccuccugacuggccagugugcucagguggauguauucaauuccucauuucugggaucagcccacccccagcuccuuacgugaggggcagugaggaguggggagguggagauggccguggaggagcgcgccaugggccugacagggcuggaggggggcagagagcggggacucugggagccgucgcugucacugccauggcugcuggggggcgucggaggcaucugcaccagguccucuggggagagcaggggaaaccgaguuagcaacguugcacaucagcuccacuuggacaucaugaguucagcugagcaugagcuugcaccagcccugacauugugggacacggacugccaggcgcuuggucucagcuaugacaucagaagccccucugcagggucagaaagacaguugacaucuggguagccaauuccugggugcugccucaucugacaccacagaggcccagcuccuuuacaagcucgcccuuggcauagacaucauaggagcugaauucgugggagguccucugugaccucugacuucacaggguucagggccuuaagcucagcaacuccagaagaucacuaagcucuagcucagcaaccccagaaggugacuggggccucucucucauagggucaggcugggcaagcaggagcgauggcagcaguagauugggcaagaagaggacuggacgaaggcugggugcaguggcucaccccuguaaucacagcacuuugggaggcugagacagguggauccccugagucaggaguucaagaccagccugaccaauauggccaaaccccgucucuacuaaaaaauacaaaaauuagccaggcgugguggugggcaccuguaaucccagguacuuaggaggcugagacaggagaauugcuugaaccugggauggggagguugcagugagcugagaucgugccaugguacuccagccugggugacagagugagacuccaucucaaaaaacaaacaaacaaacaaacaaacaaaaaacaaaaacgaagaggacuagacgaagagugggcauggauggagggacaguggguagggcaggguggagaggauauucugggugggggaagguugucaagagauagggaugggcugaaccaaggaaguggggaugcuaucugccuaugacuggaggggaaaagagcccuuccccuggacacaccuacccggugucacuuugaggaacugguucaccuccagaggcucugcuuugaucacuggcagcugagucaucucucccggggccugaggaacagacaagcccagcuccauuagcugccccugggucuguccccaccaugccaucuacccaccuccucccuaaagcugguugccugcccugcacaguuggggaaguggcugggcuuggaguucugggcacagcugcaagggaacagaggcaagcucuugagcuuaaagaagccaagucacaccuaagagaaaggauugcuggccaagcaguguagcucagaccuuaagcucagagaaggugagccucugaguguggggccaccuuccacaccaacugugaaggccacacaggcuuugguauguggguugccaugagaauaaaacaagagguaaugucuggaacaguguagcuguucaauggcugguagcaguaguacagaaggaggcauuaauuggcugggggcuccgaggaugcucccugagaagucaaagucugaaaugagucccgggguauaaauagaaguagaaucuagacaaagaaguuggaggcaaugagagcuccuaauggguugaaguaagggcuugauagaaucagauggacauuuuuaacaaacaugcauuucucuuuauuucuauucugacuuguuguuccagaaaggacuucaagagcaugcauggcuuuguacacaugacuaccaacaugcaaguaaguggugcucugucugaggaaggcguuguugggggcuggauugcaggcccugggcugcagccccagagagaucaugauauugugggugggacgcagaauccagaauguaggcugaugaguaagaaucccagaagguucaaguuggcagggaccuuggagauuccuuggucuacaucccagcucagcccucaagugacagagaggggacugcggugcagagagcucacuguugacaaugccagcuccugugccuuccacuagggguuaugaccucacucgcgugggcuucagggucuggcaggccgaauuuggaaggcaugucaguugcuucuaacugcaugauuuugggcaaauuacuuaaccccuugagccucaguuucccuuucugaagucuccucuucccuggcugcugcugcugucacuccaucccuuccugcuuuggcaaggccugaggagucucagagccagucuuggagauggucucaaaagauccugcauauuugccgccgacccuugaucccacgggucugugguggggcagggaggggcugaccuuucuugccuucagccacguacaguuagagcaagugagccguguggccagcagggggcagggccagccacgcucccaucuagggauuuuaagaugcugcucauccuguggaaucccagggcuagaagcaccuuaggggguucaugagccccuuuuacagagaaggaggaugugcaacaugcccagaacacaaaggaggcaccgaguugggacucaggcaggaccucggcuaggagccaggggucugggguucacauucccagaggggucuuggguuuauagcugaaugcugucaucuacacauugguggaggagggaguucagccugagaguguggguuaaaaauauuaaucucauaaauguaaacaauuggaauauagcacacuuuuuuuuguaauuuccuuuuuggucuuuuuucuuuuuuaaaaauacugaagcuuugagaaaagucaguggccugggcugucuccaccucugagacccuggacugggcuccugaugccaccccugccuggagcccugcaagcugucuuuuucugcacagacgagagccucaguuacuccaagggggcuguggcuugugcccguugcgguauggugagggggcagccagggggguaggcggaggccugggcugggcgggggcuucccacccucagcccugaggcucaugucuuccuguucacagagccccagggcacagggcuuugggcaccucuucccacagacccaccagcccuccucccucccucagccgcuacaaacaguucccaggcucaccuggugggggaugggcagccuggacaaggggcugaggcccagcagcggggugguggccauggcggccgcggcagccauggccgagggggcagccagaggguccacgggcagcuccgggcucugcuccugcuucaccaugauggagcacaguuugugucccagcgcccaugcuccaugcucugcaucuaggggaaggggaaaggcucaggggacucuagggcagaggucucagcccccugccugcccccugggagcuacccuaggcugaacugaagagagcuguuaggguagaccagggggcaggcaggaaagagggugguugugaggugaggaggaguugucuggggccagaagaggugaggacauccucuucauucagcagcuuacagaaugagcuugggcaccagauucacacuccucuugauuggcugugugugugaccuuaggcuaguugcuuaaccucucugagccugagcuucuucaucugcaaaauggggaaaggaacaggacguaccuaauacagaaguucugaggcuuaaguaguauaauguacauaagacacuuaacacugugaguguuaauacuuaacacuggugagaaguaaauguucaggcugagcgccguggcucacuccuguaaucccagcacuuugggaagucaagacaggcagaucgcuugagcccaggaguucgugaccagccugggaaacauggcgaaaucccaucucuacaaaaaauacacacacacaaaauuagcuaggugugguggugugugucuauaaucccagcuacucaggaggcugaggugggagaaucacuugagcggccaggugcaguggcucaugccuguacuccaguucuuugacaggccaaggcagguggaucgcuugaguccaggagauugagaccagccuggacaacauggugaaagccugucucuacuaaaaauacaaaaauuagccaguuguggcggcacgugccuguuagucccagcugcucaggaggcugaggcaggcaggagaaucacuugaacccgggaggcagagguugcagugggcugagaucgcaccacugcacuccagccugggcaagagugagacucugucugaaaaaaaaaaaaaagagagagaauugcuugggaggaggagguugcagugagccaagauugugcuacugcacuccagccuagacagacagagugagacccugucuugaaaaaaaaaaaagaguaaguguucaauaaauacaagccaguguuaauacaacuacuguuauuuaguaaacauuuacugugcuagaugcuggggauauagcaagagucacaagcaguuuagcauaguuggaaugcaaaggggaguggaagauggggucagagaggccaguggggguggcuuggccuuggaggcuggguuaguucagagaugugacuuuauccuaaagcaaauggggagccgcugaagaguuuuguaugugcucaauuuuuuuuuuuuuuuuuauugagacaggaucucacucauucgcccaggcuggagugcaguggugccaucaugagucacugcagucuugaccuuccuggcucaauugguucucccgccacagccuccuaaguagcugggacuacaggcgcaugccaccaugcccagcuaauuuuuguauuuuuuuguagagauguugcccaggcuggucucgaacuccugaacucaagugauccacccaccucggccuccugaagugcugggauuacaggcaugagcuauugcaccuggcccaaauuugcaauuuuaagaaagauuauggcugggugcgguagcucacgccuauaaucccagcuuugggaggcugaggcaggaggaucgcuugagcccaagaguucaaggcugcagugaacuaugaucagaccacugcacuccagcugggugacagagcgagacccuaucucuaaaauuaaaucaauuaaaaaaauauggccuggcgcgguggcucacgucuguaaucccaacacuuugggaggcuaagacgggcggaucaugaggucaggagaucgagacuauccuggcuaacauggugaaaccccgucucuacuaaaaauacaaaaaauuagcugggcaugguggcgggcgccuguagucccagcuacucgggacgcugaggcaggagaauggcaugaacccgggaggcggagcuugcagugagccgagauugcgccacugcacuccagccugggcgacagagcgagacuccgucuuaaaaaaaaauauauauauauauacacacacacacacacacacacacacacacacacacacacacauauauacacacacacacauauauauacacacauauauacacacauauauauguauauauauacauauauauacacacacacauauauauguguguguauauauacauauauauauauauaaaagaucacucugcccucguguggggacuagacuggcugcaggcaagauggaggcagggagaacugcaggaaguguugaaaucggccaggagagagagaaggggaggccugagcaaaggcaguggcaguugugauggagaggagggaacagauuuagaaggaagcauccacaggacccagugacuggggguaugaggcggguggaggaggcggcgguggggagcgguggggagcagugagaggugaggcuuagauuuccugagggaagaacccaccuccugcccaccuagugggccuccugguuucaccugggcaauagggcuggcaggcaucaccccuuuuccugaugggugcccacagucuuccacucuaagucagcccuguucaugguggccacacugccugguagccauugaagcagcggguaagacaggggagaggggaggggagccaacauucaaggcagggcuggaggggacucuggacuuuggggccugcuguggucggggagaggcaguaguggcugauugaccaccuuggaggccaggccgcacccuguugggagccugagugccccagcucugggccacaggcugcccaugggcuccaggaauacccacaaucuucccaaauuacagggccuggccaccggccuccgggaagcugcccccugcaaagggcccacagacaaauugcuuuaaaaauagacgugggagcugggugugguggcucaugccuguaaucucagcaauuugggaggcugaggugggaggaucgcuugaggccaggagguugaggccaggaggugagccaagauugcaacaccguacucuagccugggugacagaguaagacccugucacccugcccgccccccccaaaaaauuaauaauuaaaaaaagacuuaggguggcuaaggaguugcugggcugaccuaagaggggcggaugucccugccuucaugggguuuggggggagguacaaagguuugucuuugccccuagggaaucucaaagacuaucagacgcagcucacacuucuugcgcugagcacagcucuaagcccuugucacacaugagcuucuauuuuuuuuuucuuugagauggaauuucgcucuuguugcccaggcuagagugcaauggugcgaucucaguucaccgcaaccucugccucccggguucaccgauucuacugccucagccucucgaguagcugggauaacaggcaugcgccaccacucccggcuaauuuuguauuuuuaguagagacgggguuucuccauguugguuaggcuggccuugaacuccugaccucaggugauccacccuccucggccuaccaaagugcugggauuacaggcgugagucacgcgcccaggcaaaugagcuucuuuacuccucccaacaacucucugggggcaggcaccauuguucucaccauuuaacaagugagaaaauuaagaaauucacucaagaccagguccuuuagagggaaagaggaauaagaagaacacuguucauuguuacaagcacccauaguguuucuguuuuauuuuuuuucuuuuugagacagggucuugcucugucgccuaggcuggagugcaguggugccaucauagcucacugcagccucgaccuccggggcuuaagauauccuccugccucaggcucuuagguagcugggacuacaggcaugugccaccaugccuggcuaauuuuuuaauuuuuaauuuuguggagaagguguuuugcuauguugcccaggcuggucucaaacuccugagcucaagcaauccuccugccucggccucccaaagugccgggauuauaggugugacucagcaugccuggcccacccauaguauucauaggacuuuuaugugcacagugaaaauagucacuaauuauuauuauuuauauuaauuuuugagacagagucucacucugucauccaggcuggagcauaguagcaugauuucggcucacugcaaccuccgcuuccuggguucaagcgauucuccugcuucagccuccugaguaacugggauuacaggcacacaccuccacucccaacuaauuuuuguauuuuuaguagagacaggauuucaucuguuggccaggcuggucuugaacuccugggcucaagcaauccuccugccucggcuucccaaagugcugggauuacaggccugagccacugcacuuggcugcugcuaauuauugauguauauauuaugugcugggcacuuagcaggguauuuuguauauauauauuuuuaagccugacgagaacucucaaggcguauauuauuuucauuuuaucacugaggaaacagaggccuagagagguuaaguaacuugcccaagaucacccaguggcugguggagacacggggaugcacaccaaugcccuugugggucccaaccaaauagcccuggcugcccuucuugacuggcaaauguggugguggcaaggguuugcgguugagaaucagggugugcuauuaugucucuguucugcauuuuacugugggcgugaccuagacaacugagcuuuugugaagucucaguuuucuuuuuuauuuuuuuuugagacagaaucucgcuuugucaccuccgcuggagugcaguggugcaaucucagcucccugcaaccuccgccucccggguucaagcaguucuccugccucagccuccugaguaacuggaauuacaggcgcacgccaccaugccuggugaauuuuuguauuuuuaguagagaugggguuucaccauguuggucgggcagguuucgaacuccugaccucgugaucugccugccuuggccucccaaagugcugggauuacaggcgugagccacugcacccggccaagucucaguuuucuuaucggucacauggagauuaugauaaaagugauuccaaccucaccugucagucaugagaaauaaaugugauaauuaacaugaaggcaaucuguagacuggagaguacuauagaaauguuuauuguuauuugcauuuguagauauagauacuaaggauuacagagguuaagcaacaugucugugaucacguagccaaaagcgacagagccaggaccaccuguauuugaggaaaugcccgaagggaccauuucuaaguggggcacaaugugggucuugaaugcugauuaccugaguggaagaacucagggugcucuuugcuuuaaaggauggaguuagggggagaggagagcuuuagagaaugcuaccuucaggaauaaaagaaggaaucucucucaaguagcgucucagaggacaacauaguaugaggaggcagugagguucuagagucuugguaacuugucuacagcuuauuauuauuauuauuauuauuauuauuauuauuauuauuauuauuauuugagacggagccucgcucuguugcccaggcuggaaugcagugacgcaaucucagcucacugcaagcuccgccucccagguucacgccauucucuugccuuagccuccugaguagcugggacuacaggcacccgccaccaugcccggcuaauuuauuuuuuauuuuuaguagagaugggguuucacucuguuagccaggauaguauuauuauuauuuuugagacagagucucacucugucacccaggcuggagugcaguggcuugaucucgacucacugcaaccucugccuccuguguucaagugacucuccugucucauccuccagaguaguugggauuacaggugcccaccaccacgccuggcuaauuuuucuauuuuuaguaguuucaccauguugaccaggcuggucuugaacuccugaccucaaaugauccgcccaccucagccuccuaaagugcugggauuauaggcgugagccacagcaccccgucuauuuuuuuuuuuugggacggagucucacucuguugcccaggcuggauugcaauggcgcaaucuuggcucacugcagccuccgccucccagguucaagugauucuccugccucagccuuccaaguaccugggaugacaggcagcauguaauggaggcaccaugugauggagggcaucaugcugggcuaauuguuguauuuuuguagagacgggguuuuaucacguucgccaggcuggucuucgucuccucaccucaggugauccacccgcaucagccucccagagugcugggauuacaggcaugagcaacugcacccagccaguuauuauuauuuuugagauggagucccacucuguugcccagguuggaaugcaguggugcggucucagcucacuacaccuucuccacccggguucaagcaguucuugugccucagucuccuaaguagcugggacuacaggagcgcaccaccacgccuggcuaauuuuuguauuuuuuuuuuuuuugagacggaguuucgcucuugucacccaggcuggagugcaauggcucacggcaaccuccgccugcuggguucaagcgauucuccugccuuagccucccgaguagcugggauuacaggcacccaccaccgcgcccagcuaguugguuuuuuuuuuuuuuuuuuuuuugagauggagucucgcucugucgcccaggcuggagugcaguggcgcaaucuuggcucacugcaagcuccgccucccggguucacgccauucuccugccucagcuucccaaguagcugggacuacaggcgcccgccaccacccccggguaauuuuuaauauuuuuaguagagacgggguuucacuguguuagccaggauggucucgaucuccugaccuagugauccgccugccucggccucccagagugcugggauuacaggcgugagccaccgcgcccggcccuguauuuuuuuuuuaguagagacgggguuucaccauauguuggccaggcuggucucgaacuccugaccucgggugauccaccugccucggccucccaaugugcagggauuacaagcgugagccaccacacccggccccacaguuauuauugaauuacccccacugucuccucuaagucagcgguuugcaaaucugagugugcaucagaaucaccuggaaggcugggcccuacccacaggguugugauucagcagguuggggguggaacccgagaaucugcaugucuaacagauucccaggugaugcugcuggucugggaaccacacuuuguaaaccacugacuuaagucagcaaaaaacccuuuugagaagugcuccucuggcuuugagcugagggagaacagaaaggcagggaggagcaccuccuaagggguuugugguggcuccucuuggagccucugggagucucaggcugcaggcacacucucuugucaccccagagcuuccucccuccugggccuccugggccugugcuguccccagguucuuccaccucuuaccuugggugguguccuccaucuugaugggcacaagggggcucuggggcgcugagucgccgcucagggaguagcugugcuccgccuggaugccuggcguaggggaguccaguuccauguccaauagagggcucuucucauccagcacagggucaucaaagaagcugcugaacaggucauuggagaaguccuccauguucuccguaaagugguccaggugcucaggaaagugcuagggaaggaagaggugaggggaagagggaauucagcuuugcuugggaagggggugcaggugcuacugugguggugcagcaccccaccauggccaccacugucccugcaaccucccauuacugugcccauucccauuaauaucagcaacaucaccaaucuccccaguaccaacauugcaacaccaacucucaucauuuccaucaugaccguuaccacugucaucccauucucucuaccaccagcuccacgcucaccauuguuaucugcaagggugagcucaggaugggaucaaaaacucccuggaccaggcaacaggacacugggcucugugaccuuugucaaaucacuuaaacugcgugagucaguuucucaguccuucuuacuuccuucauaggcugaugugaagacaaaguaaaagaacaaccgugugucuacgccaacaaguuuguuuuccaaaggcaauauuagugaauuuuguaugaucuuuugcuggaaugugggaagggagugaugcagggcagugggauucuugaggccuccagucuccucagcagcacaguguccaucuguccucaagacuucggggucucucuccuuucccaagccauccuuuauauggagagguuaggcuccggagcccuacuauuuagguucgaaugguggccuccauccuucuagcuaugauucagugcuguuuaaacuguggguggugacucauuaauggguugugaaaucaauuuagugggucacgaccagaauuuuaaguaaaaauaaaacagaaaaaaaaaaguagaaaauaucagagugcacagcacacaguggaguuaaauaccuggcaauuaaaaaaaaucacaguugugugugugaacgcacauguguguacuugguaaugauguaaaauauauuucuuagaaacaaaaaagucugaaaaaucuuggucuccaugaucuugggaaggucaauuaaccucucuguuucauuucguccucuguacagcugguaauauuaauaguuccuaccuuccaagauugucaugaggauuaaacaaguuaauccacguacaggccuuauaacagucccuggcacauaguaauuacucaauaaacguugccucuuauuguuaguaaagcacuccaguggcugacauaugguagguucuuguacauuauuuuucucucucuaaagaauuauaaauguguaaagaaauguuucuuucucucucuuucugucuugcuugugagagucucacucugucacccaggcuggagugcaguggcaugauuuuggcucacugcaaccuccaucucccggguucaagugauuugcaugccucagccucccaagcagccgggacuacaggugcgcaccaccacgcccagcuaauuuuuuguauuuucaguaaagaugggguuucaccauguuggcuaggcuggucucaaacuccuggccucaagugaucugcccgccucggccuuccaaagugcugggauuacagguguaggccaccgugccuguccaauaaauguuucuauuguuuguuccuuauuuauugaacgaaugaauuugcuggugggucagaagagaugggggauggggggcugccuuagguccugaagcccugccugcugagugguuaaaggcuugugccaggggauuccuucaaggucuggaguuguuggcccuuucuggccuggaauauugggagccugucccaaccuggaagguaaugagcagagaagccuucuguaugagcauaagguucagggccacaugagucugucugcauggaguaggagaugaacacgagcucuggagucacauagacgugcuuuugacuccuagcuccaccacuugcuaaguugcuuaacuuccccgugccucaguuuccuuauccguaaggggaaaauaauaguuccuaccucauaguguugccaugaggaucuaaaauuuuguuagauuaguacucaccucauaggaguaugaggguaaaaugaguaaauacuguacauauaaaacacagaacagugccugcuacagagugaaugcucgaucauuguuaguuaucgucaucaugaaaacugcagccccuaaacucuguccccgagcugagcuuggaaccaauggugggaguuguggggggaauguuuggccuuucccuccaaacaaagccugaugagauaauccaggacaaaaugagcucagaagccccauuggcagggguacucucccacuucccaguuugccagcaaucaaucaucauccuacauuucuguugugcuuuuaacccaaagugcucuccuaugcauuauuucauuuaaucuucacaauuauccaaugagacaagacaaaugcauauuggcauuugacagagagagaaacugaggccaagggcgcuaaugcagcagggaggugcccaccaucccucacuguccagucuuuuacaacugcagcagacccuccccgguccgguaauugcccugaagcaggguuugcacccuguucaccugcugccuuccagcaccuggcucaugauacugguggagggacagggccuuagaacccagauggcaaugccaucagcauaccaauuguccaucaauaccuggagugaggcaguaccaggaggucagagcugaaugaguuucuaagaaucacugugaucccagacagaggccauuuacaggguauaaccaccccccaaccacccagccagccacagccagggccgcgcuggcuacacccuccgcagagcccgggccugccggcugggggcgcuuccgccaguucucucccuuagggucucucaaaggccugguguugggcccagugggagggggcugugagcagagggagccggugagucagccgcuaagguauuucuccagcagcugcuucucaggcgauaaggguuugccaagccccuuccuggggccugggagaggaaagaugcuuccucggaucugggcuggacucccugaaggccuuggcucaggcagaugacccagguucuucccagagacccuuuuagggugcccacaggaaacugcuuagagagcucagcuggccccauugugugagcaguccccaccccaccugcuagaaacagcagccaaaacccagcaggauggagcuuccagagcaacgggagccaaguggaaggggagggcggccaaggggcaggcgggguggggguggaggacacuccgacgcccagguccucuuugcgccgggcuucuucaggugcuggguggacggugggcgcgucccaucaucccuaggcccaccucgcccuccugggagcacugccaucagggacuccccuagagcgcucugcggcccuaguuccgucugaugccuggccucucauggcggcuaagguaggguugguuucuaucaccaaguuagaggcagaagggacgggagaaagcuccccgacgguccccugccccucguucccccccuccuauuucuuaguagagaaaacuccaguccagagagggaaacacagcuacccaggacgcacagugagcgagcuggugauguccggggcugcaaagugagcuggugaaguccagggcugcccuggcgugugcgggaccuucugguccucucacuccuuccaccgcauccacuuggccccaucccuggaaagcccauuuuggagaccucagaccuccuccgcuccagcacgcccccuuguccccucuacccccaaccacacccagcccucccuccacuucacacacaaaaguucagguuuagauuguccgauggaaauuggggagcaagagcaaggggucggcggccaggaguucacgaacuucaggggagccaugugucaacgcucugagggcgacaggguucugcagggggugagcguccuacaggggugccuuuccaggcaacgggggugggaagccggagaaggacauauuaugauuuguuucccuccucguuaaagacuuuuuccuauagucgugccaauauaagcuccuucucggcugucacgcgcagccggcgccggcuucccucccuuggaggagagguucccgagcucuccugcuugcagaccugcguaccccucuucucggcugcacccucucuuggagccuggccucagccgcccgcccuuuaaauuuuagagaaggauccgggugccgccguccuggagcggcccacaaaggguuaacccgggaacacccggggccgccccucaccggaauccggccugcucacuggugggagccgcagagcuccuggccaauggcgggaggcugcgagcagcagccgguggcggcguggagggcaccggaggagugcagggcucgcgcggaggagggucccggccugcgccgacggcccgcggcugagggagcgcagggugcacuggcucgggccugcaugggaccccuucugcgucuggggccgaggcagaaauggccuggccgucucacgguguccuaaaccccucaucaguagcgcggccccgcccccacccccgcagggagaaguggagaccgagggucuccccgacgaccccgacucaaagggcgagccgggccuuaaauccccuugcagcuccaucucgaaucguccuaccguggggcgcuuugguggcugucucugguggcggcagaggggacucucccggggcaguaaugguaccagcucuagccuuguuuuaccccucccuaaauuccuuccccaaggucagugcagagacaggguaaagcucugggggcgcagcugccugcuggggucgguguaggagaaugguuucccugaccagaagcagccucagcgcgcccucuucccucaggucccuggcuccuuggcgccugcacccccacuccuaacuucugccccucccccggcccaggcugguucagucugugcuuggggaaaggagggaggagaccagagcggguccaggcugagcugugggauaaggggugggggggaauccugagcccggacauuccuuccgagagagugagagcuagggagagaugggaggagaggccucucacauuucccccuuucuuuccccccgcaggcuggggcccacagacccccccacaccccaacacacacugacccaugcauucccggacgguuacuugccucguggucacuagaaaauuguccccauuucaagcugaagggccuucagucugagucacugcugugccuagggggcggggaguggugagagcagggagaggaggugggccccuugaguccccgguugucagcagaccccccuguccuuaagcauugccauccaguagcugggguuccuacgaggcccaggccuugccuucccagagcuaaagccgcccugugaaggagaaaacgcacugaacugaaacucaggaggcccuaauucaagacccaggugugcucugagaccugggcaguggcaggugucuccucuccuggccucgguuuccucauccauuacagucugugucuuuauggaagcgcgguugacaggggccuagaaaagugaauuagucuucagaacgugggccuuuuuccucugcccuggccuuuuggggacuggauggugugaaaccaguucuccuggucccuggagccagucccucccugagucuuccuggcagaguauggggguuaagggagcacguuguucugacccccgaccucacucucagcccccaguccccauaggccuagggaaggcggcugcugaaguuucauauuuuccccuaccgaacuggucaccacagaucccaaguccaaauaagcagaaauacuucggugugugugugcacgcaugcaugugcacaugcuacacagaugugggcugagggguuccuuuguacacagggaaacaccaccucucugacaccacauagugaaaaguacacucaucgacacauucagccaguuccaugugcagccuuguacaggcgcuaucacacauacagauacccucacagagucacauaggcugacgcugucagguaugaacacaaacucaacaagacacacucaucagaugugaucagacaaacagugauucacaccccuacgcucacacacaugcgaagucaccccagacacaggaucacacagacauggucacgcauacucgcugucacacacacaccaucucacauaaccacagaacuaaauguuggcugccaagccagcaucucagugccugagaugacugagucaugugaacaccagugagggagauuugggagccccgggcuugcauggggcugggacacugagggcugggacugaagaaagcgccaacauggggacugagcuuuucuuugccagugugugcuggagaaaggaaggagagaggaaucagcaggcuggcgccagccgcgggcuacuucaaggcagagcagaguccuggggaggguguguauucucugcagcccccuagcccuguuagucuggcccuuccauugccccuccugacacugguaaccuuguccuggucaggccauagcuuccucauuuucccagccagccccuggcaucuucuuaccaggcagcccaugcgcugugguccaacccuggggugggcaccaggcacugucugggcaggaggaagcgauggcagcgagugccgccgcccagggcugggauuagcugugucuggcaccuccgagggcacagcagcccacggucuggcugcuggagaugcuggucuauaggcagcggccaggggaucccugcagggcagcuuaggacaccggaaaccgagugccgggguuggcgcaggggccucuggagaauaagggcaucuagucacauucauuuauucaucauucaugcauuuguucgguauuuacucagcaccuacugggugcccagcuuuguggauacagagaugaacaagauccaguuccugcucucaaaaggcuuucugaccaauggugugacaaugaaggguaaguccaagucucaaacucugaucccucuccagagcauucuccaccuuacaugaagagagaucuucuaggccacucaagggggcucacacuuguaauccuagcacuuuggaaggccaaggugggaagauugcuugaggccaagaguuugagaccagccugggcaacauagcgagaucccaucucuaaaaaaaaaaaaauuuaaaaauauuagccaggugugguggguaaucccagucacucaggaggcugaaggaggauuacuugagcccaggaguuugaggcugcagugagcuaugauuacaccacuacacuccagccagggcaacagagcaagacccugucucuaaaaaacgggaucuucuaaaacuuagaaguccuaugucauuucucugcuccauugaugaggaacuuguacucaucaucagugaaucauggcucccuacuacccuuaggauagaguacagguuccuugguguagcuucaaaugauccagccguauugccuauaugucuugcuguguccaauucucguuugaaucugcaaagccuagcauugguccccgcacacaguggaugcucaggcauucacggagugacugacugacuggaugagugugugaauaaaggagugugucagagagcuuauggagucaggcccuuuuuucuguagcagagagccuccaggaaugaccgucccgaaucuugcucugaugccagcuugcuucugcuccaggcagaguuuccauguguuuggaccccuucccucggcuccucccuaguggggccgcuguacccauucuccggguuguucuuccuucccuaagccuuucuguucuuaagccccagcagaccagguaccugggaagcacagacuccacucagugcuggaauugcuguccccccagacccugucaggccuaaggguauaaacagaacacaguggccaacccgccagggcugcucucucggccccuggccagcuggaaggcccuccucgccuggagccuaccgccucacucuggcuggaauucccuuggccucuccccucuccucaguguacucagcauucagccucugacauccucagcgguccuggccugaguuguccucagguuuuauuuuuggaaggagugguauucucucuccuuauuuacucccuucuuucagggaaggugugggaccccugggcucagcuggggauuaggcuauugacuccaaucccuggggucuggagcucucugggccuccaagggaggggaccuccaaagacucuugacccacccgaugcuucaaagccagcugucucugccuuccuucccccacccaguaggugacuaaugcuugcccuugcccuucuugaagagcccugcaacggccaaaagaaaucauuacaauuuucgaacugaaaggaauuuuggcaucauuagguccacccccucuuacgugaagaggcaaagcaguucaaugguuauaagcaagggagucagacggaccugguucuaauccugguucugcuauacacugugcaggcuuuggacaaguuacuuaaccucucuaagccucaguccugaguauaaaaugggaacguucauauccaccccaccagguugcugugaggauuaaaugagacaacaauugcgaagugcuuuauauaaugcaggacauauaggaggaaggcucucauuaaauguagcuguuauuauuacagaugaagaaaaccgagagcuggggaugggagugcacuugccuggggucacacagcccaagguaagcagccguuuccagagucauucauuugucucuaucucccuuccaaggagaagagaaggacuggcaccagcccaaaggcacauuuuccuugagucagucggaugggcaaaccacugggucuucagugccucccuccugccaucauacccuggcccaccucuguggcaagcauuuccuccauugccccaggggccucuuucuugcucacugagggucaggggucuggggaagagaccccaguacucagccccaaguggcccccaggccagugggacucugaggggagcggggagugcuggguccugacaucacagagcagagaagcuagagccacaguuaugcaggccagcuggggcccuuccagugcauccagaugucucaggaaugugcugagcugggaacuaccaccuuccuugccuccccacccccaaccccucauccccuugcuugcucaagcucugccuccgcccacccccuuggcuccuccucuuucaucucucccugggaggccuccuguacacugucccucuggcaccgugccacagucaggcucccuguuaguccucugaagggauugucagaggcaggagcccuuccccuccugcagaccccaggggcugaacuugugggguggaaggagaugggagcuaacugggaggagagaguuccaagcagauagugcaugccagaucccaaauguggaagugauuugcagcccuggagagaaaggggugaaggccuuggggcggcagagggcagggcuggaaggauggugaguggggcucugggcaucuugucccagccaauggguaagagggucaaggagcuggugugccaggcugggcugggcucaggaggaggguucagacccuccuaggccccugggguucauagagacaugcuuugucugauaguagaggguccugaaguauuggaggagaugggggaaucuuguuaggguccugguguugggccaggagccaggacaugguucaggcuggagcucccagccccaaagaggaacagccugucccuuugcaagggcggaguugccuugggccuccccaggccagccuagcucucagugcugggggugaaggagccagaagggaacugguacuccuggcccagugcgagagucacaucagggcacugaauaguagaaaucagaggagagaagggaccuggagucagcugcuguccugggcucagggaggucccacaacucuguucccccugggggagagucccugaucacccagacaggcugacagcugagauccgccugauggaccgcaggccuccuagcacugagacccuucagaggagcuggugaccaucaccuggugcaacccagaacuaucguuggcucccuccugccugcugaaaaacucccagcuccucagcaugauacucaaggacugucagaaacugaucccaacuuaccacuagagcuggagcccccucauuuucucuccucuccaggcuaguuggauggaccauucccagcuccuuaaaccugcugugguccccauggcuguaggaccuuugcuuauaccucuccuggugccugcaguguuuuguccuuuaucuccucauucuaacucuuccuauccuuuaaggggccaacucaaaugcugcuuccuccaagaagccuucccugaucaccaagcuugaagaguaaucucccucucuguucuaccacagcacuuacagacuguuaggucauugguuaaugucaugcccugaacucuaauuacacacaaugggauccagcuguccuucuaaacguuacccuucuuucggguagaucaaggacagguuucaucuuuuuuguuuuggagauggggucucacucuguugcccaggcuggagugcagugguaccaucuugggucacugcaaccucugccuccuggguucaagugauucuccugccucagccucucaaguagcugggacuacaggaauggaccaccaugucuggcuaauuuuuguauuuuuugguagagacgggguuucacuguguuguccagguuggucuugaacuccugaccucaagugauccgccugccucagccucccaaagugcugggauuacaggcgugagccaccgcgccuggccggauuucauccuugaacccucugcagagccucaaacagggcccagcauauacucugccuaaugguaaugaucauaauauaauaacagcgaauauuuauguaccaggcacugcucuaacuuccugcauguaguaucucauuuaagcuucaaaggauaaaguggguccucuuaguacccucacuuuauggaugagacgcugaggcucagaguaguuaagcagcuugcccagguucauucaguuagcaaguggucaagcggggauuugaacccaagcucugauugcagaacccacgcucuuaagcacccacaacaacacugguugcugaaagaaugauccugcugccccauugcagcaccuaguccagggccagauacaaaauaugggcccccacuccacacacuggguucauccuggggauccgguuuugcuccuuuccuggccaucccucuccugcugcccagaaagagcccugagaaguggccuggggcuuuuuggcuuuacccaaaggaaagagccuuccaucuccagagaguugagacagaaaaauaaaauccccgugaucagggcucugcagggcuggacaaggugggauauuccugcgagggcugucaaaugccaugggccuuccuuuuaagcaaugacagcaacaaucaaaauaaaaacagcaagggggaccacagucaauuauaacuuaauuuuaaaauaacuaagagggccgugugcgguggcucacgccuauaaucccagcacuuugggagacugaggcgggcggaucacuugaggccaggaguuugagaccagccuggccaacauaacaaaaccccaucucugcuaaaaauacaaaaaucagccaggugucauggcgcaugccuguaaucccagcuacucgggagacugaggcagagaauugcuugaaccugggaggcggaggcugcagugaguggaggucgcgccauugcauuccagccugggcaacagagcgagacuccaucucaaaaauaaaugaauaaauaaauaaauaaaauaaaaaaaagaguguaauuggauuguuuguaacacaaaggauaaaugcccgaggggauggauaccccauucuccaugacgugauuuuuuuuuuuugagacagaaucucagucuguugcucaggcuggaguuuaguggcaugaucucggcuuacugcaaccuccgccuccuggguucaagcaauucuucugucucagccuccugaguagcugggauuacaggugcacaccaacacgcccggcuaauuuuuguauuuuuaguagagaugugguuucaccauguuggucaggcuguucucaaacuccugaccuugugauccacccgccucggccucccaaagugcuaggauuacaggcgugaaccaccgcaccugucccaucaugugauuauuauguauuacaugccuguaccaaaauaucucaugugccccauaaauaucuaaccuacuauguacccacaaaaauuaaaaauuguccagguguggugacuuaugccuguaaucuuagcacuuugggagccaaggagggaggaucgcuugagcucaggaguucaagaccagccugggcaacauggcaaaaaaaacaucuuuacaaaaaauacaaaaaauuagccagacauggugguaugucccuguaguccuagcuacucagggguuugaggugagaggaucacuugaguccgggagguugaggcugcagugaacuguguuugugccacuacacuccagccugggcaacagagugagacccugucucaaaaaaaaauuuaaaaaccaaaacaauaaaaacagcaguggcaacuauuguuuauagaggguuuaugguguaccaggcccucugcaagaauuucuaauggaauucucuuaagaacccuauguuuuaccaugaacccuacuuuuggaugaggaaaauaagcuuggagagguuaaagcaccugcccaagcucacacaggugacaagugggaggccccaggucuaagcagugcugaagacgucccgccucaggcaaggaucacuuccccagcacuugccucaucaucugccaucugaccuguggacccacugucugcacacguugagccugggaguacgcaccugggaagucuugggacuuuccuguuuaaaaucuccccagagugggguggauucagggucuacagcucaccucugucccaaacucaugcagcuuugagagaccaagauauucagaaccgaguguguuuucuuuucuuuuucuuucuucuuucuuucuuuuucuuuuuucuuuuuguuugucuguuuguuuuuugagacagagucuuguucuguugcccaggcuggagugcagugguucaaucucggcucacugcaaccuccgccuccuggguucaagcaguucuccugccucagccuccugaguagcugggauuacaggcucccgccaccacgccuggcuaauuuuuguauuuuuaguagagacgggguuucaccauguuggccaggcuggucucaaacuacugacccgccucagccucccaaagugcugggauuacaggcaugagccaccaugcccggcccugagucugauucuuaagcuggguaaguuuccauguauuaauuuuauuauacuuuauaacugauagauauacagucuauauauucuaccagugcacaagauaucauaauagaaaaggccaugaugauaaagugaaagggagagauggcauuuaugcuaacauucacgauuugaguaaucaaaugagugaacgaaugaagcaaucuacuuuaaaaaagagggccaucaaagcuggaaguguagaaguguccuuucuuuuacuaucuauccacccaccuauucauuccucuaucguccccacccuacuccauccugccuuccuuccauccauccaauaaauaaacauuuccugagcacucagucauuauagcuguaccuagggaauagccgcaaauaauugacugacacacccugcucucaaggagcccucaguuuaguucagaaaugaggaggccaaggcccagaaagggaaagugauuugcccagggucacacagcaagugagggaaaugagguaaagaagggugaggguauuccagguggaggggaacccaugggcaaaggcucagaccugucugccuccaaagcgagccccugucaaucacugccugaaacccgccuccuggcucuccaugaaggccugaagagccugccucacuccaucgcuacuuucauuuuuguuauucuuuuggaaggggaggaggagccaguggcugcugcuguccagcuguuaugucggaccgcacaucccagcccagaugugucaaacucucugugaugggugaaguggcuucugggccacgagccacgagccaacggccaaggaagcggcagugaaggcucugucccaggggaauuaggggaggaggcacacugaacccggcggcagggaagcccaugguugcuccagcuaucaaacuggccuuguagacaauauggugugucuaggugguggggaucaagaucuuugacauuccaaagaaaucaauaccuuugacauauuuccucugagggucagaguccuggggcauuuccugccucucccagcuucuccugaaccagacaaucccacccccacacauuccccaauccugguccaggguccugccauucagucuggcuuccccagggcugcucaagaggguuacacagaguuccagcucacagucuugacuuaacuccacccaaauauuccuccuccauccugcccccaggagugcugagacuuccagagaaacagccuguucuccagcaucuggagcugguuucuugagggagguucaagggcaagccagguuccagagagagaugcuccaggagggccucgguaccaggacucgcacgaggcacaugauacagggagaagacacaaaacagggauguccuuuaugcuccccucuccuggugcaguagccaggccaggccagggcagacagaaacagagucuccugaggaguccugggagcugcagagagcaaagauccaaguccccagaagggcuggggaacagcauccugggggugaaucugauagggugugaaaugggaugugggagcuuauucaggggaucugguuuugcccauaaagcucuaggcauccaaggugcccuaaggaugggagugggugaggaugaagacagggacccugugauaugaaagauccugaauuuuccuugcucuagaggggaaaucucaaacuagaacaaugagagaacuugcuuguagcuucuucuugcuccccucuuugacucuccauaggacuccugcccuugagcagagugcacaauggauaauaaugccuauacguguucaguaaaaggaacauggccccagucccuguggaaaugccuuuuuuuuuuuuuuuggagauggaguuuugcccuuguugcccagacuggagugcaauggugcgaucuuggcucacugcaaucuccaccuccuggguucaagcgauucuccuggcucagccucccaaguagcugggauuacaggcacaugccaccaugccuggcuaauuuuuuugguauuuuuaguagagaugggguuucaccauguuggucaggcuggucucaaacuccugaacucaggugauccaccugccucagccucccaaaguguugguauuaugggcaugagcuaccaugccuggccagaaaagccuucuaauaacuccuuugccacuaaggaagagggaaauuggggcagcaugugcagagaucaccuucugagaaagcuuucaugaccuguagccuggcucagccuccugccaugcucugcuccaucauggcgcccaccaugguguugauacugccuauuucccucucugucucucucauucguccgcgauugacuggagggucaaguguguuuucuucaucuggguuacccuggcaccagcauagauguuccuucagugcccaguugcugaaggaauggacauguguauuaaugaaugagcaagugaauucccagcugguccagggaagccggagggaccucacaacauaucggggcacagacagcacuucugugggacccagcauccccaccacccuaagggauggccaguccaggauccugaaaaccccaggaucccuucaggaaucauaaguacaccucuugaacacuuagaucugauuuuuugggucuugcucuguugcccaggcuggagugcaguggcgugauaauagcucacugcagccuugaacuccugggcucaagugaucaucccacaucagucuccuaagcagccaggacuucagguaugugccaccaugccuggauaauuuauuuuuuauuuuuuguagagacggagucuuucuguguugcccaggcuggucucaaacucuuggccucaagugaucccccugccuccgccucccaaaguacuggaauuacaggugugagccaccacauccagccugggauuuuuuuaaaacaauuuuucccuucccuuacaaggauugccccagucuaaaguaauuuucucuacaaauauaguaaguccuugaaauagagcaaaguucacuacaaugugacccaaacuugacuucuguucuaugcucaggccccuucucaaauaaaagugagcaaaacuccauucucuauggggcugguaaaaaaaagugacugccucaugcuccugugguacucuuucuguuuggucugcuuugugcaguaaggugucacaauuuuuacuuuccugcuuuuugugauaguacagaccaucugaaaaauacuguuuuucguuaauucuacaaaaauauuacuccacauuuuauguaauuggaaaauuuauuuuuaaauuuguauuauuauuauuacuuuuagagacagggucuggcuuuguugcccaggcuggagugcagugaugccauuauggcucacugcagucccaaccuccccagcccaagugauccucccuccucagccuccuaaguggcugggaccacaggcauaugccaccaugcccggcucauuuuuuuuuuauuuuuuguagagacgaggucucccuauguugcccagacuggucuugaacuccugggcucaagcaauccuccuaccuuggucucccaaagcauugagauuacaagcaugagucaccgcaaaggaacauaauuggaaauuuuugacugggcauauuuauugcauuauuguagaauuuuacuacauugagcaucuauuuugucccaugugacugugcuagguuuaugucaaugcacaaaacugauauggacucuccucuuauggaacuuacuuucucguggaggaaauagacaauaggccauuaaaauaauugcaaacuggguuaagggcuagaagauaucaaaagacuaaaacagaaaagaacaggggggucccacuuuagguagucagggagcguucccuaaggaggcaauauuugagcugggaucagaaggcugagauggacagacugggggaaaagcaguccagaugacaggaacagcaugugcaagggcucugaggcagggcuggaaaaggcuuagucuuaaauugggugaguauggauccaggaguccuagagcaaucugaagaagaaacuggggaaaacggaagcccuagagacagugcucaagagugacaccugagccacaaguucaaauccccugugggucagccagcuguagacuauucuagaccaggggcugcagaggccugugcaguagggggauggcucaagguaaugagaacucauuaaaaaccauggagagcccuuccuggaccccagagacagugcagggucugcaggaccucgauggcugcaaauagaugggcuuaaggacacuuuucccucuucucuaagaauguggggucugguuugggccccuuuuucuucauccauccauccauucauucauccauccaucgauuuauucauucaucaacgguuguuaggcacugggauacagcagugaacaagacagaccaagccccugacucaaggaacuguucccucaacacugggggaagcaaaacccaaaucaaaccucugcucaaaacgaacuuaauguuuugauagaguagguaucagaggucuccuuucugaauaggcacccugagauuugggcuccuccaguagguuuuucauuagaucuuuucuagcagauugcacucugagaccagagugccuuagcacuucuguccucuuuccuguuggugagaacuuaaacagaaacacacacaaaucuccccuuuuaaggacuguuaaaggcccacccacagacauaggaacacccaaacacacauacuucucuaaucucccuaaaucucccgaaggcugggggugggggugccucucugcuucccaguuagcucaggagaagccaggcuaggcguguggggaguagcgaucagccuuagcccccaccgccuccccgcaaugcugggcuggucccuggguccccgucacucccacaccuggccuccccagcugcagggaguaaacgggugugcugggcaaacauccuugcagcuuccugcugcuccccucugagaaaacagaccuuuucuuccuccuccuucuccuccccacacccucccagcuggggcuucucugggaucccaagccaguucccucuagagaagccagacaucccuuccccuuagccagaggaaggaggggacagcacacagaccuaguguuuccaucuggagaaacgaccugcucucccucugguccuuuaucccaguucuuggagcccagacccucucucucauacuggccaaggggcugaaggaccacagaguacaguggcucaaggguggccacaucagaaaccaugggagagcgggaggggcagggaggagaugcccccacaugggacaggaagggcagcccccuucugaggaucucugagaaucgcauaaacagaauugcagcaacaugaagguauccucauagaaagaaaaauaaggcagcccagccaccuccaaacacacuugucuugacuuuguguacucacucuccugucuguccaagugcaugcguauuucuugcauaguuguuuucagggugagcauacauuuugcauuuugcacagagcaacagagcacacaugauuuccacaugauuuauggcccguaucuggauuuuuaaggaggauagcgaauauucugcucuccauuuuccagacugagaggcacacagacgccaucccuacccauccuuaacccuggaaacauuuuccuauccucaugcagaaugaagaaguugggggaaggguuggaaugggaucucagcuggaaagaaccucggauauggagauggagaccccagagaaggaaagugacuugcuauguucacacagcaacucguagcugagcaauucucacuaucacgcccauccagucucuauggaucaagccaacgaugaacguuacaugccaggcauugugcuacauaaccuucacuuuaauuuucucucgaaaugcuuacaguaaugcuauaguucuaauauucccauuuuucagaugaggaagucaaagcccagaagaagaaaagucacuuuuggccgggcgcaguggcucaagccuguaaucccagcacuuugggaggccgagguggguggaucacgaggucaggagaucaagaccauccuggcuaacacggugaaaccccgucucuacuaaaaauauaaaaaaaaauuagccgggcgugguggcgggugccuguagucccagcuacucgggacgcugagacaggagaauggcgugaacccgggaggcggagcuugcagugagccgagaucgcgccacugcacuccagccugggcgacagagcaagacuccgucugaaaaaaaacaaaaaacaaaaaacaaaaaaaaaaacaagaaaagaaaagucacuuuucugaauugucccgcuggcugguggcagaaacagagacagaauuaaaucuccugauucccagcccaagaguccuuucucucuuuccuuaggcaccccaucuucucccgcugccucuccuggcgcugccccaggugcgagaucaggagccuccccagcagggcuuuuccuccccaguguccuagugcuggaucccacugucuggucgugccucuuuuccugugcuggaccaaggcccagauaagcagcuggggaugcagggcugaauggagcagcaggaagaggcuucgggcggccgaguucauucagaagaaagcccaacucagagcugccaagggccgagagaagcuuacugcagggcucuacugcccugcuugacuucaaggguccgagcucugacaaaccucuuucccucugacuagugucuuuuaccagcuucaagaggagguguggaucccccgaucccugcugcuuuauuccugggaucugugccagaaccaucuauaggaagaccugauccaaccucucccccauuuuacagacaaagaaacugaggcucagggaggagagccagugguaggggccaagcucacaggggaagcagagccaggacuagaaaccaagucucgcugcagucaaugcaagcccucugcccuuauacccuugucuugucugcugaauuaugcucucucugccugggacaggggccuuccucagagcgcagggugaccaggaugugcugcuuaauggagaacagggagaccucagcccccaugccuccuugacuccggcuccugucccuuggccugguuccucaccaucaaucuaguggccugggacaguuuagguggaaguccaagaugcucaaguccucuaaggacuugacucuugccuggccaaguuuaucuugguccugggagguagaggucagcagguaaagagucucaagugcuugaucacaggguguguguguguguguggcgugugaacaggcaugcacacgcaacuggugguucacugaagagggggcucccacuagacuccccaaacaauccacauuucaucugggcaggcccuucugaacccaaauauuuucucccauucuaaguccgugccccucccccaucaaggccuuagggcugagccugagagagggagggagggaagaagagagagaagccacguuuccuuagggagggaggggaagagugagaaagaggagaaagacaagcucacagucggaccuagucaagaagacauagggagagggagaaagucagccagacuccaggaacagagggacagagcagagaucuagaggcagauggagagaaauggcucccuccuccugagccaucacccuauguugcccugaccgccucuucccagcccccagccucaggucccucccugggguggggggucucugggccugauucccuggggcugccaggguagcacccugaaauuucugggccuggcuuccccgaggggucgggucucaggcccucugaacguuccccggugcgccccccagcggagauccagccuaugagccaccgaagccccaagggaggcgcaggaaagggcgcugccacuuugcgcccagucugguccuggaaccugggguggguuggggacggcuagaagacguggguggagggcgggauuggugucucuugagcucagauccgaggaucggacggacccgauaccucgauggccccuucccccuagaagguggaggccaguguauucaaagauugagcccccaggaggggcgcuuagcuccaaacacaugucgcuccuggagacccugcgcugaacccucuccccggcuccugcccagugauguguagucggguccuucuaggggcccaggcgcgccgcgaggacgggugccgagggguggaacgggaacggagacccuucaucuuaccgcauuguugaggaaguccgacucguucagaucccccaaguccaggaagcuggauccggggaacagccugucggccgggaaggguuccaagacggcguccaucgcagccggcucccgggacccccuuccacugggcuucccucacuccagggcggcggcgcgcccaguccagagcuccugccugagcgcuggcaaacgggcggggggcagguccggggcgaagccccgggggaggggcggacggaggcggcgcggccccggguggggggcgcggggcgcgcgggggccuuagggcagcggcuaggagcgggaugggcucaggggccccgggcgcaccgugggcauucagccgacuccaccuccuccugcuccuccuggggcacagcuggcuuccauggggagcccgggguuggggcugagggcuucaggagccccccggacagggugggagccggggcgggggagcuaagugcucccccgagacuggguggcugccggccucuccucugucucugcgucucccuccgcacgucuucugucacuu

SEQ ID NO: 13283 - RNA, 5743 nt, Homo sapiens
aacagacuaauaauagcugccagcuagagcuccacucgugugcucagcgccuuuaggaacaauaauaacgaccacagccauaguagccaccauuuauugagcgcuuacucugugccaggugcuguguuaagcgcuuugcaggcaacaacccucggagguaaguaccauuaucaucccuauuuugcaggaaacccgggcacagagagguuaaguaacuugccccagggcacacagcuagcugaugucagugccagaauuccaaccgcggcugucggaccccaugccauccucaugucaacccacuaaggacgggauccuucuguccaucuuaaagaugaggcaacuaaggcacauggaaauuuaaguauaauaccuugcccaaggucaccuagcuggaaaauggacgagacagaaagcgaacccagggcuccuuucuguacgcagaacccgcggucuuggccauaggcgaugccacuuccgacagcccagcagggucuggcccugggucccagaggcgcagccccugcgggguuuggauggguuccugcggccuccgauccgcuggugaauugggugugucugagcaucguccccgcucagcccgcaggcguaggauagggaggcgucuccgggaaucuacuccgggacggguccgcgguccucagucgggauggagcgggggcggaggcagccggagggaacuggaguccccauugcagaacugcggggccgggcucugggcugggcgccugccccgcgcggccggcagagggcgcugccgcacacgccuuggaucucacugucacugggaccucggggcaggcugacgucggccugcagacgccuggacucagaaccccgaagcaagaagcuucccuuccugguggcugccaucccucaggcccaccauuucagcccuggaccugcuuucccugaccacuuuuccccaucuucugugcuccugccaucccaccacuggccuucaagacuuccccagucccugcacagcggguuuugucaucugcugagaggcgcggacacugauucccaucccauuaaaaggccuagaugucugcaagucaaauucagccuugcuuccccuucucgcccucuggugauuuaaaauagggauacaucaucuacuuggaauaaaugacuaauuuuucucuucuccaaaauacgguggguauggggaggguugguuaaguaggcgcacacagaugaaaggaucuauuuucauaauagcuaccgaguacagagugcuucuuuugcgcugagcccuuuaugugcuuugacucauuaauccucacuacagcccuaagagguguggaugaugauugcuguuugauggaugaggucacaaggcugguaaguggcaaagcugggauucuucccaggagugucugacuuuaaagcuauguucucaucacccagaauguacacgcugaaacaacugaacagaagagguaagaugcaaaucaugaaaaacaaaucaaaaucuacgcugagagugcauagaaauaccacaugucaugggaggcuugaccagcuugaguccccaaugugggacucagauguugaacagaaaaacaaaaccuaaaggugcaaggagagaauaagaaugaggcuuuuggcuuuagcuuggaagagcauccggagaggcccacucacuuucuaugucugggcucugagaaaauaaaggugguucuaggaaaaucugaaaaguaugggagaaagaaaaaaaaaaucccuuuugugguuuuuccuuuaaccaagccucauuuugcuauuuguguuuuauuuuaaaauuaauguggcucuccccacccuuuaaauuggcacauaaauagcaaaaacagaaggaaagccagcuacaaacuuaaaaugugguggguuucucaggaaggagguacaugacuugaaauggaaaugaggauuaaaugagaugccuuaaacauuucaaaaacagacuuuccacaaggaauuuagaucauaagcccuuagggcagaagcuuugucugggucugggcuugguauagugucuagaaucugugagugcccaaugaauguguaaaacaaaucacccuuuuaguacaugcuugcaucaucugaccaucugggcuaccacguugcuuaugguuuuauuuauuauuauuauuauuauuuauuuuuugagacggagucucacucuuguagcccaggcuggaguguaauggcacaaucuuaacucacugcaaccucugccuccuggguucaagugauucuccugccucagccucucgaauaggugggauuacaggcaccugccaccacacccggcuaauuuuuguauuucuagaaaagaugggguuucaccauguuggccagucuggucucgaacuccugaccucaggugauccgcccacgucagcuucccaaagugcugggauuacaggcaucagccaccacgcccggccugcuuaugguuuugaaguguugcuucuggggugauauuccuguccucuagaucucagucacuccucagaccccucccuuuuccagaaauuugcucuggaaauucaaucaaggugaggcaauaggugaugaugucacuaggcuuggugaaguagaaugacugcucagcucuggaaccaccaacuggagguuuuuccaaacgaggaaaacaaagucaugggacuugucacuuaauaguucugacuguauugcccugugccuuuaaacuggaagaauucccccucuucacccaauacccuggccaucccagguggccuccugcaaaauuauuggacuucuuugcccuuuccucagucugcuucuucuucccuccuucuuucaguaccuucacuccacagacauguauugagagcccauuauauguaggugcugggaggacagcagagaaccuagcaugagcucaugggcucaccuucuccuguucccaccuccaccuggcuccuuucuucauggcuccaacuuucagguuuggcuccaccauaguaacugacuugcuucuccaugugggaacaacuacucagacacuuuuuuuuuuuuuuuuuuuugaaacggaauuucacucuuguugcccaggcuggagugcaguggcaccaucucagcucaccgcaaccucagccuccuggguucaagggauucuccugccucagccucccgaguagcugggauuacaggcaugcaccaccacacccggcuaauuuugcauuuuuaguagagacaggguuucuucauuuuggucaggcuggucucgaacucccgaccuuagaugauccgcccaccucccaagugcugggauuacaggcaugagccaccaugccugaccagacacaucugacauucuaucagcuccgggcagcuuccugagaccauaccugcugacuuuagaaccccaccuuggggguacccauuuggcagguuuggauccugauggaccuucaggagcagaacuugggaauguucuagcuccaggaccugccaaugccgucccauccuuuccuaguuggcuuuccuuccauucauaagaacacugugacaacugaaauaauucaggucauauuuaugaaacaucuauuacaaugagaaucccauagugacauaauacuccacuguucacaggaaaaugcuagcuaaaacaaacaacagugacugucuggcaagggacgcaucgaauaaugcuuaugagucuuuugggucuuuuuuuuuuuaaucuugggaucgagugauugauaauaaugaaggggaaggaagacauuaggccuguuuuaguucucagaauuauucacagggaauagacuuucaccaucaacacccuaaagaugcagaaugcucaagguaaauugccaguuuuugucuuucuggaaaauccauuaauacugaaugaucuuggucuugacccauuccaaaaaaaaaaaaaaaaaagaggauugagccaugggauucagauuauguccuugaaaaucccuuuaaaaacuagauuccaaaucagugcucucauucuucuugaauaucccacccaccagcuuagcuuguccuaucccuucuagauacagcauuauuuucucucuuugaggaagaauggcccagaggccggaagagugagggaacguaagaacgacuuuuccacugaccugaguugcuaaagccauuuggacccagagaacucauuguauaugugugcugcucaauauauaugugugcaugaauuugugguugugcauuuucuggcuaauauccaaagucuucauaacaaggggccugagauacgacaaaaggaagaccuaugugucaaggacguguguccacccaccaagaaguucuggaugcccaaaggggcuccuagcucagggucuguguguccagcugcugggguaaagagauuuggaaaccacugaacauuucugcugggauccuuccaaacccuuuugggaaccggcaauagcacuugucaggggaaauuaguucugcacuuucacagagugagaaauuccucagggggcauucuuguacuugggaagagaaaucgaacccagcugauuccuucagggcccuugccauuaauaaagcagacgaaguccaguucaguuagucccgccugggucagggcguggagugaggacaggagcaauggcguucagggaauuucaccuguggcuauggcccuccucugaugggugcaagcuugauauuuuaggggaucgcguuaccggcauguaaacaccgugagugacagccaaagcucccaggcgaccacagaggaucucaaacccuuccuaucuuccuagaaacccuggcagcccgaccggcugcuugcugucugaugcaacaguuugcaacgcuguucugggaguugaguccugcugcggggcgccgggaaccgggccgacgcgcaugcgcgggcugcggccccgccccaaagggcggagggggagcuuuucaccagaugugcggggggcggggccggucggccagggagaccucuggcagcucgcgccugcgaucugagcuuaauuaaacuucucccgaggcauuggcugacugauugacccagugauccaaaaaaaucagagaggcccaaaucuccccaaacgcaccggcagagcgaaguugggaaguuggcuucgguuuccagacuugggccuuuggauucggcgucccucuccugcgcccccgauccgcagcacuguccaggauccacagcucggaagcacagucaagccucgcgggucugggcccucacaccacacacuuucuuaagaagggaggcauuguggcuacggggcggaaaggaggcaagauuuugauaccuccuuugucaguaucuccucugccucgcucaucuguuuuagguuuuaugagcaggagacgucaccgauuauuuuccaaaauuuucagcuguucggauauugccuucacgguuugcuuccauguccacauuccaccacuauuauauauuuuaauagacuuuuauuuuauuaacuuuuucuuuaacuuuaaaccguuucccuuuuuuagauagcuuugcccuaagcaauaacauuagcaaagcuacaggcugaaaauaaauucaaaacuauuaaaauaaaaaauauauauaugggcugguccgagugcagugguguuugcaacuaacugaucacauucaguuacagauuucuuucuuuucuuuuuucuuuucuucuccacucacacugcuucacuugaccagccauauauauauauauauauauauaua

SEQ ID NO: 13284 - RNA, 2234 nt, Homo sapiens
ugggcugaguuucccaccaggacgaggggagggcugggggagcgggagcagccacccgcgaaggcccgggccccgcuaccugcccugacccccugcccugcccccgcucuggggccgcgucuccuccccucacuccccaaggggaggggccaguguccccgggcccgggaucaaagacacugcgggagcucgacacgagggaggaggagggggccggaaugcaggccgcagggucugggacaccugcucuggggacaggggcggagccggccgacaccugcgccagagccgcggagcaccugaagccuucgccucacucccccacucucaguccagguggcccggccgggcccugccggcgccgccaggacaaagcgcccuugugaaggccgccucccgcccgggagcuggcgaggggccccagacgcgggcggccuaggcugccugggcagggccggggauccccacucuuguccagaucgucgugauugugcccgggcgcaccggccuggagcucgucuuuccucccucucccccgcgcaccccauagcaggccagggaauggguggggggcgcucuggacccuaaaccagcacagcgugccaggcccugugcuaaggauuuaaucacccucgauuaaucccaugaugcgggcuaauucucccccggagaguuuaagugaccuguuagacaagaacacccuccggccccucccgucucaagcggccccacuccguuccccaggcucugcgcugcagaagcagcuuucuugcuccuccuccggaagggucucccgccccaggacuugcccuugacguuccuucuggcagcggagccucccagggcuggcuagcacucauggaaaguugaaguuguuugcuuguuuauugcaggucucccucccagaauguaagcugcucaccggacuggaaccuugucuguccaguccccagugcccaaccagggccugcacauaccaagugcucaauaccuguugaaaguggauuggaaugagaaucuccccucccaugaccuggaaagggggcucaggcugugucauuugcccaacuucuggcugcaaaaagugaggcaaacucaaaagaagcuguggaaagcagcccaaccugagacccccuuucucugggagauggggaaggucaggcuuugggucucuggagggcagggauaaugguugcuauggagacugaugguggcuccuugugcacccagaaauugagaagggccaugcacuggccacucaggcgucuggagcuugagccuccagccucccugaucuucaucuguagccuaaagcugggguggggaaaugugauucccucuccaggacccucaacagagacgguuuguggggguuaaacaugugagaccaggccagaacaguggcuuaugccuguaaucccagcacuuuggaaggccaaggcagguggauugcuugagcccaggaauuugagacuagccugcucaaugcggccaaacuguaugacugcaaaaaauacaaaaauugcugggcgugguggcaugugccuaguacuugggaggcugagguaggaggacuaccugaacccaggaggucaagccugcugugaguuguaaucacaccacugcacuccagccugggugacagagugagaccuugucucuaaaaacaaacaaacaccauaugggauccauaguugggugcuggcccaggaugagucuucaauaaaggggcugggggagucagugcaggaagcugggucugcagaucucacuguagucacucacaauguuggcccuucuucuggcucaaccucaccacucagggaaacugaagugcugagauaccugcuaggcccccaagggguuguucugggggcguggagggagaaagagggacacguaugggcauauaaacaggugcuguuccucuuggccuaagacccauuuugacccagcucugcccaggacuuugcugugugacccuauuagacgagugaggcuccaucucugggccucugguacucucguagguaaauguuggacuggucuaccucucuuccccugugacuuggggcaaacugaaggagagaggauacggcucaaucugcccaaagguccuuccagcccaacaaagacggccaagcccaggcagggggccagggagcaggggaggggccuccugcacacaccgcaacucuuugucucugggcccuaauccggccugggaucuagag

SEQ ID NO: 13285 - RNA, 35813 nt, Homo sapiens
ccacgucgccuaccggggcggagcggggguggcuggagcagucuggacagucauggcggcgacuguggcgacggcggcagcuguggccccggcgccagcgcccggcacggacagcgccucuucggugcacugguuccgcaaagggcugcgacuccacgacaacccggcguugcuggcggccgugcgcggggcgcgcugcgugcgcugcguuuacauucucgacccgugguucgcggccuccuccucagucgggaucaaccgauggaggugaggggacccggggcuggguggcggggacgcagccaggacccugacccuggggugaccggcgaacagcacgauccccccaaccccgccacggcuggaaggccagaggggagaagccgagaccggggaaguaauucgucaugguccuaacgcgccggugggccaggguucagccucugacaaagcgcguucgcacuguuaccccuuugagccucacaacugccuguggaacggagaucaugauccccguuguacagaugagacccuugagcccuggagacccaaagucgaccugcccaaggacuuguagccagugaguggcagaacaggggcuccuggucuagggcucuuacggucuacucagggaggggcggaagggagauaacguagugugagggcgggacggguuuuugcucgcauucuucaagagcccguugcugggcucggggagaucacuccgaagccucuggcucguuugaauccgcccuaccacccauccuggcuacccugcacccagaccguccugccucuaggggugucaagugacccuggcuuagcauuaaauaaggucuucuccccuauauuauaaauaaagaagccaaaggcgucuucagguggagucgcuuuauguucaaagcuccagagaauccaggggauucuccaaaauguuuuaagcccugcucuggagcuuugaccucgauagaaaaauuuaaaagaauccaaagugucaccccgucauccucuugucaugauuuuagaggacaguagagccauuagagaugagacuuuuaugaacuguugugguaagguuagggagcaggaaagccaugauaucaagggccccucugaugaccccccaggagauggagucgacaugaucauggaaaaagaugaacaggucguuaguguauuuucacuguaaacaguauucaaacuaaagaguuuugagacauaauguacccaucgcucuucagaacaccuaguggcagucgcucgguuuguuugcauuguucuggggaauguuugcuuguggccuuguugcaucgauggacaggguuauuuccaggauaccguggcucucggcacaccauucuuuucucuccaaggugugugcccugcuaagagagugagugcugcuagcagugggccuguucaguguccccuccugcccagaaggaacaacuaaggaguccuguggagagccugcccacaguuuucaggcugccuuauugcucugucucugcuccaguuuucuacagauaggagguuggguuugacaagcaucaucaaaugaccaucccuagugugcacauuaagccaagccucagacuuugcccugcaccagucggagccaggcaaauggaauccgacuaccuucuuguuacauugucacagaguuucuucuuuuauuggguuuugggggacauugcauaguacugccuacucuuuuuugauagggaagauuaaaaaucaacaauaaaauuccuguugauuaaacuccaguuugcuaggaaccagguguuuauggauuuuugugggucaucauuuugugaucgugcuaucaaucuagugaagaagaaaaggaauguggcucagaugccugagucaaauccugaagucagaggcuguguaagaaugcagauauuaauugaucacuuaauaagugccuaauaucugccagguacugcucuagauguugcuagggauacagcagugaauaagcagaugugucugugcuccagaacuccuggagccuacauuuuaccaacaaacaaccauaauuuagugaaacgaagugccaugagaaacauaagauaaggggacagacuagagcagugguucucaaucuuggcugcugugcauuggaaucccauaagggucuuuaaaagauaccugggccccuuucccccaauucuauuuuuuuuuuuuuuugagacggaguuuuguucuuguugcccaggcuagaguacaauggcgcagucuggacucacugcaaccuccaccucccggguucaagcaauucuccugccucagucucccaaguagccaggauuacagguggccaucgccacaccuggcuaauuauuuuguauuuuuaguagagacaggguuucaccauguuggcuaggcuggucucaaacuccugaccucaggugaucugcccaccuuggucucccaaacugcugggauuacagggcaugagccacugugcccagccccuuucucccaguucuguuagaauuguucuggguuauggccugggcauuaagguuuggggauuuuuuguuuuguuuuguuuuuuguuuuuuuuuuuuuuugagacgggguccugcucaagugacaacccaagcugaaaugcaguggcaugaucauagcucacugcagccuugaccuccugggcucagcgauccuccugccuuagccucccaaguagcugggacugcaggcaugcaccaccaugccuggcuaauuuuuguauuuuuuguagagaugggguuucaccauguucuccaggcuggucuugaacucaugggcuuaagcaaucaccugcgucaaccucccgaagugcugugauugcaaguaugagccacugugcccggccuugggcauuaagguuuuuaaagcucuuauugcagcaaagcuuaagaagcacuggacuagagaaccucaguccugagacgggcaaccuaggaaguauguugcagugcauuggcaggaagucuaauuaauguuggcauucagaagaaagagaugaaguaacacaaacagauugaauauaauaacugcuccugggccuggaaacagacacacuccuaccaccuccaccauucugcuugcuuccuggaucaguugaaggcagagcugcauucucuuuugugcacaaaguuggggauagaggggagggcuggagccagccauaucuugacaugacuguaguauguguaaucgucccgugguuguuucuggauuccaagaguggucuaagagaauugugcugcagcauaauguccuagcucugcaacugcuuaaguugucucugagaagccucccugggaagggcaagggaccaucugcaaggaggggaggacccaaaaucugugacucuguuucccuccugcuccuucuacacugacucccacacaauguuuuucugcagaggaaaucagauuaaaauaacuaugaauggcacuaagaguaaaaacggacagagaaaugcaaccaagaaauacacauauugauuagcaagaagaagccuagcauacuucuugcccuggugauggugggaaguuuacgggcuaauuguagcuauaugagccucaggacuuuuuuuuuuuuuuuccaagugcuacuuggcuaagcccuuucacauuuuccccagccucaccuuccccagauuugcuacaucuagaaggagguacugcagcaagaagauaaacuaaaggaagaugugagcaguuccuagauuuuaaaaugaccucugugguuuuucauuaccuuucucuccccacugcaacuuggauagguguuagcaacaguuccucuuccacuuuauuuaaaucauuuugucccuggcucugugcugcgccucuuucaggagcuucugggacagagggaauuuguagaaauaaaauauguucccucucagcccauuucucuuagaauugguaaaugagguaaacugggaacuucccaggaugccccaugagaacaagugugucucucuucccagaugcugagagcugaacacuguuggacuguugggaaguggauugagaacgcuagucuacuggcagggaaacaggagcuucucugagcuauucacauugguaccugagagaggcacuuuacuguucugcugccaaggaaauguuucuguuugcccaaaggggauaaaaaccuucaucuuucucuuugaaauuaggaaagaauaaauauauuuuuaaaauaauaagaauuuaauauuuaaguauuucuaaauaucacucagauacuuagaaauaaaucccugccagagauugugaguuuagguuauccuuuuccauggggcuuaagcucucuuaauuacuuaggaaaaauuaauuucuauuaauauccuauguagccaaucugugccagccagugguaucaucaucguuguuagauaaccuugccuugaagcagaggaacuuggucaaggacagccuggacccaaaagaauucacuguuauccucccuccccccauuaacaacaaauaaauaaaauauuccucaacacaggaucagccauuccuagagaaggccuucccuaaauaugaguacuuaaucaaaggaucugcuuguuuuauucuaaaaggcuagccuuguagagucccugaguuauaguguccucucuauauuuuuggaaaucccagucugguuuucuccaguucugccugccucuggcuccagagcacuuacauaauaauguaauucaguugcacauguugucuaauccaaaggguaagcuuugcucucccaggaccaugugcucugaauuuuggccaugugagcucagcuaagagcugccaagggugaagugccagcccccaacaccaccaucuccaaugcccaggccaguuuccuucagaguccccucauuggaguaaagagaaauuggaguaaagaggaggguucuaagggaccacagaaggcccaagguucucucuggugaaagaaugcauauaccugcccacugagccuuugcccagucgcagcacugcuccaaaugugagggacagcugucaccuggcaggccucaaagguaguacccuagugguggcuucucauucucugcauucucuggcugccuggagucuggagauacuggggacccuccucacaucccugucuauugccuccgugugguggcuguccugagcccucccuucccggguugacucgggagggaaguuggaagaagcagagcauuucuagcaggccaaaggggaggcagaaauauggaugcucaagagagaaaguuuaguacaaacaaacuagaagcaaagaaaggcaacuuguaacagagacuagaaguaaaguucaguuuucuagaguagugcuugugaaacuuuaauaugcaaaugaaucaccaggggaucuugcuaaaauacagauucuaauuuuggaggucuggguuagagccugagauucugcauuucaacagacuccuggguguuucacagccaaugcugcugauugucagaccacacucagaggaggaaagaucuggcagcagagguguugcuggccuuugaguuggccuguggugcucccuaauggcugagcccagggcagcacagccucagugcucuguuuguugagaggcaguggcuggcuaaaaacgaacaugucaagccugacagauugccuagguuugaauucuggccacuuacuagguauaugauguugggcaaguuucauaaucucucuaugccucaguucccucaucuauaaaaugggaauaauaauauuaccuacuugauugggcuguuugagaauuaaaugagguaauguaugugaaacaaguagaauagugccugucauuguaaaugcuuauuaaauguuaaucauugccauuauuaucauuauuuuuauuuaguugcuggguucagaguugggccuucuaccagccucacaucucugcuuccugcuauaaacaucuuuugugaaagaagaaaagggcucucauaggauuagcuguacuuuagagaugcuacgaggaaucucuccuuuuaguaaaugaggucuaaaaauaaaguucuauagaaggcagauugcuacauguucuggaaccuagauuucaugugcauuccaaccuuauuuauagcuucaaaucaaaguccuaugcagccugguggacugugaaggaaaagacccccaaagcgcauggcaaggacacuccugggagcugcagauggaggacccuguguccugggguuaugaaauuuaaaucacugcuccuagcccuaggcauucuaccuggcaggguccagguuucagauggcaugagaccauuugcauggauuucucuucuuuuccuuccagaagaguggugaggcuugggggaggccaacacaagugacgcacuugcagcucccuguuccuuuucuggaggugacaauuuuucaaaaacagaaauucacagagguggagcuuuugguuugcauaaagcagcauucaaccuguuugucuuccaucccaaccucucagagagucuuccucaugcucuuuugcaaacaugaugcuuugagccgaggccagggcucagcccaugcuagaaugugggucgguggcauuggccguaggagugugucaaguuguguacgucagaggcagcagugggggcugguucuaguuggcagccugggaauagucacugcuucuguaagccuccaguagucagggaaugugacugugaugugccauuucuauuguugacagagaaaaaugcuggggauggguggagacccaagggguagauagcaggugccucagagguaucugugacauaugcagauugaccuguggguucuugaagaagaagauaagaaugccaguggauuaccuguagucacauugcuauuagagaacaggauuccaaacuccugagggccugcagaaucucagccccuggaacagaguuggugugcaacuagaaaucuuuagaaauggggcacagaacccucacgguggcucacgccuguaaucccagcacuuuggauggcugaggagggcggaucacuugaggucaggaguucaagaccaaccuggccaacauggugaaaccccaucucuacuaaaaauauuguuuaaaaaauuaauuggguguggugcacauaccuauaaccccagcuacucggaaagcugaggcaggagaaucgcuugaaccuggguuggggagguugcagugagccgagauuacgccacugcacuccagccugggcgacagagcgagacucugucucaaaaaguaaauaaauaaauaaaaaagggcacagagaggaaaauguggguuucagagugaccacccuagguuccugaauccccagcuuugucacuuaacagcuauggucuuagacaaauuaauucaccucugagugucucaguuuccucaucuauaaaauaaggaugguacuauuuccuucaaaauaguugagagaauuaaaugcagaaaugcacuuaaaaagcaugacagaaccaaaaucccauugauaaccuugguugccucuggggagugagggaggggaaaacccuuucuacuauguaccacuuugucacuggaauuuugagccacaugaauaguuuaucugguuauaauguuaauuuaauuuaaaaauaaaacgcugaaggcacucagcaaauguuaauguccuuucccuuuccccuggugauccaggucuccugcugaaguucuugccuagcugcggucuuccccacccccacccccacaaaaaugugaagauagcuauugagaaguaccuuuuaaggccuucucccucuugggaugagaaccugaucaccagagcccuggagaggccuggagagugagccaccugccaaacaaagcucugggaacuagggacccauugcaggcugugaggcuguggcagcagaaauacgcauggcccagagcaugcaugcagaaagucaaggagucuuuuccaccagaguaaggaggauuuucccggcuguggcagucugguccucugcuaagaggaccuuaaugcuucauaccacaguauugcacuggcuuuucagauggcucccacgugagucucacaacaaccucaugcugggcagauacuuauaucuagccccagagacugcgagggaguaagugacuagccucugaucacacagaaacaccacacuaggaacagcucacauuuaucucaugaugucugugugccaggcacagugcuaaauguuuuucacacauuauucgauuuucuuuucuuagcaauuuuaugagauggguacuaacaucagcuucacauuaccggcgagaaaacaggcaaagagguuagguuauugccuaaagucacacagcuaguaaguggcaagaccaggguuugaagcagagcagcgcugauccacuaccacaucccuccugggcuggaacccaggccucuccagcccuagugaucaugaggcugccuguugggcauaaacagcgaaccaguuucucccugcuuuguuaggaaagagagccacucuucaugauguuaucacuaacaaggccuguguggacuccacagguuccuacuucagucucuggaagauuuggacacaaguuuaaggaaacugaacucccgccuguuuguaguccggggacagccagccgacguguucccaaggcuguucaagguaagcgugcagagccccagagaagacagugagauucugucccugacgguuuccccacagccugagugauaugauauuccgacugagggaauggaaacaucagggcuggucuggcuguugcugcuagagaaguugggagcaaaggcagccaguuagcuugcucuuggaauggaaacuguguuaaggaaaaaaauucugggaaaccagugucuuguuggaaagcucucagcucaguccagacauaggaugugguaagucauuccacucuggaugccacuggcuuccuucaauguuuucuuggcucaagccagccagauuuauuaggguuccuucuaggccaagacuuugaggugggguuucaugucuagcaagguacauuucccaucuugcuuugcucugcuuauugggaaaagucagccuuuucugccgggcgagguggcucacgccuguaaucccagcacuuugggaggccgaggcaggcggaucacgaggucaggagauccaggccauccuggcuaacauggugaaaccccgucucuacuaaaaauacaaaaaauuagcugggcauguuggcuggcaccuguagucccagcuacucgagaggcugaggcaggagaauggugugaacccgggaggcggagcuuucagugagccgagauugugccacugcacuccagccugggcaacagagcgagacuccgucucaaaaaaaaaaaaaaaaaggucagccuuucugaggaagcuuucuuguuucccaugggguaaaugauugauagaaaucuucauuuuggugccacauagguuucuguuugcaguaacggggccaguccacuuuucccucaaucccuuuaaaaaguauauucuaaggcccacauagaagcacaggaacucauggacagagggcugugggacagacugccaucacccucagcagcacacaaugauugucaugccccuccccacccuaacuccgagacaaaaggaaaagucaugucaaggcaaacagcuuagugaauacaucauccuucaauuccccuccccguaaccccacacauaauugugcauacauguacaaaucacacagugcuaguaauugcccacauucauugagggcugccuaugagucaagcgcuguucccagugcuuguuuacaucaacugaguucuuccucacagcaggccuaagagguggcuacugcuaucccgauuuacaggagaggaaacagucauugguugugaaguuaauaagugacgaucuuggauucugacucuagagcuguauccuuacccaccauaccauauaaauacauuugccucccuucuccccucgacauugcccuuuuucucccccagcaacucagaggccaacccacuuauaucccagagauauagcuaggucauccauucagucauguaauguauuuuuauugagcuucugcuagguacuaggccccauacuagguauaaggguaaugaugaugagugagacaacaugguuucugcucugagaguucacacuaauaggggaaacaggcaaguguaucauugucauauaauacaugcugcaguggaaaaaagacaaggugcagaagaauuauauugaaggaggaggucaagaaggcuucuuggagaaaauguaauuuaauaauauuguuauucacagguuacaaugaguauucagugauguaaccuauaugaacuauaagcaugguaccuggcauauagcaagggcucaaucaauguuuaaugcugauauccucgaaugagggauaacuggcccugcuaaggacccaguccccgggcagggcugagucaggaccagaccagccugugcauggcuaggacauuugccccugugguucagagcuuucagagacuaugaccagagacuuuggagaauguguuuuucuucuugcaaguugcaugcucuagggcuuucuguggguugacuguacaaccauucacugggccagcuugcuaugagaucuagaaauuccuaccagaaaugacuaaaggcuuaggaaagaacuuccuccuuuucaacauguagccccucuggucaguuuccucugaccuccagacuaaggaucgcuuccccuuuccugacucucucagggcuggaaccuauuagcucuguuugcuauuggccucaggaguguugcuguggaaacaauuaagacacuucacauagcacaacucugccaagaaaacuaggccacaagucugcagggcugugaggagcucugggaaaagcuugcugagcaggcagaaggcugugguccugucccaccugugagucagugccacucucugggacuggggguuucccaggagcguuguauuuauggccuccugcugcauucuccuaccucaaggacacagcaagugcacaaggcugccuaccucucucccaacuccacuguugcugugcuguuggcuucgccacacugccugcccuccucaaacuuucugaaccucagcuuguuugcuuuccagaucaaaucccuguuccuaguuuuuucugcugcccaucagauaggucucuagacuagcucuguucucucccaggaaggaacugagaguccagcuucccccuccuccccaaacacaguguugagcauaacagauccucuccccacaggaauggggagugacccgcuugaccuuugaauaugacucugaacccuuugggaaagaacgggaugcagccaucaugaagauggccaaggaggcugguguggaaguagugacggagaauucucauacccucuaugaccuggacagguaagagauggggcccagggaucagguuaccaauugugagaguuaguaauuugggccccugcugagcggaacucagagagguucagcauuagggcuaccugacccaggaggcauggcaucuucuagaagcuggaggagaauaggccagagucaggaccuguagaacaggucacaaagagcuuuaccccauugagguggcagagaggcuuguuaggcccaaagcauggaagcagugaggacccacacucaggguauuuacaaaucugcuccuaguaugcccgagucccaccugugccucauauucccacuuccauccugcucaacagcugcccucugaccucaguggacccugucuguuaccccuccaacagaccucuguucacacagguccaguuuuuguaccuaagaugaguuccuaggcugggcaugcuggcucaugccuguaaucccagcacuuugagaggaucacaugaguccaugaguucaagaucagccugggcaacauagugagacccccgucucuacuaaaaauaaauauauuagccaugcauggugggacaugccuguagucccaauuacugaagaggcugagguuggaggaucacuugagcccaggggcuugaggcugccaugagcugugaucaugccacgucacuccagccugggugacagagcaagauccugugucaaaaaaaaaaaaaaaagaguucccagguucuaugacuaucuggguuuccaggccauguugcuugguggcggggagggcucuagagaucccugcagggagcugcuaacuacagaggagccuccuccccuggugacagccucugugcuuucagagauucuaggaggaaauccucuccuccccuucccugccaugccagagcugucacccuccugcugcugcugcugcuguugcugcugcugccaagccagcagccgccgccgcuccccacccccacuucccaacccagugcuggcugccaagaagccaggucacacagcugugcacgugagccgggcccucaggaggagaggcuggguguggagauccuccuccugcugcgugccagaggagagggaggcauagcagaggcagcagccgaccauauaucuccacuaacguggggagagcaaacugagaaaugaacucacccagccagaugggccuugcguaagcuacuucuuggccaagaagagccccgggaauguggcuccauaccaucccaauucauccuuauauaaacagccuccguucucuucuucgcccucugauacuccuuccuucuugcaugagugcaguuauguuuucccuggucaugaaaaauacuuuguaaacuacaagacucucuuuaaguaucaguuguggcuaugaacucuagcuccagucucugaauuugggaggauaagcugucuuccaccucucuguucaauguucuaauaaauggaggcuaagaaggggaugauuuuccaagaaaggaacaugucugcuauuccuuaugauguuagaguuaaaaaaaaaaaaaaaaaaaacaugucuucagcucuuaucaaagaacuuucuccagggcuuacaugggugguagaggccuauggggauucccuuagcuuggacagauaggccaagugccaagcaggcuaguagggauuuuucugugauuagagauuuugucagucucugucuuuaggcggcucugcgucaacaccagggagcccggaauugagucccagcucuggcccugccuugcuccauuacugaggcaccugcuucagcucucugggcuuuauuuucccucucgguaaaauggagaugcggccucccuugcccccuccuuuccacucaggcaugggaccugugaguggaugaggaaagccacccucaaagccuucagagucuggguucuuuuuugggugggcagggacccacaucacagggccauguggguaacacuagcuaugcuuugggcuccccaggaucauugagcugaaugggcagaagccaccccuuacauacaagcgcuuucaggccaucaucagccgcauggagcugcccaagaagccagugggcuuggugaccagccagcagauggagagcugcagggccgagauccaggagaaccacgacgagaccuacggcgugcccucccuggaggagcugggugcguacuuccugcccagagccacuugugcuggugccugcuuuuguguaaagaaauucuuugugaaaguaaugcaugucauuauagaaagguuagaaagcacaggaaaacaaaaauggaaauggcagucacuauuacuccaccacccagagguaaccacaauuaauuuuaaacuguguccuucuaguauuuguucuguucauacucauacauguaaucuucuguuucugguucuagaucaugccucuauuuuuguacuaaccucucgcagacaauacaggcacugccuggugcugguguccaugggcuucucaguaacaagauagcuaguauugcuucuguugaaagcagggaaucugucagccucucagauuacuaacuacacucuuucaccccucccucuuucuuaccuuuuuuuuuucuuuuuuagacggagucuggcucuguugcccagucuggagugcaguggcacagucuuggcucacugcaaccuccaccucccggguucaagcaauucugcugccccagccuccugaguagcugggacuacaggcgccugccaucacgcccagcuaauauuuguauuuuuaguagagacgggguuucaccauguuggccaggcuggucuugaacuggugaccucgagugauccacccacaucggccucccaaagugcugggauuacagacgugagccacaccuccagucuuuugaucugaacaaagcuauuagccuuuuucaccugaaaaccacaguuguugccagcuaaucugaaaaggcaggagguccgggauuguugucaucuaccuggagcgaugagggugcaggggaaagcagagaaaauagugacugugggaagagaaccaaguugaccuagaaaacgcuaaaacuuuaaggauuaucuaacccccaguagcaccgagacacugugguucaauucucauaaaguucaaauaacagaacagccgugccgggcuaucacugaaauggucaaaccuccugucuugugaccuuuccuucucuucaggguuccccacugaaggacuugguccagcugucuggcagggaggagagacagaagcucuggcccgccuggauaagcacuuggaacggaagguaugggccguuucugagacacagagcugcagauacugauauccacacagcaggagauacaggucauguccauguccuuuagucccucuuagcucacauuguuuggaaaaugaaaaauccuccuauccuccugauggccauaacaacagcaacacuaacagcaacuaccauuuagagaguacuuaccaugugcuggucacuaggcucagcauuuuuggguuaagcaccugcuggcauuucuuuuaaucuuuccaauagccugcaagguagguacuaagcuguucauucuacagauuacaaaauugaggcuuagagagguuaaguaacuugccugaggucacaaaguuaguaauuacagguugaguaucccuuauccaaagugcuugggaccaaaaguguuucagauuuuagauucuugaauuaggaaugcucaccuuauaacacaguaagaccuuguucuauguuauucuaaagcuaugucggauugcuuuucuuucaucugugggcagguucccccuacuaagaggauaucugguuaguaaaaucuauaagauuauuuuguguugaugugucuccgcaccuuuuugcuggaacucuuucagcguguugauuuccauaugcuuggacacagagcaaauggcccaccucccagugcagugagaacuggggaggaaagaagcccaggccucagaggcacagugucacaaaguccucacuccccugcagcuagaggagcagagaaaguucucauguccgagaacagucagcuccuaguuuccugcccccugcagcugguuuauaaaaugucagcuuuuucuaugccugcuaagauggcuagguauuuugccuagcagccagaugaugacgauaauagaacaaggaggccaaggcaaaucuacuugggaagaauguucuccagcccuggagguguccagucaacagugaaggcccacagccucgauguuucuaccugguuguuuccuucagccugggacgaaagcaagccccacagacuuaaaggaugagacuagcuaucucuguccacaucaaaagguucaccuagagauucuugggcccaguuugaagacaaagguugggccaaggggcagaaggguggagaugacaaaugggauugcaggaguagaguaaggcuuaaaccuguaaagagcuaucaucuaugguuaguuuuuaucagcuggagaacauuuuguagaaggaugucccuuaggucaccgacaggagcuccuuuuccacauacccccagagagcgggccccuucucucaagggcccuuacgccauggacauauucagacucaguggugcccagaggaaauacuguguccugcacaucugggagaacaaauggugcuagagauacaggaguugaaccugauuucaggauguuuauuuuagcuuccuucaguucuccaaaucugaagggagcaccuacucaugccaguuuagcaauacuagauagaagaagguaugugccucuuuuccgaaagcaccaggaaaagucccaaggcauguuuucauuguccugguuugggucaugugacugucccugacucaaugacuguggccagguauaggagguggugcuuucccuggccagacuugcaucaugaguccgcucccagaacuggaagguagguuuagcucugcuuuauccacucggacuaggaucagggaaggcugauucuccacaggaauaugagaugcuguuacugaaaagcagaggaagcuacaugaucuuuaccacuggguuacucaauaguagaugagggcaagcaucucucuauaaaaguauucugauuauuaaauuaaaaaggaaugguggaauuugaauaccaccauuuuguaacccucaauaaugaugcauuauguauuggugacugcugacaccauagaaggaggcaagcauuaugugcccccuguagucuugucaaagggaucaaaccugaguccaguccaguuucugguacuagccaccaaugugcaggugauacacaggacacagcacuuguugaacugcaccaugaguauacagucagcaaaauccagacugugggaaucuuggcaagucagauggccuggauucuuucccagaacaauggaaaggaaaagaaaaaaauggcauaaaaugugcagauuaaaagaaaauuaaauaacauauuaaaguuuuuuuuaaggccaggcacagugacucacaccuguaaucuuagcacuuugggaggccaaggcaggaggaucucuugaaccuaggaguucaaaaccagccugggcaacaugacaagcccucaucucuaaauaaaaacaaauuagccggguguggcagcaugugccuguagugccaacuacuugggaggcugaggugggagaaucacuuaagcccaggaagucaugccacugcacuccugccugggugacagagaguggggucucagaaauaaaagaaaaagaaucccagcacuuugggaggccgaggcagguggagcacuugaagucaggaguucgagaccagccuggccaacauagugaaaccucaucucuacuaaaaauacaaaaacuaguuaggcaugguggcgagugccuguaaucccagcuacuugggagguugaggcacgagaaucgcuugaaccugggaggcggagguugcagugagacgagaucaugccacugcacuccagccugguugacagaaugagacucugucucaaaaaaaaaagaaaacugaguagcugggauuacaggcucccacaaucaugccuggcuaauuguuguccuuuuaguagagacaggguuucacccuguuggccugacuggucucaaacuccugaccgcaagugauccuccugccucagccucccaaagugcuggaauuacaggcaugagccaccacacccgggcagaaauaaaguuuuuuaaauggccaagacuaaauuguaauaccuaggaaugcacauuuggguaaaaaaaaaaaagcuacuuaaacacaaagaauaacugugaaaagauaaaguccuuccuuucaaacguuuugccaaaauagaaaaauguaaacauuucagaaaugcagaacguguuuauuauaaaagcugagguagggguugcauauacuggggggcaggagggaacuauuccugggaugagcacauagacucuugggguggcugucaaagcucuguuucccaaaccuugguggcuauugcguggauguuugccuuagaauaauucauuaagucacacaugugugugauuuucuguauccaaguuucauuuaaaauaaaaauauuuuaaaagcugggggcuagcaaggguguguacacgcaaaaauaccuaguaucuguuagaagugcuuaaccugauaccacagggguuaccugcagaggaggaagccuugagguugcgacuugaaggaagagucucaguuaaccaggugaaggugagggaaaggaagacagugguccagaggcagcugcuugugcagaggcaaaggccagugagagcagaugcguaaagaagaggggcagcaggaggcggaggguacagugagccgagaucacaccacugcacuccacccugacccugucucaaaaaaaaggggcaagagacagagcuggaaaggccugggugcuggggagccacagaagcuuucaugaagauuugggcucuguccucagagcaacaggaagcccacuguguacauuaucccgagcaacaggcauuacauuacucuggucccagcguggagaaugaguuagcgggggaugggaguggacgcagggaggccagucaggaggcugccacaguuguccagucuagauaugaccuuagccugaaccagguugguggcagcagggaauggaaagaaaaggacagauuugggaaauauuuaggcaguagaauugacaggacuuggugaggggacaaaggugauggcuaggauugugccuugggcagcuagguagcuagcaguguauuaucugagguagggaggccaauggaaggguggguuaaaagaaaagggcacaucucccuugagcugccugagaggcagccaaguagagguuucuagcaggcagcuggguggagcaaucugggcuagagcuauggauguggugguugucugcaaagggguggaacugggagccaugggccuggaugagcuugcugaggcacacaguugaguagagaaccuagagcugagcccuggguacccacauuuaagggagaggcagaggagguggagcugaugaaagaccaagagcgccaggcagcugggagauaccaggagauguggagucacagaggccaaggaaucaagaggauaagacagcacaguuggcagguauagcgcugcugagagaucccaaaauacaaggucagaaagugccugcaggacucaguggcacagaagucacaggagacucuugugggaaccagccuuguggucaccugagguuuggaguuagagaccagccuggccaacauggcgaaaccccaugucuacuaaaaauacaaaaauuagccaggugugguggcaggugccuauaaucccagcuacucaggaggcugaagagagucaagguugugaaacaguaucauggagaggaggagaggauguugggaguuaagaaaguggaaauaggccgggcacaguggcucacaccuauaaucccagcacuuugggaggccaaggugggcgaucaggagaaucccuugaacccgggagguggagguugcggugagccgagaucacgccacugcacuccagccugggugacaagagcaaaacucugucucaaaaaagaaaaaaaaauaaauaaaaaaagucgugagagacugcauggaacagcaagucaggaaaguaaaguccuaugccagcaaccagugaugauaaaaacaugaccaguaauguuauaugacacauggccccagaaaugaaugauuccauugguccccaggaauggauuggaaguuuccuccuuccccagcugcuguugaacaauaaugcgaagucccuggugucugugauacaaccucagggccgcuagugacuagagaagggacugagauauucuuuucuguaacauagaagccuuguuuccugcuguauaauuagagaguucauucagugcuuucagaauucuuucauaucucauuuuaauccacagaagauuggaaauuuuguucuuauuuaauagauacguagcugagggaaguaacaacguguucacagucaccccacaaauuaaagagcaagucagagaaugacauagacucguuguuuggucugauggugguuccgucucaaaaucggcuggacaagcacaguguuccauggcuccauggcuggcuguucugugaccguaggcagauuccuuaaccacccaaugccuccauuuuuuccucuguuacauccaagccuuuccuuuugccaccuucucuuucugcuguaggccuggguugccaacuaugagagaccccgaaugaacgccaacucccuccuggccagccccacaggccucagccccuaccugcgcuuugguugucucuccugccgccucuucuacuaccgccugugggaccuguauaaaaagguaagggggacauaccugcccacauugcaccuaaggccugcagccaggccuuuugggcuugucagucacccuaaaaaaggcacugguggguggggguugggcuauggccccuggaagggccuaagugugugcagauaguccggaggaggagagaagacucaauauccaagagggcagagccaagcacagagugaacugcccaccagaaugaagcccagaccaucauguagagcagaaggacaggcagaaaagcaggccucaggugugacccuagagguggcauauccucuggcagcugguggacaggggcgagguccccagggugagaggcauggagagggugaggcuggagccagucugaaguggaagagcauagcugcccgcucuggagcuguguccacagcauucaaaaggggaguccaggaacagcaguugcccaucagugauggagggagugguguggaggggcugcacacagggcugugcuauacagacaagaagcaaauaagccuguguuaacuguccccagaaggagagagggcaacacagucagcauucagagggaucaccucaucuugugccuauguuuuuuguuucuguuguuuauuuaagagacaaagucuagcuguguuacccaggcuagaguguaguguggccugaucacagcucacugaaaccucagacuccugggcucaagcaaucccucugccucagccucucaaguagagcuaauuuuuuacauucuuuguagagauagggucuugcuauguugcccaggcuggucucgaacuccugggcacaagcaauuguccugccuuggccucccacagugcugggauuacagccgugagccaccaugccuagccguugugucuacauuuguuuuuuuguuuguuuuugagacaggaucucauucugucacccaggcuggaguacagugguaugaucacagcucacugcagccacaaccuuucaggcucaggugauccuccuaucucagccuccccagcaguugggacuauaggugcaugccaccacaccuggcuaauuuuuuguauuuuuuuguagaaacuggguuuuuccauguugcccaggcugaucucaaacuccugggcucaggccauccacccaccucagccucucaaagugacagaugcuagccaccacaccuggcuguaucuagguuuuuaaauguuaucuccucauccuugccauuauugagauuuuguggcaugggauagcuuugccaguuuggugaguaaucuugugacuuuagggaagucauuauuugcuuggaggucugauuucuuaauuaccuuauggccccagauccaggcuguguguauaauuuauucaaccaaaaucuagacugagcauuuuucaugugugcugauaggaaaauuccuuuugacuuucuagaagguggagccaaacagggaacucuugaggacaaggaacaugaccagucuugggaaguuugaauccuagugcagaguccuguggugaggccccuucccacugccuggcccucuguagcuuucuucuugcucagagcaguggcacagugcaggcagggccuggguguuucacaugcaggcaugcugugccacuucuaggggauagucccuccacaucuggcagcugagccacuaggucuuuggagggcccagauuccuuuguagaagagaccugagaggcaccaugcuaagagcugggcgaguguuuguauccaugugccaccccuaccucucaggugaagcggaacagcacaccuccccucucccuauuugggcaacuccuauggcgagaguucuucuacacggcagcuaccaacaaccccagguuugaccgcauggaggggaaccccaucugcauccagauccccugggaccgcaauccugaggcccuggccaagugggcugagggcaagacaggcuucccuuggauugaugccaucaugacccaacugaggcaggagggcuggauccaccaccuggcccggcaugccguggccugcuuccugacccgcggggaccucugggucagcugggagagcgggguccgggugagugcucucucaacgaaaagcuggccuguacccucuggucaggcccgucaaagggcagcccccuucugggcugagggaugaggugggauuucuggguccaggagauccccuccagauccucuguggcuugccuucaauggaaggguuuuggcuccugggggcacuguggugacuugggaaaaaacauggcugcauguccccaaggaggcugaucauccccuccccuaucuagguauuugaugagcugcuccuggaugcagauuucagcgugaacgcaggcagcuggauguggcuguccugcagugcuuucuuccagcaguucuuccacugcuacugcccugugggcuuuggccgucgcacggaccccaguggggacuacaucaggugaggauacagaccaggcucucuggccucugaccacuguggccuccuacuaggaugggauacccugggccuuuugaaggagggucuggguaugcugaugggucaucugguguaucuuauuucaggcgauaccugcccaaauugaaagcguuccccucucgauacaucuaugagcccuggaaugccccagagucaauucagaaggcagccaagugcaucauugguguggacuacccacggcccaucgucaaccaugccgagaccagccggcuuaacauugaacgaaugaagcagauuuaccagcagcuuucgcgcuaccggggacucuguaaggagacaaacaccuagcucacugaagggaaggacagcaccuacaggcucagggggccagauggggauguccagauacuugcaaagggagacugagugcugucuuucagguugacaccuucgcuggguaugggacacugcaggcugggaugaacugggccuuccugaguaguuguggggcugugggaggaaauggaaccucagugucuugcuccuacccuccccacccccacuugcuucauccugcccuguagcccucugcaauccugcgagacggcacucugauuacuccucgccucucucccaggucuacuggcaucugucccuuccuguguggaagaccucagucacccuguggcagagcccagcucgagccaggcuggcagcaugagcagugcaggugagcagcagcaaccaaccuccuguggccuccuguggccugugccaccacuucagucauucaggacugaggccagaaggaggccuugcccaguggagcuuauauuccaccuggggcagucagauaguaaagaaaccaaguuggaucauuucagauaacaagugcuuuggaggaaaagaaaguugaguaucuugacagagggacugggaaagaaggauuucuucugugucacuugagauuggagcagucagggaacaccucuguuaagcagagacccacgucaugagcaggagccagcccugccacacacugagaaaauaacauuccagacaaagggaguagcaagaaaaagcucacaaacaguaccgagcuuaguccauucaaggaaccgaagggaggucaguguagcggcaugucccagugaggagcuggaaugagaugaggacaagauacagcaugagcagcauguggcaggccugauguccgagacgaggacuaggauucagccuucagugcacugaaggauggucaguagggcagggcaugauuggacuuaggucugaaaaagcucccuggccugcuggguggagauuggacaguguaggccggagcgggcacagggaggccagagaggaggcagcacagacagggugguggccgcaaggagaaagacuggacagauucgcugcauucggagccucuucccuucuuggggaugaagaugaguaacaugagaugggaagaacacggguuuuucuaguuggcccagcuaggcugccuccaugggcagcaugacuccuccacaggggcccugcucuuugcugcuuggggaggcugauucaggguugcagagggaaugccucaccuucaaagcaggacagcaggcaggccaaaucagucucuggccacagcccaugccauuuggggcccaaaagcugguccugcuaccagcaggccugcuuggucauguccuccuuggacauuuccaggcaaagucacugcugaaagcaaggccgaggggcaggucugaggagcagcaugcuggcauuccauugauaagugugcucccuguccccuaaagagcugcugcugcauagugugggaucauuuuggcugcaugcacagucugugugacccuuugacacgcuucccuacaggcccaagaccacuacccaguggcccagcaucccccaaacgcaagcuggaagcagccgaggaaccaccuggugaagaacucagcaaacgggcccggguggcagaguugccaaccccagagcugccgagcaaggaugccugagagugagugacagcagccuagauucaaccucaggaaggaaguugggagugggggggccuacugcccugccagcugcagguugaaacauagcaaacuagaugaaaaucuggugggaccacccaaugcucagccacuaaagcuuuaccauuuuacaguggcagccggguuccauccuggcuuagggaaugaguacuuucugguugauaucugugugaccuuuaccauugggccggcuaugguggcucauguauguaaucccagcacuuugggaggccaaggugggaggaucgcuugaggccaggaguacaagaccaaccuggccaaaccaacauagugagacuccaucucuaaaaacauaauaauaauaauaauaauaaucuggugggacugcaugacuuuuaggauuucagcucaaaaaucccaccauucugacuuuuaucagagauuuaaaagucaagcccuuuuguauuuuuuugccagcuaagggaaaaagggaggcaugggggcugagggguggcgcuuucuaccuauuaaaaugagucacacucaagagaaagaaagcugagaccugcgugugaagcagcggggaaaaggcgcauugcagggucugaggcugcuccaggcccccugcuuuccgacaggcuguguucuauaggccagccaguggagggcagcacugaccuugagaagccuggacagagggcugugcugugucuuacuuggcccagcccugccugaggaccaguagacccagucugucaucaucuuugccuuuugcggccucuccucccuucucacccauccuguggccucagcucugcaccucccuggcagcgcucaucuuggaagccuccugaaugucaucaaaacacuggcuucuccuuucccaagggaggaagggccuuuuaugccacucuuggggaaauguaaauuccuguccccucugagucaucaucucaagcuguuccuuaugcaccaugucuucgucauuagauuggagggugauuuuucuccauggagcugauagguucuuuuuaucagaucccucuuacuucagggccaggccgcagccaucugguuugagugucuggauuugugugcucacugagaugggcauuugaugccugcacccuucaccuuuccugggcucuuugacauagacauugcugauggacagaugugugcuaucuuguuccugggaguaccagcaaccuacuacucucucaguuaucucuuagcucugugauacuaagcaaaguucauccuguauuacaaauuuggaacuugccaggcugacacucugauuuucggaugagaagaccaaagaacagagagguuaaaugucugggucaagguugcucaguaagcuaaugguguccaauucaacaugaaauuguugccagcaggugggugaagaagggggagcauuaaacauauaaaaugugaugugcuguccauccauaaggauugaacagucugcuuagauaaaaaggaacaauaaccuagaauuccuggacaaaugauacagacuauacaagcuuagcagaaggcugcugguguggucuggaacaaucagggaacauaucacagaaguuugcgcuagggggccugaaaagugaauuggauucaggcagugagcagggcgcuuaggacaagaaaaacagcugaagguuuaugugaucuuguacaaaugacuuaacugcuaugggacucaguuuccucaccuauaaauuagguugcuguugcaagaauuaaaugauuaaaucugggccgggcgcaguggcucaugccuauaaucccagcacuuugggaggccgagguggguggaucaccugagguuggggguucgagaucagccucaucagcuuggagaaaccccgucucuacuaaaaauacaaaauuagcuggcauggugacguaugccuguaauuccagcuacucgggaggcuggggcaagagaaucacuugaacccgggaggcagagguugcagugagccgagaucgugccauugcacuccagccugggugacaagagcaaaacucugucuaaaaaaaaaaaaagauuaaauguguaugugucagcuagaaaugugggggucuauuaauaauagcucaauuacuguggcuaaaacaaauaggggcuuauuuuucuuaccuaacaaggggcccagagauaguguugcuggucugggcuuggguggcagccccagcuucagccaucaauucuugaucaaagaggaaagagaagggacagcaagggcagcugcacuccuuccguacacaugucaagagcucauguuuugccagacaccauuccaggcauugaggguaugguuguauacaagacuggcaauaucacuucccccuugggugcauauuaguggaaggagacagacaguaaacaaauaaauauuuaaaauuuaaagaggccagccgggcgugguggcucacacuuguaaucccagcacuuugggaggcugaggcagguggaucacgaggucaggaguucgagaccagccuggccaacauggugaaaugcugucuuuacuaaaaauacaaaaauuagccaggcgugguggcaggugccuguagucccagcuacuucggaggcugaggcaggagaaucacuugaacccgggaggcagagguugcagugagccaagaucguaccacugcacuccagccugggugacagagcuagacucagucucacaaaaaaaaauuucaggaggccaucagugcuaugaaaacaauaaaauaaaguugaguaagaaaguaaggucggggcacagaagaggcugcaguucuguauuauaaggguugcugguccagggaccauacuuggagaaucacugacuuagaccaaucauaauccauuuucugggugaagcccauugccuccugaacacauuuuagguucuguuaaccaggaaguguggauacugguagacagcuaauggugacugcuuuauaggcaagacacuuacucaagugugugggucaugagugcuugguaagcaguaguuauuauuguagguauuguuauuauuguagaggacacaagguuacaguugggucugauuauggaggguuguaaauggcaggcacaugagucugcuauguacucuuugggagugaagaaacauuuuggaacaggaaugaucaaauuggcauuuugggaggaugaauuaggcauugggcugggaccugcagaggaacagguuggggagagaaagucagcugagaggcuugacagugauuccaagggaagacaugacaaggaugcagagguaaaugcccgucucuugcccuggaguccagaagauugucagccuacugggauuuuaaggacugauucuugagguuuacucugcccuccacugguggcucaguggggaguuaggccaggcuagacugugaagguugggggugcagaggucagaggaucugggguggugcagacuucccuccaagacagacuagggaggaacagcuguguucuuuggaaauccugagagaagaagaguacaccaugucucaccaugugcuggcagaggcaccugggccuaaagaugcuuagcauccucagcuguaaaauggugauaauagcaucuugucaccugcccuacccaucgaaaaagucuuugaauauguaaaaugcacuaugcaaauggaaucacauuaucaucuugcacuuucuucucugggugucuuugauuauguugguguuacuucagucagagccagcacccuaagcugaauggaccacagagcuguggcuauguagcccaaauugguaucauauuauauuggguugggggaggggaguggcagggagacuugccccucuuuccuccauuuccucuguaauuuuuaauugugugacuuugggcuggauccauagccuuucugccaugcuuuagguguaagaugugaauagucauucuucaucagccugaaggcuacauccugggccuuuugaggucuccuuuagcucugagcucuauaguucuggauucuguuuuucuaaugccucaggccuguggcaguguacaggguguacagucacuuaaaauuuaaacugaucugguaggaaagcauggccuccaaucaguagguucuacacuuaccucagauccacaccagcuaucuguucugcauuaaguuuuauuuuacagcauucacuaaacugaaaaacaagccagcccccaaauagcuauuguuucaaaugguuccccauaauccccaaagcugcugacugcuccggauuccauuagccuugaauuguguacagauuucucucauugguccaauuauuuugccauggggagaacagcucacguguuccauuugcccuucugcugguacagacugaucuguggagagaagccccacugaauacaaaagguucccggccaaggaucaccucuuccccucccccgcgggcuuuuguuagcucugcaguaagccugacuggguagaucaucgaguaaaaccugacuucuggauucuccuugaugucuuuuugacacuaguuuaguuguauacucuguccuuguaaggugaaaggcacuagcaauugguaaaaugcuaaauaguggaagugaaggcaguguggcauuggccagagagcccugcauuauacucagacuagugucugcaucccagaccugccagcauuacacucaaacuagugucugugucccagaccugccacuugccucuugugagacuccacccaaauagucucaccucucuguuccugccuuuaaaaucagaggcaggauucucuguuccugccuuuaaaaucagaaguuuagacucauauccccuagcgcuuucccuggcacuucauaaguaggcguugacugauggcugucccuuccacuuucuugcaugaucugcaugcugugggaaggguaaaggugugguugaccugaggaaugagauugagcucagagcuucagcucucucccccauccaggcccagcuguacuucccugacccucacuuggaagcagguagcgaacccucugccuuucucaagcucuugggcacugugccuugcccaauaugauggggagagggaaacauugagacucggugacagucugcaaacaaaguuuccuccaaaccaucagcuguuguggacccucugccagcauaaacucaugccugcacacgugcauccaccccuccagggcgaggagcauagggacgggcagacuuauacacuuggguucuugauagcaucuaauggaugggaagggaugugagggcaaagguacccaggaggccaugcuaacuaacauuggguugcagagggagacagucguuaacgcuuuuuguucuagccgccacuguguuucuuguaucaaugacagguugaaagaguuggacaacuaagagauugauuuuucagugaauguuuuaugaguugauuuucccuuggugccuccccuuggcuguucuucccuucccuuuaguccugcuaucaucauuuuuuugcaagaccucauuugauuuccccagaccccuuuuucuacagacgcaugcccuagcuugaggacaagagcauggcaccaacuaguuaucugcugaucaagcagcucgaguaacuaguugaacaggccuuuggcuagcuuuguaggcgaggccaaguugguucuucuaaaccuugguuuucugcauugguagcuuugaaaccaucauagagggacuugggugacuagggcuuaucugaguccaggacacugcccccucccuucaugagccugcccaaaacuaacuggugccgaagucaacauaugucugaauuguuaucauuauauccaccugacuguaccucacccucuuaucuucuaagcuuaggcauugguucuuaaacccuguuuggguuacuccccacuuuggaaagucgauggaggauggaacccauacccagaaaacugcauauguucacacacagagaggaaugugcacaucacuccagaggcuccauggacugcaccaaagccuauccuugggcuccuuaaggcccaggaaccccagauuaacagcaguuauucuaaggaaucuucaugcacucuuuaucuucccccaucccugaaaauggauaaaacacacacaaaaaaaauggagguguugggcaaggaggaccuuuugugguauauccugcaauccugaaaguuuucuauuucagaagaauagccaucucuuuaguuuaacaacaggggccagagagagcccuguguguggaguauauacucagaaucagcacauuucaauaaauacauguacaccuuaauaauacauacauuuguagcaaaaaaauggcuagguuauuauaguacaagcuuaaagggaaaaauuauugaaaauaacacacauuuuaaagaauaaaacacacagccaggugcgguggcuuacgccuguaaucccagcacuuugggaggcugaggggggcggaucaccugagaucaggaguucaagaccagccugggcaacauggugaaaccccaucucuacuaaaaguacaaaaauuaguugugguggcaggugucuguaaucccagccacuugggaggccaaggcaggagaauugcuugaacccaggaggcagaaguugcagugagccaagaucgcgccacugcacucuagccugggcaacagaacaagacuccaucuauuaaaaaaaaaaaaaaaaaaaaaaaaaaaagucgggcucgguggcucacuccuguaaucccagcacuuugggaggcugaaguggguggaucaccugaggucaggaguuagagaccagccugaccaacauggagaaaccccaucucuacuaaaaauacaaaauuagccaggugugguggcacaugccuguaaucccagcuacucaggaggcugaggcaggagaaucgcuugaaccugggaggcagaaguugcagugagccaagaucacuccauugcacuccagccugggcacuaagagugaaacucugucucaaaaaaaaaaaaagaauaagacacacaguacugaccuauacaggcacccacucuuaugucugcucuuuauuuugcccagcuuccagauaaauuaucaucagauaaaaucugcuucagauuuaccaugcggccuuaaaagcaucgcaugauacugaauccuugucuccaaugucuuugacuuuaagagcauuuucccuuuucuaauaacagcuuaauucacauguaugucuguuggauauuagucuucaugcugccauguugaauuucuucuaaaagucuucuucucuaaaagucuuaaugagcaauacuaucguauagagauuacuugcuaguaaaaagacagauuugagaaucagacagauguggauuuccuuuuuuggcucugccacuuaugaaugcuguuguccugggcaaguuccuucuccucucugguuucuguuuucucaucuacaaaaauggagggcaagcuucaagguuacugggaucucaaguuguguuagucugcucaggcugccaugacaaaguaccacagacuggguggcuuaaucaagagaaauguguccucucacuguucuggaggcuggaagucuaagaucaaaauguugccaggguuggcuucuuuucuucugaggcuccucucuguggcuuauaaacagccaucuucucccuaugucuucacauggucuucccucuguacugucugggucuaaauuuccucuuccuuuaaggacaccagucauauuggauuagggcccacacuaaugaccucauuuaacuuaauuaccucuuuaaagacccugucuccaaauacagucaccuucugggguacuggggguuaggacuucaacauaagaauuuugugggggacagaauucagccacagcacaaguguauaguaccugacccacggcaggcuuaguaagccuacuuauugucuaccucacccacauuuaaacugcacaaacuuuuaaugggacgcugugugucucuguagacucccagacacacuaaaccuauuuaaacagacaacucagcauugugacaggcgcacucuguccuuccuuuauuaucagggaugaagcuguuucuucucuuugccccagauuccggaugucauaaaucuuuaaaaugagucauccuugugucuccucucucccuccugcccccacaaucuuccagcacugugccagggugcuuucaucuauauguggaaaugugcucaccugcugauuguaaacucagucauugccuuacucuucaaaauuacuggucccagcgggcuucucuuccagccauuuuuuccugauucuccaucucuggcagcagcugcugugccuugauucagaagcugcccuugucauaucugagcaaguaucccccagggcuucacgugacucucacauagccuuguccuccuccuccucugcuguccgcagcccuggguggagggccugcaguggggagcuuguccugcaucagcaccucagaggggcaguauucccucaucccaguggcaucccagcaacaaccuguccccagguaccguggcccuuucagcucacucuuucagcucuucucaggucccgcucugaauguccccagagaagcagccagaggagcuugugucccugggcaacugagcagccuccugaaugcuccuuuugcacuuguuuuucucuuccagcugcagagcccuugcuccgugagcaaagccugggugcccaagcagccaccgcagcagcagaguacaaccugcagagaagcugaucaccgggcagagauagagcgagcaugugugugugugugcgcgugugcagaggagggaguggugugccuguuugugugugcaugcaucuguugacacucaugauucugaauguugccugggcugggggaguaccuguagcacgccagugcuguuucccggccuccagacacaaggcucgagguuauggcagugacuuucagcugagaccuguuccugcaagccagcugccuugucugaacagaacguagugguaggacccuagcugggauucuggcaucugccucccuagaccuccuucccucccuccucacgucaggcuguggagcaggagcacagcaguucuggcuguuguccaaagcaugggauucuggaggcagccagagcccugcugaguuccugcuuucugaccuggaggcugagcaggccggaguggauggaugcuguccagacguagccaccuggccucuguuucuuauuuuaaaauucucugcuacugggcucagucccaggcccuuccuugggcuucugggacugagcaugaggccauagacagaucuaaaaaguuuccaccacccuacagaaguacacacagauaccugacuggugugggguaugccugguacuguaauaggagccuaagacagcacaccuaccuuuucaggauuuagaaccuaaaauuagaaagagaaucccagcugucauuguuccuuccccagaagcuaagagccagccucagagccuacccaggagcugugaaggggcaagggucaaacugacucacucuaccaggaggagaccagguugcaguggcguaaggcccccugguuucucuggccacacuccaaggcaccacagugcugccagugaggacagcugacacccagccagggaaaccauucuagucuuuauucuguuggcuuccagggccuguccuggacuugucagcauccagacugccaugucagcuaucccaguagcugagcuccaaggacucaggcagagggacucagggauggggacugccaggggcaguuggcaaaaguccaaguagagauuacacccagaacaccauuccuuccaggagcaguaggugggagguuugacccagagaagccaauccuugcauuccaggaguggccugugccucccaccucuuccuucccacugccaaaggccuguguugagaaagaugucaugcaaaaggacgacgguggccaacuaaagcaagucuuccuuccacccuguggccugcacuugagccacaaagugugugugugugugugcgugugugguacguguguguguguguggcuaugaggcugauuccuguuuggauuuuuguccucacguguaucauuaagcuggccuuugggccuuuuccuuucuaccuccccugugaccuuuccuagccucagaucuguuaauucuuuuggccccagcccugucccucacuguccucuguccuuggaccagaacccuggggucagacccaucuccuguagcuguccaucacacugacaggcuucuuccugagauauccucagguuuucucagccagagagcugccuuuagaguccaacuguuguacguaugucaccuucacuagaaaugucccaucaucgugggaggggagcagggcacaggggauggugugcauucagagcauuggguugggggcuucccuguucccucagccccagucgagaggaaagagaaucgggccacugccagaaagagagucaagcaaaccuggaagggcaaaucugagagugggaaggccaaaggccgaggcccagauuuaguauucacuagcagcgccuucggguagcaggaugauuccuuuuccugccugucugcugcuggcucucuucccuaagguacagguuggcaggaccaccuccgccuacuucuccaccaucccuagcaugucagcccguucccagaucaaccugccaguggagucaggcagugcacuccuggagccaagagggaagggcaggguagagaggguauguccaguagccuggagcuccaugguggcuucaugccucccuucucccagcucagguggcccugagggcucccucggaacagugccucaaauccugacccaagggccagcauggggaagagaugguugcaggcaaaaugcacuuuauagagauuuucuauugcugggaagguguguuucucccacaauuuguuugugaauauucacuuguuuuauaaaugucugaccugucuugaguaaguu

SEQ ID NO: 13286 - RNA, 26744 nt, Homo sapiens
uugauuaaacuccaguuugcuaggaaccagguguuuauggauuuuugugggucaucauuuugugaucgugcuaucaaucuagugaagaagaaaaggaauguggcucagaugccugagucaaauccugaagucagaggcuguguaagaaugcagauauuaauugaucacuuaauaagugccuaauaucugccagguacugcucuagauguugcuagggauacagcagugaauaagcagaugugucugugcuccagaacuccuggagccuacauuuuaccaacaaacaaccauaauuuagugaaacgaagugccaugagaaacauaagauaaggggacagacuagagcagugguucucaaucuuggcugcugugcauuggaaucccauaagggucuuuaaaagauaccugggccccuuucccccaauucuauuuuuuuuuuuuuuugagacggaguuuuguucuuguugcccaggcuagaguacaauggcgcagucuggacucacugcaaccuccaccucccggguucaagcaauucuccugccucagucucccaaguagccaggauuacagguggccaucgccacaccuggcuaauuauuuuguauuuuuaguagagacaggguuucaccauguuggcuaggcuggucucaaacuccugaccucaggugaucugcccaccuuggucucccaaacugcugggauuacagggcaugagccacugugcccagccccuuucucccaguucuguuagaauuguucuggguuauggccugggcauuaagguuuggggauuuuuuguuuuguuuuguuuuuuguuuuuuuuuuuuuuugagacgggguccugcucaagugacaacccaagcugaaaugcaguggcaugaucauagcucacugcagccuugaccuccugggcucagcgauccuccugccuuagccucccaaguagcugggacugcaggcaugcaccaccaugccuggcuaauuuuuguauuuuuuguagagaugggguuucaccauguucuccaggcuggucuugaacucaugggcuuaagcaaucaccugcgucaaccucccgaagugcugugauugcaaguaugagccacugugcccggccuugggcauuaagguuuuuaaagcucuuauugcagcaaagcuuaagaagcacuggacuagagaaccucaguccugagacgggcaaccuaggaaguauguugcagugcauuggcaggaagucuaauuaauguuggcauucagaagaaagagaugaaguaacacaaacagauugaauauaauaacugcuccugggccuggaaacagacacacuccuaccaccuccaccauucugcuugcuuccuggaucaguugaaggcagagcugcauucucuuuugugcacaaaguuggggauagaggggagggcuggagccagccauaucuugacaugacuguaguauguguaaucgucccgugguuguuucuggauuccaagaguggucuaagagaauugugcugcagcauaauguccuagcucugcaacugcuuaaguugucucugagaagccucccugggaagggcaagggaccaucugcaaggaggggaggacccaaaaucugugacucuguuucccuccugcuccuucuacacugacucccacacaauguuuuucugcagaggaaaucagauuaaaauaacuaugaauggcacuaagaguaaaaacggacagagaaaugcaaccaagaaauacacauauugauuagcaagaagaagccuagcauacuucuugcccuggugauggugggaaguuuacgggcuaauuguagcuauaugagccucaggacuuuuuuuuuuuuuuuccaagugcuacuuggcuaagcccuuucacauuuuccccagccucaccuuccccagauuugcuacaucuagaaggagguacugcagcaagaagauaaacuaaaggaagaugugagcaguuccuagauuuuaaaaugaccucugugguuuuucauuaccuuucucuccccacugcaacuuggauagguguuagcaacaguuccucuuccacuuuauuuaaaucauuuugucccuggcucugugcugcgccucuuucaggagcuucugggacagagggaauuuguagaaauaaaauauguucccucucagcccauuucucuuagaauugguaaaugagguaaacugggaacuucccaggaugccccaugagaacaagugugucucucuucccagaugcugagagcugaacacuguuggacuguugggaaguggauugagaacgcuagucuacuggcagggaaacaggagcuucucugagcuauucacauugguaccugagagaggcacuuuacuguucugcugccaaggaaauguuucuguuugcccaaaggggauaaaaaccuucaucuuucucuuugaaauuaggaaagaauaaauauauuuuuaaaauaauaagaauuuaauauuuaaguauuucuaaauaucacucagauacuuagaaauaaaucccugccagagauugugaguuuagguuauccuuuuccauggggcuuaagcucucuuaauuacuuaggaaaaauuaauuucuauuaauauccuauguagccaaucugugccagccagugguaucaucaucguuguuagauaaccuugccuugaagcagaggaacuuggucaaggacagccuggacccaaaagaauucacuguuauccucccuccccccauuaacaacaaauaaauaaaauauuccucaacacaggaucagccauuccuagagaaggccuucccuaaauaugaguacuuaaucaaaggaucugcuuguuuuauucuaaaaggcuagccuuguagagucccugaguuauaguguccucucuauauuuuuggaaaucccagucugguuuucuccaguucugccugccucuggcuccagagcacuuacauaauaauguaauucaguugcacauguugucuaauccaaaggguaagcuuugcucucccaggaccaugugcucugaauuuuggccaugugagcucagcuaagagcugccaagggugaagugccagcccccaacaccaccaucuccaaugcccaggccaguuuccuucagaguccccucauuggaguaaagagaaauuggaguaaagaggaggguucuaagggaccacagaaggcccaagguucucucuggugaaagaaugcauauaccugcccacugagccuuugcccagucgcagcacugcuccaaaugugagggacagcugucaccuggcaggccucaaagguaguacccuagugguggcuucucauucucugcauucucuggcugccuggagucuggagauacuggggacccuccucacaucccugucuauugccuccgugugguggcuguccugagcccucccuucccggguugacucgggagggaaguuggaagaagcagagcauuucuagcaggccaaaggggaggcagaaauauggaugcucaagagagaaaguuuaguacaaacaaacuagaagcaaagaaaggcaacuuguaacagagacuagaaguaaaguucaguuuucuagaguagugcuugugaaacuuuaauaugcaaaugaaucaccaggggaucuugcuaaaauacagauucuaauuuuggaggucuggguuagagccugagauucugcauuucaacagacuccuggguguuucacagccaaugcugcugauugucagaccacacucagaggaggaaagaucuggcagcagagguguugcuggccuuugaguuggccuguggugcucccuaauggcugagcccagggcagcacagccucagugcucuguuuguugagaggcaguggcuggcuaaaaacgaacaugucaagccugacagauugccuagguuugaauucuggccacuuacuagguauaugauguugggcaaguuucauaaucucucuaugccucaguucccucaucuauaaaaugggaauaauaauauuaccuacuugauugggcuguuugagaauuaaaugagguaauguaugugaaacaaguagaauagugccugucauuguaaaugcuuauuaaauguuaaucauugccauuauuaucauuauuuuuauuuaguugcuggguucagaguugggccuucuaccagccucacaucucugcuuccugcuauaaacaucuuuugugaaagaagaaaagggcucucauaggauuagcuguacuuuagagaugcuacgaggaaucucuccuuuuaguaaaugaggucuaaaaauaaaguucuauagaaggcagauugcuacauguucuggaaccuagauuucaugugcauuccaaccuuauuuauagcuucaaaucaaaguccuaugcagccugguggacugugaaggaaaagacccccaaagcgcauggcaaggacacuccugggagcugcagauggaggacccuguguccugggguuaugaaauuuaaaucacugcuccuagcccuaggcauucuaccuggcaggguccagguuucagauggcaugagaccauuugcauggauuucucuucuuuuccuuccagaagaguggugaggcuugggggaggccaacacaagugacgcacuugcagcucccuguuccuuuucuggaggugacaauuuuucaaaaacagaaauucacagagguggagcuuuugguuugcauaaagcagcauucaaccuguuugucuuccaucccaaccucucagagagucuuccucaugcucuuuugcaaacaugaugcuuugagccgaggccagggcucagcccaugcuagaaugugggucgguggcauuggccguaggagugugucaaguuguguacgucagaggcagcagugggggcugguucuaguuggcagccugggaauagucacugcuucuguaagccuccaguagucagggaaugugacugugaugugccauuucuauuguugacagagaaaaaugcuggggauggguggagacccaagggguagauagcaggugccucagagguaucugugacauaugcagauugaccuguggguucuugaagaagaagauaagaaugccaguggauuaccuguagucacauugcuauuagagaacaggauuccaaacuccugagggccugcagaaucucagccccuggaacagaguuggugugcaacuagaaaucuuuagaaauggggcacagaacccucacgguggcucacgccuguaaucccagcacuuuggauggcugaggagggcggaucacuugaggucaggaguucaagaccaaccuggccaacauggugaaaccccaucucuacuaaaaauauuguuuaaaaaauuaauuggguguggugcacauaccuauaaccccagcuacucggaaagcugaggcaggagaaucgcuugaaccuggguuggggagguugcagugagccgagauuacgccacugcacuccagccugggcgacagagcgagacucugucucaaaaaguaaauaaauaaauaaaaaagggcacagagaggaaaauguggguuucagagugaccacccuagguuccugaauccccagcuuugucacuuaacagcuauggucuuagacaaauuaauucaccucugagugucucaguuuccucaucuauaaaauaaggaugguacuauuuccuucaaaauaguugagagaauuaaaugcagaaaugcacuuaaaaagcaugacagaaccaaaaucccauugauaaccuugguugccucuggggagugagggaggggaaaacccuuucuacuauguaccacuuugucacuggaauuuugagccacaugaauaguuuaucugguuauaauguuaauuuaauuuaaaaauaaaacgcugaaggcacucagcaaauguuaauguccuuucccuuuccccuggugauccaggucuccugcugaaguucuugccuagcugcggucuuccccacccccacccccacaaaaaugugaagauagcuauugagaaguaccuuuuaaggccuucucccucuugggaugagaaccugaucaccagagcccuggagaggccuggagagugagccaccugccaaacaaagcucugggaacuagggacccauugcaggcugugaggcuguggcagcagaaauacgcauggcccagagcaugcaugcagaaagucaaggagucuuuuccaccagaguaaggaggauuuucccggcuguggcagucugguccucugcuaagaggaccuuaaugcuucauaccacaguauugcacuggcuuuucagauggcucccacgugagucucacaacaaccucaugcugggcagauacuuauaucuagccccagagacugcgagggaguaagugacuagccucugaucacacagaaacaccacacuaggaacagcucacauuuaucucaugaugucugugugccaggcacagugcuaaauguuuuucacacauuauucgauuuucuuuucuuagcaauuuuaugagauggguacuaacaucagcuucacauuaccggcgagaaaacaggcaaagagguuagguuauugccuaaagucacacagcuaguaaguggcaagaccaggguuugaagcagagcagcgcugauccacuaccacaucccuccugggcuggaacccaggccucuccagcccuagugaucaugaggcugccuguugggcauaaacagcgaaccaguuucucccugcuuuguuaggaaagagagccacucuucaugauguuaucacuaacaaggccuguguggacuccacagguuccuacuucagucucuggaagauuuggacacaaguuuaaggaaacugaacucccgccuguuuguaguccggggacagccagccgacguguucccaaggcuguucaagguaagcgugcagagccccagagaagacagugagauucugucccugacgguuuccccacagccugagugauaugauauuccgacugagggaauggaaacaucagggcuggucuggcuguugcugcuagagaaguugggagcaaaggcagccaguuagcuugcucuuggaauggaaacuguguuaaggaaaaaaauucugggaaaccagugucuuguuggaaagcucucagcucaguccagacauaggaugugguaagucauuccacucuggaugccacuggcuuccuucaauguuuucuuggcucaagccagccagauuuauuaggguuccuucuaggccaagacuuugaggugggguuucaugucuagcaagguacauuucccaucuugcuuugcucugcuuauugggaaaagucagccuuuucugccgggcgagguggcucacgccuguaaucccagcacuuugggaggccgaggcaggcggaucacgaggucaggagauccaggccauccuggcuaacauggugaaaccccgucucuacuaaaaauacaaaaaauuagcugggcauguuggcuggcaccuguagucccagcuacucgagaggcugaggcaggagaauggugugaacccgggaggcggagcuuucagugagccgagauugugccacugcacuccagccugggcaacagagcgagacuccgucucaaaaaaaaaaaaaaaaaggucagccuuucugaggaagcuuucuuguuucccaugggguaaaugauugauagaaaucuucauuuuggugccacauagguuucuguuugcaguaacggggccaguccacuuuucccucaaucccuuuaaaaaguauauucuaaggcccacauagaagcacaggaacucauggacagagggcugugggacagacugccaucacccucagcagcacacaaugauugucaugccccuccccacccuaacuccgagacaaaaggaaaagucaugucaaggcaaacagcuuagugaauacaucauccuucaauuccccuccccguaaccccacacauaauugugcauacauguacaaaucacacagugcuaguaauugcccacauucauugagggcugccuaugagucaagcgcuguucccagugcuuguuuacaucaacugaguucuuccucacagcaggccuaagagguggcuacugcuaucccgauuuacaggagaggaaacagucauugguugugaaguuaauaagugacgaucuuggauucugacucuagagcuguauccuuacccaccauaccauauaaauacauuugccucccuucuccccucgacauugcccuuuuucucccccagcaacucagaggccaacccacuuauaucccagagauauagcuaggucauccauucagucauguaauguauuuuuauugagcuucugcuagguacuaggccccauacuagguauaaggguaaugaugaugagugagacaacaugguuucugcucugagaguucacacuaauaggggaaacaggcaaguguaucauugucauauaauacaugcugcaguggaaaaaagacaaggugcagaagaauuauauugaaggaggaggucaagaaggcuucuuggagaaaauguaauuuaauaauauuguuauucacagguuacaaugaguauucagugauguaaccuauaugaacuauaagcaugguaccuggcauauagcaagggcucaaucaauguuuaaugcugauauccucgaaugagggauaacuggcccugcuaaggacccaguccccgggcagggcugagucaggaccagaccagccugugcauggcuaggacauuugccccugugguucagagcuuucagagacuaugaccagagacuuuggagaauguguuuuucuucuugcaaguugcaugcucuagggcuuucuguggguugacuguacaaccauucacugggccagcuugcuaugagaucuagaaauuccuaccagaaaugacuaaaggcuuaggaaagaacuuccuccuuuucaacauguagccccucuggucaguuuccucugaccuccagacuaaggaucgcuuccccuuuccugacucucucagggcuggaaccuauuagcucuguuugcuauuggccucaggaguguugcuguggaaacaauuaagacacuucacauagcacaacucugccaagaaaacuaggccacaagucugcagggcugugaggagcucugggaaaagcuugcugagcaggcagaaggcugugguccugucccaccugugagucagugccacucucugggacuggggguuucccaggagcguuguauuuauggccuccugcugcauucuccuaccucaaggacacagcaagugcacaaggcugccuaccucucucccaacuccacuguugcugugcuguuggcuucgccacacugccugcccuccucaaacuuucugaaccucagcuuguuugcuuuccagaucaaaucccuguuccuaguuuuuucugcugcccaucagauaggucucuagacuagcucuguucucucccaggaaggaacugagaguccagcuucccccuccuccccaaacacaguguugagcauaacagauccucuccccacaggaauggggagugacccgcuugaccuuugaauaugacucugaacccuuugggaaagaacgggaugcagccaucaugaagauggccaaggaggcugguguggaaguagugacggagaauucucauacccucuaugaccuggacagguaagagauggggcccagggaucagguuaccaauugugagaguuaguaauuugggccccugcugagcggaacucagagagguucagcauuagggcuaccugacccaggaggcauggcaucuucuagaagcuggaggagaauaggccagagucaggaccuguagaacaggucacaaagagcuuuaccccauugagguggcagagaggcuuguuaggcccaaagcauggaagcagugaggacccacacucaggguauuuacaaaucugcuccuaguaugcccgagucccaccugugccucauauucccacuuccauccugcucaacagcugcccucugaccucaguggacccugucuguuaccccuccaacagaccucuguucacacagguccaguuuuuguaccuaagaugaguuccuaggcugggcaugcuggcucaugccuguaaucccagcacuuugagaggaucacaugaguccaugaguucaagaucagccugggcaacauagugagacccccgucucuacuaaaaauaaauauauuagccaugcauggugggacaugccuguagucccaauuacugaagaggcugagguuggaggaucacuugagcccaggggcuugaggcugccaugagcugugaucaugccacgucacuccagccugggugacagagcaagauccugugucaaaaaaaaaaaaaaaagaguucccagguucuaugacuaucuggguuuccaggccauguugcuugguggcggggagggcucuagagaucccugcagggagcugcuaacuacagaggagccuccuccccuggugacagccucugugcuuucagagauucuaggaggaaauccucuccuccccuucccugccaugccagagcugucacccuccugcugcugcugcugcuguugcugcugcugccaagccagcagccgccgccgcuccccacccccacuucccaacccagugcuggcugccaagaagccaggucacacagcugugcacgugagccgggcccucaggaggagaggcuggguguggagauccuccuccugcugcgugccagaggagagggaggcauagcagaggcagcagccgaccauauaucuccacuaacguggggagagcaaacugagaaaugaacucacccagccagaugggccuugcguaagcuacuucuuggccaagaagagccccgggaauguggcuccauaccaucccaauucauccuuauauaaacagccuccguucucuucuucgcccucugauacuccuuccuucuugcaugagugcaguuauguuuucccuggucaugaaaaauacuuuguaaacuacaagacucucuuuaaguaucaguuguggcuaugaacucuagcuccagucucugaauuugggaggauaagcugucuuccaccucucuguucaauguucuaauaaauggaggcuaagaaggggaugauuuuccaagaaaggaacaugucugcuauuccuuaugauguuagaguuaaaaaaaaaaaaaaaaaaaacaugucuucagcucuuaucaaagaacuuucuccagggcuuacaugggugguagaggccuauggggauucccuuagcuuggacagauaggccaagugccaagcaggcuaguagggauuuuucugugauuagagauuuugucagucucugucuuuaggcggcucugcgucaacaccagggagcccggaauugagucccagcucuggcccugccuugcuccauuacugaggcaccugcuucagcucucugggcuuuauuuucccucucgguaaaauggagaugcggccucccuugcccccuccuuuccacucaggcaugggaccugugaguggaugaggaaagccacccucaaagccuucagagucuggguucuuuuuugggugggcagggacccacaucacagggccauguggguaacacuagcuaugcuuugggcuccccaggaucauugagcugaaugggcagaagccaccccuuacauacaagcgcuuucaggccaucaucagccgcauggagcugcccaagaagccagugggcuuggugaccagccagcagauggagagcugcagggccgagauccaggagaaccacgacgagaccuacggcgugcccucccuggaggagcugggugcguacuuccugcccagagccacuugugcuggugccugcuuuuguguaaagaaauucuuugugaaaguaaugcaugucauuauagaaagguuagaaagcacaggaaaacaaaaauggaaauggcagucacuauuacuccaccacccagagguaaccacaauuaauuuuaaacuguguccuucuaguauuuguucuguucauacucauacauguaaucuucuguuucugguucuagaucaugccucuauuuuuguacuaaccucucgcagacaauacaggcacugccuggugcugguguccaugggcuucucaguaacaagauagcuaguauugcuucuguugaaagcagggaaucugucagccucucagauuacuaacuacacucuuucaccccucccucuuucuuaccuuuuuuuuuucuuuuuuagacggagucuggcucuguugcccagucuggagugcaguggcacagucuuggcucacugcaaccuccaccucccggguucaagcaauucugcugccccagccuccugaguagcugggacuacaggcgccugccaucacgcccagcuaauauuuguauuuuuaguagagacgggguuucaccauguuggccaggcuggucuugaacuggugaccucgagugauccacccacaucggccucccaaagugcugggauuacagacgugagccacaccuccagucuuuugaucugaacaaagcuauuagccuuuuucaccugaaaaccacaguuguugccagcuaaucugaaaaggcaggagguccgggauuguugucaucuaccuggagcgaugagggugcaggggaaagcagagaaaauagugacugugggaagagaaccaaguugaccuagaaaacgcuaaaacuuuaaggauuaucuaacccccaguagcaccgagacacugugguucaauucucauaaaguucaaauaacagaacagccgugccgggcuaucacugaaauggucaaaccuccugucuugugaccuuuccuucucuucaggguuccccacugaaggacuugguccagcugucuggcagggaggagagacagaagcucuggcccgccuggauaagcacuuggaacggaagguaugggccguuucugagacacagagcugcagauacugauauccacacagcaggagauacaggucauguccauguccuuuagucccucuuagcucacauuguuuggaaaaugaaaaauccuccuauccuccugauggccauaacaacagcaacacuaacagcaacuaccauuuagagaguacuuaccaugugcuggucacuaggcucagcauuuuuggguuaagcaccugcuggcauuucuuuuaaucuuuccaauagccugcaagguagguacuaagcuguucauucuacagauuacaaaauugaggcuuagagagguuaaguaacuugccugaggucacaaaguuaguaauuacagguugaguaucccuuauccaaagugcuugggaccaaaaguguuucagauuuuagauucuugaauuaggaaugcucaccuuauaacacaguaagaccuuguucuauguuauucuaaagcuaugucggauugcuuuucuuucaucugugggcagguucccccuacuaagaggauaucugguuaguaaaaucuauaagauuauuuuguguugaugugucuccgcaccuuuuugcuggaacucuuucagcguguugauuuccauaugcuuggacacagagcaaauggcccaccucccagugcagugagaacuggggaggaaagaagcccaggccucagaggcacagugucacaaaguccucacuccccugcagcuagaggagcagagaaaguucucauguccgagaacagucagcuccuaguuuccugcccccugcagcugguuuauaaaaugucagcuuuuucuaugccugcuaagauggcuagguauuuugccuagcagccagaugaugacgauaauagaacaaggaggccaaggcaaaucuacuugggaagaauguucuccagcccuggagguguccagucaacagugaaggcccacagccucgauguuucuaccugguuguuuccuucagccugggacgaaagcaagccccacagacuuaaaggaugagacuagcuaucucuguccacaucaaaagguucaccuagagauucuugggcccaguuugaagacaaagguugggccaaggggcagaaggguggagaugacaaaugggauugcaggaguagaguaaggcuuaaaccuguaaagagcuaucaucuaugguuaguuuuuaucagcuggagaacauuuuguagaaggaugucccuuaggucaccgacaggagcuccuuuuccacauacccccagagagcgggccccuucucucaagggcccuuacgccauggacauauucagacucaguggugcccagaggaaauacuguguccugcacaucugggagaacaaauggugcuagagauacaggaguugaaccugauuucaggauguuuauuuuagcuuccuucaguucuccaaaucugaagggagcaccuacucaugccaguuuagcaauacuagauagaagaagguaugugccucuuuuccgaaagcaccaggaaaagucccaaggcauguuuucauuguccugguuugggucaugugacugucccugacucaaugacuguggccagguauaggagguggugcuuucccuggccagacuugcaucaugaguccgcucccagaacuggaagguagguuuagcucugcuuuauccacucggacuaggaucagggaaggcugauucuccacaggaauaugagaugcuguuacugaaaagcagaggaagcuacaugaucuuuaccacuggguuacucaauaguagaugagggcaagcaucucucuauaaaaguauucugauuauuaaauuaaaaaggaaugguggaauuugaauaccaccauuuuguaacccucaauaaugaugcauuauguauuggugacugcugacaccauagaaggaggcaagcauuaugugcccccuguagucuugucaaagggaucaaaccugaguccaguccaguuucugguacuagccaccaaugugcaggugauacacaggacacagcacuuguugaacugcaccaugaguauacagucagcaaaauccagacugugggaaucuuggcaagucagauggccuggauucuuucccagaacaauggaaaggaaaagaaaaaaauggcauaaaaugugcagauuaaaagaaaauuaaauaacauauuaaaguuuuuuuuaaggccaggcacagugacucacaccuguaaucuuagcacuuugggaggccaaggcaggaggaucucuugaaccuaggaguucaaaaccagccugggcaacaugacaagcccucaucucuaaauaaaaacaaauuagccggguguggcagcaugugccuguagugccaacuacuugggaggcugaggugggagaaucacuuaagcccaggaagucaugccacugcacuccugccugggugacagagaguggggucucagaaauaaaagaaaaagaaucccagcacuuugggaggccgaggcagguggagcacuugaagucaggaguucgagaccagccuggccaacauagugaaaccucaucucuacuaaaaauacaaaaacuaguuaggcaugguggcgagugccuguaaucccagcuacuugggagguugaggcacgagaaucgcuugaaccugggaggcggagguugcagugagacgagaucaugccacugcacuccagccugguugacagaaugagacucugucucaaaaaaaaaagaaaacugaguagcugggauuacaggcucccacaaucaugccuggcuaauuguuguccuuuuaguagagacaggguuucacccuguuggccugacuggucucaaacuccugaccgcaagugauccuccugccucagccucccaaagugcuggaauuacaggcaugagccaccacacccgggcagaaauaaaguuuuuuaaauggccaagacuaaauuguaauaccuaggaaugcacauuuggguaaaaaaaaaaaagcuacuuaaacacaaagaauaacugugaaaagauaaaguccuuccuuucaaacguuuugccaaaauagaaaaauguaaacauuucagaaaugcagaacguguuuauuauaaaagcugagguagggguugcauauacuggggggcaggagggaacuauuccugggaugagcacauagacucuugggguggcugucaaagcucuguuucccaaaccuugguggcuauugcguggauguuugccuuagaauaauucauuaagucacacaugugugugauuuucuguauccaaguuucauuuaaaauaaaaauauuuuaaaagcugggggcuagcaaggguguguacacgcaaaaauaccuaguaucuguuagaagugcuuaaccugauaccacagggguuaccugcagaggaggaagccuugagguugcgacuugaaggaagagucucaguuaaccaggugaaggugagggaaaggaagacagugguccagaggcagcugcuugugcagaggcaaaggccagugagagcagaugcguaaagaagaggggcagcaggaggcggaggguacagugagccgagaucacaccacugcacuccacccugacccugucucaaaaaaaaggggcaagagacagagcuggaaaggccugggugcuggggagccacagaagcuuucaugaagauuugggcucuguccucagagcaacaggaagcccacuguguacauuaucccgagcaacaggcauuacauuacucuggucccagcguggagaaugaguuagcgggggaugggaguggacgcagggaggccagucaggaggcugccacaguuguccagucuagauaugaccuuagccugaaccagguugguggcagcagggaauggaaagaaaaggacagauuugggaaauauuuaggcaguagaauugacaggacuuggugaggggacaaaggugauggcuaggauugugccuugggcagcuagguagcuagcaguguauuaucugagguagggaggccaauggaaggguggguuaaaagaaaagggcacaucucccuugagcugccugagaggcagccaaguagagguuucuagcaggcagcuggguggagcaaucugggcuagagcuauggauguggugguugucugcaaagggguggaacugggagccaugggccuggaugagcuugcugaggcacacaguugaguagagaaccuagagcugagcccuggguacccacauuuaagggagaggcagaggagguggagcugaugaaagaccaagagcgccaggcagcugggagauaccaggagauguggagucacagaggccaaggaaucaagaggauaagacagcacaguuggcagguauagcgcugcugagagaucccaaaauacaaggucagaaagugccugcaggacucaguggcacagaagucacaggagacucuugugggaaccagccuuguggucaccugagguuuggaguuagagaccagccuggccaacauggcgaaaccccaugucuacuaaaaauacaaaaauuagccaggugugguggcaggugccuauaaucccagcuacucaggaggcugaagagagucaagguugugaaacaguaucauggagaggaggagaggauguugggaguuaagaaaguggaaauaggccgggcacaguggcucacaccuauaaucccagcacuuugggaggccaaggugggcgaucaggagaaucccuugaacccgggagguggagguugcggugagccgagaucacgccacugcacuccagccugggugacaagagcaaaacucugucucaaaaaagaaaaaaaaauaaauaaaaaaagucgugagagacugcauggaacagcaagucaggaaaguaaaguccuaugccagcaaccagugaugauaaaaacaugaccaguaauguuauaugacacauggccccagaaaugaaugauuccauugguccccaggaauggauuggaaguuuccuccuuccccagcugcuguugaacaauaaugcgaagucccuggugucugugauacaaccucagggccgcuagugacuagagaagggacugagauauucuuuucuguaacauagaagccuuguuuccugcuguauaauuagagaguucauucagugcuuucagaauucuuucauaucucauuuuaauccacagaagauuggaaauuuuguucuuauuuaauagauacguagcugagggaaguaacaacguguucacagucaccccacaaauuaaagagcaagucagagaaugacauagacucguuguuuggucugauggugguuccgucucaaaaucggcuggacaagcacaguguuccauggcuccauggcuggcuguucugugaccguaggcagauuccuuaaccacccaaugccuccauuuuuuccucuguuacauccaagccuuuccuuuugccaccuucucuuucugcuguaggccuggguugccaacuaugagagaccccgaaugaacgccaacucccuccuggccagccccacaggccucagccccuaccugcgcuuugguugucucuccugccgccucuucuacuaccgccugugggaccuguauaaaaagguaagggggacauaccugcccacauugcaccuaaggccugcagccaggccuuuugggcuugucagucacccuaaaaaaggcacugguggguggggguugggcuauggccccuggaagggccuaagugugugcagauaguccggaggaggagagaagacucaauauccaagagggcagagccaagcacagagugaacugcccaccagaaugaagcccagaccaucauguagagcagaaggacaggcagaaaagcaggccucaggugugacccuagagguggcauauccucuggcagcugguggacaggggcgagguccccagggugagaggcauggagagggugaggcuggagccagucugaaguggaagagcauagcugcccgcucuggagcuguguccacagcauucaaaaggggaguccaggaacagcaguugcccaucagugauggagggagugguguggaggggcugcacacagggcugugcuauacagacaagaagcaaauaagccuguguuaacuguccccagaaggagagagggcaacacagucagcauucagagggaucaccucaucuugugccuauguuuuuuguuucuguuguuuauuuaagagacaaagucuagcuguguuacccaggcuagaguguaguguggccugaucacagcucacugaaaccucagacuccugggcucaagcaaucccucugccucagccucucaaguagagcuaauuuuuuacauucuuuguagagauagggucuugcuauguugcccaggcuggucucgaacuccugggcacaagcaauuguccugccuuggccucccacagugcugggauuacagccgugagccaccaugccuagccguugugucuacauuuguuuuuuuguuuguuuuugagacaggaucucauucugucacccaggcuggaguacagugguaugaucacagcucacugcagccacaaccuuucaggcucaggugauccuccuaucucagccuccccagcaguugggacuauaggugcaugccaccacaccuggcuaauuuuuuguauuuuuuuguagaaacuggguuuuuccauguugcccaggcugaucucaaacuccugggcucaggccauccacccaccucagccucucaaagugacagaugcuagccaccacaccuggcuguaucuagguuuuuaaauguuaucuccucauccuugccauuauugagauuuuguggcaugggauagcuuugccaguuuggugaguaaucuugugacuuuagggaagucauuauuugcuuggaggucugauuucuuaauuaccuuauggccccagauccaggcuguguguauaauuuauucaaccaaaaucuagacugagcauuuuucaugugugcugauaggaaaauuccuuuugacuuucuagaagguggagccaaacagggaacucuugaggacaaggaacaugaccagucuugggaaguuugaauccuagugcagaguccuguggugaggccccuucccacugccuggcccucuguagcuuucuucuugcucagagcaguggcacagugcaggcagggccuggguguuucacaugcaggcaugcugugccacuucuaggggauagucccuccacaucuggcagcugagccacuaggucuuuggagggcccagauuccuuuguagaagagaccugagaggcaccaugcuaagagcugggcgaguguuuguauccaugugccaccccuaccucucaggugaagcggaacagcacaccuccccucucccuauuugggcaacuccuauggcgagaguucuucuacacggcagcuaccaacaaccccagguuugaccgcauggaggggaaccccaucugcauccagauccccugggaccgcaauccugaggcccuggccaagugggcugagggcaagacaggcuucccuuggauugaugccaucaugacccaacugaggcaggagggcuggauccaccaccuggcccggcaugccguggccugcuuccugacccgcggggaccucugggucagcugggagagcgggguccgggugagugcucucucaacgaaaagcuggccuguacccucuggucaggcccgucaaagggcagcccccuucugggcugagggaugaggugggauuucuggguccaggagauccccuccagauccucuguggcuugccuucaauggaaggguuuuggcuccugggggcacuguggugacuugggaaaaaacauggcugcauguccccaaggaggcugaucauccccuccccuaucuagguauuugaugagcugcuccuggaugcagauuucagcgugaacgcaggcagcuggauguggcuguccugcagugcuuucuuccagcaguucuuccacugcuacugcccugugggcuuuggccgucgcacggaccccaguggggacuacaucaggugaggauacagaccaggcucucuggccucugaccacuguggccuccuacuaggaugggauacccugggccuuuugaaggagggucuggguaugcugaugggucaucugguguaucuuauuucaggcgauaccugcccaaauugaaagcguuccccucucgauacaucuaugagcccuggaaugccccagagucaauucagaaggcagccaagugcaucauugguguggacuacccacggcccaucgucaaccaugccgagaccagccggcuuaacauugaacgaaugaagcagauuuaccagcagcuuucgcgcuaccggggacucuguaaggagacaaacaccuagcucacugaagggaaggacagcaccuacaggcucagggggccagauggggauguccagauacuugcaaagggagacugagugcugucuuucagguugacaccuucgcuggguaugggacacugcaggcugggaugaacugggccuuccugaguaguuguggggcugugggaggaaauggaaccucagugucuugcuccuacccuccccacccccacuugcuucauccugcccuguagcccucugcaauccugcgagacggcacucugauuacuccucgccucucucccaggucuacuggcaucugucccuuccuguguggaagaccucagucacccuguggcagagcccagcucgagccaggcuggcagcaugagcagugcaggugagcagcagcaaccaaccuccuguggccuccuguggccugugccaccacuucagucauucaggacugaggccagaaggaggccuugcccaguggagcuuauauuccaccuggggcagucagauaguaaagaaaccaaguuggaucauuucagauaacaagugcuuuggaggaaaagaaaguugaguaucuugacagagggacugggaaagaaggauuucuucugugucacuugagauuggagcagucagggaacaccucuguuaagcagagacccacgucaugagcaggagccagcccugccacacacugagaaaauaacauuccagacaaagggaguagcaagaaaaagcucacaaacaguaccgagcuuaguccauucaaggaaccgaagggaggucaguguagcggcaugucccagugaggagcuggaaugagaugaggacaagauacagcaugagcagcauguggcaggccugauguccgagacgaggacuaggauucagccuucagugcacugaaggauggucaguagggcagggcaugauuggacuuaggucugaaaaagcucccuggccugcuggguggagauuggacaguguaggccggagcgggcacagggaggccagagaggaggcagcacagacagggugguggccgcaaggagaaagacuggacagauucgcugcauucggagccucuucccuucuuggggaugaagaugaguaacaugagaugggaagaacacggguuuuucuaguuggcccagcuaggcugccuccaugggcagcaugacuccuccacaggggcccugcucuuugcugcuuggggaggcugauucaggguugcagagggaaugccucaccuucaaagcaggacagcaggcaggccaaaucagucucuggccacagcccaugccauuuggggcccaaaagcugguccugcuaccagcaggccugcuuggucauguccuccuuggacauuuccaggcaaagucacugcugaaagcaaggccgaggggcaggucugaggagcagcaugcuggcauuccauugauaagugugcucccuguccccuaaagagcugcugcugcauagugugggaucauuuuggcugcaugcacagucugugugacccuuugacacgcuucccuacaggcccaagaccacuacccaguggcccagcaucccccaaacgcaagcuggaagcagccgaggaaccaccuggugaagaacucagcaaacgggcccggguggcagaguugccaaccccagagcugccgagcaaggaugccugagagugagugacagcagccuagauucaaccucaggaaggaaguugggagugggggggccuacugcccugccagcugcagguugaaacauagcaaacuagaugaaaaucuggugggaccacccaaugcucagccacuaaagcuuuaccauuuuacaguggcagccggguuccauccuggcuuagggaaugaguacuuucugguugauaucugugugaccuuuaccauugggccggcuaugguggcucauguauguaaucccagcacuuugggaggccaaggugggaggaucgcuugaggccaggaguacaagaccaaccuggccaaaccaacauagugagacuccaucucuaaaaacauaauaauaauaauaauaauaaucuggugggacugcaugacuuuuaggauuucagcucaaaaaucccaccauucugacuuuuaucagagauuuaaaagucaagcccuuuuguauuuuuuugccagcuaagggaaaaagggaggcaugggggcugagggguggcgcuuucuaccuauuaaaaugagucacacucaagagaaagaaagcugagaccugcgugugaagcagcggggaaaaggcgcauugcagggucugaggcugcuccaggcccccugcuuuccgacaggcuguguucuauaggccagccaguggagggcagcacugaccuugagaagccuggacagagggcugugcugugucuuacuuggcccagcccugccugaggaccaguagacccagucugucaucaucuuugccuuuugcggccucuccucccuucucacccauccuguggccucagcucugcaccucccuggcagcgcucaucuuggaagccuccugaaugucaucaaaacacuggcuucuccuuucccaagggaggaagggccuuuuaugccacucuuggggaaauguaaauuccuguccccucugagucaucaucucaagcuguuccuuaugcaccaugucuucgucauuagauuggagggugauuuuucuccauggagcugauagguucuuuuuaucagaucccucuuacuucagggccaggccgcagccaucugguuugagugucuggauuugugugcucacugagaugggcauuugaugccugcacccuucaccuuuccugggcucuuugacauagacauugcugauggacagaugugugcuaucuuguuccugggaguaccagcaaccuacuacucucucaguuaucucuuagcucugugauacuaagcaaaguucauccuguauuacaaauuuggaacuugccaggcugacacucugauuuucggaugagaagaccaaagaacagagagguuaaaugucugggucaagguugcucaguaagcuaaugguguccaauucaacaugaaauuguugccagcaggugggugaagaagggggagcauuaaacauauaaaaugugaugugcuguccauccauaaggauugaacagucugcuuagauaaaaaggaacaauaaccuagaauuccuggacaaaugauacagacuauacaagcuuagcagaaggcugcugguguggucuggaacaaucagggaacauaucacagaaguuugcgcuagggggccugaaaagugaauuggauucaggcagugagcagggcgcuuaggacaagaaaaacagcugaagguuuaugugaucuuguacaaaugacuuaacugcuaugggacucaguuuccucaccuauaaauuagguugcuguugcaagaauuaaaugauuaaaucugggccgggcgcaguggcucaugccuauaaucccagcacuuugggaggccgagguggguggaucaccugagguuggggguucgagaucagccucaucagcuuggagaaaccccgucucuacuaaaaauacaaaauuagcuggcauggugacguaugccuguaauuccagcuacucgggaggcuggggcaagagaaucacuugaacccgggaggcagagguugcagugagccgagaucgugccauugcacuccagccugggugacaagagcaaaacucugucuaaaaaaaaaaaaagauuaaauguguaugugucagcuagaaaugugggggucuauuaauaauagcucaauuacuguggcuaaaacaaauaggggcuuauuuuucuuaccuaacaaggggcccagagauaguguugcuggucugggcuuggguggcagccccagcuucagccaucaauucuugaucaaagaggaaagagaagggacagcaagggcagcugcacuccuuccguacacaugucaagagcucauguuuugccagacaccauuccaggcauugaggguaugguuguauacaagacuggcaauaucacuucccccuugggugcauauuaguggaaggagacagacaguaaacaaauaaauauuuaaaauuuaaagaggccagccgggcgugguggcucacacuuguaaucccagcacuuugggaggcugaggcagguggaucacgaggucaggaguucgagaccagccuggccaacauggugaaaugcugucuuuacuaaaaauacaaaaauuagccaggcgugguggcaggugccuguagucccagcuacuucggaggcugaggcaggagaaucacuugaacccgggaggcagagguugcagugagccaagaucguaccacugcacuccagccugggugacagagcuagacucagucucacaaaaaaaaauuucaggaggccaucagugcuaugaaaacaauaaaauaaaguugaguaagaaaguaaggucggggcacagaagaggcugcaguucuguauuauaaggguugcugguccagggaccauacuuggagaaucacugacuuagaccaaucauaauccauuuucugggugaagcccauugccuccugaacacauuuuagguucuguuaaccaggaaguguggauacugguagacagcuaauggugacugcuuuauaggcaagacacuuacucaagugugugggucaugagugcuugguaagcaguaguuauuauuguagguauuguuauuauuguagaggacacaagguuacaguugggucugauuauggaggguuguaaauggcaggcacaugagucugcuauguacucuuugggagugaagaaacauuuuggaacaggaaugaucaaauuggcauuuugggaggaugaauuaggcauugggcugggaccugcagaggaacagguuggggagagaaagucagcugagaggcuugacagugauuccaagggaagacaugacaaggaugcagagguaaaugcccgucucuugcccuggaguccagaagauugucagccuacugggauuuuaaggacugauucuugagguuuacucugcccuccacugguggcucaguggggaguuaggccaggcuagacugugaagguugggggugcagaggucagaggaucugggguggugcagacuucccuccaagacagacuagggaggaacagcuguguucuuuggaaauccugagagaagaagaguacaccaugucucaccaugugcuggcagaggcaccugggccuaaagaugcuuagcauccucagcuguaaaauggugauaauagcaucuugucaccugcccuacccaucgaaaaagucuuugaauauguaaaaugcacuaugcaaauggaaucacauuaucaucuugcacuuucuucucug

SEQ ID NO: 13287 - RNA, 8698 nt, Homo sapiens
ucccucaggccacacacacaggaucuuauggauucuuuauugaaucacaaacaacucagggcaucaggccccagcagcugcauuagaacccaucugggauugugaggggacuggagagggaggggggagaagacccgcucucccuagcuuuucacuauauagaguaaaaacaucagaaaucaccccaagagaaaggacauaccaaaugcccaccagaagggccagggacugcaagccacccugagcgcaggaggguguggugaagggugguauggccccgaaauuugugugugucccccacucccccugcaaauucacauuggaauucucacccccaaggugacaguauuaggagguggggccuuuggagcugauugggucaugggggcggaacccucaugaacaggguuggaguccuuauaaaagaggcaggaaggagcuugcuuguuugugcuucuaccauugaggauacagcgagaaggcaccaucuauggaucgggaaacagcccucagcggaguccgaaucugcuggccucuugaucuugggcgucccagccccccaggacugugagcaauacguuucuguuguuuguaagccacccggccuacggcauuuugauauaggagcucgcuggacuaacaguggggccaagcaggcucugucagccacaaccucagggaagaauguaaagguuggugucuuaccaucacaaggcaagcggcucagaaccagcuguaacaccucccuugcagagaucuaggggcgccagacacagcugggguggaaggcuccuagucuggacccuugcuccaucagccccaccuggggaggaaggcuucuggggagguagaacugggagaagagagaagcagcuccuuggcucugcuuucagaaggcuguuaccugggccaggugcugggagaccagagggacaggugccacucagggccagaggagccacgcaggacaaugugauguuagggacugggggaggauguuaaugacccugcuuaaccucuaagagaagcaugguucccuuguguucaaaagcuggacauacaggguguauagauggugagcacuuucucacaauccaccccauucccaggccacugcccagcagccccuggggaucugcuggugucagagggaacucgcucauuuccucccucaguccaggccacacuuuccuccaaaggaaggccggucugugggcccagggugaggcugccugcccaccgcagacggaaggcuucccaacccucuccagguggcugugguagggccaucuccccugaguacagugaagccuuuguggcuuugccauugcugucccuucaagguuguugccugucccuguccucagagugauguggaggcagacaggcccuggaggcagaaggaagggguucaacucucacuagggugcucccucgggaaggacaaaaacucagaaauacgagaggauagagaaggguuuggcaacuuucugguauuacuuguaaacacugguuccuucaacuuucugauauuacuuguaaacacugguuccuucucaaccaccguauucugauugggucuauaaguagcacccaguccacaccacagcacgcuucugggguccaggagaccgccuucacuacugugcuggccccgccuguguacgggccccggggccgggccauccagggugccuguggugcucacacccccauggcgcucuucucgcugucuuuggggcugggcuccuccggagucuucuucaucucccagccccugacccagguguaggcggaggagccgcccagcaccaucauguugcucguccaccagaggaagcucuuggucuccucguaguagagcacggccagcacugucugggcacaggccuuggccgugcccgacacauugugggucagcggacuggugaacuugaucugcaguccugucacguagccgauggcaaagccaaacaggccgcccagcgucaucaucccccagaagugggcacugcccagcugggcaaagucacgcagggccugaagcuccccgagcagcaggagcaggggcaggaagaggaugcaggcguugacguuguuguagaaagucaggcgccagaugcugccguccaccgccgggagcaccuucgugguguagauggcguugagcgagacacagaggcuagccagcacgccgaagacggugcccagccacgacagggugccuucugcccccuccugguccacaccaagccagaagcccccugcaguggggagaggaggaguggggaagggugaggaagagggaugaggacgaggaggaagaaggacagaggaucagacaccaaauuucacagacugaguauugcggcccuccccguuccuccccaggccucccuccaauaagcacagccagagucuccacugcaggcaaagcacuccacaugaacuaugggagccgcccagggcaagaaaaccuccucuggcagcuuaucugcuagcagaggagaaagacauuaaaacaaaucuucccaguuacuucuuuaauuacaauuguaagaauuguaaugagguccauaaaguaguacaaggugcugugagagccuguaagugggcgacugugcuggccuggggcaucugaaaauaacaguugaacugaguucugaagaaugagugccacuuagugguuaaugugauuuaaggugacccugcguaaaugacuuccagugucuaagccuuggcugcuucuugcauggaaugggagccuaugaugucaucauggggcacauuaaguuagaaucucuugugucauuuggggcagugacucugagacucucaucuugugucacuuccugcucaaagagcuuccguggcuccccacuucugccaugaggacuacacuccuuggcguggcaggcgggggugcaggcccuuccucuguccuauggucgccccagcuucccugcucgucucccugcuucucacccugggccucaguguccuuguucauguccugugccagaaacacccuccuccuuucugggggauucuacucaucugucaaggucaaaguuggcuucuccuggggaauccuuuccugauaaucccagaaccuggacucuuacugccucgcuuuccugcaaagccccuugccugcucugggcugcugggccccugcccauggugacagucuggucuuuuuagccagaucccaugcucccagaagccaggggcugaacaaugcauguuauacuuccugccacagcaucuggcaacacggggcaguggggaaaguuuuggggucagagggauuuagccuccaaucaggcucugcaauuuagaagcugaguggccugggagaaguuacuuaaccacucugagcucucugggucaccucccuguccuccacuccagccaaucuacucuccaccuugcaacugauaugaucauccugaaguccagaucgguccaggcugugcccuggugugaagccucucuguggcucuccacugccuucaggagaaauuccacucacucaccacagcucuuaggaccugcaccacguggagucggccugacugggcagccuugugucuggugagucuugcuguggcccagccaugaagaagugcacgugcucuuccuucuaucuagaauguucugucccuacuucuuccucuaaacccaguuucuaaacuuccuccagaaggccugcuuagacugcccuguccccggguccccucccuugcccagagcucccacagccccuuuuaugcaugccccaucacagcccuuacuaugcuagcguaacugucaccaccaugcccuccaggaguguaggagcugagguuaccuuuuccaaacuuguauccccaaagccuggcauggugccuggcauguguuuagccaccaauuacuagucguggaaugaaugaaugaaaguuguuauggaggugguuguauuaaaggagacaggauacuuccuacaucauaggcacucaacacacagcacucuucucuuuuucucuuuguuuuuugagacggagucucgcugugucacccuggcuggaguacaguggugcgaucuuggcucacugcaaccuucgccuccuggguucaagcgauucucgugccucagccucuugaguagcugggauuacagggaugcgccaccaugccuggcuaauuuuuguauuuucaguagagagggggcuucaccauguuggccaagcuggucuugaacucuugaccucaggugaucugcccgccucagccuccccaagugcugggauuacaggcaugagccaccaugcccagcccaaccacagagcccgacccuccucuuucuugacagaaccuuugcacaagggguacccacagaccugcuggggguagggugaggggggcagagggcugcaccacccacucaccugcuuggcuacagcaccccuagcccuccuggugguuaccuucugaguccagaagcaacugcaacaucaauguucuagagcgacucuugcccagaaagaacuuuuuuuugagacugugucuugcucugucgcccaggcuggaaugcaguggcgcgaucuuggcucaaugcaacuucugccucccggguucaagcaauuauccugccucagccucccgaguagcugggauuacaggcacaugccaccacgcccggcuaauuuuuuguauuuuuaguagagacaggguuucaccauguuggccaggcuggucucgaacuacugaucucaggugauccaccugccucagccucccaaagugcugggauuacaggcaugagccacugugccuggcccagaaggagcuuugaaaguuacugugugacauggggggcuaggaggggaggccuagaauaguugccugagacucgucuuccccuacaaggaggaagaaagaggaaacauugcagauagggagccagguccugggcuggcagagagcguccaccucccuggccccugucccagucaggcacgcccgugaaugcaccauucucagaaccucaccacugguuacuuggauuaccuuugggauuugggcccaguuacccuagugucuucaccuuccugcaagcaaauucuccaacuaggagccucuaccccugaggccacuccuggcagggucagcaggaaugaaguagagagcccuggggcaucugaggaggacagggaggaggggagguacaccuguucccuggagagggaaauggaagcaggcugggagaguucuggcagggggggucuugcagcuuccccuacucuaacugugaccuucucccuucuccccucuuggacuuagacccagcagcccuagauccagcagcugcucaacaaggggaaacauuuucuaggacagguggcaugggaugggucccuucccccaccaaccggugcaucuagccugggacccugagccaucagcaaagaauaugauauguaggccaaauaagauaaacuuuauagcaccaggaaaaaccagcauagguucaaaugaagaccccauuccuagaugacgcagcccugggaagacucggagggaaugggaugcuggaggcucucuaacgcagcauggggcccaguaaaauaugggcccaucuaaccugugcugucccauaccauagcccucagccacauuuggcuacugagcccuugaaauguggcuagaaaaucagguuguaacaucugcaaaugaggaagugaauguuuaacauuuugcuuaauuuuaacuaauuuaaauaaguggccaauggcuacugcauugaauacugcaguucuaaccuccaagacgagcagaggggauagaagcacaggccugggagucuggccaaucuggguuugcaucccagccuggcugcuugcuagcuguguggccgugggcaaguaauguaacaucucugagccucaguuuccuuguuuguauagagaugaccgcugguagugaugccacaacccaggggaucucugggagaacaaaggagaugcuauaugugaaauaauuagcauaauuuccccaucaauaauuauuauuuucugagggucaaguccaggaagacagcugaggccucucaaagcauauugcuugcuacugucucaggcgcuauccugagcuggcagagagugaugguauauuuauuaaaagacguauuguccucuacuaagagcacuggcugggaaaucaggacaccugagcucuugagaaacaauaaaguacaguggucgggcaugugaacugugaagccagauugcuugaguucagaucccagcucugccacuuauuagcugggugaucuuggacaaguuaguuaacuucucugugccuugguuuuucccucuguaaaauguggauuauaaucccaucuuguuaugaagauuagcugaguuaauauggcuaagauccaugugccuggcacauuuuaaucacucaacaaaugucaguugcuuuugcugcuguuguuacuauuauuauuacuauuguucuugccccggcugggcuccuaacuugcugggugaccuuuaguaaguuacuugcucucucugugcccccaggcucuuucuccuaugacugcugcaccaaaggagcugggacagaugaaguccuaggaugccuagaagaguuguucuucacugcuucaguccccaugaccacucuaucccccguggccccagcugccacucaccgaugaugauaccgcaggugagcagggcauagaaggagguggucugcuugagcagcagguaggagagcagcacguugaagacgguggugagugagcggcccacauuguagaaggccacaccgacguacuugaggcagagguuauugaaggugaucaugccgaugaagaccaccgacaggggcaggacgcugcgggccacccugagguccaggcgcaagcuggggaaguccacggcaccagggcagcaggcggccagagcgcugaggccuuugcacagcagcguggucaccaggcacugguagaaggugacgaagauggggguguccagccgcagggaggggcuguccagcagguacuuauuaaggaacaccauggagauggaggugacccaguagagggagaccaccagcgcgaucugcaaugcccgcagcagaaagggcuucuccccguuggccucugccucugcagaggggucugaggccccggucagcgccaugugcaggauccuggaccgcuucagaggggcccuauucaugguagcagaggagcugggucaccccgcggccagaacucugauucccuggaguccagggcagugagcucacuugugcucuccgcaaggaagccgcagcccuccauugucacaugugggcuggccuaaaggccuccccauuguccucauggauugagaaguucugcuuuggggugagcccaguugugcugcuccacaaccuacucccaccccgagggggcucugagacaagacacagggcaagggagaggaauaggauaaggcggugaggccaggacagagaagaccugugaggggagaagaggcuggggccuaacagggaggggucgcagagagaagggaggggagaggaauggcagggcggggcaggaguagguacgcggggcgaaggugcaggaaaaggacgcguggcagagugggaagaggugccgagagggcgucaugggcggcugugggagggaggggcgggcagggggagggaggcguacagggagcugccggaggccgggcgcggcuggagggagggcugcggaagggucagaggggcucggggcuuggggcugaaggacgcgggagggggcugggccggcgcccacgucucgcugccuucccgggcucugucgccggcucagcccaggagccuccggacauccgaggccgacuccccgggaggcgggcccuggacucacuuccugacacgcccccacguggccuuaaagggcccgcacgccccgccuugcccuuaaagcgacagccccagagaggcggaguucgccaguccccagccccgccccugcgcuccgcugcccgcugcuggcgggggaccucggcagccacagguuuuucugggugcuugagccucgcccugcuuccuggaagggcuccaucaaccucgccugcccacccucagcuccguccgccccggagccuccgucccccgacuuggcuaggcuuggcucgcagguccacuucccggaaccccgacccaggacccgggcggcgcuacaucagccuggaccccuccaccuccggagacucgcguugcagccccgcgucccucugccaauccgagcucacucuuccauaacaauguugugguccccuccuuuccccccauuuucaccgcccccaggcccucucccaagcccgagacccccggcagcgcuccccgaggccggaggccacgccgccucucucggacuucaguuuguccucccugugcuccugucgagguccucugggcggcccggauccgagauuccaaaggcucaagacagcaucucuuaccccuuccagaaaauacuguuuccccggccgguccagccgcaucagcucccgcgucccugccuguguccccgggccgcgaaggcgaccuggcgcucaccuccuccggugcacugggcgcccgccccgcgaccccgugcugcaucugcagcgccgcacccugggccgcgcccgcggga

SEQ ID NO: 13288 - RNA, 8698 nt, Homo sapiens
ucccgcgggcgcggcccagggugcggcgcugcagaugcagcacggggucgcggggcgggcgcccagugcaccggaggaggugagcgccaggucgccuucgcggcccggggacacaggcagggacgcgggagcugaugcggcuggaccggccggggaaacaguauuuucuggaagggguaagagaugcugucuugagccuuuggaaucucggauccgggccgcccagaggaccucgacaggagcacagggaggacaaacugaaguccgagagaggcggcguggccuccggccucggggagcgcugccgggggucucgggcuugggagagggccugggggcggugaaaauggggggaaaggaggggaccacaacauuguuauggaagagugagcucggauuggcagagggacgcggggcugcaacgcgagucuccggagguggagggguccaggcugauguagcgccgcccggguccugggucgggguuccgggaaguggaccugcgagccaagccuagccaagucgggggacggaggcuccggggcggacggagcugagggugggcaggcgagguugauggagcccuuccaggaagcagggcgaggcucaagcacccagaaaaaccuguggcugccgaggucccccgccagcagcgggcagcggagcgcaggggcggggcuggggacuggcgaacuccgccucucuggggcugucgcuuuaagggcaaggcggggcgugcgggcccuuuaaggccacgugggggcgugucaggaagugaguccagggcccgccucccggggagucggccucggauguccggaggcuccugggcugagccggcgacagagcccgggaaggcagcgagacgugggcgccggcccagcccccucccgcguccuucagccccaagccccgagccccucugacccuuccgcagcccucccuccagccgcgcccggccuccggcagcucccuguacgccucccucccccugcccgccccucccucccacagccgcccaugacgcccucucggcaccucuucccacucugccacgcguccuuuuccugcaccuucgccccgcguaccuacuccugccccgcccugccauuccucuccccucccuucucucugcgaccccucccuguuaggccccagccucuucuccccucacaggucuucucuguccuggccucaccgccuuauccuauuccucucccuugcccugugucuugucucagagcccccucggggugggaguagguuguggagcagcacaacugggcucaccccaaagcagaacuucucaauccaugaggacaauggggaggccuuuaggccagcccacaugugacaauggagggcugcggcuuccuugcggagagcacaagugagcucacugcccuggacuccagggaaucagaguucuggccgcggggugacccagcuccucugcuaccaugaauagggccccucugaagcgguccaggauccugcacauggcgcugaccggggccucagaccccucugcagaggcagaggccaacggggagaagcccuuucugcugcgggcauugcagaucgcgcugguggucucccucuacugggucaccuccaucuccaugguguuccuuaauaaguaccugcuggacagccccucccugcggcuggacacccccaucuucgucaccuucuaccagugccuggugaccacgcugcugugcaaaggccucagcgcucuggccgccugcugcccuggugccguggacuuccccagcuugcgccuggaccucaggguggcccgcagcguccugccccugucgguggucuucaucggcaugaucaccuucaauaaccucugccucaaguacgucgguguggccuucuacaaugugggccgcucacucaccaccgucuucaacgugcugcucuccuaccugcugcucaagcagaccaccuccuucuaugcccugcucaccugcgguaucaucaucggugaguggcagcuggggccacgggggauagaguggucauggggacugaagcagugaagaacaacucuucuaggcauccuaggacuucaucugucccagcuccuuuggugcagcagucauaggagaaagagccugggggcacagagagagcaaguaacuuacuaaaggucacccagcaaguuaggagcccagccggggcaagaacaauaguaauaauaauaguaacaacagcagcaaaagcaacugacauuuguugagugauuaaaaugugccaggcacauggaucuuagccauauuaacucagcuaaucuucauaacaagaugggauuauaauccacauuuuacagagggaaaaaccaaggcacagagaaguuaacuaacuuguccaagaucacccagcuaauaaguggcagagcugggaucugaacucaagcaaucuggcuucacaguucacaugcccgaccacuguacuuuauuguuucucaagagcucagguguccugauuucccagccagugcucuuaguagaggacaauacgucuuuuaauaaauauaccaucacucucugccagcucaggauagcgccugagacaguagcaagcaauaugcuuugagaggccucagcugucuuccuggacuugacccucagaaaauaauaauuauugauggggaaauuaugcuaauuauuucacauauagcaucuccuuuguucucccagagauccccuggguuguggcaucacuaccagcggucaucucuauacaaacaaggaaacugaggcucagagauguuacauuacuugcccacggccacacagcuagcaagcagccaggcugggaugcaaacccagauuggccagacucccaggccugugcuucuauccccucugcucgucuuggagguuagaacugcaguauucaaugcaguagccauuggccacuuauuuaaauuaguuaaaauuaagcaaaauguuaaacauucacuuccucauuugcagauguuacaaccugauuuucuagccacauuucaagggcucaguagccaaauguggcugagggcuaugguaugggacagcacagguuagaugggcccauauuuuacugggccccaugcugcguuagagagccuccagcaucccauucccuccgagucuucccagggcugcgucaucuaggaauggggucuucauuugaaccuaugcugguuuuuccuggugcuauaaaguuuaucuuauuuggccuacauaucauauucuuugcugauggcucagggucccaggcuagaugcaccgguuggugggggaagggacccaucccaugccaccuguccuagaaaauguuuccccuuguugagcagcugcuggaucuagggcugcugggucuaaguccaagaggggagaagggagaaggucacaguuagaguaggggaagcugcaagacccccccugccagaacucucccagccugcuuccauuucccucuccagggaacagguguaccuccccuccucccuguccuccucagaugccccagggcucucuacuucauuccugcugacccugccaggaguggccucagggguagaggcuccuaguuggagaauuugcuugcaggaaggugaagacacuaggguaacugggcccaaaucccaaagguaauccaaguaaccaguggugagguucugagaauggugcauucacgggcgugccugacugggacaggggccagggagguggacgcucucugccagcccaggaccuggcucccuaucugcaauguuuccucuuucuuccuccuuguaggggaagacgagucucaggcaacuauucuaggccuccccuccuagccccccaugucacacaguaacuuucaaagcuccuucugggccaggcacaguggcucaugccuguaaucccagcacuuugggaggcugaggcagguggaucaccugagaucaguaguucgagaccagccuggccaacauggugaaacccugucucuacuaaaaauacaaaaaauuagccgggcgugguggcaugugccuguaaucccagcuacucgggaggcugaggcaggauaauugcuugaacccgggaggcagaaguugcauugagccaagaucgcgccacugcauuccagccugggcgacagagcaagacacagucucaaaaaaaaguucuuucugggcaagagucgcucuagaacauugauguugcaguugcuucuggacucagaagguaaccaccaggagggcuaggggugcuguagccaagcaggugaguggguggugcagcccucugccccccucacccuacccccagcaggucuguggguaccccuugugcaaagguucugucaagaaagaggagggucgggcucugugguugggcugggcaugguggcucaugccuguaaucccagcacuuggggaggcugaggcgggcagaucaccugaggucaagaguucaagaccagcuuggccaacauggugaagcccccucucuacugaaaauacaaaaauuagccaggcaugguggcgcaucccuguaaucccagcuacucaagaggcugaggcacgagaaucgcuugaacccaggaggcgaagguugcagugagccaagaucgcaccacuguacuccagccagggugacacagcgagacuccgucucaaaaaacaaagagaaaaagagaagagugcuguguguugagugccuaugauguaggaaguauccugucuccuuuaauacaaccaccuccauaacaacuuucauucauucauuccacgacuaguaauugguggcuaaacacaugccaggcaccaugccaggcuuuggggauacaaguuuggaaaagguaaccucagcuccuacacuccuggagggcaugguggugacaguuacgcuagcauaguaagggcugugauggggcaugcauaaaaggggcugugggagcucugggcaagggaggggacccggggacagggcagucuaagcaggccuucuggaggaaguuuagaaacuggguuuagaggaagaaguagggacagaacauucuagauagaaggaagagcacgugcacuucuucauggcugggccacagcaagacucaccagacacaaggcugcccagucaggccgacuccacguggugcagguccuaagagcuguggugagugaguggaauuucuccugaaggcaguggagagccacagagaggcuucacaccagggcacagccuggaccgaucuggacuucaggaugaucauaucaguugcaagguggagaguagauuggcuggaguggaggacagggaggugacccagagagcucagagugguuaaguaacuucucccaggccacucagcuucuaaauugcagagccugauuggaggcuaaaucccucugaccccaaaacuuuccccacugccccguguugccagaugcuguggcaggaaguauaacaugcauuguucagccccuggcuucugggagcaugggaucuggcuaaaaagaccagacugucaccaugggcaggggcccagcagcccagagcaggcaaggggcuuugcaggaaagcgaggcaguaagaguccagguucugggauuaucaggaaaggauuccccaggagaagccaacuuugaccuugacagaugaguagaaucccccagaaaggaggaggguguuucuggcacaggacaugaacaaggacacugaggcccagggugagaagcagggagacgagcagggaagcuggggcgaccauaggacagaggaagggccugcacccccgccugccacgccaaggaguguaguccucauggcagaaguggggagccacggaagcucuuugagcaggaagugacacaagaugagagucucagagucacugccccaaaugacacaagagauucuaacuuaaugugccccaugaugacaucauaggcucccauuccaugcaagaagcagccaaggcuuagacacuggaagucauuuacgcagggucaccuuaaaucacauuaaccacuaaguggcacucauucuucagaacucaguucaacuguuauuuucagaugccccaggccagcacagucgcccacuuacaggcucucacagcaccuuguacuacuuuauggaccucauuacaauucuuacaauuguaauuaaagaaguaacugggaagauuuguuuuaaugucuuucuccucugcuagcagauaagcugccagaggagguuuucuugcccugggcggcucccauaguucauguggagugcuuugccugcaguggagacucuggcugugcuuauuggagggaggccuggggaggaacggggagggccgcaauacucagucugugaaauuuggugucugauccucuguccuucuuccuccucguccucaucccucuuccucacccuuccccacuccuccucuccccacugcagggggcuucuggcuugguguggaccaggagggggcagaaggcacccugucguggcugggcaccgucuucggcgugcuggcuagccucugugucucgcucaacgccaucuacaccacgaaggugcucccggcgguggacggcagcaucuggcgccugacuuucuacaacaacgucaacgccugcauccucuuccugccccugcuccugcugcucggggagcuucaggcccugcgugacuuugcccagcugggcagugcccacuucugggggaugaugacgcugggcggccuguuuggcuuugccaucggcuacgugacaggacugcagaucaaguucaccaguccgcugacccacaaugugucgggcacggccaaggccugugcccagacagugcuggccgugcucuacuacgaggagaccaagagcuuccucugguggacgagcaacaugauggugcugggcggcuccuccgccuacaccugggucaggggcugggagaugaagaagacuccggaggagcccagccccaaagacagcgagaagagcgccaugggggugugagcaccacaggcacccuggauggcccggccccggggcccguacacaggcggggccagcacaguagugaaggcggucuccuggaccccagaagcgugcugugguguggacugggugcuacuuauagacccaaucagaauacggugguugagaaggaaccaguguuuacaaguaauaucagaaaguugaaggaaccaguguuuacaaguaauaccagaaaguugccaaacccuucucuauccucucguauuucugaguuuuuguccuucccgagggagcacccuagugagaguugaaccccuuccuucugccuccagggccugucugccuccacaucacucugaggacagggacaggcaacaaccuugaagggacagcaauggcaaagccacaaaggcuucacuguacucaggggagauggcccuaccacagccaccuggagaggguugggaagccuuccgucugcggugggcaggcagccucacccugggcccacagaccggccuuccuuuggaggaaaguguggccuggacugagggaggaaaugagcgaguucccucugacaccagcagauccccaggggcugcugggcaguggccugggaaugggguggauugugagaaagugcucaccaucuauacacccuguauguccagcuuuugaacacaagggaaccaugcuucucuuagagguuaagcagggucauuaacauccucccccagucccuaacaucacauuguccugcguggcuccucuggcccugaguggcaccugucccucuggucucccagcaccuggcccagguaacagccuucugaaagcagagccaaggagcugcuucucucuucucccaguucuaccuccccagaagccuuccuccccagguggggcugauggagcaaggguccagacuaggagccuuccaccccagcugugucuggcgccccuagaucucugcaagggagguguuacagcugguucugagccgcuugccuugugaugguaagacaccaaccuuuacauucuucccugagguuguggcugacagagccugcuuggccccacuguuaguccagcgagcuccuauaucaaaaugccguaggccggguggcuuacaaacaacagaaacguauugcucacaguccuggggggcugggacgcccaagaucaagaggccagcagauucggacuccgcugagggcuguuucccgauccauagauggugccuucucgcuguauccucaaugguagaagcacaaacaagcaagcuccuuccugccucuuuuauaaggacuccaacccuguucaugaggguuccgcccccaugacccaaucagcuccaaaggccccaccuccuaauacugucaccuugggggugagaauuccaaugugaauuugcagggggagugggggacacacacaaauuucggggccauaccacccuucaccacacccuccugcgcucaggguggcuugcagucccuggcccuucuggugggcauuugguauguccuuucucuuggggugauuucugauguuuuuacucuauauagugaaaagcuagggagagcgggucuucuccccccucccucuccaguccccucacaaucccagauggguucuaaugcagcugcuggggccugaugcccugaguuguuugugauucaauaaagaauccauaagauccuguguguguggccugaggga

SEQ ID NO: 13289 - RNA, 582 nt, Homo sapiens
ccuuguuccacaacaggaacagauuuugugucuuuacccacauggaaauucaacaaauaauuuaguucaauucaguaagugccgauuuauugagcucuuaauauaugcuagacacgugggacauagagaugaaagagccuguucccugcccucagggagcucaaggaaacaagggaagaagcugucuucuaccuggcucugacucaaauucucuccacuuucucucuuuucccacacaaacccaagucccaugaguaauuaacaagaugaguaauagaucuucacccagaagguacaucuugcaagcuggaaaguuuagcaaaaguggcuuuguauaguuuccuuuuuuuucuuuuuacaccuuugaaaggcucugaagacauggcaaauguaacuuugaaaucagcagaaucuuuuugaggggcagcugguauaggaggagugacuugguggacuugucaccugggcugauguagucuuuuucuggguuucugccuuucagugauuaccugauuuucuuuuucugugucuguccuucagcucaucugauucuuuauccuccuucuccucccacccccauuc

SEQ ID NO: 13290 - RNA, 63108 nt, Homo sapiens
aggaagugccugaugccgcggccugugauugggaguugcuggagucggugcuucacucuuaagguuccgaucacagacugcggagugggucaggggcugcgagggcugccccaaguccuaccggguuugcacgggcgcgcccggcuccgcccgcaagugcgccuuccugacuuacugcugggugcgcggggcugggggugcgaguaccaccccugaagucucuuccugggcgaccuccggggccucauucuaggccuccuuaaagagaaggaucuaaauuaggaaaaggaagugcccuuauccacgaccaagcucuuccaccugcggagcucgcuuagucugcaccucaaccgugcggaaagugacugcccuguuuacugaggaaaaacuggggcucagaaaggugaagucauuugccaugggccaugcagcugggaagugacagaucuggauucaaagcgaguucuggcuggcgccagaguccuuguauuuuacagcacugguucucaagcuuuaugugcauuaagaauuccuggguugaggguggcguuaguuaacaaauucugggacucuacaaauugaguagaucugggauggggcucuggaaucuauuuucaacaauuguucccuggcaaauaacauauggcuccccagugaauggagcaagaaggugagcaagucguauccucugcggggacuguagguaauuguguuacgcuuuuagggccucaauugagagaacaugucaaacgggagcuccugggauuggagaauugguauuugauugucauuaacucuucugggcagauggcagccucugcgucucuccaccuauuaaaugaaaugaauuacaugcuuaucaucugggggaacuuguuaaacacacagauuccugggccuggcucagcucuacugaaucagaagaggugggagaugggaccugggaaucuauagucuaagcaagcuauuaauauaaaacgagcuuuuaccuuugagaacuugaggugugaagcuuucuuagguagaagcauaaagaaauagauuacagauguggaacauguggcuugaauuuccuuguuguuuugguagcuguacgugcuucugcauuugcuguaggcuaagcuuuuacugguacaacugucaaauuaguauuauuagccauuaugagguggauuuauccguuagcuggagacaggaguuuaauauaaguugaauguuaaucugucuguuguugauuuccugaguggcuuugggugcaucauugaacuuuaccguccacauacauaccugcauugugucaaaucuuacacugcuuguuauaaagacaaauaccuguauccauccuaaaucagauuuucugaaggugggccauagguauuuugaacaaacuuccagggaaguuugaugcagccagugauaauggaauauaugcuuggaaacagucuuagccgauuucucaauguccauguaggugaaaaugggaauaguacaguuuccuuauauucuacucuuggggacuauuaagaggaaugugguuuauaauagguccuaauuuuagaauuucuuaaaaugcacuuucuugugaaagaaacaaaaguacuaugguaagauuacaaaaggugaaugcuaaagccagcagccccaaaugacuaggcuucuugaaugaaauguugugaugacauaaacugauuuuacauggaagcucuauugccauugagagucuucugccugaaauuaauuaugccuuaggaguaauuguucacaauccuaacuaaaagcacuguuuuguuuuguuuuaauaaacagauaccauggaguaguuugaaacaggaacaaaaucuucugaaagcucggagcagaagccuuuuuggucaacauggaggaaaaaagacggcgagcccgaguucagggagccugggcugccccuguuaaaagccaggccauugcucagccaggcaagaaucuguagggauuuuguguguguguggauauggacaacucucauucucuuuuauuuauauccuuuugguuuauaauggacuuccauuucaauugacgucaaggaauuguuuaaaauguggcugauauuuuguccgauuuuguugauggugagcuaagggugggucuuuaauguuccucauauuuaguccacacccucaaaccuuucaguaucuucuguugacuuuaccaguuaguuucuacaugucauagagaucaucuccaagugggcuuuauuggcccuugcucaguagaaggugcugagaacagacuuuccccugguuugaggcuguccccucucuugcuucagcuaccacugcuaagagccaucuccaccagaagccuggccagaccuggaagaacaaagagcaucaucucucugacagagaguuuguguucaaagaaccucagcagguaaauucaugguuuuuucuucaauagugauaaaaauuugcuuagaaaagugauauucacacaguagacacucaaauaaauaaugacugaauaaauucacuaauagcagagcagaagaacuauaauaauaaugaaaugagaaauauuucaguuccuuucuaugucuggggauucuucguagucugcucccaguuuauggucacauguuauucccguauuuuuggcaaggagguuacaccauaaugagagcuugcuugcauugguuauuugagcuccagcaguccuaaaacugugcugucuucagugcuauugcacuucaccaucuuuggaauuggauuaaaauuucaguuuuuacaauaaaaugccugauuuuuagcccuuuuuucccaugaggaaaaauguaggaaacagugaagauuuacuuuuuaauaauguggaaaaguuaaaaaguuggguuucuugccauaguaacaacccuauaaauaauuauuaaaacuccuuauuuuauagcauauuuucuauuuuaaaaaaucuugucaagauuuuuccagagcugcuggcugcuaggaaaauuuauucuauuaauaauuguaucuucuuuuacugucuacuagcaaaugugaaguaguuuuaagaagaguggagacaagggucucuaguggguuagugagaaguuggaauagaaaagagauaguuuuuaacuuuauuuugaccagaaaugggaagauaugguaagucaguauccuugaggauuaagaacaucccagaaguaagauccgccuauuuccuugcagguaguacguagagcuccugagccacgagugauugaguaaguaauuugcugucuuccuguaauuguugcccacagugaaaugaagagccuggaaucuuuccucacuguuuuuucuaucuggaagagaauggcccaauaagugucuuaacuguagucugggauauucccaucucaaaugucuuuaaacuugaucuuuugagaagacuuucugaauuugcugauaguauugaaaaugcaacaagauauccauauguuaaacuuugacuuguguagauuuccuggcccuauuucaccgauaucuguagacaguaagcuaaaccucucaggcaaagacagagagggauuuuuccugagucauugaagcaugguucuuugagaagccauuaauugccucuuuuuuuuuuuuuuuuuuuuacuagcaaugcuaugaaagcugcuagugcuguagaugagcuuacaguccauuuauuaaaaccauguaauuauuccagaacaauuuaaaugauaguaaacauucuucuuauauugaucugugucuaaaauguucuuguccaaaguuggugagagaugcuuugacuccucuuuuuaugcuugucaguuuucaucugauguagauaaauugucaguagaaacuauucuuuuaucuuagcaaauuagcaucagauauauguucuugcccaugaucaaucuguuuguuaugcuguuugacugcuugcagauuggcuuguauaucuuagaaaaagucgcaggcuaauagucuuugguuguuuauuauuuuuuauuuuuuuggaacaggcugucacucugucacucaggcuggagugcaguggcauaaucaaaacucacuguagccuccaucuucugggcucaagugauccucccaccucagccucccgaguagcugggaccacaggcacacaccaccaugccuugcuccuuuuuuaaaaaauuuuuuguagagaugggaucucccuauguugccugggcugguuucgaauuccugggcugaaaugauccucccaccucagccucccaaagugcugauauuacagggaugagcuaccaugccaggccuuugguuguuuuaaaaaaacaaguguguuagugccuucauuggugaaggagaauaaacaaaaccaugaaacauguuguaagcuacagaugugacauucggccccccagaaacaggcaauugucggagaaaaaugacagaacucauuccuacuugguccuagaaucuguuaauucucauuaucuaaaguuaacuaugcuagguuuuaaaaaaauagccggaaaugucuuccauauuuaaagugagccauuucugaaugugggccaaaaauacaccauauugaaacauuuuguucucuguauacucagggaaacauuauagacgaugcauguaguaaauaugugugacagcuaugccugcuaugccuacauuuuggcugaaaggcacucauacaucuacuuaaaagccuagcucagagaucaugaaccacuaacucccaugacagaaggugaugugaaaacugccccuucguguucucuauaacgugucucucucugagaaggaucugacacaauugucuugauagauauaccuauccagucugugucacuuuucucauuaugggccucaccaccuggcaguucugcaacagcuuuauacauuuccacauuugauuaaauuuaguaaaccuuuauugcccaucugcuaugugcagacacugggaagcaauaaucuaccuauuccuugcaccucaggaccccacagucuauaaaauaaaauagacauuuaaucagauaaauuguaaucuuguacaucaugaaaaaauagacuguaaggucuagugguaacacagaggaugagagguuaauauuauuugccuggauuaaaggucaggaaaaguuuaaaggcggugaugcugaagcuaggauuuuugaaaggugaaugagaguuuuccacuggaccaaagcuggagguggauuggauuggggaugccgggugaugggguggcauuucagcauggaaaagcauggaguuagaaacguagugguguauucaggagauuccaagcaguugauugcugcuggaggaugaugaguuuaugggagcugucagaagauagagcuacauuaugaggaccuugaaugcaguuuuggggugccauugaaggauuuuaaucagaagaggaaccucaucagauguguaucucugaaagcaacagaagcccagagcccugagaugugcuugcugccuguuaaauguauccccuauuccacauucuccagaggagugcucuauuugaaaccucuuugugcaauagauuccuggaccauaucugccucaauuauggguaaaauauaaaggaguagaaucagaauugauuuuaucccaguuuuugucuccauggccugauacugucacaguuccauuccagugccauuaaugauauaccaugaucuucucagugguagaagaagguggggauuaugccucucucauaacuaaaugacuuuggugagccaggacuuuggcaguucagaaggauaacucuuccacuggguauagcauauuguuuugccucaaacuaacaagucuguuuccuuuguuucuuuagcagagaggguguguaugaaaucagccugucacccacagguguaucuagguaagcaaauccucacaagaagugaccguaauuaucacugaguuauagucucuuaaaauaguuuacuccccuagagaaagaaaauguaguacauauacauuauggaauacuaugcagccauuaaaaggaaugaaagcauguccuuugcgggaacauggauggaacuagagaucuuuaucaucagcaaacuaacgugggaacagaaaaccaaauacugcauguucucacuuguaagugggagccgaaugaugagaacacagggacacacagaagggaacaauagacacuggggcuugucgguggguggagggugggaggagggagaggaacaggaaaaauaacuaaugggcacuagacuuaacaccugggugaugaaauaaucuguauaacaaaccccuaugacaaaagcguaccuauauaacaaaccugcauauguaccccaaacuuaaaguuuaaaaaagucuacucccuuauuucaaauagguaacuucugccccuuaaauucuuggggagcaaaaauuugauaauaucuccuuuuuauuaguauuucuagcaucaaaauauuuucagguauaguuccuaaccuuucugucagauauaguagcugcuauuucccaaguuuuuuagaugaggaaaugagaccuaggaagauugaauauuuuuuucuuuuugagacagaguuuugcuuuuguugcccaggcuggagugcaauggugcuaucuuggcucacuguaaccucuaccuccuggguucaagagauucuccugccucagccucccaaguagcugggauuacaggcaugugccaccaagccuggcuacuuuuuucguauuuuuaauagagaugggguuucaucauguuggucaggcuggucucgaacuccugaccucaggugauccaccugccccaccuuagccucucaaagugcugggauuacaggugugagccaccacgucuggccugaauauuuuuucuuagugccacauaauaacuugacauuagaauugcgccuagccuggacuucugugcugugagugcuacauuauauuauuauacuucauguauauuacauauuguagauuauuguguauaauguuacaaauugcuacacuaggguaaauuucuuuuuuuguuuuuuuuuguuuuguguuuugagacagagucucacucugucacucaagcuggagugcaguggcgugaucuccacucacugcaagcuccgccuccaggguucacgccauucuucugccucagccucccgaguagcugggacuacaggcacgugccaccaugcccagcuaauuuuuuuuuuuuuuuguauuuuuaguagagacgagguuucaccguguuauucagcauggucucgaucucuugaccucgugauccaccugccuuggccucccaaagugcugggauuacaggcaugagccacugcgccuggcagucuuucuguuuuugagacagggucuggcucugucaccuaggcuggggugcaguggcacgaucucagcucauugcaacuucugccuccugggcucaagccacccucccacuucagccuccgaguagcugggauuacaggugugcgccaccacaccuggcuaauuuuguauuuuuguuuguuuguuuguuagugaugggguuucgccauguugcccaggcuggccuugaacuccugggcucaagugaucugcccgccuuggccucccaaagugcugggauuacaggcguaagccaccauacguggccuaggauagauuucaguaguuaaagcauauacuauuuaggguauauuaggcauuagucauuguuuuaaaaacauuuaaaaacauugaaacauuaacaucgccuuaaugcaugaguauacuaauugucacuauaaaauaaugagacauuuaaaacaaauagaacuuacacaucuagaugaauuucuucagaggagcuucugcuggaacaauggcucugccaugguuauaaccuuuuuuggaacuguuauuuuaaagcaagucacucaagaaaaccaguuuuauuguuuuggucauaucucauuguuaacuagauacggcuucagguaagcuuuggcucuuucacaaaaucagaugcaccuucaaagagugaagauuugcuaccaaggcaguuuaagagaaucuuccgugggcuuucagaagguaucuuaagaaagauauccaaaauuauuuugagcugcguuggcauuguugaaauaaacacauauucagugggagaaagaacccucauuagcuguguuuauuuugauacagucauaaugagcuguagcuuuuccuagaauuagcauagucucagaagacuaccaauuguuuaaauaaaacagggccaggcauuuuauuaguuauucuuuuuuuuuucuuuuuucgagauggaguuuugcuguuguagcccaggcuagagugcaauggugucaucucagcucacugcaaccuccacccccggguucaagcgauucuccugccuuagccucccaaguaguuggaacuacaggcaugcgccaccacgcccagcugauuuuguauuuuugguagacgggguuucaccauguuggucaggcuggucucgaacuccugaccucaggugauccacccgcuugagccucccaaagugcugggauuacaggcuugagccacugugccuggacuuauuauucuauuuacucuucacagugaaucuaugagguugaugucaucucagguuacagaugagaaaaccaaaguucagagagguucaguaacuugcccaggguuucacagcuaagcaguacugaaauacuguuugaauuaugaucuauaaaagcccucaccuaucaucccuuuauccuucauugccucuuuuauuugucccaacaugaaaggaguuuauuuuauaucuggagccucaugaccugggugauguuaggcucugcuugcugugggagcugugguaagaugauuucauguacccauuagaggcugcauccagauuaacuguuuccacuaacauuuagagucuaacuuaucuuuuccauguuuuuugguuaacaauguucauucugcacccagggucuguuuguauccuggcuuuguugacgugaaagaagcugacuggauauuggaacagcuuugucaagauguucccuggaaacagaggacuggcaucagagaggguaaguagaucccagaggucacaguuggugcugcguguucucccucucuggaauguuuccuaguaccaucacuucugcucaccaaagcuagucuuaaacagaaauucaaaaccugagauccuaagaaaguagaauuagccaaaaaggacagggaagaguauuccaggcaggagaaacagcagguggaaggcccagagaucagagagaacauggcaggaggauagaggugagaguucaaggaaccaaaggaaauuugguuggcugaacuauggcugacauacuuaucuccuuuuguguuuguucacugacuugcuucaaauggugccaacuuuuuccuuucuucauagaaaauuacagagcuuucuuuuuuucuuauccuauuuugcauacauucuuucacacuccuugcugacuuuguauucuucuuuaacuuuugccagaagaguccagucuccucuagcuucagcaucuguacucuccugagcuuguaaaagugacacggcaguuuguuaccugaguuggaaccugaaucucugcgggcauccacaagccaacagugccuguuauaccacaggcggucacuugggggcgucuguacucuagcaucgaauuuuuuucuggcacauugagugaauuuaaauuuucuguaaagaggcaaaguauauauaguugucccucaguauccacaggggauuguucccuguggauacugaaauucauguaugcucaaauccuuucauaaaaacuaucauaguggcugggcgugguggcuuacgccuguaaucccagcacuuugggaggccgaggcagguggaucaugaggucaggagaucgagaccauccuggcuaacaugaugaaaccccaucucuacuaacaauacaaaaauuagccaggcaugguggugcgcaccuguagucccagcuacucgggaggcugaggcaggagaauugcuugaauccgggaggcagagguugcagugagccgagaucgcgccacugcacuccagccugguaauagagugagacuccgucucaaaaaaaaauaaaauaacuaucauaguaugugcauauaaccuaugcacauccucuaguauccuuuaaaucaucucuagaucacuuauaauaccuaauacgauguaagugcuauguaaauaguuguuauacuguuuuuuauugugguauuguuauuuguaauuuuuauauauuuuuugaguauuuuugauccaugguuugaguauuuuugauccaugguggauguggaacccacagauaugaaagaccaacuguacuggcuucauuuuuguuacucaugcaucagaauaggagucagcuuucucucagccuucaggacagccuucucucaacucccacaguuucugcagcagggcuuuuggugacagacauggcuuugauuguuggcucuuucauucaaaguaguuguuaauuuuaagcaaauuacaguuaaguaacucucugaucccugguuuucuuaucaguaaaauuaaauuaauaacaaugucuuucuuauaaggugguuguguuaauacaaugagauaacgcaugagauugccugguacauaguaagccuucagugaguauuagcugcugcuauuauuauuauuauuauuguucuuauuguuguggcugauaccaguuaugggaaaaagaguagaucuauggauaacugcuucucuaaauuggaacaucaaagccuucugaugaaaaucagcugcaugccacaguuggucagggcacuuuuuccucccuugaaucaaaaagguuuacacaacauugcacacaugaaugagcaguuugucuuguuucucacauggauguuggugccacaaauuucugcagacagggguucagucuccauauucugcuuuuugagaccgucccuagucugagccccacuguuccccagugugacucuuugcccucucuuguuuaugucaucacuaauacaagcaagucacccacauucucaucucagagccuuugcccauguggugucugccaacauagugguuucucuuguccauucuacuugcaaagucccauaucuucugugaagguggaacuuugggucacagcccauucuuacuuuucuuuuguauuucucauagcacauugcaaggcacaaaguuggcacucaguaguaacaccuuaaauagcauuaaaccauuucaaaggccuguauuuucuuucuuagauauaacuuaucagcaaccaagacuuacagcaugguauggagaacuuccuuacacuuauucaagaaucacuauggaaccaaauccucacguaugucaacauauugucauugguaugguuuuauagacuauauacuauguguugagugcuauaaaauaacaacaaauuaccuugcagagauucaugcugguuccuaguucaaaaaaccucucuggguugaaacauugagucuuugugcuugucauccuucaugugcuagaggaugagaaaaaacuagaacuagaguaaacugaaccagagucuagcauuucaggaaaaugaacuauuucuucuccuaauaucccucuuucccaagcuuuucuagcuguauuccuucuguguacacccugguaugcauuugcuguggggcugaguccuuaugacugacgagugaggucaauaugccuuuuucuguuucucaggcucuuuugcuauuugugaaaaaaaaucugauguuuuucuuguuaacuuuguauuuauucuauggcugcaguucucagacuuccgucugauuuugcuuuggcuuguuucugcugcugcuuuugcuuuuaaaaaauuuccaugaaaguagaugaagauauucuaguauauaaauuaagcucauccaggggauagaguuaagguccaagaaauagcucccuguuuaguuccuggaaucuugccuuuggcaaauaauguuauguuuuauugaaagagacuuugaagaaaauggaguuuugcuuauggcauugggauacacagaaaugugacacauuucagagcuucuagaaauuuguaauugcaagcuaccacuuuacuaaaauuucagggagaaaacauugacugagggaacauggccuuuucacguaaggagauagcugcaugcuuugguuucaagggcugcauuuagaaugugagccagggaagugccgagacccuuuauaucugagguugauuuugaaacguggagauaauagaauuaggccaguccaacauagccugcuuuccuuguuucugucagaguuaauuuaucuucuugucaguagucauagcagagaauuugaggauuaaaugggcuguggggaaguucuuucucauucauucuaguuaaucuuuuaaaacaagauuucucaaccucaguaguauugccauuuugggcuggauaauucuuucuugugggucuaucccuugcauuguaggauguuuaccaguaugcaugaccuccaccuguuagaugucaguggcaccccucacccagcugugacaaccaaaaccaacucaagacauuguuaaacaucugggggggcaaaauugccccugguuaagaaccagugggaauaaacacaggaucugcugaguaaaguagccucuuauuguccgacauuuugggaacauuuugacaacucuucaaaauaauuuaugacaauccuuuuuuuuaaauguugguaguaugugcuuauugaaaauuuagaaacugcacauaaacaggaagaauauuaaaauucuugauaauucuaccccauguuuugguuccaaucuuguuauuuuagacaaauauaccuagagaaucuuuuuuucuguaacaauaaaauaguccaggugugguggcucaugucuauaaucccaacacuuugggaggucaagguggaaggauugcuugaggccaggaguucauaaccagccuggacaacauaauguggucaaauuagaauucuuuaauucagauuuggcuggcucauaacuuugccuuuauuggugauauauuuaguucauuuauauacugucuugaacaaaaaagagcuacccuuucucagauuuuuauuuauguucauuuuaaauuuagauauagggucuuguuauguugcccaggcugguguugaacaccugggcucaagugcuccuccugccucagcuuccuuuaauaguugugauuaucggccacaccccgaccucucagaauuuuuuaaagguggauucacuaauguauguauauauauguugggaguacuuguuuaguuuaaaaauugucauuaccugaagcuuaauaucccguacaaaauaagcaauuucagucauggguuuuuaaacuuguuuuaguuuuuguucaaacuaaaucucacaugagcccaguguauaaaacagaucagagccuugacuggcugggagucccaccaacuugaccucuccuuucuucuccuguagacccagagguaccucugagguaccuagaacucuauacaacacuguuugaaauccacugaauagguccuuucacuucugugauucauauuuuuuguauucuuuuccuaaaaugucuuuuaaggauaaaaugucuucacugaacagugagauaaugcugaauuuuaauuuagacauucaguucugaggcaucugaauauagaguauugguuggagagucuaaauuaauccucuaguucauuauccccuuuuuucuuccuuuucucacuguuucaguaccaaaaauaacccagaaaaaaaauaccuacuuagaaacauaacacaaacuuuaugcuaucucaguauucagucccugagcaagucagggaagugcuaauuagauucccaguaacauuggagaaaaaagcccaucuuccuccuuuacauucuuguuuuucuuguuaagcguguaauucuagcaucugaucuuuaucgcuaugaagauaaauuuaaagcuguaaaguaaauaggaaauacagccugcugacauuauuauuggaauuucacuuuggaauuuauucucuugaacaaagguuuauuuaauauuuuuguuuuaugaguguggaucucauguuauguguuuuucuaccacaauaaaaaaggagaacaagagauaaagaaacuuccaacuucuggaggcuucuugagucuccccaggugucccauuagccaacuauuuguuguuuuugcuguuuauuuuuuaaaauccucugcuuagaauauaauauuauaauguaguauccacaacaaggaauuccaucuuuaaccaugguuuucacaucagaguaaagcugagugauuauguaagcuucccuggcaguuuuaccugacaaccaugggauauacuuaauaauaguaacaauaauauuccuuccuuugcugaacgucuguuucuucacugcgaaacauauaacaugauaugguuuggcuguguccccacgcaagucucaccuugaauuguaauaauccccguguaucaagggcagggccagguggagauaauugaaucaugggggcauuuucccccuuacuguucucaugguagugaauaagucucaugagaucugaugguuuuauaaaugggaguucccugcacaugcgcucuugccugcugccauguaagaugugacuuugcuccuccuuugucuucugccuugauugugaggccuccgcagcuauguggaacugucaguccauugaaccucuuuuuguugguaaauuacccagucuuggguaugucuuuauuagcagcaugagaacagacuaaugcaauagacauucaaggaguucccuaaaguaacaguucuuagaguauaaucuguagaucccuggagaggguucaugaaaccuuuuuugggaaucuacaaguaaaacuauuuucauaauaauacuaagucuguaugguauuuucacuguguuggguuugcacugaugguaaugguggauaaagcugccagcaccuuagcaugaaucaagccauugucaccaaacucugcuaguagucauuguguucgucaucaucaugcgcuuccaguguaaacuuuaaaaaaugccaguuucauuuaagaaugucuauugaugaaguaguaaacauuauucauuuuauuaaaucuuggucuuugaguaugugucuucccaauagucuucuuaaugaaauuaaaaguguaccuaaaguacuccagcuacaaacuaaagugugauuguuugagcuguaagcugaacuagcuacuuuuguuguggauuguuuuugcuuaaaauacaacgggcagaccgacugugguuauucaaacuugaguauuuggcagacauuuccucauaaaugagugacgugaaugucacuucaaggaaaacaauggacaagauuuuuuuuacuaaugauaaaaguuagguuuucaagcaaaaauuagaauuuuagaaaacugguaucugccacuauuaggguucucuagagggacagaacuaauaggauagauacacacacacacacacacacacacacacacacguauauauauaaaggggaguuuauuaaguauuaauuacacaaucacaagaucccacaauaggcugucugcaagccgaggagcaaggagagccagucugagucccaaaacugaagaacuuggaguccgauguuugagggcaggaagcacccagcacgggagaacgacguaggcugggaggcuagacaagucucuccuuuucacauuuuucugccugcuuuauauucacuggcagcugauuagauugugcucaccagauuaagggugggucugccuucccuagcccacugacucaaauguuaaucucuuuuugcaacacccucacagacacacccaggaucaauacuuuguauccuucaauccaaucaaguugacauucaguauuaaccaucacagucacuuugagccugacuucuucccauuauuuaggcuuuucugcugagaucagugguaauauuguuggaugagaauuuuuuuuguuauuuuauaaugaaaugugucagcauuuagaagaucuguguaacuuagugaacuaauauuuuccagaugaccagugguugauguuacaaaaccauacaagguuaaagauuuauucaaaguguaggcuggaccaauggcuuuauuauuuuuuuuuauuuaaagcauuuuuuuuuuagagacacagggucuugcucuguugcccaggcuagagugagcacaguggcucaauccuagaucacugcagccuugaacuccugggcucaagcgauccuccugccucagccuccuaaguagcugggacaacaaacgugccacugugccuggcuuauuuuuuauagagaggggucucaguuuauugcccuggcugacaguggcuuuauauauaaaauaauaugaaaaguuugacaugguuucagauuccauauugcaacuaaccuuuaagaagucagcaccuguuaguggaaccgcgacugcuccgcagagcugcugguaugagcgcccgucgccaccccacaucccaggcccagccauucugacaagaacuagacuuugggcuccuugagaauauucaguuuuguaaguuuuaauauccucucaccauauucagcuuaaaauaccauacuuaaugauuauccuuggcaagacaggugugaaaggauugcuguuguauuacaaucauggugcaaaaauaccagucaccagugaggguauacaaauaccccuucaaauuaauuauggcugccuaugaaaggagguucccuacguguccuuugauuccgacauucaugggcagugacacugugaaugaauucaagagugaagauggggcuguucaugucauugaaaggcgcugcaagcuggauguagaugcaccaagacugcugaagaagauugcaggaguugauuacguuuauuuuguccagaagaacucacugaauucucgggaacguacuuugcacauugagggucauaaugaaacauuuuccaauugcuauaccguucacccugaaaaugaagauuggacccguuuugaacagucugcaaguuuagauauuaaaucuuucuuugguuuugaaaguaccauggaaaaaauugcaaugaaacaauauaccagcaauauuaaaaaaaggaaagaaaauuauugaauacuaccuucgccauuuagaaggaggcauaaccuuugugccccauuggacuccaccuuccaucacgcccucuucagagacaucuucgucauccugcaagaaacaagcagcguccauggcuguugucaucccagaugcuguccucaaggaggggcugaguggcgaugcccucagcagccccagugcaccugagcccguggugggcaucccugauaacaaacuagaugcugacuacaucaagagauaccugggcgauuugacuccgcugcaggagagcugucucauuagacuucacggguggcuccaggagacccacaagggugaaauuccaaaagaugagcauauucuucaguuccuaugugcaugggauuuuaauauugacaaagccagagagaucauuugucaaucuuuggcguggaggaagcagcaccagguagacuacauucuugcuaccugggccguuccacagguccuucagaauuacuacacgggaggcuggcaucaucacgacaaagauggguggccccucuguaugcucaggcuggggcagauggacaccaacggcuuggugagagcacucggggaggaagcccugcugagauacguucucuccauaaaugaagaagagcuaaggcgaugugaagagaauacaaaagucuuuguuuggccuaucagcucauggaccugccuggcggacuuggaaggggugaacaugcgccacuuauggagaccugaugucaaagugcugcgguggaucaucgagguggugaaggccaguuacccuaagagacugggccgacuucucauccugcggucacccaggguauuuccugugcucuggacgcugguuaguccauuuauugaugacaacaccagaaggaaauuccucauuuaugcaggaaaugacuaccaggguccuggaggccugcuggauuacauugauagauuauuucagauuuccugaguggagagugcaugugcaaagugccagaggguggacugguccccaaaucucucuacuggaccauggaggagcuggagaaugaagaccucaagcucuggacugagaccaucuaccacucugcaagcaucuucaaaggagccccacacaagauucucauucagauuguggaugccucuucagucaccacuuggaauuuugacauguacaaaggggacauugucuuuaacaucuaucacuccaagaggucgccacagccacccaaaaaggacucccuaggggccccaccucuccaggugggaacaaugugcagcucauagacaaagucuggcaguggggccgugacuacagcaugguggaauugccucugaucugcaaaggagaaggcgugcagggcucgcaugugaccacguggccgggccucugcauccugcaguggaaauuccacagcaugcccgugugcaccaucagcagccugccccagguggaugaugugcucgcgucccugcagaucucuucgcacaacuguaaagugauguacuacgccaaagugauaggcuccgaggauuucagagguuccaugacgagccuggaguccagccacaguggcuucucccaguugagugcaccaccaccuucuccagccagucucacuccagcuccaugauuuccagcuagugccgcaccaccugcaccuagugugcagaggagauggccgccccuccucggacagccagcuccacccucccgccgagcagagacauuguauggacuccucucaccucuagagagcaaauagcucuccagaugguaaacauagucauuucaucccaaaacuaucuuggcagguaguuuuaacucugauccuaccuuaacucaacagccauagauuuuguauauguugugcacaaaaucaaaccagagcacaagggcucucuugaaauaaaaguaguuucuauaccaauuaaaagauugacguggucucaggaaaaaaaaaaaaaaaaaggaaaccaguacuuguugaguuuugguauaauaucaaagaagaauaucuacaguuauuugaaaaggcuguaaacuacauaccuaugugaagccaauuuccuucauauacuucaauaaaaacaaccuauuuuaacagauugaaugcagaaacaaauaugagaaucagcucucuucuauuaauuuagauauuaaaaauuugcaaaacagugucacccuucucaucaauuauucaauuauuuguguuggaaauuauaguuauuuuucauuaaaauguugauguuaacauguaauggauuugugauugcauuuuuuuuauuuuaauuuaauuuuuuuuuuuuuuuuuuuuuuuuuugcgacagagucucgcucuguuacccaggcuggagugcaguggcacagucucagcucacugcagccuccgccucccggguucaagugauucuucugccucagccucccgaguagcugggacuacaggcgcaugccaccaugcccagcugauuuuuguauuuuuaguagagacaggguuucaccauauuggccaggcuggucuugaacucccgaccucgugauccacccgccucggccucccaaaguacugggauuacaggugugagccauguugccuggccuguccuugcauuuuaaaugaauuaaccaguaguugaaaauuuuuuuaguuuuaauuuuaaauaucauaaaaacugacggcuguaacccauauaaacaaaaguucuuugggcuccucaauaauuucucauguaaaauuugagaaccacuguucuaaaggaagcuuuguaaaguacucgagauuucugggagaaaagcauucuagcaagaaccaauauaagcuauguuguuuguagcucccaaguacaaucuaaggucaggggucauagcuuccuguaauauacauggcaagacaguuccaaauaugaauuacaucagugaacccagugcccaggaggcagggccguggaaccuguuuaagucuucuguaguugauggcucauauacuugucaagagcauaucaugauucucauucuuuagaaaagaauguuuuuacucuuuagguuauguuuuuuggaaguuagccacucuggaaauauuaaagaucauuuuuaaaaagcacuucuccccaucaggauaaaauaggaauagaacgaacagagggccacccagcaggaaaguuguuucacucuucaggcuucagucugggucugcugacuaccuagugacauaucggcuuugcugcuccacuuaccaccuuaaugacuuaccaaggucacugcccugaagauacugaugaaaauacauggcaaaggccauguauuugacauggaaaggaugagaugguuagauagauucugguccucaugauauugcuguacuaaauuuaguacuuuuauaaaauugcagagaucaacuugcuucaaaauagaaaugaugggagggaauuaaacuacuuuucuugccuucuguuuauugcauuccaugugguuugcuuauuacaugcccugguuauaacuuggcugauuuugcccuuucuuuucuguuuuuccaugcggcugucauuuuguguguaaugcgacugucuugcccuuuucuuggucuguggauugcaguggcacccugugcugcgcacacuaaagaaccgcauugaagagaacacuggccacaccuucaacuccuuacucugcaaucuuuaucgcaaugagaaggacagcguggacuggcacagugaugaugaacccucacuagggaggugccccauuauugcuucacuaaguuuuggugccacacgcacauuugagaugagaaagaagccaccaccagugaguauucucuuuuucuuaugcucuuccugccucuuauuagucuguggaaaaaguagaacuccuaaaagcuucuacuuucagauuucgagcaugggaauacacauuuuguugaugaaacauuuucaagugacuacuuccccaugguuaacuuuugacuuccaaagugcuccuucauucauuuacaaguccaacaagaauuggcugccuuaugcuaggugcuggcggcucauuucauugaugauaaacucccuguccuccuggagauacagucuaguugggguagauaaauauugccuauuacucaaauaauugcaauugugaucaaugcugugaaggaaagccuuagaagaaugacucaagcuagugggaggcuaaggaagaggaaggaggcuaaggaggacgucccugaagaaaccuuuauuuuaaguguucuucaugguaauauggccacuuuucugaaagggagcauucacauauguuuguuccuucuuagccuucuccugaaauacaggugaaucuaacucuuucagagagaggaaacucaagccagauuaucagagauggugaucuguccacauucagguagaaaaacagugaccaaaaaauuaauaacgauauaauaacuucaguuuccaccccagcgcuuaccucaauuaugugacauuugaggaauacuaggguuauuaauuuuuuaaaaaaucaaaacuguagucccuuacgacuaagaaagauaguaaugccaagaaaagagccaauuauuuuauuuucaguguuugugucucuuccuaaccagcauuccugaucauucagcuuauaauguuaaaccagacccagucgguguggaaggccaaccaacaggcuguuuuuuuguuugcuuguuuuuuagagagggagucucacucugucgcccaggcuggagugcaaguggcacgaucucggcucacugcaaccucugccuccccaguucaagcgauucacuugcguuagccucccgaguagcugggauuacaggcgugugccaggaccccuggcuaauuuuuguauuuuuaggagagaugggguuuugccauguuggccaggcuguucucaaacuccugaccucaggugauucgcccaccucggccucccaaagugcugggauuacaggcaugagccacugcaccuggcccaggcugauuuuugaauagaccuaagccagaccacaucauuauuaguucuugugucaguucuucgucagauauacuuccauaagaauacaguuaacagacugaguguuuuccugguguguauuggguuuccaugcaugguauuuuuaaagcauauugugugauuuugcauauaugccauuaaguaccuuuuguugguauaauuuccauugauuaggcuuucuuugguuauguuuacauaaaaaguuugaucauuguuaggggauugguaguugccgguguuuuuuuaagugaacuugcucucuaagccuucaguuacauuggcaagcagccuucucauauaccaaggaguaccacuugagaaucagacaaaccagcuuuugcuauauuuguuuuagauaugauuauacuucuguacacagcuuucacucaguuaaauaccaaguucacaugugugaaaaauucauccugcccuuaguaagacuccuguugcauaaauaguagagagacacuguaucagucucauuauuuaaguucagacccucuucucaagccggauguauggaaccucagcuuguugccaggagugguccugagaccgggggccguagcagugaaugaguaagaugaaauugucuuucuccuccuggagcucaucuagcauaugcuagcacugcgccuuccuccuagaguuauccuucuggccuccugauuggcaaauaagcuauaguauauauagccuuugguauaauaaugguuuuuaguucuucacacuuacuuucuuuguugcucaguauuuaaguauucaguuacuguuucuuuacacacauauauucaccaccaccaugccccuuuuuaaaaauuugggccuauuuauagauuugaagcuuaagaauucccuaaguaugcuuuuuggauaaaucauuuuacuguacaagcaauuuccaaauauuaugcauucacaauauucuggugcccagaaauaccccguuucuucuccccuccagagagcugaauuucuucauuuucucauauaaagauaugacauauggugaucaagagcuauuucuugguaguacacaucaguuauguuauaggguaacauguagauggagagcauaacuacuacauacauuguuccugugggcaagcauuuggaacagcgcuuuauccugccgugccccaugcuguagcuuucucuucuccucagccuucuuggagccuauuuugaugaacaugaaugauaauacaggccaugaaauacucagaagugguaaaguccacauaauugucugccaguggcaagggaaucugcgcuaugacgaugguagcugauuugauuaaaauacugauccaauaaguaagaaaauuugccugagauuuuaacaaaguugccugaggaaagggauuugggaagaaauauaaacauguugguacuucagguuguugacuguaguaaguuuuggcuucuggccuagucuuaacuaugauugaauuucaugcaguuuuuguauaucaucucaauucuggcuuuuguuuaagauugggaaauugaauauuaauauguuugaaauuauaaucacacaugaguaaaaagugaccuuuuuuccccagaaccuguaaaguccauuuuuguguaaacaggauacaaguuuaaacuuuugaagauuccuucaggucucacuaacggauuuccaaaaaccuggggcucuacaaauguagcuaaacucgaagugcagaacccuuucuuugaguugauggccuuggaaauauaccuuaaagugcaucaucuuuaucuuauaaauaauccuuuuuuccaaaggauugaaaggaagcgauuauugcacauuuuugucuacuuuucuuuauaaacucaggugaugagaacaugacucaugauucauacagcccaagguaaagcauaauuuaaaaaguaaaaauuagguuagucuucugugugggauuuguaggagucugacuuccuguaacucuuagagaccuaucucagugugcuacuacagauuguaauuuucaugucugucaccgagacguucaggguuuauuagagguugugggagggaaucuuucaaacuccuauuagcuuugacccaucggaggagaaguuaaugccuauuugacuugagucacaguuucgcaucucaggcggacauggaagagucaugagauuuccugcacuuuguucaaaugugcaguuuugagacagaaaagcgucuguuuugggccacuuucaaagagaaauagucuugauuuuuuaaaaauucaaauuccuccacccuugcagcagcuguuuauuuuguagucuggcaccuugagcagaucuccauuaacugcugaucuacugaaagcugccccaguuccacacacuguauuccuaacaguuucucucugugcugagacgguaaggagaucuuuguuucguaagcaccagugcccucugauucaugcaucagcucagucagcuucauguagacaucaucucucggauuaaacauuucacuccuccaaggugccgguuuuuuguuuuuuguuuuuuuuuuucacuguccugugguccaagucugccaagugcugcucauucauuuugauuuuagaguaaauuacccuuuccuuuaaugauauuacugucauuccucaggggcauaguagacuuguuuaagcuugcuuuuacauucauuccgauuccuuuuuuguuuaguucaaaucaaagacuaagugaagggcaccuuaucuauauucuggcuguugucaggcuauauugucuuaagacugucauaaagcuuaucaaauauacuucaguagaccuuuuuuauucuaucaggcuggcauuauuaaagguuuucuauacuucuugucccaaacccaguuguacuuuucaaacuacauuguguuccuguuugcaaagauuagucugguucuuuucccagcuaguuuuaauucuauacugaaaaaaacaagcuggaaaaggaacuacaaaagccauuuggcaggcugcuauuucucugucgguuaccauggaaacagugauggcugggggguguuauuagauaauagcaggaaguuugugaugcacuggagguuuagaugccaaaagccuuguuuuucuagcaaauuaccucuggauaaacuguauccuucaucagcugaauucugcaaauguuaggggcuccuauucaccucagggugauugagcuacagcaaguugagcccucuaaccacuccucuuuuuagcccuugugaagaaugugaauccuguuuguauugccaggagagaugauuguaaaaccaagucuagcgguagagacuaugagagcacccaaugaauuggagguccuaguguuuccuuugcuaauugguuguggguuuuuuguacacugcugggaagaguggaguauaaaaaggucagucaagucauaaauacugauauuuuuuguaagacuuuagaaaagaagauauuggaauccaaaauaauaagauacuaaauaguguaaauuuagaaguuagauaagcuaguacuaugcaggauuucauagaguggaaacaacccacaccuuagccagcagccccgcugcugcuauuccagucaucuauccuuccuauuaauccaucuggugauuauagcaccuacucuaagagauuacaagaaauacuugaggcugggcaugguggcucucaccugcaaccccagcacuuugggaggccgagaugggaggaucccuugagcucaggaguuugagaccagccuggguaacagugagaccccaucucuauuuuuuuaaaguaaauaaaauaaauacaaguaaauaauaaguaauaaaaagaaauacuugaaaucaauuguugauagccaugaucauuuaaaaacacuuucuaaugaaauuuuaaaaauuggguuguauuuccuguuucuaucccugauguugccaaaaagcacucaacugucuuauuuguacuuauuccuuuuuuguaaaugggauugauaauugguagcuacuucauggaaguaaucaacaaguuuucccaugaaaguugcuguaguaaucagugaauuuuuaagcuuuuguaaaugguagaugcuauggugacuuuucagauauggaaacugaaaaaggaaauagcaaugaaacuaaacuccaagguacccuuggucugugaaauggcauucauugaaagaguauagggaagccucagggaggguaagguggccuguggaucauaaaugguaauuggguuuuugaguucccaucucuaggaccauuuaaugguuuggagagugugagggugaguagagagagagagagugugugugugugugugcguguguguguuuaagcagauaaagauugguaguccugauaagacuugaauuaucuucagacuugagaucccuuaggaguuggaguccucauuugcguccuuggggccuugucucaagcuagaauccaugcccugacucccacugggaauaauugauuuuugcaacaagccucccaguuuucuauuacuagugacagcacuuuuaguuucaguaggacaaacuuguguuuccuugugaaacuaagugauucauuguuguuucuguguguaccaugauuuggcuugcaaaccuggcuuuuuuuaaacuuugccccagugguagagguuuuucuccccuugccauacucuuaaggacuauuccuaagccaucugguaucuggugauuuuuuucaucuuucacaagucacauuuucauggaggauggcugucucaccgaggcagagaagagcaaaguguguuucaggaagggaaaggaggcccugcccuggagcagagugagccagcuugaggagugucacagguggugagacugggagagugggcaggcaccagggcaugcagagacucaugagccucaggaaggagcagauuuuguuuuauguccaucagggagccagugagguguauaaagcagaagagugacacggucugauuggcaauuuuaaaaggucacuauugcuacugcauggagccuggacuagaaagaaacaaggaggccaauuaggacauuguuagauuuuguauauaccuugggaccaagguagagaaggagaaaaagggaugauucaauggcaugagcucagaggaacagggauuuuuauucucugcuucagaauaaugauuugaaaguguuauugaggaguaaggagaauacucuaucaccuggcucugugagccacuggauggagagccaugaucaccuuccaccugagaggguuucagggaauuugcagucuuccagagauagccagauuucaauuaggaugaggaagcagagagaaccuucagagcucauugagacugaagauauaggugaguuugcucaucuuugaaugggaaauccagaggacacaguggaagggugcaggagggaaagaguuccgggggauugugucugaucagauuauguccaggaacaguuugggaaugaguguucugguauuaacagauggcuggagaggcuugcacuucugcuagugacugggcucagcuggaggugagguauggcggaauguguucucauaugcuuucagaggaugaagggcauuuguuucuggugcuagcaccugagauagaagcucuuucaagauagcaguucuuuuaaguugcauuuuuuggaaauauuauauugccaagaauggaauguucaucacaugaucucuucugauuucacaugcacauucaguguagcuggaacagcuacaacugugaguguaaaaccagguuuguuuuugcucaaauucgguaacuucuuacccccacccuaucccuaguauuauugcagcaauaagucugaacaguaaacgcugucagcagguauuucauucaauuucauugacauuucaaugugugcaguccagaaggaaaggcaguaguccgccugguaguuugugcugucgaugccugcugagagagcuugugccgcagccaacaauugcccaggccucccaaacgcucuuaaguuagugagacauuggugaggucccaugucauugagcuuuuaauaucacugggugugccugguauaggaugauugauugcaccaguccuuucugcucaccuuucucauuugccucgccagaaccuuccaagccaaauaaaugccaaaaaucaggaaagaguuuuagaaaaacucaaagaucuguaugugccaaguaaacuguuucgaaccaauaaccucagugacuuaaaaucuguguuuuucuagcuggcuucuuacuuuagcagaucuuauuucagaaacagcuucuguuuuuaaaguaauguacuucagaucgaugcuaggaugucaucaguuaaagugugguuugagucagcagaauaacucugcaaagaugacuuuguggggucccagcuuuauucucucuccaucauuucuguaauuaauauguuguguuuaugucagauuuuaaaaauauuuuaccacuaugaacaagaggaccagcuauguucuuguaucagcacuagaggaacaacuuugcagcccaacuguagcuccaagcuuaggugauccaugaaacagucuagaccucagcuggguucucaagggcaaggcaacaccacaguuugggaaaacaagcugaaaagaaaugauaaggaaaaaaagaggacauuacuggcauagccauaaguugggcaauagggcaaauaaauguacguuugauccucagcggguaaguagcuguaacacaggcuagcauuuaguuuucaaauaucauuucagucugcaaaaaaugccaugaccauccuuaucaagcaccuccacccucugucugauccuuagaccagcgggcuagagaaaucucuuuuaccuauuaccaucgugaaaaaaaugcuuugcuugacccugcagauauccugacaucuugggcuuuuucuuguuuuugaagcacagauucaggaaugaguugucugcaucugaagucuccccuuucucaaagcuuaacucauuauugacacaccugcuguuucgcuccaucccaccacucugcugaaauuauccucauaccguugaccucaaaucaaguccaccagccuguccucagucaucaucucucuuccuuguaauauuggucaccaggaugcaucaccucugugugugaaacuugcccauguauuaccugcguuuucuuccucugaaauacugucuuguuuuagaauucccaaacuuuucucauugcuauuuuucugccuccuuuaaggccuuuucuuuuacauucaaccccuuaaauauagacguucaagauuucuuugauucuguuauuguucucuacauuauuuuuuaggagauuaugaacuggcaguagauuguaaauaccauaugggcaaggucccuuucugucuuauuuaucauuacauucuuagcauuuaguucuacauauguugauugaauaagcaaauaaauaggaucucauuaguucuuauagcuuuaaccauuccuucuuugguggggugacuucugaaucuccuaucuccagcuuugacuuucaucugaaguuccagucaucacuuuccacauguucacgagacauuuccacuuaauaacagcacauguggcuuccacccuguaaugauaaaaucagauucguauuguucuuucagaaaaacuccacacuugcugguaaguucauuuauguucauguuaaccuaaccauucucuuggucagguuaacaccguaaguuauuuucagcucuuccuuguuccuuuguuucucauauauuaucaagucccaagucaucugaauucuuucuugaacuaucuaaagaacccaucucucuuacagugaccaucuuuaucccaggcacuuuuuaacccaugccuacaguacuaaaaugacuuuuuuuuucacccugauguccuuaauuccaaucuuugcucccucucuucuguccauuacccagaugucagguauuauuuccaggaacaguucuuuccugccucucucucacugucuucucucauucuccccucuccaaauauuaauuaaaccccuacuaugugucagguauuauacuaugcucagcucuggggauauagcagugaacaugacaaacauagucccugcccuuauggggguuacaggagcuagacuauaaucaaauaaacagagagaaauaguuacaacucaugguuagagcucugaauuuuuauuuuagaagaucacuguggcugcugugugaagaauaauuugggaagaggcaagaguaggagacuaaaagaguaggugguuguagucaucgcagugggagacugcuagcuuggacuaagguggcauuggggaugaagagaaguuaauggguuugagguauauuucugaggaugaaucaacagaacuugccaguaauauguuagauguggggguaaggauccagacucccaggugucugacuugagcaguggugaguggaguugcuguuuacucagguggaagagaagcugggauuucugcauuugauuuugucccugcuggaggaguuccuucuucuacgugcaaaaucugaggugccugaggcuuccaaauguuaaguaggcagucgacuguguaagucuggaguucagacaacaggccuggcuggagaugucauuugggaauuuuggaauaaccgcaauaguaaaacgcuaauaauaaauaacaaguguauagugcugacugugccuggcucugcucuaacuucuuuauugaauucucugauaauuuuauauaguugaugccauuauuauuuccauuguacagaugagaugacugagacucaguguuaaauuacuugcccaagauggcuuagacaacuauuuguugaauguggaaucgaauuaaaacuaauaauauagaccauauguaaaacuguggaauuguacauuaucauucagagaaagagaauaaaaaagggagcggccaggcgccguggcucaugccuguaaucccagcacuuugggaggcugaggugggcggaucacaaggucgggaguucgagaccagccugaccaacauggugaaaccccgucucuacuaaaaauacaaaaaaaauaggcaggcgugguggugcgcgccuguaaugccagcuacuuaggaggcugaggcagaagaaucgcuugaaccugggaggcagagguugcagugagucgagaucgcaccacugcacuccagccugggccacagagugagacuccuucucaaaacaaacaaacaaacaaaaaacaagaagggagcauagagccucaaagguugagcucacugcuuucaucacuuuguuuuccaccugaaaaaucuuaauuugcuucuguuggaacaaaggauaaaauagaaacuccuuacccagauugccaaauccauacaugaucuuagcccagggagauccauggacucucacuguucccguaugguugcuccauucuacuaaguuaucucuuugcuuuccccgaggcuugcucuccaacuucuuaacuuaaaagggcccccuauagcgugaaggcuuuccugaugccuccagugcagaaauuaauaauaguuacugugugccaggugcuuccugugaaccuguaaaacaagaaacagguagcaggcuucuaccuuguccuuucugcucauuuguguuuuguuuuuauaagugucuucuuaguacagagauggagguuuuucuauuuugcucaucuaaggaaucagagaugauguggaaaaccaacugccucacuguuaucugagaucaguaauuuggaagcauauuuugcuuugaaugacuuuuucugauugaguuaggggugagaugaagaaugugauaauuuuuuaaaaucauggcauuuauuuuuuaaaaucuuaauauauuaaacaauacaguuucagauacaaaaaaaauuacugcaauaaaacaguugagguguauuuccauugugcuucccuuccuuaucaggaaaguacauuguccacugagagacaggauggauggccucucccagcucuacacaaagcacaagccuacuggcucuccugggccuugguuaauacauggaacaggcuauguuuucuaaaauguuguagcaacacucauaagucaaccaugguucaaaaagucaaccaugguucaaaucacauauuuacauauugaucaauucuuuaugauagacagacauaaaugagauacaguaaauaauuuccaguuguuaaaaaaaaaaaaaaaacaaguacaggcgacaaacuuggucaugguacacaaauauacuucauguguacagacagcuucauucaggucuaauuuuuuuuuaauuuuuguuuuagguuagguauauuugcagguuuguuauauagguaacuugucugucacggggguuugguauacagauuauuucaucacccggcuaauaagcauaguacccgauagguaguuuuuccguccucacccccgucccguccuccacccuccauuauucagguauaauuuuaauuugaaagaccuagauauacuauuauuuaagugauaauggccucuaagauuuauucagauuacuaucaaauaauaaauuaaacaaauccacuauaauuuaaaacucuguccauugcuugaaaccuuggaggagccuaugcuacaaucaguugcuaacuaaaagcaauuguacguguauuugauauuuccccacaguuucuaccucuagauuuaauucaguaaaggaagaugauauuugaagaugaaguagcacuuguguccugagcaucucucaggcacuacugcauggaauggcaaaggggaugcaagaagcacaucagaugacaacggucuuagacgcuuacaagucugcuaaggugacugacaagggaaucaaagaaggcagucaugucauggaccuaucagcagcauagcugggcaacccuggagcugaaucuggcccucagacuuguuuaaauugcccaguguuuuuaaagacacugaauuaauugcgaaaauuuauaacucaggaaauuucacauaaaaaucccacuugucagcuucccuggaaaacccagaagagggggcagcacugggggaacagugaucugaaauggcucauuggcagagcagccaccaccuuucugcaggccccugguucugcaugggucccucuccucccugugcugcacccagcccacaccucucacuuaugcuacuugcugguguuugugaccccuacaguauagucagggugccauauaaucaggacaggaaauauuaggauuucagaaggaauagagcuuaccuuggagagcagaguauaguggaaagaauagggcuuuagagccgggccaaucuacauucaaaugcuagccugcccuccugcuagcuuuugccuuagagaaauauuuucccuccagcucccuuugcuuaugauaaaauggauaauaucaccuuccuugccucccuuacaagguuguagugaggauuagcaauaacggauauagagugccugaugugccuggcaccugagcacaugccaucguagaucuuguggaagaagucuggcaggaugcuuugguuuaaguaccuggaaacuguuauaaaaagaagcauggaaaaaaaagaauaacccaaccaccaccaaaaaacaaacuccauguagauuaaagaguuaaaucuaaaaaauguaaacucuuaaaaaaaaaacuaaaaggaaauacaguuguauauuuaacuuuccucaggaugggaaaagacuuucuaagcauaaaaaucaugaagacgagccaaagaaaggucaguagaguugacucuaaaauuuuugagcuauuccauguuaaauaccauaaguacaguuaaaaggcaaauagcaaaugagaaaagcauuugcaaaaaguaugacaaacaaaugccuuaauaucugugguuguagaucaauaagaaaacaguguuaacacccccauagaacaauggacaaaggacaugaacagagaguguucacagcagaagaaacacaaacagcaaacagaaugaaaaaaaaaaaguugaacuugggcugggugugguggcucacaccuguaaucccagcacuuugggaggccaaggcagguggaucacuugagcccaggaguucaagaccagccuggccaacauggugaaacccuaucucuacuaaaaauaaaaaaaaauuagccaggcaugguggcaggcaccuguaaucccagcuacucgggaggcugaggcacaagaaucgcuugaacccaggagguggagguugcagugagccgagaucacaccacugcacuccagccugggugacagagugagacucugucucaaaaaaagaaaaaaaaaaaaaaaagaacuuggcuuguaauccaagaucucuaaguuugaaugaguugucauuucuccccuaauuguuuuucguuacugucaguugauaauguucagccagaagauagguacugucauguuuuccuggugagauuauagauugcugcagccuucucaagaaagcaguuugguaauauaaaucaagugccuuaaaguucauacacuuggcuccaguaauuccauuuuuuaagaauauauccuagaaauauaugcagaaauguuuugcccaaaaaucugcuugcagcagcuuuuuauuuauuuucccucuuuuuaaaaaaaaauacugguguaugaaaaucaaucuccaaccaugugcuccuuacugcuccauccuuaguacuagcauaaugccugauauauacagguggucaaaagguauuugugaguuuaaaggaaggauauguucauacaaaggaauauucuauaaccauauuuuugaaauguauauuuaaagauauagaaaaaugcucaauaaaauauuaaaaauggaguacacacgauuguauaucuggaagacucuguguguauguuguauaaacucuggaugauaggauuacaggcgauuuucuacauuuucuguguacucuuccucagucauucaguacauauuuauucauaugugugauaggcacugagaauguuucuuaacaggaagaccacauaaacuuucccucauggaguuuauaagagcagagguugaauaaauaauuacaagugcaucauuuacuuuaguaaacuuauguuacuuuuuauauucuagaaggaaaaccuguaugaugauuuuaaagcauugaugauuguuuguaauuucuaagacauucuuuuaggacaagaaagggaugauuuuaagaaaacuccaaaucucauacaguaugaauuaccuuuccaauggaaagaaaaauguuuagguuucccaucuguuggaugguuaauaaugacauaacaguaaauacauccagauuuuuucaccccaaauagcauuuucuuaaaggaaacugaauaggauauguuggugagguggagguaagaguugugagaagcuuuagaaaagcauaauuaagccuucaaaugaacuggcugcgguuggaggaaugagaauguugaucagcauuaauauaaaaauacauguuuuucgcuuuuuccauguacucguaggguuucaaguauuuggaaaaccaagaacaucaauaacaaaacccacccuguagcuugagugugacccuaaaagcugcuuuuaaccaggaugagugauggaaaauuuuauccuuagcccugguuuugggggguguguuuuguuuuguuuugaagaaaacccugaguaaaucaaaagggcuacagagauguguuuggguaacuuaaccacgcuuaaugacuaggaaggcacucuucuaaacagucugaccuguguuuccacuguugcuuauccauuuaucaacuggagccuuuaugcacagccauguggguuccucuggccuuuuaucugacuccuaaguggaaacagucuccaugcaucuugcuucaguugaagggcaucuugcuucaguugaaggguggcucuauggucuguugccacucuggccucgagggaaggaugcauuugugagcucuguguugcauuaguaggaucccuugcccucuuuccugucugucuccuucugcaaauuaggaaugcaucuucuaagucaaagaucuuagaaggaauaaauaacaagcagcaaagaaugauaucacuucucacagaggguacacuguguaagggugucuccuuuguggacugauucgaguggcucccucccaaacgaaggcucacccuugucugcuuuuugguauggcuaaugguuauguugaauguaauguguucaaaaccaaccugagacuuucucucauuugaaaaguucagaucuuaggaacaguaugugaaaugugaucauugaacaucacuuuccaucagugcugauacauuucggaauucucuuucacuugugagguggauuccugcuucauguuuccagguggaacuauaguguuuaccuauucucuuccacugaucuagcaccuccuucuccccaacaguguuuuuaauguucuaggagaucuucaucucagaauugccuucauguugugguuaagugucuuuccuuucuacuuuauuuuauucuccuuagugucuguacuugauuuguagauuaagcccauguugcacucucugauuauguagaggguagcagaaauucuucugcuucuagcuguguugaaccuugaucugauagcugacuauacagccuaaauuaaggagccuuggacugucuaaucucauggucagugcacucccuccggauaucuuuuccccaguaggaccaugugucuccucugucuggauuuuuuuuuuaaaucagagcagcguuuugcuuuucugagauggagcugggcugcagugagggcagggucaccuucccacugcccucugguugucugaggggucaaagguaaauguuuuggugcccacuuauuacuggaagagaaaagguggcagacacaauuaaaaucaaucacugaaaccaaaguuauuuuaaacauugcuucuaucuucugucuauaaaaauuaugacuaugcuugacaaaguuacugccaaaaguuggggccuggaacuuagacuguuuaugcaaguucaugauuguuuugauuuugauuuuccuagggaaaaucuuuguaaacaguuaaguucucagaagcacccauacaguaauaaacauaaacacaguuugcacugaaaucaauccugcaguaacccaaauguaacccuuucuaccggaagugaagcagaugaaugaauagacccaucaguucugcccagaauggaggugaagaaaucaggaagcucagaucugucccagucucagcacuugacaugcucuuuguugcugugagcacagaaguuguuuaaugcuccugguuuucagcuguggaggagccacacuaccaguuaauugcuuugcagcuuaugcucugaagacuccugagaauauuggacauaaauugcuuuugagcucucuguguaaauacaaagcauuuguauccuaaguguacaggagucgugauccauccucaaagauguaaacagccaaucucaguuugacagcacuguuuuggucaagccagagcucccuuugagaaaaucuugcuguugucuguucuggaaagaggcaggaauaugucuccaaaacuccauaguagccaugagaagaauugagacuauaggugccaauuaguaaauuagcauacauugugaaaaggugaaggaagucaucgcaucaaaucuugguuaaaaggacauuuuucccacacugaguaugucaaaauguagagcacaacaucagucagauguaaagaauucuuguacaggugacuuuuauuuccuucuuaggccagaaugggcuuuucugcauuuuggauuaugaugaugacacuaauagcuagcacuuacugcaugccaaucuucaagggauuuacacauauucuaucaauggaggcucaccauagcccuagguggcagucacugucauccuccccauuuuacaaaugaguaagucaggguacagagagaugagguaacuugccaacagucaagcagcugccaaaugacagagcuauauauggauucccacagucuggcugagcagagguuuccauuuuuuuuugaccucugucagguucuguugcaucuugauuacacaggcaaaacauuuauuacaacaaaugcuguuuucuaggaagagaauggagacuacacauauguggaaagagugaagauacccuuggaucaugggaccuuguuaaucauggaaggagcgacacaagcugacuggcaggugaggaucugcaaguaauaugaaucugcuuucauguggaggcaguuuccugacucugaggacuauuucuaaguagacauggugaaaagcaagcugcuuuuacaacgagcaagagggaaugagcugacauucuuuccaaggaguuuugcuacuacugacaauccagguggacacuaguguguccgguagaacuuucugugaugaugaaaguguucaguaucugugcugccuauuguaguagucacuagccacauaugacugacuucuuaaaauguggcuugcaugcuauaaagaacugaguuuuuaauuuaauuuuaauuaacuuaaauuuaaauagcuucaggguagcuagugacuaucuuauuggaauacacagcucugcagcuaggccaugccauuuuuaggccagaucauuucuaaggugcacauguuaaugucaaaacacuuaccauaagaauggaaucucaugccucucuuuggucucauccauuuauauguuuuaugagauuugggaaauggcaggugucugagaggaacagcaacaauuagaaaagaugaaaauaucucacuucagaggugcuggcauagcacaguggggcuggggauggaaauuuguuucaaagaagggaccuuucuccacaagacuucaaagagcuuacuacucauuuaagggggaugagauggaaauauuucugcauucucaugaauaaguuuuaagucgcuuugaacuaaaaguguguauguguguauuuaugucagaguuauguguauuuccauuuagcaucgagugcccaaagaauaccacucuagagaaccgagagugaaccugaccuuucggacagucuauccagacccucgaggggcacccuggugacgucagagcuuugagagagaagcuucacugaaacggagcaaaccuuccacugagaagccacuucaagaggcuggugcugcuagaucucaugauguggcuguugggaagauggugggguuuguuugccagcuuggaguccuauuaaaugaaagccagcaacucauguugguaauaggucuacugugggaacaguuaucccuaaccacagcucaaaaucgcuaucaucuuuaggcaaauuaaaaucuauguggcagugcucauggaugauuuuguucuaagcaguuuuccuccugcccucccccgccccccacacgccccgccuucauuugaagaaauaucaauggacuugugccucuggggaaaagaaaaucucacguguuuguuccuugugacuucagugaaguggagauauaaauaugcgucagggacucuggagccuuccguaggcagacagcugcugaaacccaaacagaggugguuucaucuuggcuugcauacuauuguaauggaaagcuacauauucagggaacacuguaacugagucuuccugcaacacacucaagacagguuacaggccuccaaauaaagagugguggcaguaugcucucgucuagccaccuucaaguagucaccuguaauacaagagaaaacuguccccuuaaagggaggaaucacugaaugaugucacgggaaguagcaggcugaaauugaggcugaagagcagcagaaggccugcucaugacagcuguuccacauagauuauuuuccccucgggaaucacuugagucaucuagacccaagucagauagaagugggagcagcccugcagggaaugcacucaauugccuaauaguucucgucaccuuguguuucaguagcccuaugacuaacgcucucuucugacucaauguuuucuuacauacaaggucccaagguacaaggguuagucugugaugucacugagguucccaaaacaaaacagaguggcugcccauuguugcaucauaaaaccacgugucuucuugaccucuugacucaggagccguguaccagauucauuccaaaccaagauacagaaaaccugagagaaaggaaaugaauuuaaauggaugaaaauagggcgggagaguuagaguuucucugucugccagugggggaaagguacagugccuucuugcuuuuuauccuguuuccauuccaggcuguaagauugaugcuguccaugaucauaggaaaaugccaaaggcugggcaugcucugacucggcacucagauggagcaccaugccuggccaggcuguucucugacaagcucucuggcuccuggcauuguagucccccugcccuuuuaaaaaacaaaaaacaaacaaacaaaaaaugagcacggcuuguuucucuaagaaauaugaaauacuuucuaaaauuugagcaccacaccaagcuuuccugugagggagguucaaaucaccauaggaauaaaauaaagccucuuuucaaugcuuagcuguucuccuauuaaugcaaauaauaccuggccaggugauacagccagcuuuggugaucaguuugaugcaugacacuaggaaauuuaucuuccauuccuuacuaaugaaagaacuggcagaugguuccaagucuuccagcgucccucuuucuuaauggagggucaugaucuccccguguggcagcugugcauuugaucucuucacuugucacacccaugucuuccagggaaacauuucuacucuacagcagauggagugggccaccaccuggguuucuuggucugagagcagcaaaucuucaguuuuguuuuucuugcugucacuccagauaccacaugccagaacugcccuuuucuuuaccauuaagauaaugucccuucugaaauggcaaguagguacuugccauagaguaaaacuacaggguguaggcauggacaggaauuccagaccauggcaaagggcagugugccucagugacugcagcagccuguugcuuuguuuugcuggugcuagaucugaacuaggaauuagaggugaagcuguuuuugcuuacaucgcguguaaagcugaggaagcaaauauaacagcgguagcaugaagaaaaacagguuucgguuuuguuuuugcugcccuucuucugagcuucagcaggcacuguccuaggagcuuuuauacauaaucccuuauccuucccacagcgcugcaagagagagguccuauucccauuguagaggcuaggaaacugaucuccaagacguuagguaaguuaacagggcuuguaguggcagaaccagauugcagacugcaggcuaguuucucggccuguuugguuucccuuugccaugcugaauguaggcgaaauggucugcugagcacucccgggagccugagccucagggcuggcuccuguggagcuggucacagcugaccacaggccaccuguuuguucccugacuuuccuguucaucagggcaggcaucugcaucucaucuuuccuuaaucagcaucagcauccucuagccagaaacugcuggugacuggacuagcaguugcccauuucauuggggaagcuccuuuugaggggacagaauccaacuucuggugaguuagacaaauucucagccaacuuuccuugauuuucuggcaaguguuuccugaccauauccaccuucagagauaugaaacuuuuagagacagauaaguuuuccccggugguccuuucucaccucauucuuaccugugaauacacuuggggacccugaaugacacccaaacucauagcaggcuuuuucacaauacuuaccaacaccauuacuccagucagcagcccaaagaaacaucaggcuccacacuaaaaaugucuucuuuauaacaggcaacuugcuucaaacauggguuggaacacacacuuagcaccagauugcauccccaguguugaaaucaggauccacauugauccaucauuaacccacuagcucggguggcauugacaauuccugauaaguuugagucacagcuaauaaaccugcccuuuccuuguggcacccacucucugccucuguggcugaugugauccugcccuagugcguggcaggucugucuggacacagucacuauagagccgucuccugaauugugucauugcaaugcugaaagaguuaaguaggcccugcagugcgcugaaugcuccaguuggaggguuucagagaaagucuugacaaacgacggguuccugcccugcugggaauauuucuucuuugaguucuggcagcuauuacuuggcugcagaauaucuaagacccacuuugccuuuucuggucauaaacacuuguaguguugaaucuuaagucuugauuauuuuuuuuaaugguggcuuugguaaagcugaauguuuccauagugaugcauucuguuuauuuaaaacuuuacuuauacaugauuccacccacacgcucuccucagagggaccuggucuacaacugcccucuuucccaaccccauuuucuguuuggaaggaacacgcaugugagacccuugucagacuggugcugcuugaauccauucuuagaugugauuccugcaucugggugucaauagggaaaugacuucaguguuuauuuacuacagugacuaauggugccuuuuccagcuggucuaaagcugaugugccuccauuuauaaaagccuuccccagccugugaauagagccccauguugggcugagcugucuguuaguguuuaagcuggagcgggaagaggaggcagugucagagcacaguggaggaaaacaggauaaauuaggcuguagcuucguagccagcacuaccaagaaggcuguuuucucaaaugagccugcuuggagcuggcagaggccuguguguacgacgcuguuaggaugauuucugugccaucacucccccucauaggagcagugaugucacgcucucucagcacaaggacagucccuauucucauguggccuccaggaauguggacacgccuucacugcucuggcugagcccacugacuuuuagcucuggaugcaaauucugguaucugaaagggaaggaaaggggaaaguggggagggagcuuacagaguaacuacucccuugggaccacagcauccauaaucugauuuauuccuaaaagaaauccuauggcuguuuuuguuuuuucuaaacaccugaggaaacugaaguacccagaggauuuaucagaucugggaucugguguccgcaguggucugggagagacagcccuggagggcuagcccagccgugccugcugcuguggccugugggaccucccgucccccagcccuggcccuggggccggcagccugggugguaggagcgcugcagccagagccuccugugccuuuuucugggagccccagcgggagcucaccacuggccagguagugggaggaggcggugggcgccugagggccuugugaccguguugugaggugcugcuccccgcaggaaggacgggggcaggcgagugggacagggaccuggaggccggaggccggaggccgggaacccagugcuagccccgcagccuccaggcuauguguggccaaacccguuccugcggcacaagaggcggagccagaagggccaccucgcaggaaggcacccaggccccucgcacccugggaggccagcugggucaucgcugccugagucugagccaccugccuggggguucggucaggacaccagccucgccaccaguccgcacuuggaggauggccacggggcccccuaggggugaacccaccaaaggcggauucugcaaucagggcuccugcaggccuggagaauguggaauagcuggaggaaggauuccauggggccguucaaaugggcagaacuuaggaaagucagagagaggaggggagccccacagaagugucuccuucggguuguuuccuggaauguuuccucugaaaacaugucaagggacuagccaccaguuucuucccagcuuucucucucuuucucucagacuuucagccuccauucaccuggagugagagggaaaggaggacagcuggccugaagguaaaaaucaagaggggaggcaugaauguguggcuucuugcuccccuagccugcccagcugugcccuccuccaggcuucucugcugggaggaggggugcagagaggagagcuggugaacucccgugcacauacugcccuuugacucccuaaagcccuguggggugucgguaggggacuacuugagaguagucccuaucaaaugcuuaggccaguguucuuucugccacucugagaggccuggugacaagagggaacaugggaaacaagcagccccagaaggucacggugccuacugggacagcccuccaaggagugguauugaucgucuccacgcugcaccagccagguggcuggauauguggcaaggaucccugcugcagcuugagguagcgucguccuccugaaucuagugccagcugagcucugcaccaaccgaugaggggaauuagcuggacaauuucagacaagacuggccccguucgcuuuugcaaggggguacaugcucccucuuacggucacaguacugccugcaaggguagaacuggggagcagcucugacaccccaccccuacccuagccuccacaucugccggaaugacugucugagcccuguggggagagguggaaggagccuaggcuucagucagguggacccaggguugaaucccagcucugcccuuucuagcugagucaccucagaccagucagccuccaagccuguuuccuccaccgugaaauggacucagaagcagcccccucuuggcgguccugugaggcuugagaccaugcauauagugccugacaguaacccacuuaguaauaugauuuuuuaagugcaccauuucacaugcccugcuaaccccaaccuuaauccuuaugcugggugggcgguccuucuguggcugacggauggcccugugacccugccuuuccccuuggcaggcuccccuggugcccucgugucuguugcagucagcaaggguuggggagugggguugggcagaggcuuucuggagaauggccaaaaugaaaauugugugcgaguggagcugaucauauuaagauccagcugcacuuaagucccccucuggaaguucuuuaggccaaacugaagagagcucccagaugccaaaguggccuugcguugaugcucugcucacucucggcggccccaccacaugcuccccagguaauugguuuccuaaugcacuaucccuggacagauuccaggauuccagugccuuguccccuuggggucaguucuugacguuuccuagccuggcaagggucgccgaccaggcucagaugcacccccacaggacuguauuguuuucucguucuugcaggccacuuucaaacucuguacagaacgccuuggccugcaagaguaaacaagauuaccaggcuggaauucuguucaagaccagggcuuuuauauccagagauugugggucagaugcggugagggauacgugaaaggaagacacagugccuuccauuacagauagaaguaaacccauguggcuucuauuuuccuuggcaaaauuaguuuuuucuccuuacuacaaaagagguuuguguucuuugcaagaaauuaaaaagaaagauaaaaagagaaagcguuuguaacuucacaagcuagacauggcaacucuuuacauugguguguguguguuuguguaagacagggucucacucuuuugcccagguuggagggcaguggugcaaucauggcucacugcagccuugaccuccccgggcucaggugauccuccaaccucagccuccugaguagcugggacuacaggugcaccccaccacaccuggcuaauuucagaauuuguuguagacggucuugccauguagcccagccuggucuggaacuccugggcucaagcgauccgccccccaucggccucccagagugcugggacuacaggcgugagccacugagcccggccagcuuuucacaauuugcaguauauauauuuuuucuacacauuuaugugcuuuuuaaaagaaaaaauuaccaucuuacugaacuaauaguuuuggggccuuuuucuacuuagguacauuggugccugccauuaauucuuguucuaugacaucaucuugaguggcugcauaguguuauauacaguuguauuguuauuuaaccaguuccuuuguguuggauuuagauggugguugguguugaugcuguuuuugauauuaguaacccuuuuguugguuuuggaaaucacgagaauggagggagggagguagggagcccauucgggcuuugacuucauucagacuucaauucaaauaauaaaaagagcagguaacacuuuugaaaagcugcaauauguacuaggcacugcauucauugcuuuacauauaaucagugccugauuuaugaauccucacagcagcccauagacuaggcacuauuuuuaucuccauuuuacaguuaaacggaggcacagcucuuccacugguguggcugggugcaguccuguagcuaaaccuuugaguacaucucugauuguuucuuagaauaaauuccuaaaaguggggucgcuggcccagauccggaaggcuaugcauauuuuaaggcuuugaauacauaauggaaauggcuuuccagaaagaguacaccaauuuauccaccugccagugguguuugagcagaucugagaaacuccugcccugcuugagcacugacugugugcugggcccuaugcuuagucuuuuauaccauuucccuccucagagaagaagcuguccugugccuggcacagaguaagcaagaacucaggacaucucagccaguauggguggugguauuauacuguguguaauuuguugagaaaacaagacacacacuuggaaaacaucaauaauaaggugaaaguggaacaagggguccugaugaugagucuuagagcuggcagaauaugaggugguggccagggaagucugccuguuggaggaggcacuuggagaaugggcaggagcacccuguuaagugacagcugaaaggcugaugagcagggagggaccccuugguagcuuauguugagcuggaggggagacggugggggaggaagaugggcccacaucaggcguaggagcuggcuugggcagaggugagaagaccugggagagagacugcaggaguccaaguuugaggcugcacauguggccugggggacaccucuaggaauggugaaaagaaaagaugucggauuuucuagugcugguaacaccccuucuucccaugagugcugaaacaacagaaaaacagacacaggacucagcuacgaggucagcauaucaagguuauuacugauaaggccgggagaccuuggcuuaccuccaugaccacagucagacuucuugauaugccuucacccuaucaaggccucaggguaccccauccgaggaaacagucugugcugcaggcccggucucugccagccgccaggaggaucgcugccucccuuggugagccugcgaguggggagcggaggaggugggccuccaggugugcuucucaaagguggaugcuggcccuuccccauggaggacgcaggagcugggcagcgggcacucucuguagacaagcagcucagaguggccaggaaagggccagauucccuaugcccccagcucagcuccuucucccaagcugcuuauaagucauuccuccgcucucgggaaagagaguuagggaggcugggaaaaggauggaagcugccuuuccgauauucuucccucuugggaauggagcguuccucuccucauugcaacacaagguaggagaggcagccacugcccccaugcuggcuguugcucaucccagcccaauccaagaugcuucagaggaaagacugccagcaaccagccaggcaggauggugcugugguggcaauuuuaguccaguagaccugguucuaguuccagcuccuccacugacugcuacauggccuuuggcaaauucuuagccugaguuuccccaucuucuauaaaacagaguuguucaauugagagagacaaaauguauccgucucaguaccggcagcuauucuuaugaaauagugugugaaugcgaaggaaagagcuuguguggccuugauuuuuguuguuguuuuuugcuuuuguuuugagacagggucuuccuuuguuacccaggcuggagucauuggcacagucauggcucacugcagccuuaaucuccuaagcucaaaugauccuccuaccucagccuccuaaguagcugggacuauaggcacaugccaucaugcgcagcuaauuuuuaacauuuauuuauuuauuuauuuuacuuuauuuugagauggaguuucacucuuuugcccagacuggagugaaguggcacgaucuuggcccacuguaaacucugccccuggguucaagcaauucuccucccucagcgucuugaguagcugggauuacaggcaccugccaccacgcccggcucauuuuuguauuuuuaguagagaugggguuucgccauguuggccaggcuggucuagaacuccugaccucaggugauccacccaccuuggcuucccaaaaugcuaggauuacaggcaugagccaccaugcccgaccgcuaauuuuuaaauuuuuuguagagaugaggucuugcuacauggcucaggcugguuucaaacuccuggccucaagugauccucccuccucaggccucccagagugcugggauuacaggugugaaccaccguaccuggccucuugugugggcuuugggcaggucuuacagccauggagcaacgucuguguagacguguugagagcaaggacuuggggaaagggaggacccagccugaccaagagagacugaggaggaggguggaagggagggcagagagggaccucaaucugagccauucugacuguuggugggaagaggaaacgcagagaaagcaacagagaaggagcagcccugagaggaaggcacucccgagagugucugucccagcagucagaggcagggccggauucccaccuggcccccagccccugugaagcccuggauucuuccccucuagccugggguaaggccuggcaaggugguuaguguccagaaagacaguaagaaaccuggccuguguccuggcauagaacacucuggaucuuuguccugccucuggcuccugggaaaagccucuuccugcccuuggucucaguuuucccaucuguaaaauguagggguugagccaugauaugguuugaauauuuguccccuccagaucucauguugaaaugugacucccaguguuggaccgggccuggugggagguguuuggaucauggggguggaucccucaugaauggcuuggugcccuccccaugguaaugagugaguucuugcucuguuauuucacgcuagaacugguuaauuaaaacagccagguaucgcucuugcucccucugucacugugugauauaugccugauccugcuucacuuucuaccaugaauaaaagcuuccugaggcuucaccagagccaagcagaugcuagugcugugcuuguacagccugcggaauuguauacagaaccucuuuucuguacacauuacucagucucagguaguccuuuauagcuaugcaaaauggacuaauacaaaccaacuuaaaaauuguuuuuagcuccuuugaccacaacccaugguaaaaaagaaaaaaaguuuucacacacacacacacaugcacacacgcacacacacuaaaacuaaagcuucaugaaacaauacuguauguacuguauggcauauguuuacucugauguuuuguguuccauuguauauuguuuaaaaaugcugaccauggcccccaaacugauuguacagcccguugaugagccacacuccguggucugaaaacacugacccagcucaucuagaagguuccuuccugcucuggcaggcuguaguucuguuccauuuccuguggccuuacgaccccaucagccaagucuuugugguuuucuucuuuguacucuucuaacagugauuuccaaucucagacucugcacugaaggcauggucaugagcccagcugcuggagguguaccccccacgccccugucugagcagcgugaggccuucgaagccgccugcuggggcgucaugaguggggaggggccuucaugccuucugccaucaucacagaguagguuugggugucauccacacuccccuccaugccccaccgcaagacucuacugcaucagucuauucccuggaaaaaugguugggauuuagagucuggcugccaguuagaauucuagacccuucccaggcccagcuagcucccucuucacccucucccucugcccacugaaccccucccugggcagguccaggggucaccacugugggaggugcugaugggugaaaagagcuuuggcagcagauugaccuggguuugcaucccagugccacuucugccuggcuguguggccuugggaaaguucccugacaucucugagccucuuuccuugaacaaagcuuggagauagucguacugcucugggaagauacauuuaagggugagaugauaggcacaaagugcuuuuuguuggugccuggcaagaguuaggugcucaggaaaaauucaugccuuuaaaucucguccccugcgcgucccuuuaagggaauggcuggagaaaugacagcuguugccaucuugaauaaaguaggggaagaugccuuccacaggggggcaacaucaggaagaggcugucucaaacagggugcaccaggaguaaucccauccagccccaaaccuguccuaaaagugcagagcccagugcagcagcacccugguguucacagggcagccugaggcugugucugaggagaagcacaggcaggccuuagggagaacgggcucugggaccccaaaagugggcccauaaggaugacgguguguccuauccuggggccaggcuuagaaccuuaaaugacagggcaucauugcgacccuaauucuuggaauccauuaaaaaauucacccuccuguguggccucauuuuaucucaguauguuuucaaaaaugucuggugagauccucaugacugccacccagggagaaggauggggcacaaaugagacuuccacaaucccagggucaugagaagacuuuuuuuucuuucuuuuucuuuuuuugagacagggucucauucugucacccaggcuggagugcaguggcacagucucagcucacugcacccuccgccucccggguucaagcaauccuccuacccuagccccccgagcagcugggaccacagaugcgcaccaacaugccgggcuaacuuuuuguauuuuuaguagagacaggguuuugccauguugcccaggcaggucucgaacuccugaucugaaacgaucugccugccuuggccuuucaaagugcuggggauuacaggugugagucacggcacccagcugagaagaacuuucuagcaaacaccagaaccaaaguaucggagcaggcaguccugagaugcuguuugcgugcccucaugcuguuaccccuuaccaaggcuucgugaaagucgucuuugcagguguccucagcacccacagcacuuuuguuuuggugcccaaccacaguaguaaauuguugaaagguggauuugaaccaagcuggagauagacaagggauguaaacaccuccaucaccaggccaugccagggaagcugcuucccagaacucggaagcgguuccuuccagggcuccugacucaauagccacccccuuugucaccucagcuccugauagcugcagagccuagggcucugagagccaaagugacuugcccugggccacacagcucuaauagcagaggcuggaggcgcuuuggagggcugcgcuguguagcuggggcuugguacuaccugggaaaaccucugacccucuugcuucugcguuucuggcuccagcugcccucuucucuguuuuuccaguaggcagaagacucugcuuccaagggagagacuuauacuuuaaccuuggagcauaagguaagucccucaggcuugcuuuauggaaucaugguacuggcucaugguuugguaggagcagcgaaacuucucagaaugcgaggcuacaagcccagucucuaugcuuacuagcugguggaugucccuggaccucagugucccuguccacauaugagggaguaaugucagauggaccuaguccagagaaccagcccucccagggggcagccaggcucaagguaaaguccaggauggggucccauccugacuccacccugccuugccgcuggcugugugaccuuggucuuguucccuccccucucuggucuucucugucuucaucucaaaagacagcaaagauauuccuguuuugcugaagucagaggggugaaacuacuuugcaaagcuuaagggccaaaaauugugagggauuuucuucucagccauguaaagauucucagaccaguggucccagaagaggaacacucaggccugcaagaaagcaugugggaagggcugagccacagacccugggugggugaagcugugccggaaagcagaaccuuggcagggaaaugagcucucguuacucacaucagcaccccagguccacaggcugggcuugauucuugggaggucuucuugggaggucucccugggcuguggcucccucagaguccccaagagucucccugccccugacuccacccugguguucccugggacucauccugggagucaggggugccagggugccuccuccggugggaccagcccugccauggcagccgcugcagcugguaucccauugcaguguuacagugaggcucagauuacacagugagcucaucccagcaugaauggggccaccggggcggggcacuggaaacugauggaccgaugagggggcugucacugggggucucccuggacccucucccucccucccucucucccucucugugugucuuggacucucuucuucccugucucucucucccucuccucucucucccucucgugcacacugacaacccuucuuggagauugccugggauugucauggcaacccuccagcaaaauuaucgaaacacuuuuaugcucccagucguaccagacgaagugcuaauucugaguaaggcugaagcaguugguuaaaugcugaagucacaggcuuuguguggagggcccccuggggguggagugcgcaccagugggaggugagggccgggacagggggcaggaccacccgaaaaagacucagucucucgccugcuagagauguuguguguguugcuuuccuguccccaccccuuaugccacauucacauuugcauuccacacacacacgcgcacacacaugcgcacacacacacguacaagcgguggcugggccaaacacacccaaaguguagauggacccaaacaguaccaccuggaauaaucaucaccucauucagugcuuggaacucugagacccacucuagggagaguucugggugaggcgggggauggccaguugcccagugcaucuagcuggcaccgggucugagcuagggcaacagcagcugugggaaggggccugaccuuccugccuaccccccagggaaaagcagaggaggaccugugaacguucugccccaaccugguucuucccaccuugaugugcauccugggacacacugcaucccugcuccccugugacucacgcccagguuaccauaggcugccuuggaaacaaagcccugcuaauggcugaagaacuggugguugcuuuuuuaaaaucccagcucugcccagaagccaaaguguggguagggacgaugggggagguggugcacaaggcccuccccucucugcuuccaucuccccaccccaucugcuuccccaggacaccccuccauggaagccagccuuccccugcagccccggcacaggcugcucuggcugaaggggaggcaucuacuccugugaauggguccccucauccuccagaggauucuaggauguuagagcaagagggacccccggcgaaucagagucuggccuccuugcuucccggaugggggaaccguggcucagagauuggaagcaaugguucaaggccacagaguguguacacgcacacacacgcauacacacauguacaagcgguggcugggccaaacacacccaaaguguagaucgacccaaacaaccaaccugcaaccaggcuucuggauuccaggccagugcuguucucauugcaccagagagaccauaggaugggguggugcaagcagugagcaccaauuucagaggcaggcaggccuggccuugaaugcuggcuucagugcucagcacuuaguguagcccugaucagccccccagcccccugaguccucagcuguaaaguggggugaugcuugggucccucuggaaggacacagugaggacaacuuuaaugaggugggaugugcacgugcaaagcacaguuggcaaaaggccagacacagagugaguguucgacagaugacuuuuauuuuuauuuuuuauuuuuuuuagagauguggucucacuauguuacuauguugcucaggcuggccggaaacucccgggcucaagugauccucuagccucagacuccugaguaacugggacugcagacaugcgccaccaugcccagcaacaaaugacauuucuguguccuuccucuguagccccagagcuacagaccugcugagaagagggacuguccuacaucccuuuuaagggccgaccccugucccgggguggcugggugaggccauguagccuguccuggaaaagcccacacugaccccucccacagcucugagccccugcaaacccagcaagucccagagggcaagaggaagcaggacccccgaugcugggcagguccccaguaccuaauccccccaggccugcccacccuuugcaucuuggcugucaggccuuuggaggaaagaaaaauguugaaagagguguugauauccgccaagguccccgagggccacguuugggcaucagcaguaacaacaccccaaccugguucacuucugcuguguggaacuccacccuuggagauaugauuagagugcagcguugcucgggcuggcuuccucuuuuaaauugugagucaggcaggaggguauaagccaccaaaacccccaaaugcccucugaagcaggaauuucuuggaaccuuucccugauaucuucucaaccaaguugggggcuggguagguuugaggaggagaucauaaaagcaaaaggaacuuuuauuuuaugcuuacaacaugccggguacugugcuaggcgcuuuccuacacacuggcacccaggggcauugcuucuacacacuggcacccaggggcauugcuucuacacacuggcacccaggggcauugcuucuacacacuggcacccaggggcauugcuucuacacacuggcacccaggggcauugcuucugcuuuccaggugcggaaggcccaccaaggucacagaaugaguccauggcggcacuuagguuagaaucuaggucuguguucuccuuaccugaugguggccuuuggcuggcuccuugggcagggaagggcagagaaggcauaaaaaggcaacggcggggaggagugguccuggcccuagggacauccugaggugggggagucauggcuggggagggugggugguaagccccggggaucuaggcaguaugggagcucgguccuccaugggagguucaauuuccccaccccccccuccugcccucuucuaagaggcccucagugagcagggcccaagacccaggaggggaugaucuuauugcuacuuugggaccucugcuaugaagcacgcacccucuuucuuauuuucacugcccugggccaggauggggaaccucccauccaggggaguggagggaguugacuuaggguacccuaguccccagccucagaauuugggguccagaggagcuguguguguuggagacaguguagccccuuggcuggccugucaggagccguggaagcagggcacaugugguagcaguccaugccacagggaccucugcaugccagcucugugcugggugcuggaaaggcaguggccaacaaugaccaccuaguggggaaggcggacaguacagugucaacagacaagaagacccuuuagauaaugacaaacaugccaugaaagaaagggggacagagagacugaggggcagccgucaguaggguggcuaggcgaggcuucuucaaggagguaacaucugagcugagaacucugcagggcagacagucaaguggcuuguccaagcucacacaguaaguucuggggaagccagacuagcacacgucucuagacucccuucgaguggucucccugcuccuagaaacauccuucucuuggauucugacaugucuuccuguuuuccuccuacccuguugaacacugcuucucugaguccuuggcugacucauccucuuuccagugcuggacuguuccagcccuccucuggaaugugggccuccaccccgcccccuccaaaacugccaccuccaccccucaccucuccccuagcuucaguggccugcuugacaucuccaccuggaugucgaagggucucuuagaacaaugcuaaguccauauaauagagaccccaaguuagaguaguuuaaaaagauucaguugauuguucacuccuguaaucguuacaggggaagugcuucagguugguggauagcucagcuccacguggucauuuagggacucggacuaaugauggugcugcuaucuuuaacgugagaguuccagaaucucucugguuauugcucuucuggccagcgugaggggaaaaacacagaagucuagggcaggaauuucuucuuaaucgagugaggcagaaguugagcauacuucucacauuccacagaugagaguuuagacacauggccuccuagcugcaaggagaguugggucaugccacagcuggguggauagcuagccaucucugucacagucuguccucgagaacagugaggacuugccugcccuggcagcggaggagguucucugggggggugaccccuuauucugugucucccugaccuuggcuuugcccuucaacauugcuugccugucauucuccacaaccaccgacaggguguugagagucuacccuccuuagaugcugacucgggcuugagcaaucaugggcuuuugcaguccagccuugcaauuuuguuggugauaacaauuccuucagaaacauaguaggcuucaucuuuagucaguuccuugagccgugaccacauccaaaguuccuuucuugacagaguuaugaagucuaucuuccauacccuucuguuucccauucauuuaaaaugaaaguggcugcgugcagugacucacgccuguaaucccagcacuuugggaggcugaggcagguggaucaccugaggucaggaguuugagaccagccuggccaacagggugaaacccugucucuacaaaaauacaaaaauuagcagggugugguggugcacgccuguaaucccagcuacucgggaggcugagguggaagaauugcuuaaacccgggaggcagaggugcagugaaccgagauugcaccacuacacaccagccuggaaaacagagcaagacuccaucucaaaguaaauaaauaaauaauaaauaaaaugaaggcuauccuaaggacauccuaaauaacagacuuagauguaauacccuuaauauaauacuuugccacaggggcgauuucuuuguuugguuuaaaguuuggccuaagagacaggcuuugagagaggcucugagccacgauagucugacuuccugcuccuuggacaaaaccaguuggcuuuuucaaugcugaggacaccaguuuucugaauucucuguauuucuguguaucucuucuugcaaacuggccaaucucuuucuuguaauauuuugcuaaaagcaacaucaagcagccaacacaugcaaauggcuucagcucuuuccaaccauuuuucuagaauuauaggcucaauaggcaugugggcugucuuccaaaugaucacaggugacauuugcaauaaauauuuugucccagcauaacaagguucaccagcuucucauccucuaauauguuuccaucuugcucaccaccuauuggcuaagccaaugccacauauuugagggguuuuauacauggcaguuucccacuccugguauaaauuucuauaaggagcuacaaaguacagugguuuuaagguuauagaaauugcuuuuucucucacauaauacaguucugaugugagcauuucaggccucauucagguggaugguggguuuuaauaagcagccagcagacuccacaacggcccccccuccccacccuucucuucuccaacacauuugccugugugucaauggcaccaccaucacacacuugcucaagaaaauacacagaagucaacuuauuuuuuauuuuuugagacaggguuucacucugucacccaggcuggaaggcagugucgaaaucuugguucacugccaccucugccucccagguucaaacgauucucaugcuucagccuggguagcugggauuacaggcaccugccaccacaccuggcuaauuuuuguauuuuuagcagagacuggguuucaccauguugcccaggcuagucuugaacuccugaccucaagugauccauccgccuuggccucccaaaguucugggauuacaggcaugagccaccgugccuggacagaggucaaccuugaucccucccugacccacagcucccaucuaaucuaucagcaaguucucucaguucugucuucagggaaaucccaaaugugaccauuuccuacaucuccauugccucuacccuaauccaagccuucaguguugugaggucacauaauauucuuccaagagagcuucuugcuucuuucccagcuccucuccacacaacagccagagugaguauuauuauuauuguuauuauuauuauuacuguauagagacugggucucacuauguuacccaggcuggucuccaacuccugagcuuaagugauccucucaccuuggcuucccaaaguguugggauuacgggugugagccaccgugccuggccuccagaaugaguuuugaaaaacauaaauuggagcaugcauuaagaugccuuacuguugcccuuagaaugaaauuauaucuuuuuuuuuuuuuuugagacggagucuugcuccauugcccaggcuggugugcaguggcgcaaucucggcucacugcaagcuccaccucccggguucacaccauucuccugccucagccucucgaguagcugggacuacaggcacccgcugccacgccuagcuaacuuuuuuuuuuuaauuuuuaguagagacgggguuucaccguguuagccaggauggucucgaucuccugaccuugugauccguccgccuaagccucccaaagugcugggauuacaggcgugagccaccgcacccggcugaaauucuaacuuuguaaccugccacuaaggccucaagugauuguccccccuucccaucccccucucucacucugcuuuagccaacaagccuccuugcuguuuguucuucgaauacaccaaguguauucuugccuuagcgucuuugcacuaagacucccucugcccagacacucucuucccaccuugucacaugacugguuccaucuuuguccauugcagggcaaaccgcugcaguguaguggcucaggagccacgcugcugggguuugaaucucagcucuugcuacuuccugcugugggaccuuggggcaaguuuucuuagcuucucugugccuugacuuuucuaccuguaaauggcgauaagaaauguaugguauuuguuacccagggugguugggaggauuaaauaauauagugaacacauugaguucacgcaucaaaagugugcagagcauggccauacuaagcacuuagcauguuauuauugcccuucugguggcagcuuaaauauccaggcucugagcagccuuuccuggucccgugcucuaagcaucucaccaccugcauccccagcucaucgcccuacuuuauuucaccacaaaacauguucuucuucguguguguaucaucugucucuccccacaacaccccacucccauuagaauguaacuuucaugagggccaggacuguaccuuucuuguuggcuuccaugccuuuccugagcaggaaaguaacuucucaguaaaucuguguugaguggauacggaaaggacggaggccaaaucccacugacccccuccuuuuuggguggcccugugagcccugcugggugccugucagugccccacaucucaagcccacuuggccauggccaggcucacaguuuccucuugggagucccaggacauagggcagggacugcccuguggaccugcucuuagagaccuugggaacacuggugagauuuagcucaggguacucacccucagcagggggcugucagagcauggacucuggagucagcccaucuguuuccaucagauacuaguggaccaguuacuuauccccucugugccugguuuucccauauguaaaaaugagagaauaccaauuaccucauagggcugcugcugugaagauuaaacaggauaauauacguaaaacagagcucaugguuggcuuggaguaaagcucuccagaugguagcuauuauuguuguuguuguuguuagugccauauccaagugucacucuucagagcaugaaugggggugcccgagggacuugggugggggagugaggagacaaacauaaagaagacaucuagggaagggaagaaccggaauggaauaaucgagauguguuugcauucgugcgugugugugugugugugugugugugugugugugugugugugcgcgcgcgcgccugcggagggggguggcaaggauccagaaggggagcccaccccuucuuccgagcucagcucuggggagccgggcgcucaggcucgccaggcugcaaagagagcugagagcugccucgcgccccgcgcagaaccggcgguggaauaaccagcgccucaagugugugcaucugggaccagggggcgggggagggggaccugcggccccgcggccaacccgguuggugcagacuuggggaucccagaagggacagugcccgcccagucgcggcgauugagggucccuguccgggcgcagcucgggccagccgcgugcuccggggccgcggcuucucccggaacccccgcgggcggggccugccuuccggagccgguuggcggggggcgggcggcgccggggaaggggccguuacuuucccagagcggcggggcgacgucaggcggaagggcgcggggcgcgcacgcuuuaaauggcauucgcugucauccgagcucagagccgugugggcagccgcgggcuauauaagccgcgagccuggccgccgcggggcagacggcgacagcagcggcggcgagcgccucggagcgcggcggaacagcgccccccgagccccgugccccccgacggguccgcccgcccgcccgcccucccgaggagcgccggcccgggcccgcgagggccgccgccaccccgcagcagauuuggaucccccgcccggcgagcccccggcugcugccucccggggggccccggcgcagcggccgcccucggagagccccggcgccccgccgcccggccccgcagacgccggaggcgccauggccgccaagcccggcgagcugaugggcaucugcuccaguuaccaggcggugaugccgcacuucgugugccuggccgacgaguucccgcagcccgugcggcccgccaagcugcccaagggccggggccggcugcggcggccgcgccagucucgcuucaagacgcagccggugaccuucgacgagauccaggagguggaggaggagggggugucccccauggaggaggagaaggccaagaagucguuccugcagagccuggagugccugcgccgcagcacgcagagccugucgcugcagcgggagcagcucagcagcugcaaacugaggaacagccuggacuccagcgacuccgacucggcccuguaaggggcgccgcccgcgggggggacgcgcgcguccgcgguccgcgcggggaccggcgugugaaccccgagagugcccgcgcccugcucccgggggacccgcaaggacccgggaccgccgcuccucgcgcgcucggacucccgccccgcugcgaaccggucggugcgccccucgccgcgcucgcccuggcccgggagcgccgggagcggggccgcuuuccucguccuuguaaauguuuauuuuuuaacucuucccagugcgaacucugcugugagugugugcggggaggcgcgcccgcgcugagucggcggcggguagccacuccaugcccuuguccgaugguuugcaacuccgauuuugcacaccgcuccaccgugccccccagcgcacacccauucacacucacgccaacacucucgcugaacacuuuuauaauuguuaggcguggccguugggacuuugggcgcagcgcggcugcuacugcgucuggaggauugauauuuauuuuugcauugcgauggcugaaggcauuuauuuaacgaucuuuuuaccuggauaugucugugaggcuccugaaaggagacaaauaaagucaauauauuugcacagugcag

SEQ ID NO: 13291 - RNA, 175464 nt, Homo sapiens
ccucaccgucacggccggcgccuccuccuggauucauucacucgcucuuuucauucacgaagguagugaggccuaguggaaagccauggagagcgcucuccccgccgccggcuuccuguacugggucggcgcgggcaccguggccuaccuagcccugcguauuucguacucgcucuucacggcccuccgggucuggggaguggggaaugaggcgggggucggcccggggcucggagaaugggcaggugagucggaugcagcgccgcguccucgcucccgcggcggcccggaccaggccugggccgugaugacuaguucuggggucugcuccuggccuuccccuccccagcucuccucuuucucaggcuccugugccccgcgggccccuccuggcucccuuggcugucuucugcuugcuuagacuacuugcagaguuuuaagguacgaaauacacugcucgcucaauccugggaaucuaagcucagcuuaggguguaggagaaaacugccuuaagucucuggggcuugugcccuuuaagccauuccguguucauggagccagucagucgcccugcugccuccucagucacacgcuguccuccuugguucgccccuuguaaguguuuuuaaaauaaaguuuuucgcucgguuugaauauuggcccugugcuaaggaugcagagcauucuguuaacauguuugggcagaggauggaaagggguguagggacacaauuucagaaggcuuuuugcacugcggaaucguaccuccccaguuacgauuaagauaguaaucguaucuggauuuggccuauuucauacaauuacaaagccccuuuaaaaggaauucucgcuaaacuguucuggaguccuaacgaguagcaagaacuauugcuucuguaaaaugauaacucaucauguuaaaaucagauuuuuuuuuuuuuuucacaaggacguuuguaggaaaaaguauacccguaaagagugaaccaaacacauggaacuuguagucggaggauuuuuaaaauggaggacgaaggucagguugaggaaauagggaaaauuaucugcagggaaguuuugcuccccccccccuuuuuuuuuucuuuuucaaccuauuuuguuuccuucuuugcuuuauuuuucgucucuuggccuuuuuucccuuuaaaccgagugauuacuuaugauaugcuugugguccuacccugagaugauuauuuauuuugauguuuuauaaucgaaugugcacuuccuaagcauuuuauugaauuuuggggugguuaggcauugccugcagacugggcucagguaagauacacuaauaauguuacuccauguucuuuguuuauuuagaaacauuuaaacaaccuaguaggaaagacauauguuaaccuuuuggguuuauguuaacauuaagagaaaacaucuuagcaguggauauguaugugaaaucuuuggacgauguggagcaacauuauaauucuguuucacagucaccuguuucucugaaaaaggaagugaaauguucagcugggugugauggcucacgccuguaaucccagcauuuugggaggccgaggcgaguggaucacaaggucaggaguuugagaccagccugaccaacacggugaaaccccgucuguacuaaaaauacaaaaauuagcugggcgugguggcgcgccccuguagucccagaggcugaggcaagagaaucgcuugaacccaggaggcggaguuugcagugagccgagaucaugccacugcacuccauccagccugggugacagagcgagacucaucucaaaaaaaaaaaaaaaaaaaaaacagaaagugaaguauucaacuugguuauaauuaagauuaugauuucccaauugacuugcccacauucuucauuguuaguuuuggaaaaccuguuugaagacuuuugacuacaaaagacuacaagauuuuuauacaagauaaaaauuagggaauuguaucaagauaaaauuuguaauugguaagcaaagacuaauguuaauaacuuguuguuuucuuuucuuuucuuuuuuuuuuugagacagggucucacuuugucacccaggcuggagggcaguggugugguggugugaucauagccaacugcagccucgaacucuuggguucaagugauccucccaugugagccuccugaguagcugggacuacaggugugcaucaccacaccagcucauuuuuuuuguuuuuuguagagacaaggccucacucuguuucagaggcuggucuggaagaccugagaucaagcaauccuccugcuucagccucccaaagugcugggauuacaugugugagccaccaugccuggauguguuuuuuuuuguuuuuuuuuuuuuuucucuuuaaaauugaccauauugguugauuauucaaaugauaaguccaagucaucuacauaugaguguacaguaaaaggcaagugauguaacaccauaaguaacauuuguguugaaaagauuuggccccagaggaaggauaauugauaaauuaagggaaguauuuguguaagauuuagauaugaaauuugaacuggaacacuggaacagcagaggaucauaguaucauaauugaagugaaaugcugacagguucaauuuacccuggguuuuggauuuuuuuuuuuuaaaugcuuaagcagaagaagugaucuuaaaagaaaauacucccuuuaucuucaaauucugggacucuucaaaaacaaaauuaagagcagcucaucuuaaacagguucuucacaugaguuggaggggugaacugaaauaauuugaaaaacaaacuagcagagaugacacuugaauaauuagaguugugauuaaaaauauuguuccaccaaaguuaugauuuuagaauuguuguauguaaauaguacuaguaaguuuuuucccuacgaaauuacuaucuuaaucucaagagucucuguucuuaugcagccuuugaaucuacuuucuaguacuaauauuuaauauuuuccucuuuaaaaccaauuauauauuuuaaguauuuuauuaguauauguugaauugauacuauauuuuuauucuuguuauucuuagucucuucaugugaguaucuucaugugaguauguuuaaucugucugccucagauuuuaggaucugaggggcagaaagcguggauucucacuuuuugucuuuucucacaaauuggcucuucuaaauuuaagaacaaaaacuuugaaaaacuugaaauacagguaugcuucacaaucaguaaaauauucuagauaacaguuuccuuaguguuguuaggcuuucaagacuguccauuacuuggcuggcccacacucuaauuuaucuccaucuccuggucaagagcugggccaucucuuucuccuaguucucaccaguaacauucccacucaggugaauccccuguguucccuauaccccuagaagguggguuuagccaauuuaguaaguaagacuucuuugucauuguuacccgaauacuuccuguauuucuuaggagaacaaaaggagauccugugaauguggaguuucagguguuugaaggucaguguagcaaguaaucaaaaaaagauugauaacaaagguggucaguuuguauuaaauaaaggaaagaacagucacugcuauagagcaauaaaaaaugugaucuguagaaugugguuugaccauaaauacauuuugcaaguauuugaguaguuuccauugcuggaguucaucuaaaaugauugcuauugaaauaaaguggagaugauagaugcaaaggcaagguaaguagacuuccaaugucaagauauuuuauaacuuuaaacauaagacagcacucugagcacuuauuuuuaguuuuuaaugaagaggauauuguuacacgcagugaagaauaaaugauccacuaaucaguuagugaguuagauuuuuuaaaacaacuuuagugggauauaauuaauauaccauacaauuugcccauuuaaaguguacaauucaagguuuuuacuuauguucacaggguugugcaaccaucaucaaaucuaauuucagaacauuuucaucuuccuuaaaagaaaugcuguacccauuaggcccuucacucccugacccccacccgcuccagcccuagucaacuaccaaucuacuuucugucuacguagguuugccuguucuggauauuucauauaaauggaaucauacaauagguguucuuuuuuguuaguggcucuuugauuuuugcauaauguuuucaaguuucaucuaugaaaucuguacuucauuuuguuuguauugcugaauaauauucuguuuuguggagugaggucagauuucacaaaaaaagucuucaacccuuuguucuacccucuggauguuuacauuagcaaaucucuaagauguagcuucugguugcugauggaacucguuuggcuuugcaguauuccaagguucuccuaauucaguagauagugaggacuuaaaaauggcauggaauggugugguucuccucuggaaaaaccauucaugaaaacaugcaucaaaggauucucaaaaucacagguauaaucacaauuucuguuuucacauugguuaacugcacaggguuaaccucaaaugacugaagaauacuuguguaacuagagcuuauuaauaguaggugucuuucuuuaacaagaguuugugauaucacaugauuugaagaauuauauaugaaauguuaguuauuuaaauugacaacccagaagaaauauuaauaacuaucauuuauugaaugggugcuugaaaugugccaggaacuugagauuauuuuuaaccucuuugagcugugcuccguuguccccaguggacagaggaagaaucagaggguuuaguaaauugcuuucauuaucuaugguuucauagcuauuaaauugcagagucaggauuugaaaccaagucauccguucugcaacauucguacacuguauguuggugaugggccuacagacuggaugaguacucgggaguagauuucuuuauaccuacaaacuuuauuaaaagcuuuuugauugaagacacacuuucacuuuuuaaaauuuaaauuuuuguuuuauuuuuaagaacaaucucagaccaaaaaaaggcacaguuucaaauuugcacauucaugauuuuucuggaaggauugcagaauaguuggcacauuuugggaucaaguagcuugggauuuucuucagauuugcaaccauaaaucuugucguaugagaaaauacuggaaaguuacuaaggugcuuaacaaagcaaaggguuugacagucaucagaauggugggauuugacuucgaaugcuauuuucuguuuaucgcucuggcauucuugaauggauuuagugacucccuggagguccagcuugguaaaugucauaugcuugcuguugacauucuaguauugggguauagauaccuguucuuacuggcgagccaauguugaucgcaguagucauuacauggguuauguuuuucgcagaggcagggaaggugagggaaggcagagaaacaaacuuagucauaaauguuuuugaauauuuguuuauucugcccuuuggcucccgaaagggaguacgugugccuaaauggaaaaaguucugcagauuaaaguuggcagggcaacuuucaaguacuagugcuggagucuacauaagaggaaacagaugcaacugaagauuggaccuaaaagcauaccuuuauuugauuuggaggaaaaaccaaagagggagguuuccugggauuacagauccugaguuuacauucccugaauaucuuuuucccucacuccccucccgacuagcccccauugcucccacccuguuuuuuuuuuuuuuuuuccuguucuuucuuucugugcaacacuaacuuuccuauuuagaggucaaacuugaacuuggagacccaaaccuagacuugaauucuagcuucccuacagauuucauaggcuuauugugaaggguaaaugagaauacuuauucucuguaaaacagauaguacauaagugcuugauaacuuguuauuauuauaguauuauuagccuuaguagcacugugcucugauuaccugagcuaauugccaggguaggguuuagaagaaagaguugauaucugggugacuacauugucagauaacugagauuaccauugcuacuugcaacugagaguguugagcuuuaaaacuaauuuuuuguuguuguugguuuugguugguugaauugaggauaauuuauuucuuucaguuucagaaaaauuugucagauuuacauaacaaaauuuauaaguuuagaaugcauggguaaacggauuugaauagaucaguuucagugccauuaaaagcuauuuguagauaaggauaaguuaaauguauauuuuaaaaacagugcauccuuuauuucauuucccuucuugucacucuuagcaaaacaacauguagcaauucauaugcaugucaucugggauggauugagauuaagguuagggaggcagggugagcaaagcccucacugggcuugguggagaguaugacauaacacuauucauuugcccauuuauccaccacaaauacuguugagugcuaacuauagaccuuauaauaguccaaugggaugacaaacaguaacaaaaugaauaaacugugcuaugguaaguggugagaacaggaaguauuugguccuaugagaauuugugagggaaaguucuagagcugugcuggggaagcagugccucagcugagaucuggcgguugaguguaagugagcaagcuggagugacaggaagggcagagggaagaauguucuuggcagaaggaaaagcaguugcuaaauuccuagggcaggaaagggcagggcccucaugaaacgagggcugagugacgagccaggaaagcucagauaugagugccauggaacuggagaggcaagaagggcaaugagcagggccuucagccuuuauccuggagcaguggaaagcaguugaggugauuuuaagcagaaggguaacacuguuguguuugcaacuguaagccgaauuucuuguuucuaugacuucccuagaguuauugccggcccucuuugggaaaacauuguuacacagagauagaucagucuagguauucagauaaacucaguuaaaauugccuuuuuuaaaaugucaauuggcugggcgcaguggcucaugccuguaauuccaacacuuugggaggcugaagugggcggaucacuugaggccaggaguuucagaccagccuggccaacauggcaaaaccacaucucuacuaaaaauacaaaaauuagccaaguguggugguaugcaccuguaguccccgcuacucgggaggcugaggcaccagaauagcuugaacccaggaggcggagguugcagugagccgagauugcaccacugcgcuccagagugggcaacugagcaacacucugucucaaaaaaaaaaaaaauuuaaugaauacaauaaaaugggaauuuaugcuuuuuguaagggaugcuacuuuugugcacuucuuaguuaucaucucucagagaccauuucugucugggggaaaagucugaucacugugguaugggaaguucuucucuuacagggacugagugaugggguuauugaaacacugaaacuagguuauugcguugucaugguaacuccauaauaccauggugugguaguugagaagcuugccacaaaucuguaucagaaagaacgcuuuguuuuauuugucgauuuuugucuacaaaacaaugcguuugcccuaucucuaacuggcaauuccaggaaaacuauccaguuucuggaaaguuaucuuugccaccauuuagugaaguuauuuccauuuaaauaaccuagucauuguggaagagaggaagggcuagacaguuuaagaacuugaacaauuggugccucucaagaguauuacauugggaaacaguauagcuaacaaacagauuggcuuuggagucagugggcaagcugugcuguuacuaagcugguugaccuuaggcaaaaauaguuaaccucugagcauaacuucuuucauuuuuuagggggaugauacuuuucgggauuauuaugacaauuaaaugagauguaaaugagguucuaguauaguccuuacuguauuuuuaugaauauuaaguaacauauauuuaagagcaucauuuguuuguauagauuacucuuauuggaugaaaagggauuguugaaacuaagaaauaauuguaguucacucagcagguauacacuugaaaaucuaaaauuaugaacagaccaauuaggagaugacuagugcuacugcagaagaauuccuugcuuggguaaaagauuuacuaagcaguuccuuuauauauagauccccuuagugaguaaaucuaagauaggaaggacuucaaaaaauuugguuauuuauaauuuuucaauuacauuuguaaaaaccuuagaguuaucuuuaagucuucaccacaugcagccuuuuaggaaaucccguugacucugaacuucaaaauauccagaaucuagugaguucuaagccaccacagacucuugucucucuaauaacaaguuucuuaucucucugcuuccaccuuggcucuccugcaguugauucucacacagcagccacagugauccuugacaagcuuuggucagauuaugugaugcucugccuagaucucucuagugguuucucacccacucagauuaaaacucaguauuugucucguggcuuugaauaaggcuuuauuuuauuuuauucuauuuuauauuuauguuuauuuuuauuuuuugaagcuggguccugcucugucacccaggcuggagggcuguggugugaucucagcucacugcagccucugccucucagguucaagugauucuccugccucagccccccaaguagcugggacuacaggcgagugccaccacacccugauaauuuuuuuguauuuuuauuagagacgggguuucaccauacugaccaggcugguuuugaacuccugaccucaggugauccaccugccucagccucccaaagugcugggauuacaggugugagccaccgcacccggccugaacaaggcuuuaaaccaccugcuuccugcuuccauugaccucugaccucaucuccacuacucuuacuccguuccacccacauacaccucuugcuguuccuugaacaaccuuggcauuguugcuuuggggccuuugcuuuuuccucuucacggaaugcucuucccccagauauccaugugacugacccuucuuacucuccuucaagucuuugcagaaauaucaccuuuucaauggaaccgccccuccuaccuauaaacucacagucguuucucccucacucccacuccuauccauuacccugccccacuuuuccuuuuugucauagcacuugucaccaucuccccuacuguauacuuugcucauuuaugauguuucuguuagaaugugagcacuguaaggcaaggaucuuugucuuuuaaucucaagcaccuagaacaaugucuguacacaguaagugccaauguaccuuuguugaauuaauggaaauaucuguuaaguaagguauucauacauauauauauauauauauauauauauauauauauauauauauauuuuuuuuuuuuuuuuucugagacagggucucacuauauugcccaggcuggccucaaacuccugggcucaagcaauccuccugccuuagccuccugaguugcugggacuauaggcaugugucccagcugugucuggcuuccagucuuuuuaauauuaagggauaaugauuuuugugaauuaucuucucuuuuuacauucucuuaucagcuacaaaucuaacaaauauuagcgguuucccaaccucuaagaaugaaauuauuuaaucuaaaaauauagaguaaccucaggacgaaguucuccuaauacagacucuggaacuagauuaccuacuuuugaaucccagcucagcuaguuacaguguuaucaccuuaacuucugugugccucaguuuccucaucuguaaaauugggauaauuauagauuggaaauacugauuaaauggggcuaacugauuuaauguguguggaauacuuagacuacugagaacacuaccugacauuucaauguuaaauacuauagaaaugauagcagauauuaucugaugggaugauucugauuuuauccacaugcaucuuuucccgacuuucccucaaauuucuaaagacacugcauauucccuucuagaugauuaucaaagucgucaauuuuaguaugucuaaaauuuagcuuuucuacucuccccagcguguucuggacuuccuuauuuuugcuaauuaugucaucgucuugcuagucaugaagcuccaaaucagagauggcaaauucugaugccucaggcaggucaaguaaaaugagugaaguggaccagguguaaugcaugucaagacacuguccagguaaccaggcauggucucuaguagcagccuucagcaacacuggcacaguccucucagauuuucaccagcagcccaaaucuagauuuucauauagaaaguuucuuaauuguuuagaguugaugcaaauuucucagguuuacucuguggaccaaauaaauuaugucaguggcuagaugcaucaaguagccaguuugcucccucaucucuaagucuuagaaucaugcuuuccuuugcacaucuagacaggaaauugccaaaucuugcugaaucuaccacuacagucucucucgcauccauaccuuccucuauguucuccuaauauauugccucccuaccaaaucuuacacucacucuggcgcaaguuuaaucuaccagugaagccuccaaucaaguuaccccuuccuuauaccuuacacauacaggucagaaguuucauaaugucuaugcaaacaucaggcuccuuggcccuuuugaucuuggccuugugucuguuucugaugucaccuccuuugcacccuuccuuggaugcauccuggaugacguccugugucccagacaugccugugcuuuccugcuucuugcagccuccagggccuugcuugugcagaggcauuuaguagguuuuggugguuguugcauguuggccucacucugccugaggugcucuuucucauauuccacacucuuccucacucuuccuguuugugaaauucuacucauguuccagagugucaauugugacuuuuugcauugagagcuuucuagaugauagugacugugcacuuuuggaacucuaauaguauuucuuguauucauucuggugggcuuuuucacaguuuaccuuauuagucguguguauguauaugugugcauguaucacuucauuugcucaaaaguguauuugcacuauaauauuucaugagugaauacuuuuuuccuugagguucugguguauuucaauuggggggucagauguuuugcuuuaguuuucuauuuuuuguucuacuuugcaaaauaauuugugaacuguuuuuucuccuucuucugaaaccucaagugcuauacaucuaaaaaugcuagauugaaaauaaaccaaggcugguuagacaaagcugguuacagaguuaugauagcagggcugucauacuaguuuugaaaauguauagugcacugagaucaaaaagauguccuugaauaguauugguaacaggcuaaccuuucuucaucugugguaucaggaaauuacagggaguuacagggaacugaacacucugccauauuuaauaaacauuaaauauaaauuugguaguauauuuauuauucuuucccaaaucuuuacaaaauuguugugaguagauuuuccuuuaguaagaaagauuucuccaauuaaaguuuuaguaacaccuugcuaauugguaaggcuuauugguaagacuaauucgugaaaaauuaaauucuagaguguguugaccaaaauguaguuuuuaauuuugaaauugugauaaaauaaguccauaccuucuggaacuaccauucuuuuugaauuguugaagacucuggaccaaauucccuggaaaaucucuuugauaguaaauacauugaauaguaagcauauagaaccagaaacugcuauaaaguuaaccauagagcauugaguauauaguuuauuugcuucauggaaauaaaugaauacuacaguugguugacaauuuuuacacaaguuuagucagccauuuugugaaaaaacuugagaaaaugaaaaaaaucaggaggcagaagagaaucaugauagaauagcagaacuggaagggauguuagcaaccucuucacuucaauuauuagggaaauacaugcuggaaaagguaaugacuugcccaagauuaugcauccaguuagagaauggccaggccagacaguucaguggcaaagggcagaagugguggaugcaucugugguagauugauuaaaagcaacgauaggagcgaugagcagcaggcucugacagcaaaguggaagagauuugucuggguugaauuagaggaaaguggugaggaggaaaagcagaggugauuuagugauagugaugaggaugcuggcagaacuggacaucaucacacauuccugaaacugguaugaggcaagaaacaguccucucuauacaagagccuaaacucuuaaagaaaugauauguaccuuuuuagcccuuaaggaugccauuaugccaugcucuugguacacccuacauagauguuaagaccaggaggcacuuguucauuguauauaguggugcaagcuaaguuaguugauccaauaucuccuacccagagucucagcugugcuuauaucccaaacuacugauuauguugaugacacuuaauucccaaggaaauacugcauuuaguauauguuccucaagguggccaaaaaagaauauaguauuuuuuagaaauuuaaauaccaguguaaaaaaauccuuuaauauuccuagucuggagaaaacuucuucagauugauuuuacuguaaugacuggcauuaacugcucauaaccaagcuaacuuccaguaggaauauugucagcuuugcuuuacugauagcugagacucuaguccuguagaagcaguacucauacaguagacagguuccccugaucuugcacauccaaucuuauaauuuugccguggaacaggaagcuacugcuuaucuguguguuccaaugccuaucacugucugucauguguaaggaggcgaugaucuccuuacagauaacgugaaaacaaaagccacauugggcuagacaacaacauucacacauucugaauuagagcaggcugauuuaauaaaauguuacuguaauggugacauuuuaauuuacagagcccuuuucaaguauucuugaauuauuuccauaacaacccuaugaggcagguuaggguugguuuuguuauuuccauguaauauaccaagaccagauggagaugcagugacugguauaaggguuacacagauaguaaguagcagaagaaauugaaucuagguuuucugacucuaggcuccauguucuuucuaauuuacugccaaagcugcuaaauaagggugauuuuaaggccauuuggaauacuugcacaugagcuuacaaguuggagaauuucucaaauguugcuucaaagugaaagguuggccaggugugguggcucaugccuguaaucccaguacuuugggaagcugaggugggaggauugcuugagcccaggaguuccagaucagccagggcaaaaaaaaagaaaaaagaaaaaaaaugagccaggcauggugguacaugccuguagucccaguuacucagauggcugaggugggaggauuguuugagccccggagauugagggugcagugagccaugauugcaccacugcacuucagccuggguaacagagcaugacccugucucaaaaaagaaacauaaaaguuaaaggucuguuuauaucauggcaguauucaaauucaucuggaucauaugaaucaguccagugugcucauuaacguuacauucuagggcuuuacuacagaccuacagaaaaaaaaucuguaagaaaagagcaugggaccauguauuuuuaacaaauaagaugauucuuaaggucaugcauuuugggggccaggcacgguggcugacaccuguaacccuagcacuuuggguggcugaggugggcagaucacuugaggucaagaagcucuagaccagccuggccuggucuaguagagauggugaaaccccaucucuacugaaaauacaaaaauuagccccaagugguggcauaugucuguaaucccagccauuugggaggccgaggcaggagaauugcuugagccugggagacagagugagacucugucucaaaagaucaugcauuuugggaaacacuggacuagcccuagaaaaaacaguggauuauccaugcaggcuuuuuaaccaaauaucuucugaauaccagggcuugguuuauaauagugagccaccguguccggcccagauggguuuuuaaaaauuaucuuuauuggccgggcgugguggcucguacauguaaucccagcauuuucggaggccgaggcagguggaucacuugaggucaggaguuugagaccagccugaccaacacggugaaaaccggucucuacuaaaaauacaaaauuagcugggcgugguggugcacgccuguaaucccagcuacuugggaggcugaggcaggagaaucacuugaaccugggaggcagagguugcaaugaauugagauugcaccauugcacucucgccugggcaacaagagcaaaacuucgucucaaaaaaaaaucuuuauuaugaaauuaauauaaaugauaucuuuuaaugaugauucuuaaagaggcaauagacugaagaggauguucuaauuagucuucuucuucuucuucuucuuuuuaagccuuuuaaaugaugaggaaggaggaaaaugggcuuagguucuaccagaagaaauuuagauuuuaguuggccaucuggaugaccuuuguaguaauuaaacagucagauugggucauuccuucagcagauaaauaaauaaauacauauauuucuaacuuuuauuuuaaguucaggggugcaagugaacguuuguuacauagguaaauuugugucauggaauuuuguuuuacauauuauuucaucaccgagguauuaagccuaguacccauuauuuuuccugauccucucccuccucccaccuuccacccuccgaaaggcccauguguauguuguuucccucuauguguccauguucucaucaucuauuauaguucccacuuauaagugagaacaugugguauuugguuuucuguuccuguauuaguuuguuaaagauaauggccucuaguuccauccauguuccugcaaaggacaugaucuuguucuuuuuuauggagcagauaaauauucauuguguggugauuauaugcuaggcccugugcuggguaugagaauauagugaugagcaagaaagccauggucucaaaguucugauauccggaaucuacaagcaaguuaaacaaauuuauaagaaaaaaaaucaucaaaaagugggcaaaggauaugaacagacacuucucaaaaagacauuuauguggccaagaaacauaugaaaaaagcgcaacaucacugaucuuuagagaaaugcaaaucaaaaccacaguggaauaucaucucaugccagccagaauggcgauuauuaaaaagucaagaaacgauagaugcuggugaggcuguggagaaauaggaacacuuuuacacuguuagugggacucuaaauuaguucaaccauuguggaagacaguguggcaguuccucaaggaucuagaaccagaaauaccaugugagcaaucccauuacuagguauauacccaaaggaauauaaaucauucuacuauaaagacacauggacacauauguugaaugcagcacuauuuacaauagcgaagacauggaaccaacucaaaugcccaucagugacagacuggauaaagaaaaugugguacauacacaccauggaauacuaugcaaccaaaaaaggaaugagaucauguccuuuacagggacauggaugaaacuggaagucaucauccucagcaaacuaacauaggaacagaggaccaaacaccacauguucucacccauaagugagaguugaacaaugagaacacguggacacagagaggggaacaacacacaccaggacuuguugcggggggugggaggcaagggggaggggaagcauuaggacaaauagcuaaugcauauguggcuuaaaaccuagaugauguguugauagguacagcaaacuaccauggcacauguauacuuauguaagaaacuuucacauucugcacacauaucccagaacuugaaauaaaacaaacaaacaaaaagaaagccauggucucuaucucugcuggucuggcagaagacacagacauuauauaagcagauccaaaaaguguuacaggagccggcuaugggggcacuaaccugguucaggggcuuaaggaagguuuucuggaagaagcaacauuuaauccaagauguggaagaaaaguagaagaugaugauguucauaaugguaauaagauguaauguuuauuaaaaagcuuaccauguaccagguacuuuucuaaauaucuuaauugacucauuuaaucugcacauaauguaauaagguagauccuauuaauaucucuguuuuaguaaaagagagcuaaaauauagagaggucaagcaguuuacccaaagucacauaguaaguggaggagcaccugggcuuugaacugaagucugucuccucaauuuccucucuuagccacuaugcuaaacggcauugauaaauuagagaugggcaggugagggguguuggaggacaggggacuauuucaagcagugagaacaccuugggugaagaccuugaggaaacugagaccauuucaggaaguuuuucuaaaagaagguugagagagcuggggcugagaauccugagaggagagaggcaauagauaagacuagagaaauguaggcagggggccagaucccacaggcccuugagucuacaguaagaguuuguuuauccuaaggacagugggaagucguugaaagauuuuaagcaguagagugucaugaucaaguuuguacuuaggacaguuuacucuggcauuuuggagaauggauguggagguagcaacucaggagguugggagaccagcaggagacuggugaugguaaaccaggcauuggguggugguggcuuggauuaaggaaacugagacagggacugggagagggagucagacaagaaagagauaggagguaaaguuaugggcccuugucauaaacuuaugauuguggggcugagggagacagcagaguccaaaaggacugugaggggucugagcucugggcacugacauaaaacacuaagagagaucaggcuuugggaagaaaauaaugagguugauuucugacagguucuauguggauaucaggcagucuuacuguagauucgcaccaagcugagccuaaguccuuuggucuagccaucauuuaaguuguucuaaauuagaugcuauauuuuauagucuacagaaaaguguggugccucagcaauguaauaguuuaggaaaaggaaaauguuauuuuuuaauaaguugaguguauuccauguagcacauugugcuauaguugggucaauccguuugcuauuuucucuuugggcagaaaguauaguggaaagaacggguacaggauuaucacaggaccugaguucauaucucaucuucccaccuuuggcacuuauuaguguggaaucuuugaucagcuauucuguuuuuuuccaucuaucaaauguguucaaaaauccccacuuugucuaagauauuaagagucuuuggaagcgugguagaaaguacaaagcauuaugcacauacaaggcacugggccuuuuccccucuucaccuuucaauuagaaaccuagaaauagaauugccguaugaguugaucagcuugugugagguucacauugcuucaagauuuauuuuggggucuguugcaacuuuguugugaucaacaccugagucucuugaugugauuaucuaauauauaucaauuuuagaacauaccuaaaacagauuuuuuaaagcaauuuuuguuaauguaagcuuguuucuaaauuaaaaguuaaacuaauguaaccacuaauuguauuuuaaagagaugccuuaagcuucaacuuuauuuuuaacauauacaaaagguauguaugguuaguuacuacaguggauuaaagauauaguuaaauuauugcuagugaaguaucauuucaacuaugguauaauuggaagacuuucauagcuugacauaacuguuuaaagucucauuauuuuauuauaagcauuauuauaagagauuauuauaaguuccugucauuucucacucaauaccccacuguucccaucucaugcuaaaagauauuuagaguucuuuuucuuuagcuuaaggcuuuuuauuauucucuuuuuucauuuuuuccucuggggaagugagaaaggaauguucucauuuuuauuuaagcuagauucugaugaauuaugauguuaaugagauaauaguaccuuuuagauaucuguagcaaaaguaucaucuuugaaaugaggaaauauuuuccagaauauacuuugaaucaauuuuuaaaaaauacuaaggaguauauauccaaaucuucuaguaauuuuagcuccaaaauauguauauuugaaaauugugaauuacuuuuuguuuuuuucaaauuguuuguuaauguuacugcaaauggagacauuuauuuuucucuucucuuguguuccuauuuuaguuuggguucucccaaaaucagauguugagacacauucaaguucaguuuauuugaaaggugaucccaagaaacaccaguagggaggagauagagaagggaauucagccaauuuggccagaaaucuaauaauccgaucaaaaaaugggcagaagauuugaauagacauuucucaggacauacaaaugacaaacaggcauaugaaaaaggugcucaacaucacugaucaucagagaaaugcaagucaaaaccacagugagauaucaucuuacccaguuauggcuuauaucuacaggacauuaucaagcacuguggcccacuggagcuuuagcccacacaauaacucuggagcuagagcagaacucaaguuucaggguuaucuuaucugaggggcugggaaguuuggguauuuauacaccaguggccuuagucacuggaugaaggcuguugauggggaggagccugaguucccuaggacuucuagucuaccguguacuuggcauugcuggcuucagccaccagaaaaaguccuaauuuauuuauuuauauauauuuuuuuaauuuguaauuuuuguggguacacaguagguauauauauuuuugggguacaugagauauuuugauacaggcaugcaaugagaaauaaucacaucaugaagaaugagguguucauccccucaaccuuuuaucuuuugaauuacaaacaaaaauguacaauuaaguuauuauugacuacagucgccacauugugcugcuaucaaaugguaggucuuaaucauucuauuuuuuuuuuaacccauuaaccauccgcaccucccucccagccccccacuacccuuccuagcuucuaguaaccauccuucuacugucuguccaugaguucaauuguuuugaguuuuagagcccauaaguaagagaacacacaauguuugucuucuaugccugacuuauuucacuugauacaugaucuccaguuccauccauguuguuguaaaugacuggaacucauucuuuuuuauggcugaauagaacuccauuguguauauguaccacauuuucuuuauccauucaucugucgacggacacuuagguugcuuccaaaucuuagcuauuguaaacagugcugcagcaaacauaagagugcagauaucucuuagauauauugauuuccuuuauuuugaguauauacccagcagugggauugcuggaucaaaugguagcucaauuuuuaguuuucugagaaagcuccaaacuguucuccauagugguuguacuaauuuacauucccaccaacgguguacagggguuccuuuuucuccacaucuuugccagcauuuguuauugccugucuuuugggauauaugccauuuuaacugggaugagauaauaucucauuguaguuuugauuugcauuucucugaugaucagugauguugagcaccuuuucauaugccuguuugacauuuguaugucuucuuuugagaaaugucuauacacauauucugcccauuuuuugaucagauuauuagauuuuuuccuguagaguuguuuaggcuccuuauauauucugguuauuaaucccuuaucagauggguaguuugcagauauuuucuuccauucuguggguugucucuucacuuugauuguauccuuugcugugcagaagcuuuuuaaguugaugugaucccauuuguccauuuuugcuuuaguugccugugcuuguaggguauugcucaagaacuuuuugcccagacuaauguccuugagauuuucucuaauguuuucuugugguaguuucauaguuugaggucuuagacuuaagucuuuaauacauuuugauuugauuuuuguauauggcaagagauagggggucuaguuucauuuuucuacauauaacuauccaguuuuccuagcaccauuuauucaagagacugucuucaguauauucuuggcaccuuuguugaaaaugaguucacuguaggugugcagauuuguuucuggauucucuauuguguugcauuggucagugugucugcuuuuaugcccauaccaugcuguuuuaguuauuauaccucuguaguauaauuugaugucagguaaugugauucuuccaguuuuguccuuuuugcuuaggauagcuuugacuuuucugggucuuuugugguucuguauaaauuuuaggauuguuuuuucuauuucuguguagaacauuauugguauuuugauagggauuacauugaauuuguagauugcuuuggguaguauggacauuuuaacaauaucaauucuuccaauccaugaacauggaauaucuuccaauuuuuugguguccucuuuaauuucuuucaucaguguuuuauaguuuuuauuauagagaucuuuuacuucuuugguuaauuccuaggcauuuaauuucauggguagcuauuauaaaggggauuacuuuuuaauuucuuuuucacauuguucacuguuggcauauagaaaugcuacuuauuuucguauuuugauuuugugucugcaacuuuacugaauuugucuaucaguucuaauauuaauaguuuucucauggaguccuuugcuuuuuccaaauauaagauuacaucaucuccaaacaaggauaauuugacuucuuccuuuccaauuuggaugcccauuauaucuuucucuaauccaacugcuguagcuaggacuuccaguacuauguugaauaacaguggugaaagucagcaucuuugucauguuccagaucuuagaggaaagguuuucaguuuuuccccguucuguaugaugcuggcugaggggcuguugagguauguuccugcuauacccaguuuuuugaagguuuuugucaugaagggauauuuaauuuuaucaaaugcuuuuucagcauuaauucauuuaauucauuaaaugaauaugugguuuuuauccuuuauucuguugauaugauguaucgcauucauugauuuguguauguugaaccauccuugcauccuagggauaaaucccacuuggucacgguggaugaucuuucuaaugcaagcuuguccaaucugcggccaaugggccacauguggcccaggauggcuuugaauuguggcccaacacaaauuucugaacuuucuaaaacaugagauuuuuuuugcaauuuuuuuucuuuuuuuuaagcucaucagcuauuguuaauguuaguguauuuuauguguggcccaagguaauucucuuuccaguuuggcccagggaagccaaaagacuggacaccucuguucuaauguaucauugaauucugucugcuaguguuuuguagagaauuuuugcaucaguauucaucagagauauuggccuguaguuuuccuuuuuuuguuguuguuguuuuuuuuguuugauguaccucugucuaguuuugguaucaaaguaauacuggccucauagaaaguguuuggaaguauucccuccuccucuaguuuucagaauaguuugagaaggauugguacuaggucauuuuuaaauauuucuaauaguagaaugagaauuaaacuucuuuuuuuuugagacggagucucgcucugucacccaggcuggagugcaguggcgggaucuuggcucacugcaagcuccgccucccggguucacgccauucuccugccucagccucccaaguagcugggacuacaggcgcccgccacuacgcccggcuaauuuuuuguauuuuuaguagagacgggguuucaccguuuuagccgggauggucucgaucucccgaccucgugauccgcccgccucggccucccaaagugcugggauuacaggugugagccaccgcgcccggccaaacuucuuuaaauauucuaauaguagaauucaguagugaacccauccaauccugggcuuuucuuuagugggagacuuuuuauuacagcuucugugucauuucuuguuauuggucuguuuagguuuuggauuuuuuucugguucuaucuugguagguuguaugugucuaggaauuuguccauuucuucuagaucuuccaauuuauuggcauauaguuacucauaguagccacuuaugauucuuagaauuucugcaguaucauuuguaauguuuccuuuaucauuuuuuauuuguaucuuucuuuuuuuucuuaauuagucuggcuaaagguuuauuaguuuuaacuuuaaaaaaagaacaacuuuuuguuucauugaucuuuuguauuuuuuuuccauuuccauuucauuuauuucugcucugauccuuauuuuuuauuuucuucugcuaauuuuggguuugguuugcucuugcuuuucuaguucuuuaagaugcauuguuagauaguuuauuugaaguuuuuccucauuuuugauguuggcacaaaguccuugggcaaagagaugcauuuggaacgugcuccccagugguauggucagaggagauaugggcaaggcaccacuagcuuagcuguaauucccaucacaauauuugcauuagauuucauuuucuuuaagcaaagcaacaaaguaagccugacgaaaagguagaaaaggacuuaauuccaggagauaauuuuaaaaauauaguagauuagaggcauaaguugauguaguugauguauacuuucuuugugaguaaaguuucugcaaccucucaggguaguugauggauuagccuguuuuagguauuuucaguaaauaaaaaugacugcugacuaaauacugaacgaaccuuguagguuuguguuugugauaaaguaugaauuaaucucuuguuuauaguuuaauucucaucuacugaaugggagaugauuuccacauggucuccucaguacagggugacugcaacacuuggggaagauguggcagauacaguugguugcuuguugacagaaucccacauuuguauagguacuguguaaucauaugcuucaggaaaaguugaccaaucuugauuagcuuaagcuuauuuugauuucuuuccucuugcuagugguugguuuaggagcaugcauaucgcaguucuggacaaugagauaugagaggagauuugcuggagggagagauucugagaaggcuuuccgagccuuaagaagagguagaagaaaggguguuauuaugugaggaugggauggauaccuguggccaccuugaagaccagacagaauaaacuggggaaagaaccaacacacugaggaucacagagaagaaagauggaaagcuucugggaucuugaugcuaucccugacccacucaguuugcccacucuggaaguaccugaauguuuccuguuacuuugagauaaaaauuccauuuuuuaaggauauuucugucaguuucagcugaaagcguccuaagcuacagauucaguagaaaaggagggaaauuuucuuguuucaaaugaaauuuuauaauugauuuaaauaaaguccaauggguuuugggugaacuuaauuuauugcuauucauuugaauacagacauggaugaaaggaaaagacuuuuguaugggauaugguugcaagucuuacugaauaaauaaagucucauuccugauuaugcugguuauugaguucuuguccauaucagguaguuaaauuauuuuagugcccagguuuauacuuuauaaaaccaaagaguagagguaugugggaauugucuuauuaccauuauucuuugagaacuauuaacaaaugauucaggaauauuggauuuucaauuaacuugaaguaaguuucuugggaugaucugcuuuuaguuacucuaaauauuuuuagcaaguaccugguaaucugggagacuguggcccaaaguaguucaacugaauuugaaaaggaucaggacuggcuaugaagugaggcugaguggguacaucuauauguggauacguuacuguccuuugugcauauuucuuucuaauuacguuccaaauccaauaagaagucaauuguauucaucauccuggggguaucaucuuaacucugccauuuuuccauauuaauguauuaaguauaaagguugugaaauccauuucagaugcuccugguuugggaaguauaagguuacagauucaauggcauuuaaauuucuuuuuuuccucucuccucuuuuuuuuuuuuuuuuuuuuuuuuugagauagggucuugcucugucacccaggcuggaaugcagugacaugcucacugcagucuucaccuccccggcucaaauaauccuucccaccucagccucucuaguagcuggaacugcagguguaugccaucuuucccgguuaauuuuuguauuuuuuguagagacaggguuucacuauauugccuaggcugguagauuucuuuauuuuuaaaauagaaaugguggggaaauguaccauccgggucacugaaaagcuggagcaaagauguauggaacucagggacauggacucuacuuugcaucccuggugggguggggguguguccuuacugauguagacuuuaagaaccaugagagccugauguguguguauaaauauggcuuuaaaaaagaagacagagauuguuuaucuuuaauagcaguaauauaaggccgaagucuaaaaggacucuaggauaauaagaaaugaauccucaggcuggcaugauggcucaugccucuaaucucagcacuuugggaggccgaggugggcagaucacuugaggucaggaguucgagaccagccuggccaagauagugaaaccccgucucuauuaaaaauacaaaaauuagccgucaugaggaugcaugcuuuuaaucccagcuacuuuggaggcugagguagaagcauugcuugaaccuggaagguggaggcugcagugagccaagaucacaucacugcacucuagccugggcaacagagugagacucuguaucaaaacagaaaaaagaccucagucugugaagacuuuggucauacacuauugcuugggguuuaagggaagcugccuuuuugguuggggguauccuuucugauaaaagagauucaguaacuuagucaagcuuugcucugugaaugaagggguguguguguguguguguguguguguguguguuguggggggugggugugcauucuuuuccugccuucugguuuuauaggagaaauacucauugggucuuggaaagacgacacuuccuguguuuaagguacaguauuaugcugacuaguaaaauaaucuuaauucuuugauaaugggccaaaggcaaguacaagaugaauaggaaagcuauuauuacagguuuuaauuuugaaaauuuuaugccucuuuuucuauuuuuuguuauauuuuuauauuacugucauuucugccccuuauuugguacugaugccucauaucagggauaugacauauaccauagauauaucaucaagaguaagauauaacaucagagaaguuauaucgucuauucuuagguucucuccacaccccauaguuauucuuuuauuuaacugauucaauaaauuaauugaucaccacugguaugucagacgcuuugcaaugccuagggguguagcagugaacaaaaugggcaaagucuuugcucucauggagccugcauuuuaaugaggaaagauggacaauaagcagacauuugguaaguuugguggugaaacguacuaagaagaaaaauaaaguagaugauagaauaauagaggaggauagagaggaaguuuguaucccugcuucuuugcauaggaugaugguuagggaagauuuucucgauacguugacauuuagacugagaccugaauggaauuucuuuacuccacuccaaccauacuggccucuuugccauuccuuguguauuuacagcacaaacuuuguacuaauuuaucccuuugccuagaauacucuucugagagauagucacaauuuaaauaaguagggaaaaggauugggaguuaucaguuguguuaccaggcaaauggaauucccucuucuauuagaagugcagaggaugggucuggcagccauugaauuguguagaauuaugguuucuuuagugaaucacuucuaaaauaacaugcauaauuuguuuaaauauacaugauguuuaggauaauuuuuuugaagacuuaauuaaucucaccuguuauuuuucccgcacuuguuacuuuacaaaaauuaaaguggacuaucuaacaaaaaacuaaguugucuuggucaguuugggcugcugugacagaauacuauagacuagauggcugaaacaaaacaaauuuauugcuaaaaauucuggaggcugggaaguccaagaucaaagcuucugaugucaggugagggauuuuuccugguuugcagauggcugucuuucauuguaucuucacaugcuugugucuuuuuuuguaagggcauuaaucccauuaauaauuaccucccaaaggccccacccgcagauaccaucacauuggagauuuaagcuucaacguaugaauuuggggggaugcaaacauucagucccagagcauaaguuauaauauuuugucaguugaccuaauaaaacaugauauccuggguaacagcauagagguaaucacauuacuuuuaacacaaauaaaagcuuggaaagcuuuuugguaagcugaagaggaauaacaguuuuauucuaaugcaauuuuuaaaacaacaauaggcuauuguuuuacacaucucucugaaaacuauacauuuauugacuuuaucuagaagggcaguaacuauguaucucuuuauuaaucuuucuccuaaacauacugaaaauauuuugcaguacacccuuaggacuuauuagguuuauaaagaaaaggcagcugugaaugaaaugcugaauugcaucccccauuggaucaacucuaaaauaauuaugcaaaaaauaagaauaaccccauuuuugcugaacauauaaauuuuaucauugcaaaagaacugaauaguucaacaccacauucucauggagaugucuuacugggaccgcaguaguuggguguacuauuguugaaaaagauaauuucuauuuguauguagguuacucugugccuaaaauggaucauuucuaccaucguauuuuaucuuccuuguuuuccaccucaucuuuuauuuauacuucauagaucaugauauuuggagcauauuuggcuauuagccaauuagugcuuaucuuuuauaaugguuuucaaggauaacagagauaaauuaaauuccaaaauauuacugaaacaucauucccaauagcaacuauaaccuucuucucgcccgugcuuuuucuggaacuauagaacagaccaaaugagauuucaccuuuuuuuuguuuuuaagcuaacugugcccuccaguggagaaaacacagggcagugaaauagcucagguaagaagcagcagagaggagaggauguaacacagccagguaaaguucaagcugcguagcuguuuucuacauaaaagaaagaaauuguuuucaccccucauaagcaagacuuuuuuuuuucuuuuuuuugagacagagccuugcccugucgcccaggcuggagugcaguggcaugaucuuggcucacugcaaccucugccucccagguucaagugauucuccugccucagccucccgaguagcggggauuacaggcgcgcaccaccacaccuggcuaaguuuuguaauuuuaguagagacaggguuuugccauguuggccaggcugguugcaaacuccugaccucaggugauccgccugccuuggccucccaaaguguugggauuacaggcgugagccacugcaccuggcccauaagcaagacuauuaugcauaaguccuccucuugaugaauuuguugaugaaucaaagaaggauauauuaucauuucucugacuuaaugucuuugaugcaaugcuuuucagccuuuuguccucucugguaggauguauucaguuuuugacacauuaggcaaguguaacaggaggugaguaauuggauuuuuuucuccccuagaaugaacucaaaugauaacuuuuaauuuuuuaaauuuuuugaacagaugaaagaaaaccuuaaauuaaguagauauaaacaagaaacauuuugcugcuacuuguauauucaaaucauucagaaaacuaugaauugacuaugacucccccuuuuuugaauagaaaagggagagaguugaccugaccucuguggcuuggccugaacuugaucucuuggugaacacugggcuucaucagugugaauggugacuaugugugacugagcaccugugaggguuacagaggcacguguucagaacaugggcugguaugugugcaacucugggcuggggaauggagccagguuuaggggaugcuagacugccuguguuucugcccuuccagggagggagaacuagguaacuaaguugaagcugaaauguuaaaggaggcuugaugguuuuguguugguggaaauugggagauacguuucccuaaaagaauauagugggugauaguugagaaacaguaaacagaggcuuucuuuuucuuaacucuuauaaaacccugagccaacuauccuuacaaugaguugucauuugaaguuuucuacauacucaagaaauauguuuccuuaucuuauuuuaauggagcguaucuucugcaaaccuuuuuacaguuagagugauucuuaaaauuuaggcacauacaggacaauuagacauaaaaagacuugacuuacagauuuuaaagcagggauccuugcaugguagacuuucaaaaugauaguaucuuuuacuugaaccaucuuuugcaaaguaacauaaauaucucagagacacugccagagcgaacucacuuuuagaaaaagcaggauauguaaacuuuuagugauaaauuuugaaauucuugaggggaaaugauaugugauuuaaguuccuucaaaauaauuuaucuuuauuuuauuuuuauuuuaaauaaugaauuauguuuuaagaucugauucauucugaacuauaacugacucuagagggugcuuaaugagcacugaagacuuccuaaagauuuauauugaagaugauuuuuauuaaaaugaaguuuauuugggguuuuaauccaguauuugaaaauaaaccauauuuugcccucccaagagagccuagagcaaaaauacuuaguugucaguauuuuuucguuuuuuugagauggagucuugcucuguugcccagacuggaguacaguggcacgaucucagcucacugcaaccuccaccuccuggguucaagugauucuccugccucagccuuccgaacaggugggacaacaggugcaugcgccaccacgccuggcuaauuuuuguauuuuuaguagagauaggguuucacuauguuggccaggcuggucucgaacuccugaccucaagugauccacccaccuuagcuucccaaagugcugggauuacaggcaugagccaccguaccuggccuagcugucauucuuuuuaaaguagguaaauaauuuaccauuguucuuagaaacucuuugaaaauuccauugaauuugugggauuucuauaaacuaccuuugaaucaugcuuuugaaagcuuguuuaauauuucaaaagaaaagaaccuacuucaugcauauaaaauauaaaucuuaguacuggauuaguguaucauuuuauaaauuuaguuguuugcacagauauuuauuuuaucuuuagaaagaagcuauucaaaaagcacauucuaaaguuagauuuuacagaacauuuagguuuuagaguaauguaugcuucuuauauuuuuagcagguagaguacuuuuaaaacuaugguguguuuuuuuguuugcuugguugguugguuuuuuuuuuuuuuuuuugagacagggucuugcucuguugccgaggcuagagugcagugguacaaucacggcuuacuguagcaucagccucccgggcuuaagugauccucccaccucagccucccaaguagcugcagcuacacauguguacuaccacaccugacuaauuuuuauauuuugaguagagacggguuuuugccuuguugcccagguuggucucaaacuccugggcccaauugauuuguacaccuuggccucccaaagugcuaggauuacaggcaugagccaccacacccggccuacagugugauguauuaauuugaagaaaauuuucagacuuuucagaugggaaagcuuuuagaaaauugcugucuuaacccaaacuucaaagauggugaugauaaagauauacauuguaaagcaaaaauaaaauuugaagggccccccagcccccugcagccaucugaauggacucccucaucagcaagggcacuguaaaauuuaaccugaaagacugacucaggccaugaaguagggguuggacaugccucauuauaccccuccagcauuaacaucaacacagaccuuaagucugauaagaaacauuuacaaucuauuuucucugaagccugcuacuuggaggcuuugucuguauaauaaaaccuuggucucagccuggcgcaguggcucaugccucuaaucccaggacuuugggaggcggaggcgggcagaucacgaggucaggagaucaagaccauccuggccaacauggugaaaccccgucucuacuaaaaauacaaaaauuagcugggcaugguggcaugugccuguagucccagcuacucaggaggcugaggcaggagaauugcuugaaccagggaggcggagguuguagugagcugagauguugccacugcacuccagccuggcgacagagugagacucugucucaaaaaaugaagaaacaaccaaaaagcuuggucuccacaaccccuuaucuuaacccagagauuuuuuuuucuacugauaauaacucuuucaaccaauugccaaucagaauauguuuaaaucuaccuaugaccuagaagccccuccccugcacugaguuuuccugcccuuccagaucuaaccaauguaaaucuuacguguauugauugguguauauaucuucccuaagauguauaaaagcaagcuguaccccaacuaucuugggguacagcuucugaggcugugucaugggugcguccuuaacguuggcaaaauuaacuuucuaaacugacugagaccucucucagauuuugaguucacaacguuuacaaaaggucuguguuauagugagaaaacuuugcuaaacaaaaugaguuauccuucauuggaguauuagucauugcagagaaugaauguuaauguaaacuuuuacaugaugucagccuaugaaaaagugauguguuuccauacuacccguuuguuuaacauuucuucagaaauaucacacuguuuucauuacugcaggcagagaaucauauuagaaaaauucaguaauuugaugugaaaccuauguuuuacucauugaaggcacuguuauccaacagaacuuuuuaugauaauggaaauauucuguaucuacacuguacaauuugguagucaccagcuuuuuuaaauuuuuuuguuauacuuuaaguucuaggguacaugugcacaacgugcagguuuguugcauauguauacaugugccacguuggugugcuacacccaugaacucguuauuuacauuagguauaucuccuaaugcuaucccucccccuccccccacccuacaacaggccccagugugugauguuccccuuccuguguccaaguguucucauuguucaauucccaccuaugagugagaacaugugguguuugguuuuuugucuuugcgauaguuugcugagaaugaugguuuccagcuucauccaugucccuacaaaggacaugaacucauccuuuuuuauggcugcauaguauuccaugguguauaugugccacauuuucuuaauccagucuaucauuguuggacauuuggcuugguuccaagucuuugcuauugugaauagugcugcaguaaacauacgugugcaugugucuuuauagcagcaugauuuguaauccuuuggguauauccaguuaugggauagcugggucaaaugguauuucuaguucuagaucccugaggaaucgccacacugucuuccacaaugguugaacuaguuuaccgucccaccaacaguguaaaaguguuccuauuucuccacauccucuccagcaccuguuguuuccugacuuuuuaaugauugccauucuaacugguaugagaugguaucucauugugguuuugauuugcauuucucugauggcuugugaugaugagcauuuuuucaugugccuguuggcugcauaaaugucuucuuuugagaagugucuguucauauccuucacccacuuguugaugggguugcuuuuuucuuuuauauuuguuagaguucuuuguagauucuggacauuagcccuuugucagaugagcagauugcaaaaguuuucucccauucuguagguugccuguucacucugaugguaguuucuuuugcugugcagaagcucuuugguuuaauuagaucccauuugucaauuuuggcuuuuguugccauugcuuuuuguguuuuagacaugaaguccuugcccaugccuauguccugaaugguauugccuagguuuucuucuaggguuuuuauaguuuuaggucuaacauuuaagucuuuaauccaucuugaauuaauuuuuguauaagauguaaggaagggauccaguuucagcuuucuccauauggcuagccaguuuucccagcaccauuuauuaaauaggaaauccuuuccccauuucuugauuuugucagguuugucaaagaucagauaguuguagaugugugguauuauuucugaggguucuguucuguuccauuggucuguaucucuguuuugguaccaguaucaugcuguuuugguuacuguagccuuguaguauaguuugaagucagguagcaugaugccuccagcuuuguucuuuuggcuuaggauugacuuggugaugcgggcucuuuuuugguuccauaugaacuuuaaaguaguuguuuccaauucugugaagaaagucauugguagcuugauggggauggcauugaaucuauacauuaccuugggcagaauggccauuuucaugauauugauucuuccuaucuaugagcauggaacguucuuccauuuguuuguauccucuuuuauuucguugagcagugguuuguaguucuccuugaagagguccuucacaucccuuguaaguuggauuccuagguauuuuauucucuuugaagcaauugugaaggggaguucacucaugguuuggcucucuauuugucuguuauugguguauaagaaugcuugugauuuuugcacauugauuuuguauccugagacuuugcugaauuugcuuaucagcuuaaggagauuuugggcugagacgaugggguuuucuagauacacaaucaugucaucugcagacagggacaauuugacuuccucuuuuccuaauugaauacucuuuauuucuuucuccugcuugauugcccucgccagaacuuccaacacuauguugaauaggaguggugagagagggcaucccugucuugugccaguuuucaaagggaaugcuuccaguuuuugcccauucaguaugauauuggcuguggguuugucauaaauagcucuuauuauuuugagauacgucccaucaauaccuaauuuauugagaguuuuuagcaugaagggcuguugaauuuugucaaaugccuuuucugcaucuauugagauaaucaugugguuuuugucuuugguucuguuuauaugcuggauuacguuuauugauuuggguaugucgaaccagccuugcaucccagggaugaagcccacuugaucaugguagauaagcuuuuugaugugcugcuggauuugguuugccaguauuuuauugaggauuuuugcaucaauguucaucugagauauuggucuaaaauucucuuuuuuuguugugucucugccaggcuuugguaucaggaugaugcuggccucauaaaaugaguuagggaggauuuccucuuuuucuauugauuggaauaguuucagaaggaaugguaccagcuucuccuuguaccucucguagaauuuggcugugaaucugucuagucaccagcuauugagagcuuggaauguggccagugugacugacgaacugaauuuuuaauuuuguuucauuuuaauuaaaaauuaaauuaauagcaauguguaucuaguggcuacccuguuggacugcacugauuuuaaguccuccugcuaggugauagguguaucugggauugaauuaugacucugauggugcauauguguaucuguuuaguccuuugaacuuuuauaauccugccugagguacuauaacaugcaagcaccuuguuuucaaauagccacauuuaugugaaaagaagaggaauuguguucugaaaacuaaguuaaguuuagguuaaaccugaaacuuaacuuaauuuaaaaaauccucugacuuuuuaacaaacccguagauuaaauugcauuugcccuuuggaugugucucaaacccugaagguuuucuucugugcuuuugaguuaaaaugcagguagcauauaacaggugacugcaaaauggagggacugaugaaaacaaaacaaaagcaaccacaaaccagaacuuauaucuacucuguaggaauuuuguuugaaaguugguaugcuuuucugaauguccuuaaguauaacaagucuuccuacucugaggguaaacuuggguauuauaaagaggcaauuugugcuuacgucugguaaauaaugauaaaauacuugaguaauacuuuauaauuugccaggcaguugcgauuucaucuucuccuuggaauauuaaccccauucuaccgacaagagaaccaugauuuaaucaagguucucauucauuucgcaaacccuuauugaucacuuacuauugaucaccuugcuauucauguagauuucuauguuaggaaugaaagaauaguuccucuccuggaggaauuaacaaucuaguugggacaauuaaacaaagaaacaauaaauuauacuguacucaacaggaugagauuauauauuguauuauauauuauauauauuauacauauauauauauauaaaauauauaugugcauaggaugcaguggaagaagaaggagaaacaucuggcaugguggugagaccugagggagucaggaguuucccaggugaaggaggcaggggaaaggugccccagaagaggauaugucaggaguaaaggugugaaggugcuaguguucuaaaucagaauaaauuuaguaaauagaagguaccugaauauucacaugcacaaaauuuacuagcagucuuauaucauuuugaccuugcuuuuuuucuagcucagucugaagaaaagcugggcuaaaaauagcuccugguacagugauaaagcauccaaguaacgauuucaaggagaaaguuaagacuagauuuaguuauuuggcaaacacuaacuuacaauauugaugugcuaauaagaaaucaucuuacuuauuaaagcagauccuuagaggccuguuuuuguuccucuuacuggaauaucaauuccaugaggacuuuaauucacuguuuucucagggccuagaacaguaccugacauauauuagaagcucaguaaauauuugguauauaaaggaaugaauccuaggcuauuaugcuaaaagucacugugaaugcuuaaaccauauuagaaauguguuuuuuaaaaauucaagaauucauucauuuccauuauucagacuagccuuuucuccagugucugagauaccuauugcuauauaacaaacuauccuaaaacuuagugauuaaaaaaaauuauugcuuaugauuuuguggauccggaguuugggcagggcuuauuggagacaacuuuuuucuauuccacaugguauuggcuggggguagaggguucacgauggccucaccuccaugucuggggccuugauacuaguuguuaccaaggaagccucaguuuucuuccauguggucucucauuauuuacuagacuagguugagcuuccuuacaugguacugagauuguuccaaggugaaaacagaaguuguaagauaucuuaaggccuugaucugaaaguuauacacugucaguuaugccacauucuucuucuucuuuuuuuuuuuuuuuuuugagacagagucuggcucugucgcccaggcuggagugcaguggcaccaucuuggcucauugcaaccuccacauccuggguuuaagcaauucucauaccucagccucccaagaagcugggauuacaggcaugugccaccauacccagcucauuuuuauauuuuuaguagagauggaauuucgccauguugcucaggcuggucucaaacuccuggccucaagcaauccacccgccuuggccucccgaaguguugggauuacaggcaugagccacugcaccuggccaguucuaccaaauuauguuggucaaagcaagccacaggaccagcucagauuuaaguggaagggaaaagauucuacuuuuugauuggagaaugucaaguuccuauagcgaaguggcaugagauggaagguauuguugcagcugucuuuggaaauagugugcuacagucugcccucugaacauaucaauucacauuucuuccacgugcagaauauacuuacuccucucuuagaagucuuaucccauuauggcaucaaccuggaguccaguaucuuuucauccaacuaaaguccagaugcauaugagauuucuuaggcacagcugcuccaguacagcuucuuuagaucuagaaaucugugaaugaaaauauaaguuaccugccucugucucccaucccccauccaacauacaguggugagacaggggcaagaaaacuguaguagaugcucucauuuaaaaagaggaagaauuggaagcacuguuccauagcaauuuugaaauucaucugggcacauguuacuaagucucuuaccccauguaucaaaaauauaccuugaauagccuuuucacaagauggcgcugaaagcaaagaaggaagcuccugccccuccuaaagcugaagccaaagcaaaggcuuuaaaggccaagaaggcaguguugaaagguguucacagccacaaaaaaaagaagacccgcacgucacccgccuucugguggcccaagacaccacgacuccggaagcagcccaaauauccucggaaaagcacccucaggagaaacaagcuugaccacuaugcugucaucaaguuuccauugaccacugagucugccaugaagaagauagaagacaacaacacacuuguguucauuguggauguuaaagccaacaagcaccagaucaaaaaggcugugaagaagcucuaugacauugauguggccaaggucaacacccugauucagccugauggagagaagaaagcauauguucaacuggcuccugauuacaaugcuuuggauguugccaacaaaauugggaucaucuaaacuuaguccagauggcuaauucuaaauauauguauaucuuuucaccauauacaugccucugucaauuucugguugggcugggaggccauauacaggcauugacauuguaacagggcuuggucaagacucuuguuuuacuuaugcuuuuggaauacucacccugccacuccaccauguuugaucacuccagagaucuaugugacuagaguuagcaucauaggaaaaccagaacucagaacuugccuccaugguugaggguaacaagaagcuuuagaagaaccccuuuuaucccuggaagaggcugugugugaaaccaaugcccagaguuugaaggguauuagcauccauuucaggcgaguauggguuggcuggcuuucagguagcauuuuguccucauacacccaucuacuaugguccaacuggucugucuguuucccucacuccuugugcaauaaaggacaaggacuucaaaaaaaaaaaaauauauauauauauauaccuugaauagugcccaguucugcucuuugagaguuguucccuaguacauuguuuuguaagacuauuagcucuacccuuugggcucuuggcuuucuccuucuuuuuucuuuuucauaagaaauaggucauauuuguagcugaguagcuuuucaaccugcuucuuaccuaugugaaguugggaacccacagauauuuuauuucucccauuuugaacuguuucuuucucuuuuaguccaaacuggugguacuuuuaguacgauaguuuucuuuaaaacuuugagaguuuucuaugaauguuauuagggauugauucuaugucccaaaagccacauuuauaaucccuuuccaggacagaacugucuuuacuuugggucugccuauugaagaaaaggucauuaagauucuucgaagucccuuuguauagaugagaagggucuauauuuucaaggucucaacaaaagaucuuauggacaaaccucugauuugauaucuccccagagaccauuuuuaaauuucagaucuuucgccaguuguagagacuguuuugggcccucuuuacuuccucuaaauucugcuuaaaaauuaaacagguccuucuuuaguuuauuucucucuucuccauacuuuaucauaugcagcugaaagaagccaguugguacuacuuucaguguucuaccuggaaauaucuuuagccagucaauaaguuaauuagguaaauauucuaucuuauguaauuguuaaauuagguaaauauuauugcagacaacagucuugccaaacauuccaccacuguguaacaugaggcacucucucuccugcaucuaauagcaauuuucucaugguucuucuggccuuugcuaacaacugacuuuccacuuuuucagccucugccugccaucaggucccaaaaccaaugcugcauauuuuaggcuguuuggcacuucccuuaagcaagucaaucaaagcaagucgcauauccaaggaagggaaaauagauuccaucucuugaugggaggaauggcaaauucacauugcaaaagagcauguggaaugggaugacuuauagucaucuauagaauaaucuauugcaccuaguaaguuuaaacuuggaagauuuacuauaggugagaaguuaacaagugguagccuguguauguaucuggcucacagauaugguauauuuggcuuggauagaguuuuaaugaaaaaaaaccaacauaauuuaucaucaaacaauugggagauuuuaucuagaagguuauauaucaggucucucuugaaaaauaguaagcuguuuuuguguugggccuucauuuccauauuagcuggaaauugccugauuuacucccuuucaugaccucuuggcuccuauagguauuugauuuugcaguuuuugcugcugcagauuacuaauuuauauguuaguuuuuuuuaagggaauauggugaugagcaagacagucauagagcuuacauucaaguaugggaagauggacaauaauacuagauaaauaauguaauugcacauggaaguggaauaaagcaagaaucugggauagaaaguaacuaguaaauagguaguugggguggggauauuuuagauaggguggucaggaagcccucucugaagacaugacguugaguggccuuagugugagaaggagccaaacaugggguaagaguguuccaggcaggcugagccucguggcugaugccuguaaucucagcacguuuggaggcugaggugggcagaucaccaggucaggagaucgagaccauccuggcuaacauggugaaaccccaucucuacuaaaaauacaaaaacauuggcugggcaugguggcacgugccuguagucccagcuacucgggaggcuaagccaggagaaucgcuugaaccugggaggcagagguugcagugagcuaagaucgcaccacugcacuccagccugggugacagagcgagacuccaucucaaaaaagaaaaagaauguuccaggcagaggaaaaagcaagugaaaugacccaugggugggccugggcuugggguguuugaggaaaggcaaagccgagaguauaagaggagaaaaugguaguagaagaggggcaugaacgaggucaugaaauauccuguaggacauaaaaaaacuugagcucuuauucugaguaaugggaagucauugaaggaauugaacagggcuaagguugugaugucauuuacuuuuugcaaagaugucuguagcugcugugugguaaauagacuaguggcaaaggguggaaguaggauguuguaaaggaggcuugcagucaucuaggggagguauaaaugauggggccuugaaccagggcaugguacuuuuaggagugagaaguggucauacgugguauguauuagacaggucuuauggauuauugaauaugggauaugggaaugggaggaauuaaagccaacuuugaggcuuuuggcuugagcaacugaauaaauggguggucccauggggaguucugacagaggagcaagcucgaagugggaauugagaguuuucucuugacuauuauuaacuuugugacccuacugcaaaaauaaguuugaaaaugaaaacuccuaaagugaaauuguuuuuaucuuacagcucuuuauauguguuuuuuucuucuuuuccucuucauuagaagacuuugccauuacuuggauggcauaccagcugcaauggaggaaguauacagauguauauuggaggauguauuuauauuuuaauguguagcuaucugcugucaagaauuaggcaaggagacuagucacucacaccuguaaucccagcacauugggaggcugaagcggaaggauugcuuuaggccagggauucgagaccagccuggccaacauagugagcucuugucucuacaaaaaauuuaagaauuggccaggugugguggcucacaccuguaaucccagcacuuugggaggccgagauggguggaucacuugaggccaggaguuagagaccagccuggccaacauggugaaaccccaucucuacuaaaaauacaaaaguacuagcugggaauggugucaggugccuguaaucccagcuacuugggaggcugaggcaggagaauugcuugaacccgggaggcagagguugcagugagccgagaccacaccauugcacuccagccugggcaacaagaaaaaaaaaauuaagaauucgccugccaugguggugugcuauuuugaguaaugggaagucacugaaggaauugaacagggguagugaugugaugucauuuacuuuuugcaaagaugccccugguugcugugccgugaauagacuaguggccacagguggaagcagaauggucauuuaaaauuuucuauuuauuccaauucaguguggucauaaaggaucaaguguaauuuauuauucacauuuuauugguauggagaauuaauucauuuuuacuauuaaaaaaagguggcauguuaguaaucagaauguucuaggagaaccuuccagagguuugcaacucuuagaauugaaaucacuauuuagcuaagaccagaaucguaacauaaggcaagauugaauaaggugaauggauuugaugaauuaaagugcuacuuguaaaggauaguaaauucacuuuugcauuuuagauaguagcuuuuauuguaaauuuggaugcaaaaugagauaauagcguuuucaccccuuuucaagagccauuuggagauagcauuuugacuagaucugucauucaauucagcuuagaaauaauuuauaauuuuauuuuuaaauuccuauuuuaggauauuaucauauuaucaugagauaaugauaauaccacucuaauuuuauuauaauuggguugggaggaaauagucuuuuguaaaagguuaguuaguggcauauugccauuagcauuuauuuuaccuuuuuuagaaaaugaaaaucauuacacuuaaauucaauguauauuauauagagaacauaacugauuuauaaccauguaaaauaucuugucuuacuaacaaaacguucaguuuuuccuucuuugugaaaccuugagucaaaauguacuagugaggauguuuauauuccagugguguagcugaaccagacaggucugcagcgcagugguuuauuuuuagaccugcguugccauuuuuauccugcaaaaauauucaucagugucuugcugacaggccaucaguuucauaaaugugucacauagaccagauuuuguucuuugucucauuuucccuccaacucuucuuuuccuuuugauuuguucauacaacuguuuggaggaggagaauuuuuuuuuuuaauuucaauucauguauuagaugcuucaauucuaagaucuaacagauuuucagaucacccaguucauucaucuaucugcaucugcuuacacaucucuacuuauugucugauaugagaagcuguuauagaucacuaagcugaaggcaaggaaaagagaauugcaugcauuggggauucucuucauggguccagucaguuuuugacugccuucuccauauauguuuuuauauauuuauguguaugcucuguguguguguguguguguguguguguguguguguguguguuuucguuuauuuacuugucuuacccaacaagggacuggcauaaaauauuuugcauaaaaaaaauagcugccuaagggccuagggguuaccauauguggcagaaagccauguauugaaaauaaauccaucauuaucuuuaaauacauagagcaccaauuauuuaauuuguuaggagacuguuuuaaccuguuugggcugcuaaaacaaaauaccauaaaccaaguggcuuacgaacaacagaaauuuauuucucacaguuuugaagacugugaaguccaagaucaagguccuggaagauuugguauauggugagggacuguuuccugguucacagaugguacuuucucacuguguccucucauggcagagggggcaaaugagcucucucagaccuccaaaagaggacugaucccauucaugagggcucuguccucgugauccaaccauccacaaaugcccccugcuaguaccaucaccuuguggguuaggguuucgacuaugaauuuugggggaacacaaacauucagaccguaacagagaugauguuuugauuccagaugccugagugacaaauaucaccaaaacagaaggaaaaauuccugcaaucaagagaaacuaggggcacauacuugagaauauaguaauuuuuuaacaguguauauucaugucucauuuuuauaaaaacucagauucccagagcaggauugguauucacuuaucucuguaacaaauauuuacugaguagcuacuugagggcccaauauauuaauugcuuuaguggcuaccauggcuuggagaacaggauuucugacuuguggagcuuauaguuauuuuaagaggaaaauacuucuauguauauuucacagacauggcaguacagcauacuagguaagaguauaggcacuggagccagaaauuugcauuuauaguuugugccagucauuuccuaguuuuguuaccuugagcaaacuguucagcuuuucugagccucaguuucuucaucucuaaaauugguauguacuucagaaauuauugcaaagguuaaaaaagaugaugcuuguuuagcaaugugcuaaaaauacugaacaucaugccuagcacauaguaagcacauaauaaaugcugguuaauucauaauaacaguaauaacaaugauggggauaacaacaaauauucuaugcauauucuguaaugcuuuaacaucaggaaugucuucagcuguaaguaacagaauacacaacuaugguggcuuaaacagauaaggauuuauuaaucuaacaagucugacauaggccagauugaauauuaauuauucaacaauuuuuaucaauaaucuauaugccagcuacuauucuaggcacaaggauucauccauuaacaaaaugcaguuauuccuguccucaugaagcuuacauucuaauuggggagagagacaaaaauaaacaaaacaauguaauauaaaaaugguaaguuauuacuauguuagaaggugggcuucauagaaagcuuugugaaggagggcccauuuauguuaggccauaagggaacaacagaguuugaauaaaugaggcuaggugagagaaagacacaacagaggaacagauaugagaaaaauggaggagccauuuugagccaucucaaaauggaaguuuuggcaacagugcuuuguuaaucaucaaguaaucaggagccaugaacgcaagauuuuucucagauuucuaaaguaaaagauuucauguuguuauuuucacuuuauguaacaguuaacaaucaaauaauaauagugauaguaauauguagugcuuacaaaucaaacguucuacuuaauacuaaugauaauaaaagcauauggcugacacuuacguaaugcuaauuagguaucacacuagucuaaggauuugguauucauauccuaaucucuguguuaaguacuaauaguauucccauuuuacagauaaguaaaguuagguaguuugguaacuuggcccagguuuauuugcccuuagugucucuaagggcgauaagaaaagagauaacuggagagauagccucucauuccauaauccaggggauagagugggugaggaaauguucagggaauauaaguagguuuaaccccuaaagcccgagcaaaggaagaaaggagaaauugagggcguuaguagggcuugagauggcucaucuaaacaguuacccacaauuuccacaacucuggcagaaauuuaccauuagaugagauuagguccagagcuuuaucauauuucagagacaggcuuuccaaugcuaagcaucacacauauaccuuacccagcagggaccauuagaauccuuuucucauagggagagugucuuuuguuguuuguuucuucacuugguuaucucuuaaaugaaagaagaauuuuccaauuucaacaugagcuuucaaauggaccaaauucucaagcauauuuagguugugucuaaauaguucuuauagaacaaauauuaugauaugugcugccuguuaaaauuucugucuguauucauguacacauucuaugucuaauuagaagcugccagccuugucaaaauacaaguaugguccacuguuaaaaccugauguaagaaaauauaaauguauaaaaauaguuaaaguugggagguggggggccauggagaguacuugcauucuaaaaaaauuuuuaaggcuuccauuaauugggaaaguuugcuuuacauaauaauucaaagaauagauuuuauuuauguaguauaaaugugagaccacaguuauuacauaaagggugaacuuacuuaaauauacuuuauauuaaggauucagucaugguacaaugccaugcucauuuucagugaacaagacaacuguauacucagauagcauaugguagaaagaacugaggcaucacaggccaagaggcccccugaagcugaauguggucuugcuggugcuguuagacugaguagcccuugucggaagaaaugguagauuccaucagaaaauguucaauguaaaauauuacagcaguccuugugauuuucaguagguguuucccaagcuacucuuacguuauugggaucagcuaacuaaccgaagguggcuguguucuauuuaaauaaaaucuugaguuuagaagguuucaggggagucccaguuuagagggaacuuugugugaacuuugauucuguuugaaucuugaucaugcuagagaaauaacucaugaauauaaggcuuuuuuuuuuuucgauagggagucuugcuauauugcccaggcuggucuugaauuccuggucucaacugauuuuccugccucagccuccugaguagcugggauuacaggcacacaccacccuaccuggcuuauaaggcauuuuguugauauaaauucccaucauaguacaaaccaccaucucuuaaugcugaguuuuacaacuccuucuccaaguauuugguguuaugguaaaacaguaggaaaaaaacacaacaauucacccucuuucuacccuuuaauccauuuuuguuuuuaaucacaccuuuuuuccuccacuuugccagugugcuucuugaucucagguugggagagaugaacuauggcaguaauguauagugggcaguggacuccccuuucuccagagaugguagaguagguuuggugcuuuuuuguuuguuucauuucuggaaaacuugaguuuauguguuuuucugucugaggcuuuaaauacaaacugaauuaagcagacaucucaauuguggcaguaaccacaugggggcuugcauagugugauucuguuuuuuuuuuguuuguuuuuuguuuuuuuguuuuuugagaccgaaucuugcucugucacucaggcuggagugcaguggcacaaucuccacucacugcaaccuccgcuuccuggguucaagugauucuccugccucacccucccaaguagcugggauuacaggugccugcaaccacgcccagcuaauuuuuguauuuuuaguagagaugggguuucaccauguuggccgggcuggucaugaacuccugaccucaggugaucugcccaccuuggccucccaaagugcugggauuauaggcauaagccauugcaccuggcccaauucuguuuaacuaauauacagaauauaauuuuauuugaauuuuaaacuauaaaaacauuacacaagaaauauauuuacuuauagaaaaauuagaaaauccagcuaaguaaaaaaaaaagaaaagaaaaauuauuuauauuccucuaccuagagguaacuaccaucaacuuuuuggucuguggcucuuuuagauucuuuagauuuuuuucccaaaacaaaaaauggcuacuguacuuguuacuccucccacuguaucugggaaucggauuauuuaugagcuagauuauugguaaacuucuuuugacucaucauuaggugaugauccuuagaaauuucaauuaaagaucuucuggagaaauaaacauuguuaaaacaaaaauaguuaauuuuuguuaauuaaaaaauaauccauuuuuucuucacuuggcuguguaucauagacagguuuucacugccagucaccauucuuuggugccauaauuuuugauaacuguauuguguucuauuguacugauaugcuauaauguguaauauagauaugcuacauauaauauagauauaaauaaggguauaaaagauuaguaugcaccauaauuauauacuauaucuauaugcuauuaugugugcuauacaugcucuauaauuacauauuauaauguauuuaguggccccuuaugguuucaauguugguauuguaaacagugcugccacauaccagcaucuuaaaggucuuguucauucugaaaaacuaaaagggaaaggcaauagaguagcaacuuaguaagggccagcaaauggcauagaaaguuaugacauuuaaagaauuguuucagauguccuugcaucuuagggaucaaugacaauuuaaguaaaaugaggacuauuguacaucuaauagaauuuaauaaaauaccaaguuuauauguuuaguaguguccuaaucuugugaagggauugaagguguuuucaaaauguuaaauagcagauaguauuaauuuuuaaauuaauuaauugcaaaguaggugaguaggucuguaacagcacaacuauaacuucaggcaucagagaaguuguuuuuucucucuuugagcucuaguccagacaguaaacuucguuaaguaauuuacauuugaaacuuuugcuggagaccaggaaauuucuaugguauguuuguagaauaaaaagccauguaaguaaauaaaugaaaucacugaaaagugcauaagaggacgcuuaaaucagacuuguauuaaaaguucuauuugugagagguagcuucuugaagggaggaaaguaugcuuucuuugauuccaugaagcucacagucaugcuguaccugcugccuauccgcugcaucugaaaggguagcuuaucuaagaaguugaaugaaacaaacuucaaaugauaaacagaaaguuauuucaucagucuuuaacacuuccaccuaaagguucacagaagaaauaaaagucauagagacuagccucaaguuuuccucuuuucuuguuaaaggucugugggagagaagguaaaaauaaucaaaacauuuuucuuuuaauucaguuauucauguucuuucuauuuuaaauuguugaagaugagcuagcuguagguuuauuguuuuaaaucacagcucugacuugacauacuguuuuuaaaacuuguggauguguguguguuuuuuuuuuaauaaagauaagagaagucauuacuuugauuuuauauucaucauagucauggacucauagggucuuggguguucauuuaguuugcaacuacauuguaaagaugcugaaacuaaggcucagaaauauuaaccacugguccagguugauuuagcuagcagaaccaggaccagaaaauagguuuucugacuauuggucaauccaccacuauuguauguagaguauaaucucuguaacugagaaauauugugcuggauuauaugaagccccuuuaaaaagauuuaucuggaagugaauuucacugaguguucauuuugaaaagucuguuaguuguuaaguuguuuaacauaauuuuauuggcagucuggggguuuaccaaaaaguagaaagaggauccagcaggauguuguauaacaagaaggaauuguguugagcuuccaugguuuugacuucucagggaugagaaaaaaaaauuaguugagaauaaaugagcauucuuccuuucuuuucucacauuuguuguugauacuaccauuauuuauuucagucuucaagauauauaaacuguuuauuaaacuaucuuuuggugaggcuguuuugaaguucuugacuaggccugagugagucaggcaugacaaguagauuuacuugauuucuccuagguguaaaguaccuaggggugugcugggccucagcaucaguaugcuuaaacacaugccuuuaagauauauuuaauccuuaaagaaaagguaguuauucaccaggagacucuggcccaaacauaggacuuuauuguaguguuagugugauaagcaugguggcuuaaaaggagaauagcuuucuaaaucucauuucuaaaucucuuagugaggugagacagagugaauaaaauccagggucucuguuuuuggagaauuugcccacuucuuauaugaagaauauuauuaaauuuuuuuuuuucgagacagaguuucacucugucacccaggcuggaguacaguggcacgaucuugguucacugcaaccucugccucccggguucaagcgauucuccugccucagccucccaaguagcugagauuacaggugcacaccaccccgcccagcugauauuuguauuuuuaguugagacgggguuucaccauguugaccaggcuggucuugaacuccugaccucaggugaucugcccgccucggccucccaaagugcugggauuacaggcgugagccacugcgcccagccuaaaaucuuaaacuggaugaauuagguugaaauaagucaaauaaucuacauuagaccuucccuuauguuuaucuggguggauauaaauguggaccacugaagauaaguuagcuaguggaauuauaccagguagaucucauuacaccucuuucacuuuuauuagaccugaguuauauacaguauuucaagggcacuuguguaguagacaacgauuguccuacugguguguuugcauacuguuuauaacuaaggagauguuuaauguaaucauguugacugaagaacaaaaagggucauaaauuucgaaaggagagcuuuauuucucauaaaggguugcagccugcagguuggucauccugacaagcugggaagcaaagccucccaccagaauuuggaaacagauacuuccagggaggggcaaagggaacaggaauuuaugcugggcaggguggccaaauauauauguucaguaagcucuaggaggcaucaugaauauucauggaaggagaaaauguacacaugugcaauugagcuucagaccuuuccauggcauggaacccguguccaaaaaauggcagcauuagcaugaucucgggguggaguuuucgaucuucugacaucaaaagaugaagcagagcacacaaaaaccuuuacugugcuuccucuguagacuggccagaaccacucuauaugguuuggcuguguccccccugaccuaagucucaucuugaauuguaguucccauaaucuccuuaaugugguaggagggaccuggugggagguaauugaaucuuggggugguuaccuccaugcuguucuccugauagugaguucucaugagaucugaugguuuuauaaggggcucuccucugcccuuagucuguacuucuccuugcugccaccaugugaagaaggauguguuugcgucccuuucugccaugauuguaaauuuccugaggccuccccagccaugcugaacuaugagucaaugaaaucucuuuccuuuauaaauuacccagucuuggguaugucuuuaucagcagcgugagaguggacuauacacacuccaugguuggucucuuaucaggaagaaaugcugcugguuaguuguuuuguugaaacugcaaaaggaaggggcagcaguuaggcuauugguugcagucagcgguggaucuuuuuuuuuuuuuagagacagggccucugucauccaggaugaaguguuguggcccagucauaacucacugcugccucuuaacucuuaggcccaaggaauccuccuuccucagccucucgaguagcugggacuacaggcaggugccagcaugcuuggcuaaccuuuuuuauuuuuuguagagacagggucuugcuguugcccaggcuggucucgaacuccuggucucaagugauccuucugcguuggcuucucaaagugcuuggaauuauagaugugagccacugugcccaguugaaguucacguuauuaauuaacuaauuaauuaauugacagucucuguugcccaggcugaagugcaaugacaugaucaugguucacugcaaccucagccuccuggcucaggcaaucgucuugccuuggcuucucaaagugcuggaauuacagaugugagccacaaugccuagccucagguuguuuaaaaaguggcugaugggaaugaggaauaaagaaaaaugucauucucaguggugaagagugacuugggcacaauaugaaacugauucccuggcauguuguauuugggaaauaccagguggacuguuugaaguuaaaacguugguuaaagguaaugaaaaauaaaguuggauucagcauuaucagauuaaugaggaauccacucuuuggaguauuugugugugcacagugcauuauugcugaaugcgucuguuauagguaguuccuaguuuauaaagcaauauuguauuguaucguuggguuuauguuguggcgaucagauuaugaugugaugagugacaagucauuuaaccucucugagauugucacuucuucuguuaaauuagaugcuuuaaucaggucuuauuaucuaccacccuccuaggguuguuuggggaacuacugauuguaccuuauagaguguugggaucuguuaaaacagacauugucuguaaaguaucugcuacuguguuuggcacauguuaggcacuugauacauuuagauuuaaauuuuaaaaggcuguuccacccauaggagcaguccgaacuuaggauucucuguauucuguaguguaaauugagugauacauugaauaguuuuacuucccaaauucaaggaaugauacaccaagaaaaauagcaauuucugucccuuuccugaucuagcccuugguaaaaagcuaaucuuuaguaacuuuuaaaaaaagggguuuagggggaauucauguggaggucagaguggaagaaggugugagagggcccagcagaagaaaacuuggcugccaaaguguuugaguccauuggcaaguuuggccuggucuuagccguugcaggaggugugguaaacucugccuuauauaauguggaugcugggcacagagcugcgaucuuugaccaauuccauggaguacaggacauuguaguaggggaagggacucacuuucucaucccauggguacagaaaccaauuaucuuugcuguucucgaccacguaaugcuccagucaucacugguagcaaagauuuauagauugucaauaucacacggcggauccucuuccggccuaucgcuagccaacuuccucauaucuucaccagcaucggagaggacuaugaugagcgugugcugccguccaucacuaccaaaucaagucagugguggcacgcuuugaugcuggagaacuaaucacccagagagagcuggucuccaggcaggugagcgacgaccuuacggagcgagcagccaccuuuggguucauccuggacuacguguccuugacacaucugacuuucaggaaggaguucacagaagccguggaagccaaaaagguggcucagcaggaagcagagagggccagaucugugguggaaaaggcugagcagaggaaaaaggcggccaucaucucugcugagggugacucuaaggcagccgagcugaucaccaacucacuggccaccgcaggggacagccugaucgagcuguguaagcuggaagucguggaggacauugcauaccagcucucgcucucggaauaucaccuaccugccagcagggcaguccgugccccuccagcugccccagugagggcccacccugccugcaucuucacgggccaacuggccacagccccgaugauucuuaacaccgccuuccuucugcccccaccccagaaaucacugugaaauuucaugauuggcuuaaaaagugaaggaaauaaagguaaaaucacuucagaaaccccauccccccaaaaaaugggggggcaggguuaaaagaaauucaaguaaaauucucauuacauaaaauuaaccauuaacgaauucacaguguacgauucagggggcuuuaguacauucacacugcugugcaacuuucaccucuaucuaguuucaagguauuucuaccaccccaaaaggaaacaccauacccacuaagcagucccucucuauccucccauccacagucccuggcaaccacuaaucugcuuucuuccucuauggacuuaccuauuuauucuggauguuucguguaaauagaauacauuuugugucuggcuucuuucauuaagcaugauguucauauauaagguucauccacauuguagcauguaucaguacuuaaucccuuuuuguggcugaauaauauuccauuguauguauauacuacacuuuguuuauucagccaucauuuguuggacauuugaguuguuucuaccuuuuggcuauuggcaguggugcuguuaggaacauucauauacaaguuucuguuugaauacagguuuucaguuuugggggcuauauaccuaggaguggaauugccaggucauaugguauuucuguugaucuuuuugaggaacucccaaccuguuuccuucaguggcugcaccauuuuauaguucuacuagcaauguacaagggcuuuaauuuccccacauccucaccaacacuuaauuuacauuuuaaaaaauuacggucaaccuagugugucacuguaguuuugauuuucauuucucuaauaauguugagcuuuuuucuuaugccuguuggccauuuguauauccucuuuggauaaaugucuauucaaguccuuugcccaauuuuaaaauuggaucaucauuuuguuacugaguuguacaaauucuuuauauauucuagauaauaaaccuuuauuauauagaugauuugcaaauguuuucucucauucuauguguggguuguuguauuaguauguuuucacacugcuguaaagaacuaccugagacucugucauuuauaaagaaaagagguuuaauugacucacaguucugcauggcuggggaggccucaggaaacuuacaaucaugguggaagaugaaggggaagcaaggcaugucuuaccugguggcaggagagagagaucgagggggaacugccacacgcuuuuaaaccaucagaccuccugauaacccacucacugucacgagaacagcaugagaauuccuauuuucaugaggccccuuccguguuacucccacauuuuggguauucccaaaggaagccacaaaguaguuugaaucagaucacacugaggcauaaagauugauagccuuuuaauucuuauacauggguuugcauuuuuaaagaggauguggcauuaaccaaaaugaaucauuauuuggaaggguuuuuaguuaaccaaauaaagugaaaaaaucaggcagaaggcauuuuuggguuauggugccaccagaaggaaucgcagggccuugccuggaagucggcccaggggaguaacugccuuuaagcaaaucugcuuuucacaguuuuuuuuuuguuuucguuuuucuguucuggaccuauagaugcuuugaauuuuuguuauuguuguuguuuggguuugccaguuuuuuaagugacaaguagaacagucugcagugucugguugggucaaaagaaggggaguaaagagucgaagagagggcugcucaguggggaaccugaaaggacugagugggaaaaaggggacucuguauugggacaggacauuuguaaacugggcauuuucuuucuauaauaaucuacuguucuugaagaaagaugugugcuuccucauaccaugggauuguggaaaaugcccacaauaucuggguguaugcauaaacuaauauuuuucuguaaaauuauuuuuauaauaugauuaggagaacaaguuagaguggucuuauauugcaucacuuucacuguuugucuuuaauaaaaauggaggaaguugcugcuguuuuauuaacuugcacccugcaugcuucucuucuuuguucuuuguuaaauaugagcuggcguguguuaagacuacguuagcauuugcucucagggacuucugugguuucuaaauucagcacugcuaagccccuacacuguuugccugaaucaguugagacugcuauuuuuagcaacaaaagggaauugaaauagcaauuuucuuuccauguaauagauucccaagaggaauacugaugcaagcucucuaucauuuucuauuccuaccacccuccucccaaagcccucagaggaaaggcagcugucaugguuugcggcaguauuaaucuuuaaucaaucgaguguuuucugcauucagguguucggggggaaaaaagagucacaagaaggaaccuguuuggaauaacuaagcucuuaggcauggacuuuacagucagaauuuuguggguaguggcagggaauagacagaagagcuaaaaauagugaguuugcuuccaguguugcucuagucuauuuuugauguuugauuuugauaagguugauuggguucuuacuaaaaauaucuguuccuagcaaguugaggacaaaaagaguagaauauuuuuaaccuacacaaacuaaaguauuuuuguugacuguauaaaaucuggaaguggagcccuggucaguugccaguauuuuauauaaucuguagcaagcuagacacuucuggaugccaaguugggcuauucuuuauaguugucaguuuccaucuucucaaaggcuuguaaauuuggguucuaguguuauauuuguguaugaagacauaagccuuuuuaaaaaaucuuccuuuuuccacuuuccuucuuuucuuccucuaccuuauagugccacccaugaccaucaucuguacugucccaacccacaggguucugggugauaccauauagcuuuuuucuguguauuguuaaaagcuacccuaacuuauccacguauuucauagcaaaguggaaucugaggacaccaguguuaaaugaagaagcaaaucuuagagacaagaauagugaacuguccggccaggcgcaguggcucacgccuguaaucccagcacuuugggaggccgaggcagguggaucacgaggucaggagaucgagaccauccuggcuaacacggugaaaccucaucucuacuaaaaauacaaaaaauuagccaggcaugguggcgggcgccuguagucccagcuacucgggaggcugaggcaggagaaugaugugaacccggcaggcggagcuugcagugagcggagauugccugggcgacagagccagacucugucccaaaaaaaaaaaaaaaaaaaauagugaacucucacuacuuugguaauuuagcauguuugguaaagcauguuuugguaaaacauguuuuagcauguuucacuggcacauuaugagugaaguaguucucucuagcacugaaaaucaucacuugucucuuuuuuuucuuugacuuuuaaguucagggguccaugugcaggaugugcagguuuguuacagagguaaacaugugcuauggugguuugcugcacaggucaucucaucaccuagguauuaagcccagaguccauuagcuauucuuccugauacuuucccucccccaacccccacccccuccaacaggucccaguguguguuguuccccggaaaucaucaccuuucaaggacagccucagaauucuuugaaagugcaaaucuacagguuuaucauaaaguuaaacuucucucuguuaaaguucuugaaaaucucacuuuuagaugauucuugacguugagaggaggcugaagaguguagggguuguguaauuauuucuaaauaagguguggaaaaagcaguggguagggucauaaaagguuaguuuuccuuuuauaaucuccauucauucacucauccauucauacaguaaaaccucauuaaucaccugcuuuuugccagguucugugcuagcaguuagacugugaugauccagacagacccugcucuuacagaauccugugugaugaaugucaugaugauauuguccaaaggacgaccagcauggcuagauaguaggaaagagaguuuuauuggcaauaucaguuugcaaaacagagagucuccagcaugaaccgaaagcacucuccaaaacaaaaagaaaaaaacuagagguuuuauaaaaagaagaaauguuaccuauugcucuuugagaaaguucacuggcuuuggguaaggguuuggggaacuggcaaguccugauuggugagcaacugcuguggacaaaauuaguuccagaguugcagcaaacauagauaaaacuggugucagguuacaacgagcaguuucagcagucaagcuugcagagaauuacauucuuggagcaauguuuuguacccuaagggcuuuucccccuggcuucuugucucuguuucagucgggugugacaagagugacccaacuggcaugaucagcuuucacaaagggggaguucggaguacuauggggcagagaauucuguaugagguucuaaguuagucuacaggucaaggaaggcuuaaugggagaugagacgguuuaacugaaaaaccucaaggaugggagggaaacacagcuagaagugugucuuaguucauuugugcugcuauaauaaaauacauaaagaacagaaauguauuuucucacaguuuugcaugccaggaaguccaagaucaaggugcugguaaguucaguugucuggaaagggauacuguguguuuccaggauggcacccuguugcugcauccuucgaaugcuguguccucacagagcagaaggcagaaaguuggcugaaggaacacuucaugaagauucuuuuauaagggccuuaauuccacucaugagggaggagacuucauggccuaaucaccucuuaaugucuccacuucuuacuacugucacauuggccauuaaguuuaacaccugacucuuggaagggacacauuaaaaccauagcagaguguacguuggagguguagagaacauuuucgaagagaaagcauguuaccuuggaggaacuguaaaaauuucagcacaacuggggcaugcuugaguggaaggaggaaagugguaggaguaaggucagcucauggaagaccuuguaaagaaugaggggagugagaagccagugacagguuuuaggcagggaagugaaguucagauuugcacuuuggagugauuguuuuggcuacaauguagagauugaauuggagaggaguaagaacgggaccaggcgaaugcguuagaaggcuguuaacaguaguucuugugggagaugaaugaugguagcucuaggugguagcaaugggaagaagugaaugaauuuguguuucaguuuuuauauaguuggcaaaagggaaauguaacuucuuggcagagaaaaaaugguguuugagaaagauaauuuuuaacuguguauagcaugaauugagugaggagggaugaaagauuccucguacaaguccuuguguuugggaugauagcguagauugggguaguaguugugagaauuaccuggaugauaucagugacauaccuugagcaaauauucuuauaaugaugugaauauuauuuuguuuucauaauuuauuuuauugaccguuuacgcuuacuuuuccgggccuaucauaguugcuuuaauaagacaaguuuauuuuucacccacuuuaaagacuagaacuuuuguauauguuugauuccuuaugauaaacaguaaaagaagaaaugauugggauuuuaaaauggcgugguaauucagugguguuaucagggaccuugauuccuaugauacuguuccauuaucuuagcccauggcuucaacccuaagauuacuucaugguucaagagacuacugcagcuacagccaucacuuuagaauugacuagaugaagggcaaaaggggccugucucugccaagucagcuuccauuaagcagccuuuuucaaaguccuucacaaccuugcuucauguuguucccugaaauuaaucauauggccacugcuagcugguagggagguuggaauauaaguccuuauuccaggccacaauaugcuggguuaaaaaucaguauucuccugcaaaggaagaagggaagaauggguauuaaggaaggcaaccagcaggcucuggcccagaugugcauuuaacacaugaaggauggccuccccaggguaguuuuugcacauuguaucuuaucauuucaguguugcugugaaugcuucguuuuuuucauuuuaagaaaccacaaaaaacaagcaguacuucugauuuggaugacuuggaagcuggucuuuguuuuauuugguuuucauugaaaauugguauuauaagggugggaguguuuagaucaguguuuuccaaagaucaaccaagagauuaucuuagguaccacauugauuaauauuuuuaaauuuugacauucauauguuuuuuacacuaauagucuauguuaauugaaacugaugguccuuuauaagaagcaauuaaacaguaaucaaguaaucaaguuuucuauuaaauuuuaguuaagaaaaaauuucaguuuuaagaaaacuuaagugaccuugagaaacacugauuuaaacaagacuacccugauuuuggaaaauuggaguagaugaguuugcuggcucaguuuacaccauuuuucuauucauaguagcaaaggacuuuaaaaaaaaaugcaguacaugcacaugguuaaaaaaugcaaagaguuaaaauaaugauaaaaaguaaucucuuucccaucuuucccuaaucccccagaagcaacuaucaauagacuuuugauuugagauguuauacuuugguuuaccuuucuaaaauuuaugaugaagaauugacuccccagacaauauaguuuaauuuuaaaauagugaaaaucacacuauuauuuuauaaaaauaaaaaauuauugaacuuaacugagggauuuucuuuuucuuuuucuuuuuuuuuuuuuuuuugagacggggucucgcuuugucgcccaggcuggaaugcaguggcgcgaccucggcucacugcaaccucccccucuuggguucacuccauccuccugccucagccucccaagcagcugggacuacaggcgccugccaccacgccuggcuaauuuuuuuguguuuuuaguagagacaggguuucaccacguuagccaggauggucuugaucuccugaccucaugaucugccugccucggccucccaaagugcugggauuacaggcgugagccaccgcgcccggcaacugagggauuuucuauccaacuacagcugcuaucucugcuacuacuguuggaagacauauagcuuuaaggcaaaggaaauauauauauauauauauauauauauauuuuuuuuuuuaaauugagacaggaucucacucugucacccagguuggaguacagugccgcaaucauaacucacuucauccucaacuuccugagcucagaggauccuccugccucagcuucccgaguaggugggacuauaggugugugcuaccacauuggcuaauuuucuugaguuuuuuuuuguaggauuggggucucgcuauguugcccaggcuggucuugaacuccugagcucaagcauucuucccaccucagccucccaaaguauugggaugagccacugugccccaugaaaauaccuuuaaaaccaaaagcaggacaacccuuauucccacugucuuaaauaaacaaauuugaauuuuuuccauguuuguugaguaggacuuuuucuuucauaauugacuuaaacuuggguauguuuguauguuauugcaaauauaauacauuacccaucauguaacuuguagaucuaaaggcuuugucauuuccuuugcuggggaaaugauacuuggucucccauugccugaccacuguguauaacacuaauuauuguagaacuacaguggugcuauagagauggcuaagagaggcccaggauuuccaguuuuuuuguguguguguuuuuuuuuugugcccauaaauaauuuuuacacuucucuguuuucucagaaaaaauauuuacuugugagguaauauuugacuuacauguaacugggcaguguuggauuugguuuugagaaguaugagaaaauggaaaaaugauauuuuuaccugaaauaucagagguuaaauuuuuaauauuuguacaauguaaagucauauuguuucugcuuauauuuaaaguccuaaccaugaaauggguaauuuauagaauaucuaauaucgaauguggaccauuguauucucgauagucauacacauaauaguuucugaagacuguuaguuucacuuaaauuugauaguugcuagcaggagauaggaaaaaauguucuugcugggcauaaaucuuucuaaguauguuuaguaucauucucaacuaaaguuaguguacuuugguauaauaugcuuaagaggaaccuugggugcuucuaguuuuaaaaugaugaaguagcaauacuuuugaccuuucaucucuuggaaauguucucuaaaggcuggaagaauaagaaauggaaagcuccauuuugaugcaacuagggaacuucugucaucccucauccccagucacagcuauugaaggugguggagugguaacugacuuccagagcagacaccugaguccucauaguggggccaccauugggaaacaagcaaguuuugucccuuggaucccagaacagcacaggaauuggaaguaucagguaucucaaaagacagggguggggcagaugugcuugagacucagggaaauuaagcagcagaagcccuaagaugagacaccugacugagaacagaggaugaguaaaacaccugcaaacuaauaacugcccagcagccagaagacuggaaauuagggaaugcuuuuuaagagacacugaagggccccacagaagagacagauacugacuuuuguggauuccccaaugacaaagcugauuggcccguugauugcauuguauugagggucacaguguaaucaccucaccuaugaacucuaaucgauauuuuaaugcagccaagaugagagugaccaaaacaaucaagaaggaacuuagaggaacaaaauauaaagaguagaagaaaauguaaauguguaaacaaacuauaauuaauauccucagagauuagauaauggaucuauaauaagaacaagaugcuguuaaaagcgagaaggagagugagagugugcaaaagggcagucggaauauggaagauucuucaaaguagcaaaauugacaaccuacauuuaaaaaguacauagaugguuuggaagauaaaguugaagaaauuuauaggaaaguagagcaaaaagaaaaguaagauuaauagagaaacuguuaaguccaaauuccaauuuauagggauucuaggaagagaaaaaugugaggcagauauuauuaaacaauuaacauaagaaacuuuucagaacugaagaucaugaauuuuaagacccaccaaugccuagcaccagugaguggaaaaacacccacucauuugggugcauuuucaugauggaguucuacagacuaagugauaauuguaaaagccccaaugauaaaaaaaaaagcagguuacauagaaauggugggaaguaagaauggugaaacauuuuaaaaugauacuugcguuagaagacaacggagaguugucuaaaauuuuuuuguuaaaaaugauuuccuacuuagaauucuauacccaguuaagcuauuauaugugugguuagaaaauagacuuuuuacaaaaagauauacacaauuuaaaaaauguugucuuuuaaacugucauauaaggagacaugaugacuaaaugugguauauccuggauauccuggaugggauccuagaucagaaaaaggacauucaguaacaaguaaggaaaucugaauaagauauggacuuucauuaauuguaucaauauugguucauguguaugugagguguauucaggaauguucucaggaauaacaccugugaggaagcaaaagaagcagaauugagcagagggagaaauugaacuaugaugcagguauagcaaagguuguagcugauaccauuggcccugaacauaggauggcucuagagagaugccuaaaugagguaagggagcccaaccuuugucccugaguguggccucgccauuagacauguacugcccaggggagcaaggcagcccgccuuuggcugagagcaguuacugggagagacucaguccugagcuggcagcagguaacacuccuggcaagaaaggauugauugaguaccucuuugccggaagggaggaucuggcuggugcacuaacaguauccauuacaaacuccaacaacuggagaaucaggaaaaggaagacaauauacaugaggcagauuucagaaucucuagaccuggcauauucuggccuuucuaagacuguuuuuaguuuuaugguaugcugguuuuuagaucagcccaaaguuggcaauuuuaaacauggauacgcacaugcaacaguuaucuguauucuuuugaaagagauuccagucaaauguuuagaugcacaguacugagugacuuuauguaguuucauucuucagcauauuuucauuaagagauuucugagcccuuaaucugagaaaucuagugauacugccaucaauucauugcuguaaucauauauauagucauaugucauuuaaugguggggauacauucugagaaauguguugcuagacaacacauuuguuguuguacaaacaucaacagccuguacuucuacaaaucuagaugguuuaaccuacuguucauaccuagguuauaugguauggccuaaagcuccuaggcuacaaaccuguauauaauagcauguuacuauacugaauacuauaggcaguuguaacacagugguauuuguguaucuaaauauauccaaacauagaaaaaguacaguaaaaauaugguacaaaagauuaaaaagggccaaggauggugucuuaugccuguaaucccagcuuuuggaaggccgaggugggagcauugcuugagguuaugaguucaacauagcaagaccuggucucuacaggaaaaaaaaagguuggucagguaugguagcaugugccuguagcuacacggggggcuaagacaagaggaucacuugagcccaagagugagaggcuguagugagcuaugaucacaccauugcacucuagccugggugacagagcaagacccugacucuuaaaaauaaacaaacaaaagauuaaaaauggcacaucugucuaggacgcuuacugugaauggaaccugcaggacuggaguuuuucuggguaagugagugagugaguggugagugaaugugaaggccuaggauauuacuguagacuuuauaaacguuuaauacuugggcuauacugaauuuauuuaaaaauuuuuucuuuaauaacuagcuuacuguaacccuuuuacuuuauaaauuuaucuugcuuaucuuuuggacuucuguaauaacacuuagcuuaaaaaagaaacacauuguauacuguacaaaaauaucuucuuuauauccuuauuccauuuuuaauuuuugaaauuuuauuuuuuacuuuuuaagcuuuuuuuuguuaaaaacagagauauaaaacauacacacuggccugggccuacaccaggucaggauccucaauaucagugucuuuuaccuccacauuuugucccauuggaaggucuucagacucaaucacacacauagagcugccaucuccuaugauaacagugcuuucuucuggaguaucuccugaaggaccugccugaggcuguuuuacagcuaacuuuuuuccuguaaagcagaaggaguauacucuaaugugaaaaaguauaguauuauaguaaauacauaacucaguagcauaguuguuuauuaucauuaucgagcacuauauguuauauauaauuguauguguucuacuuuucuauuacuggcauaguuguagguuuguuacaccagcaugaccacaaacacgugauuaaugcauuacguuaugacauuaugacagcuacagugucacuagaugauaggaauuuuccagcuccauuguaaucuuaggggaccagagcuguauaugugguccuuuguugaccaaaacauuguuaugcagcugcugacuguaugugguuugcuugcuccacaguuguaggcuuaaugcagaauaaucuaguuaccaacaggauuuguaaauaggucaguggcuaauagguguuaguguaggaaaguguaagauacuguacuuguaaauaaagacuuuugagaaaccagguugucaggaaaacuguccaagucuugcguguuuugcaacuuuuuagaccaacuaaaugccgaucaucauuuaaacacuuaccaaaugucuacugaacaccuaccuugugcauguugccuagcaaggagacuagaaucuuacagaagaauuaagacauguagauguaaggaaauacaauucaaaauagagugguaaagugccauagacuuaaagaugugccaaguguugugggaguuuagaaagaggaaguuuucuuucacguaaagugaucuagaacagugaaguugguggaucuucaauaaggcuuugauggaagaggguaggaggugagguucuguguuggaaacagggcuuguggggugccugcauaaacugcccauaaaaauaggggacaauaaguucuggaaagccacaagaggccucugaggaggaaagccuccuaauugccaucauguucccaugcucagagugagagcugcucucuuaucuguaaacacuguguucaaggagaaagacacuccuuugaagcguuggaauguggacagauaugcaggcuccuaguuaagccuacucccaccagcuacucuucgauaaguuaaagauaugcuguuugaacacaaaggagauucacuuaaaccgccacugcuauagauuaugugcaugacggacugccuuccauucaccauuuugcccugaacgucugcuucuuagaucuaagugacuguacucaauaaaaaguguggagaccagagcucugagccuuuugcagccuccauuuugcaauuggcucucuggcccccacucuuuaugcauucuuaaccugucucauuccuucauugccacuggauuuugaguacccugcgggugguguugaggcugguccccaacaguucuggggucuuggagaggggagaaaaguuuaucacagagaaaaggaagaggagaaaaguggaaacaauuagaauauguguauccaucacuuaugaaauguuagugaaucaauaacaagaauacaguauaaaauuuggauuccugugccucuaaaaacagucgggagaugaaaaguuacagaaaauuauguucauugcuacucuagucacaauaccaaagacauggaauuaguccaggugcccaucaaugguagauuggguaaagaaaauguggugcauauacaccauggaauacuacacagccaugaaaaagaauaaaaucauguccuuugcagcaacauagaugaaauuagaggccauaaucuuaagcaaauuaacacaggaacagaagaccaaauacugcauguucuuacuuauaagugggagcuaaacacugagcacacguggaaauaaauaugcaaacaguagacacuguggucuacuagaggguggagggaaagggggugaguugaaaaacuaccuaucagguacuauccucacuaccuguguggugggauauauacccacaaccucagcaucaagcaauauucccauguaacaaaccuccacauguacccucuauaucuaaaauaaaaguugaaauuaaaaaaacaaaaacaaaaguuaugaauugaucaugagguuggaggagauuuuauaagaugcucaguuuucuguaauuagguucucccacaaacauuuaaaucuguuaguuacuaauguuuccuauaaacaggacaauagugacaaaaacacauggguuaccuuuggaagaugccagaguaccaguuuauuuugaaaacugauaaauaaaggcaaaaaaaaauucaaacauuuaucuuguguucuuaugcaaucuauauaucaugguaacuaacuaaugaggaauaauuugucucuggaaauauuccagcuaauagaugaagaugaaugauugaacucuaauaugaccauuuugcaaccccuaaugaaauaauggaucucaguggugaccagcaguggcugcuaauauaacaaaacaaaagauaaccagacauaugcuuccugauguaaaaaugcauuaucccuuaugaaguacuccuaccaaaaaaaucaaaccugaauuugaucaauaucuauauccaaccaccaugggacagaggaacauguuaaaugguaucaaggacaggcugagaaagcacaaaccuaugaccuaauaucuuaaaccaauaaauugagagggugaagggaagaaaggggagagggguuauagacaugguuaauugacauauuaacaaauuuuauuauggaacauuuugaauccugauuggaacaauuguuaaaagucuuuugaaacauuuggcagaauuuauagugauuacauauuggaugucaaggaauuguuauuuauaauuuuaggaaugagauaaugguauuguggcuauuuuucauagcagaaacauacuguaauaguuaugaaugaagugaaauaauguuuuuacuucaaaauaauccagugugagaggaagcaggagggaauauuagaugaagcaagguuaaccucaaguuguugauuggugaagcugagcuauggguaccuagggguuuguuauacuguucucuggauauuucaacuuuuuuuuucuuuuuuuuuuuuaauucuggaaagauaucagcuaagcaagaacaugaugaaagucuacaagauuaugagagauauggcuagggagacuaugaauguguuuaccauauuucugaauaguaaaauuagggaccaucuuguauaauuggaaagaagugaauacaagaaaauccuacuuuacaccauaacuuguuuuucaaagucuguaaauguuuuggaaaaacucguauuuagagaauuuggggaggcaucccuuuuugaagcagacaucugugcuuugaacuuguaacaugauucuaguauuccagagauaagauaucaugguauagccugcccuauauaaauuucaauguuucugcuacauaaaguuuuugagguuguaaggcaaauaugguuucucauagaauaauuaagaccauuuucuauuuacuuuuacuacccuuuguuuuaaaaaguagcuuaugaagauauauacaguaaguauguacuuaaguguacagcucagugaaucuacacacacacaguaguaacugccacccugaaaagauacagaauauuuccuguauccuggaagauucccguauugcccuucccuguuaucuacuccacuauccagagauaaccaguauucugacuucugucaccauagauuaguuuuaccuuuucuuaaacuuacauuuuuaugucagacuuuuuguaaugucuuagagauucauucauguuuugcauauaucaguaguucuuuuuuuauuuucuuuuuuauugcuguuuaguuuugcuucuuuuguuuucucuuuuauugcuguuuaguauuccauuguuugucuauaucucaauuuacuuauucuucugucgauuaauauuuaguuguauuuaccuacuaugcaucaacuaagcuacugugaacauucuuugggguagacauuaaugcauuucugucucuugagaauugguggguuaagguaggcauauuuuuaguucugaacauauuggcaaauaguauuuuccaaaauaauuguaccaauuuacagugccaccagcaaugugugagagucuaguugcuccacauucuuuuuaacacuugguuuugaagucuuuuuaaaauuuuagcuauugcgguguguauucaaccuuagauuugaaccgcugguauuguucugucuuuuacaucaaagugucacacugguccuuuuguauguaauugguggguccuaacuaugaccaauuccucaauguaauucuuagacuaaacuauugcuuuuuucccuuucccaguugucacagguaguacugauggaauuggaaaaucauaugcagaagagguaggugauuuucaagaucuuuccuuuuaauauaaaaaauaagaauaaauaugggaugauuucuuauaguaguuuugauuuuugaaguaaaaaacacaaauauaauguugcaugguacaauagaugcuuuuuguuucuaccuuguuggaaauaccauauuugccuaaacagacacaauuuuuugaaacaaauuucauguaaaauaaguauaaaacuuucugguuguacuggguaguuggaacugggaacaauuuaguguaauuuuauuuuaugucauguaaguguguacagucuucagauuugaaagucaauuauuuugaacuauuuuccaaaaaaugaaaauauuauaggugguuacauuucuaggcuaguccaugacaucauuuucacaagaaggacugugauuaacagaaagguauugauagacacaggcaaaggguucagauucucugcaaugaaauuaaagaacaggagagcaucauaguuugaagaccacuggacaaagcaggagccggggcaguauucuuuaggcaaguuucccugccuucuggucccugugaaggcaccuacagccuaugaugaagugaucuggaacaguggggugauucuaauaaagaucccagcagauucacuggaucuucuauuuaucauucucaaaaggucuuuuuguuaauuuuaauuuuuccagcuuuuuauuuggaagaauaucaaaacuacagaaaaguugcaagaauauaacaaacaccuguauacucuucaccuggauucacuaauuguuaauauuuggcacauuuaauuuacuuuacuauuauuauuaauuauuucgcuggaccauuuguaaguuaguuauagacauaacaguucaccccuaaauauuucaggaugaaucuucuaagagcuaaaacauucacccuuacaaccccaauacauuggucacaauaggaaguuuaacgugacacaauacuguugcauaacauacagcccuuaugcagguuuccgguugccccaauacauccuuuuaagcucuuuuuuaaucguuguuuuuccaagauccagguaaggauuaugcauugcauuuggugucaugucucuuagucuccauuaaucuaaaagaguaaguuagccuuauuuuucuuuuauaagaaugccauuuuugaaaaauccaguuuaguuguuuugcagacaaacuuggauuugucccauuguuuucucauuagauucaggaaaagcauuuuuucaucaggaaggcuacacagguuuauccuucugaguucaucuuauuaggaggcaaaagaagucucauuuuucccauuauugauuauaaacguaauuaauaaggaauauguggaaugacacuuugaggcuguauaaauauauuauuucccaaaaaucuuuuauccagugguguuaggauucauugauaguuuuugccuagauugguuauuaccauggugguuaaaaaauggugauuuuuggccaggugcaguggcucacaccuuuaaucccagcacuuugggaggcugagguggguggaucaccugaggucaggaguucaagaccagccuggccaacauggugaaacccuaucucuacuaaaaauacaaaaauuagcuggacaugguggugggugcuuguaaucccagcuacucaggaggcugaggcaggagaaucgcuugaacccaggagguggagguugcagugagccgagaucacaccguggcacuccagccugggugacagagcaagacucugucucaaaaaaaaaaauaagugauuuguuucuaaugcuauaucuccuacauuuauuaagaugguguuuuucuauaaaagcuuuuccuuaucccucuugcccuauuaauuuuuuaaaagaaaguaucaguaugggcuaaugguuuuuuuagugguguuauaacagauuaauuucgcaaaucaucaccaaccuuuuuauuuuuauaaaaaauguucuuccauagcuucauuugcaauaucacucacuacuuaauaaacccugacuuuaggauuuaagacuggaauauuaguuugcuaaaucacuuuuaguugauagcaccuaauuuauugcucauuuauauucugucuagaauauuucacuaaauaguuuugugcagauuagugcuuuuuuuccucuacuacuauauuuauguguccugggauaguaaccacauuuguguaaaucuuuuucauuauguacaacacuuacauaugcuggguauguacacagaagguguuccucaggaaauucuuuauuuauucaauuaacuucuuuaguuugccaugguccauaaaguauaaugcucaacuuaaaauuuuaaaaauaauuauguuuuuaggaauuuuuaaaauuuuaguaguaguuuccuuugccaguccucugauguuuguuuuauauauccauucugcagcaaaaacuuuuuuuuuuuuuuuuuugagauggagucuugcucuguugcccaggcuggaguguaguggugggugcaaucacggcucacugcagucuaaacuuccugggcucaggugauccucccaccucagccuccugaguagcuggaacuacaggcaugugccaccacacccagauaauuaaaaaaaaaaaaaaaauuuuuuuuuuuuuaauuuuuuguagagaugggauuuuacuauguugcccaggaugguuuuggacuccugggcuuaagcaauucucccacuucggccuccugaauugcugggauuacaggcgugaaccacugugcuuggcauaaaacuuuuuuaaagcuaauuuuuaaauuauagaagugguagacacuuaaagguuuaaaaaacccaaauaguauagaugauauaaaaugaaaaaguaaaagucucccuccuucuaaaacccuuucacauuuaaauacuagcuuggcuuagaaagauaacuuuuuggggcauuuuuuugguaaaaucucuauuuuggauuaugucuucauuacacuuggguuuauauuuugaacuaucaucuggacagguuuucuuaaaauggggguuauagcucauuaauguuuuucagugacaugcacaggugugauucaaaucuccuuuacuguuucaguuagcaaagcauggaaugaagguuguccuuaucagcagaucaaaggauaaacuugaccagguuuccagugaaauaaguaaguucucacaucaaacaaaaggaauacauagcuaauuaauguuuucaagcaguuauccgauacugacauaguuauuucuaguucaggaaacuucuuuuucaaggagagauaucauuaaagagcaugaaaaagcacaggaugcuuuaaaaauggaucaucaauuuuaggcugggugcgguggcucacgccuguaaucccagcacuuugggaggcugaggcggguggauuaccugagaucaggaguuugagacuggccugaccaacauggugaaaccccgucucuacuaaaaauuaaaaaaaaauuagccggguaugguggcgggcaccuguaaucccagcuacucaggaggcugaggcaggagaaucucuugaaccugggugguggaaguugcagugagccaagauagucccacugcacuccagccugggugacagagugagacuccaucucagaaaacaaacaaacaaaaaaaguuuuuuaaaaauuguuuuagggugauuguaauuugcuuaaaaugucuuuuacuaauuuauuuuugucuugucaguagucaaauuaucugauuauuuuaucguauucugcugaaaugucuaaacuuguuugcugugacuucauuucaguauuccugaauguuuuuuacucuuuuuaucucaguguuucuaaauguauaacacauauguguuaggaaaaauagaaaagauagcaauacccaugugacagggaaaaucuuuugaacuuucuucuuaggcaauuauacuugagaccugaauuacaauauggcaaagacucuuaacuaacuucuacucaaucaaccagauggauaaaccaaugcuguucauuuguuugguaaaacauacuaacugauguccccaguuugcugaccauuuguggccaggaagcuucuguguauaaugcuuauauacuuuuauccucacaaaucaaauuguuuacuuauuaagagucaauuuguguuuguuuccaaacuuauguuggguauauuuuuuauuaaauauucuguaaaaugaugaacuauuaguguaaaagcuagaguuaguucuauaaaaacuaaguugaaugcucuaaaaaaagugaguaaaauuacuucuuugaaaaauuggccgucaaauuaguguugaacaaagacaaauguaaaauauuggaagaacuuacaaaaaagaaaucugcucuccugauuguuucauauguguugaaguuugugcuguacuuuacuagaacugaaauuguaaucauaaaugauagaauaugggugugaugcaugcaagaaagacuggaauucaaguccgcagauccaaucucaaagacaaggucuuggcccuacacagaggauuggugaaugaauuacauuuauacaugguuuaagugaaaauaaaaugauuaccauguguauuuaucucuaugaguccuuguuuuaacuaacuucucagcuaacagaucguccaaauucuuucaaugagaauugaugagagaggauuucuucuauauuuuguuaccaacauuaccaccuacugcuaacauuuauauagugccuuauuauuuauucauucucucacauguauugucuccuuugauucuuccaacauacuuaugagguauauuuuguuacuauuucuuuccagaccauagcugguccuauuggacagauagcuucacuucaucuuuagauaaaaaacagaguguauucgucuguuuuucaugcugcugauaaagacauaccugagacuggguaauuuguaaagaaaaagaaguuuaauagauacacauggcugaggaggccucacaaucauggcggaaggugaaaggcacgucuuacaugguggcaggcaagagagaaaaugagaaccaagugaaagagguuuccccuauaaaaccaucagaucucaugagacuuauucacuaccaugagaacaguauggggggaaccgcccccaugguucaauugucucuuaccagaucccucucauaacacaugggaauuaugggagaugcaauuaaagaugagauuuggauggggacacagccaaaccauucacagcgccuuauuggagauucccaauauuaaauauguuauaucuuuuuuuuuuuuuaauuauuuuaaccuugcugagaguacagaucuuuacaaagcugagcaugugguauauagauauacaauauaucuuuggcauuugaagcuuuuaacauucaagauuucagcuauguaaaugcaaccccaaagggccaagauauacaguauuuuacaguuuugcugaggucugaaucugaauuaagccaugacacuaaugagccugagguaguuacugagauaguaggugaauuuaacauacugccuggaucuuagcacuguuucauucuuagcuucuuguagucuuguauauaauaacucuuaaagugauuuaaaaaauguuguguuugugggugugucuagaaauugccucucaaugaaugcaucuacuaguugcuagaaauaaagguacauaggcagaaaguagaugcuuuugacuaaauggaauguugcauuuugaaaugcuaugauaugaaugaaucuaccgucuacucgauacagaaacaagaaaagcuaccucaugacacuuucagcaaguacugcagccuguacaaagauugcucagugacucagaagauaugcuuuaaugauauuugagaauuugguuaacucaugauaugagguggcacgugacuguuggcagaaaugugauucuggagaaagagaggauucuguucaaacauuuucaugaaggaacagaugguaaagacacugaauugaccuuuauuaaaaggcauggguuuuuauccuuguuaaaauuuuugaaaaauguuuuucugggcauaauaugaauuuaauaggagaggugauaucagcagacuaugucuucuguucuaagcugaaaaaauacauagaggagauuuauaaguuaagacagauuuuuaacugagauguaaaucaccucuuugggaggauaauguuugcaugaacauauuuauuccaggagaaagaaggaccaguauuuaauauugucaaagacagacuaacucugcauuccuuugauuauaccuuuaacacaucuuuauugaaugccuguguaccagguacugugcuaggcagugaagauaccauggugaacaagguggcaugcagucccuguucucaaagaacuuaagugcaggagacaguaaaaacaaauagguaggccgggcgcgguggcucacgccuguaaucccagcacuuugggaggccgaggcggguggaucaugaggucaggagaucgagaccauccuggcuaacaaggugaaaccccgucucuacuaaaaauacaaaaaauuagccgggcgcgguggcgggcgccuguagucccagcuacucgggaggcugaggcaggagaauggcgugaacccgggaagcggagcuugcagugagccgagauugcgccacugcaguccgcaguccggccugggcgacagagcgagacuccgucucaaaaaaaaaaaaaaaaaaaaaaaaaaaacaaauagguaaaaaacaaacaaauaaaccaaaccaaaaaaagcacacacaaaaaaaacagacaaauaaauaauugcagccuauauugaaugccacaaaggaaacaaagggcuagagagauaacaauagagaaguucuuacuuuguugcagcauggugaguuuugcgauucgcaaggugauaaaagggcuagaauaacggccuguugcccauauaacagcacuccaguaacaaaacuggagccuuacugaaagaccuauccucugggcccauuuggggguauaaugguggagggauugugugugugcaaguugcauaggauacaugcacuaacguuucuauuuucuuaagccuuguuaugcaagggaauuuauggccccccagucucauuaaacuguagccuauuauggaguccaaguuccaaguuucagucagccaaccaagucaaccaacuauaugaacuaaacauuaaauccuaaaucucugguaagugaaucauaaaaauauuuggcccaaucugguauuauauuguuuucuguugugggugucagugagggauauuugaguuaagucuugaggagaagaggaauucuuuugcuaggaaacugcccuuacuguuguggugggguuauuagaggaucuucaagccagagaacgccaaucuugggagacacaggcaggagaacagacuaguacuauuuccacuggaaagggagguucagaguagcuugggaguccaagauucucaguuucaguugagucugaccaaauauccccaucccaaaucucagggucacacuuuuucucauucagugcuuucaaaugagacuaggugucuguggaauucaacuuaaguuguaauucugcaacuggcacauuuaaaucugauguuagcaaggugaacuccauggcuauaaaacauaaaacuuuuuacuggggcuaccacggaaguucucugguucucucaugguaaaugugagcugacaguuuagugaucugaacuugccguuuuuauucuauaagugcuccaguauauucagaagaagccacagcuuagcacagucuuuguacucaucauuucugccaaacucaaauguagccaccauuuggucccucaaggcacuucuccaguggguacuucauuacaauuaacagccaggguuaauuugaugaacugucauaccacuuauugcauaauggauugcuaguaucccauuuccuauugggaaggggcuuaacacuaugucuaagcccaaggacacaaucaaaccagugcaaaaguccuuugaaguuugucuugugauccuacuccugaaacuaauucguggaucaggcagcgcccagucaggaaacagaagucacacaauuuaguuuaaccaggauaacuugucucuucuaguccaacauuuaaacucacuccaauggguugaacucaucguucuuacuucccugugugacugaaagacaaaaagaggaaaugggggauugaugaggaaauuacuugacaagugaaaaaaaucaaggacuuuuuuuuuggcugcucucaccuucgaaaucugucaucauauaaacuugggcacuuuauaucaagaaguaauuccuuaugaauguggaggguagccuacucaucagugucaaaauuuuuaagaaaaauuuugaauggauuauauguaguuaguaggacacuaaauguuucaccaacaauggauaagugcuuugucaggauugacugcuuugaugaaauuacaguucuuuguaaggauaccugucacccuuuuaauuaagacaagcugaaagccaucacacauguaauaagcuuauuuuauuaucauucuuagccaggauuauucauauauuaaauauuuuugccaauuuugauucaucaaagaaaaaaacuagaaauuuuuuuaacacugagcugaguuuuuauuugcaauaaagcauaauaaaaaggagacuagcuuucagaacaaccuguugguucacagauuguagagauggugauauuuauaauucauauuauuuuacaguccuuucuuccuucucuuuucguuucauuucuuuucuuuuuuucuuuuuugagacagagucuuacuuugucacgcaggcuggaaugcaguggcccaaauauggcucacugugaccucaaccucccaggcccgagcaguucucccacuucagccucccagguagcugggacuacaggcuuguaccaccacacuuggcugauuuuuuuuuuuuuuaaauugagacaaggucucacucugucauucagccuggaguucaauggcacgaucuuggcucacugcaaccuacgucucccagguucaagcaauucuugugccucagccuccuggguaacugggaauaagaggcacgugccaccaugccuggcuaauuuuuguauuuuuaguagagauggggguuucaccauauuggcuaggcuggucuugaacuccuggcuucaugugauccacccaccucggccugccaaagugcugggauuacaggccugagucacugcucccagccuaauuuuuuuguuuguuuuuucuuguauuuuucgcagaaacaggguuucgccauguuacccaggcuggucuccagcuccugagcucaagcgauccucccaccuuggccccccaaagugcugggcuuauacauguaagccacugcgcccagcccacggucaguauuucugauuggaugcaguuuaauaaacuuugauuuuuaaaacugcauauuucuuucuuggauuuaaaaaaaucaaaccaugagauuucucuuuuuuguaacuuaucucaggguguaaagcuuuuggaugguccuguaacuccauggcuuuaucucuugaaaugcaaugcuuuuuuagaaauguaaaucuuacuggucuauagugaacagaagaguaggauaagguaagaaauguccauuucacuuuuucaggccuuacuuggaauuaaauuucuauaguuaagauaugaauuugaccaaauaaguuuguuccacaauuuucugaugcaguaauaauaccauuaauacgaugccuuguuauauuuagcuuguuuuguuuucauaaguacaacaggaggcauuaguaaacaccuguagaccuuuucguuuuaugucuaauaaaacuaaaaccacaugauguuaggauuagagaguuaaucucauauagccccaugagucauauuuuuaaaacugcuucuuuaaugcuagaaauaucuuuguugcucguagaguuuauauguuacagggccaggaauaaaacccauccauuuugccucuacugguuuugcccauaguaccuguaacuguagagauauucuacaauuuugucaauguuccuggccuuccagaaagugacguucuguacugccuguaagacagacuccacaaggcagugagcuagucccaggauaguuuccugaaaggucuuugaagcauuguuuccacauaagagaauccuuguuccuuacuagugggcuugucaugcuuaauuaaaugaaauuuaccauuaaaugaaacauuucuguuauggucaugguuacaaaauuguuuuaucuaauuauauccugauagggagaaggauagauucuuacugagacaaugcaaauaauuacauugucauguaaaauaaaagaacucaauaaaggcauguuguagaauauuuggccauugcuuugauuaguuuuacagacaaggccaaucaauauguguuguauuuucuauauaauuaacaucuuuaaauuuaucuaaugauuuaccaguuuauauuucagcuacuguugcagcguaacaaaccaccccaaacuuauugugguaaaggaacaaccauuuuagaugcucacaaguuuuucuggucaggaauuuugucaggacuuagacaauccuuuugcuccucauggcauuacugaggucacucagugauauuuugcugacggauggucuggucuggaagaucuaagauggcuucucuuaacaggucuagugacuuggcaggagauggccagaggcuggacuuagcugggacuguugacuagaacaccuacauguagccucucuagcauagccauaucaggguaacuggacuucucacaugguaacuauauucccccagagugaacauuccaagagaaccaggcagaggcuuaugucuuuguugccuggucucagaauucacguagcauuauuacuaccauacucuguuggucaaagcagucaugaaucugcccagauuuaaggggagaggaauagacucuaccauuugauaagggaguggcaugguaacuuuggcaaagaacauaugggauagaagauauuguuggaaaauacgaucuggauuuggaaaauacaaucugccaguuuauaagcuauauuaaaguuucccagggaauauuuuuccugaauucugugggaucaguaggaaaaacauagaauuccaagagcguucauugcaauuugcccaaguauggcuaacuaccaugaggguuagugaaaaauuaagaagaaaaaaaagacguuuucucaaaauauuaaguuuuuucugguucuauuuagucuugcaaaauuaauuuuuguuccauuggucagcagcaugcuuuuacaaaauguuuaauuuuggaauauagaguccuauaaauacuaacucaauuuccugguacaauuugucagauugucugcuuuuguggcaauguuggguuacacugagcaggaagccugacuuacacugagaaugaguugauucucugcagcaucaguaauagccaagaguccagauacagcccuugcugaggcuaauuagucuuuugaugaucuuccuaaagacucuauuuucugacauucaguuuauggccggggcccuuagacaagcuugaaggaaauguagcaaccaccuguuaauaagacugaugguuaauuuauuauaauaauuaccacugucagaauggaauccccuagugggauauaauauggaacuaauuaauaugauuuagucagugauuauccugaggguaugagccuuaucauggacauuaaaggaauugauaccuccagagacuuucauaauguguguuuuuaaauugccaacuauuaagaguauuuuguacuuguugauaacguaaucuuagcaaucaauuuguucauaguugugccagucuuugcauagaaucaugaauauguuucuauucauccugaaaaguaguacauguugagccauauuuauuauuaauuacaccuugccuacacauaauugaccaggguguugagcuucucuuauugauuuaauaguucuucccauaucaugggcuugauaaacaaagcaggucucauaagagagcugaacuaauuaaagauguggaauaugcuauguaucuaguuacaccuaauguccuccuugcucaguagugcugcauagcgguuaaucaagaagcacugaagauaguuuggguguaaaguauaucuuaacaauuuuauuuuucuucaucugaggcccaaauuugugaagagacuaaucguuauacugacauauaagcauaagucuuagguacccaagacaagaaaugauuauagucuuaauuugguaugacagcaauuaaagcauagcuacaagaaauaaugguuauuagcaaaucuagcauauacagaaacaagaaacuuuuguucgaaaaucauucaacaacaugacaaaagucaacacaaaagcucaaaaaguuaacaggcucuuaggaagugagaguauucuaaggagauaaggaaccuuuacuagccaggcuggauacugaggcgcauaguaauuuugauagcuuuaucauuaagagaagacuauauucucaaagaucaauuuucuucucaacaacugguuccagacaguuuaauucauaagcuuucuuuguugauuucaauauauuuuauacccuuauauauauauauauaagguuaucuuauauauauauauaucuuaucuacauauaagauauauauauagagagagagagagaugacaaguuaauacuuucaacuagcuuaaaauacguuaacuuuacauucugugauuauucuucaaguuguugcacauaccacauugaguucuccauccuaacuggaguuuucuguaugaauuuuaaucuuuagaaauuguccagggcaaccaaagauucucuuuauuucacuugcugugauauuuguauaguauuucaaggucaguuaagaauuauagauauuauauuuaaguugacauugcagagcaacaugaucauuguugauaccacguuuguccaagaggugauauuugaaaguuuuccacagauggcgugaagaguuacuuaguuuaaaugauuuggggaaugucugaaguucacaagugucaagccuuggcauuauauuucauacugugauaauaucagaagauauauagcuauuuuuaaaauuaaaguuaucaaaccaguuuuaauuugguuagggauuuaccuuaauuaggaguguaaugugaaacuuggauucuuauauaacucugaauuuauuuaccaauauuagaaauguuucaaaaguuuauguuaguacauuuuaaaauaaugacuaguuguuagccaaauaucugaauuuuaaaaacuaucacuguuugagcuggccauuucuguggggaaugauuugucugagauugccagcacauuuaaagccucagaaguuuuguccuugucuaauaauuuugaguuuuuuucuucuuagauuuaaauaagcacuuacuaagucucuauaagcuauccagaacaggggcuuuuccaaauuugaaagagagaauugaugggcaguauuguucacgucuucuguauccuuauugguuuccuuuccacuuucuccaucaauuauuuugagaggggcaaugaaaucaccgacuauaauuauggauuuguccuucacaauuuuucuauuuaucuguuauuagguguauuaacauuuagaguuguauguccucuugaugaauucacucuuuaucauuauggaaugacccucuuuauucuugguaauaaucuuugcucugaaaucuacuuugauggaaauuuacuuugucuagcuuucuuuugauuaguguuagcauggcauuucuuuuuccuuuaaucuauaagugcuuuauauuuuaaauggguuucuuauggacagcauagaguugaucucgcuuuuuuaucuaaauugaugguuucugccuuuuaaucgggguccccagaccaucuacauucagugucauuauugauugagcuaaaaccuaccaauugcuuuuuguuugcuauuuauucugucuguucuuuguucccuuuuucauuuuuucugccugcuuuugaauugcaugcuuuuuauaauucuaauuuuauuucuauccucgguuugcugacuguauaucuuuuuuucuuucuuuuaaaagucuuauauuuacauacauauuaacauuucugaugcucuucauucuuuuauguaaaugauuucaaucaggaaucuuuuauuucccuuuuccccugucugaaggucuuccuuuaacauuucuuguagucuggucugcugaugauucauucuuuuuguauaucugaaaaaaaaacccuuuacauuugaaagguauuuucucuggguauaaaauuauagauagaugguuucuuuuuguuuucugguacuuaaacuacuuugcuucacugucuucuggcuugcauuguuucugauaagaagucagcuguuauucuuaccauuuuaucaccaugcauaaugugagguuuuucucuuuucugguuacuucuaagauuuuucucuuuaucacuuaaguuuuuuuuuuuuuaauuauuauuuugccucuucuuguaguuucccuacuuggaguuuguuaagcuuaaauuuaaguguucauaguuuucggauaguuucuucaucucacacucuuuuucugggacuuuaguuacguauauauuaaguugucuuaacccacugaugcugucuuuaguuuuuauuugaguuucuuuucucucuguguuucauuuuuggacaguguuuauuuauaugccuucacauucaccaacguuuuuuucugcagugucuaaucugcuguuaauucuguuaguguauuuuaaauccagacauuguccuuuuucucucuguauuaaaauuucugccaauuuuauaucuucuacaccuuuucuuuuuuugagacggagucucacucuuuugcccaggacggacugcaguggcacuaucucggcucacugcaagcucugccucccggguucacgccauucuccugccucagccucccgccacuacaggcgcccgccacugcgcccggcuaauuuuuuguauuuuuaguagagacgggguuucaccauguuagccaagauggucucgaucuccugaccuugugaucugccugccucggccucccaaaaugcugggauuacaggcgugagccaccgugcccggccucgccuuuucuuaacgugcucacucucuaguuucuugaacauauagaauauaucuaucauaauuauuuuaauguguuuaguguuuugucuacgaguuccucaauuaguagacuacuaauuaguagacagacuugacugcugggcucuaucugaauuccucuucuccucauaauggucuagaaaaucucuccagacuauaagcuagggucauagggcucaccucauuuguuuucuuucucuuagggacuucugucaugcauucuuuauuguccaaugucuggaaaccauugcuucauauauuuuguccauuuuuguucaggcuggucaagugauguccaguuuuuuaguuuaaggccaaggaauaaaucuagucucuguuacaccgucauggccagaagcagaagucccucuccccuccuuuguuaaccaucauagauuuccugguaaauauuaccaucauugcauguguccauaaauguuuggucuacaucacacuuuuaaagagagacaaggacacaauucuuuuguauuucguuguaccaggccuagcaugguuuaaugggugugggcacuuaguaaguauuguuuuggugacugaagaacuacugugaaacuuccucauguucuuacucuugcacagaaagauauuuugaaauuuagcuuaugguccaauuuuggcacacaugguuuuuuaagccaauaugagaccauguuguaaaacugucuaacuaaacguuuucucuaaguguagcuuauuucaacuucauuacuguuuguuaccagucguuuacucugauagagaaaaacaucuguaauauggguggauauuuuguuaaaaauguagcauacccaccaauuaguuggcccagcuaaauuagcauguguuggucugcaucuccaauuaaggcagcugcuugaauguugcuguucuacagcuggcauuagggaugugggaguguacuccaccguggccagacacuagcuguaccucucaacauauuugccuauguuuguaugguuucuuuaaaacaguaaagggucuuuccaauuggauuauugaugguucagugacuuuuguguaaaaaaaaaaaacacuuuuuuugguugggaaaugugggaccaagguguuauuaaaugaguaccauuuaaguagagaauguuucgccucccacuuuuaaaauuugguuguuguucuaaguggauaauuggaauuugagguacaaccuucagcuauaaaagaauuuguagaauggcauauucuuggaaacauuuauaaaauuuaguaguuuuauguggggauugcuuccuuucuuaucaugaaaagaaaguacuuugaaacuuuuauugaaaagguucacuuuaacuugauuuuuccaucaagugaaguuaaauauuuucuugucaauuaccaguuguuuugaucaucuuauuuugccauuauuuauuaaaugcauauuuuuguuacaugcuaauuuuuaaaauaacuacaaaccaauuagguaauuuaaaugaccuagcguuaugucuaauacuagaaucaaagagaaaaggaauucauuaacaccaauaggaauuuucacauauuugaauuauuucauuucuuugcuauuaaaagccaauagaauuaauauuuaacaacaccaggccacuaagaauagaaaaaaugauauggaaucaacuuuuaaugugcuuucauucuguuuaaugcuguagagauguacaaaaucuaagacgcaaucauucugcaauaccugaugaaaguauuaagucacagauguaaauacauuuaacuuuuauggaacacuuaaucauauucaggcauguuuggaaaacauacuccucacaugauuuaaaaggcaucucuguuuaggaacugcugauggaucaauacucucauuuuauaaauaugaaaacgaagucuggggagagaccaacucacauccagugaauggcacaacuaacugaguucuaaucuuugacuucuugugcuguguucuccgugacuccaugcuuuuaaguguacuuuaaguauuguagguggguaacugaauaacuuuuggaaggugcauccccaaaacguaaugucagaauuacaucacaucaacagauaaaacacaaacuaaauuaaauuugcagcaugacuauguuugaaugcaauugccuguuggaguuauuauauuauuuaauugauauauacaauaauuuuuccuuuuuaagacauagccaugcccuuguauucauuuauuuagagacagagucucacucuguaccccaggcuagagcacaguagcacaaucuugguucacugcagccucugccuccugguguguccagaguugguuccuucugguggguucuuggucucacugacuucaagaaugaagaagccaaagagguuccccuugaguguuauauagcgcuuaaagaugguguguccagaguuuguuccuccagauggguccagaauuuauuccuucugguggguucauggucuugcugacuucaagauugaagccacagaccucacugcgaguguuacagcucuuaaaggugguguggacccaaagagugagcagcagcaagauuuacugugaagagucaaagaacaaacauuccacagcacagaaggagaccagagcggguugccguggcuggcucugguggccaguuuuuauucucuuauuuggccccgcccauguccugcugauugguccauuuuacagagugcugauugguccauuuuaaagagugcugauugguccauuuuuacagaaugcugauuggugcauuuacaauccucuagcuagacacagacugcugacugauacauuuacaauccucuagcuagacagaaaaguucacgaaguccccaccagacucagaagcucagcuggcuucaccucucaccagguucaagugauucuggugccucagccucccaagaagcuaggauuacaggggccugccaccacuccuggcugauuuuuguauuuuuaggagacacaggguuucaccauauuggccaggcuggccuugaacuccugaccucaagugauccgccugccucagccucccaaagugcugagauuauaggcgugagccacugccucacugccuuaaauaugcuggccccuacuguguauuuaagcguggcuuuaaaucaguacaauuaguaacuaaagaaagcuaaacaguuuuuauauucuaaaacaagcuuugauuaaaaacaaauagucuuacaguaauauuuuaaauguuuccugaaaauauaaugaaauaagcauccauaguugauucuuagagcaauuaugaggacacugagaccuggcaacgucacccagugcacaguaaagcugagcuucaauugcccaucaccuaauugcaggucuaguucucauuccacuucuagauugugauguugauauuucuaacuguucacccccuuccaguuuuccuuuaugguauuaaucuaaaaucucaaggccucuugaauguaugacauuguuuuucaauuaugaaucacuuaaaaucaguguuuuugacuucuauuucugaagugaagaaauagaauggaggaugcugcugucacuacccauuucuagaaagccuuuauucagucuuugugugccuuuuacuagugguuuaugugccuggauguuagaccagcaaugugggggccacccucaugugugagucucuagcuuuccuccugcuucaguuuggcuauuuugcuuugaucaguuuuguaaauuccauuuuguauucuuucgauagaagggccuauugcaauaaagugaaaaucauugcucagaaaauucuccacauuuucucuaccaauccuuauugcuuccuuccaacaaaggacuuauauuacucaaagugugucucuacgugccuagcccucuauccucagagaaagaaaugccaucuucucuaaaagcuaacuuuucccugguaucuugauccccagugucuuccugguuccuuaggacuuguucccauagcauuccucuccaucugauaugucucaaacaguuacacuauagacaaauuuuguugagcugauuguuuguuuuaaaaaucaguacauuucacuuacucaaaucugaauuuauauuuucuucugaaaauuuacaggaucuguuaacccugggcccagcauucuugcagggcagcaauccacuggagcuguguccuuuagaugggaaugcuccugucaaguuagcccagcccacucauauagugcagcaccuacuugcuuuuauuaggaccucuucacuugcuuaaguaauggacuuggcacugaugacauuuaacucucugccgggcacagugguucacacuuguaauuccagcgcuugagaaggccaaagugggaggauggcuugagcccagaaguucaaaagaccaaccugggcaacauagggagaccgugucucuacaaauauaaaaaguacaaaaaucagccaggcuugauggugugcaccuguggucccagccacuggggaggcugagguggaggauugcuuaagccugggagguugaggcugcaaugagccacugucucgucacugcgcuccagccuggguaacagagugagacccugucucaaaagaaaaagaaaaacaaguuugcagucuuuauuauccuuuaaggccucuuagccuugcaggacaucuaaagagaaauucuauauuguuugcaagccauuucagaauauuuguaagacgcauagaacauuuuaguaauaggauuugccuuauuuucagugaaauuuauuucuucuauuaugguauauuuauaaauauucuccacuaauuuugcuuuugucacauaacaaauaucuauagauaugaauacuaaaacaauguaaacuucggacauaggaaaaucacaaaaauacgcauguacagguuagugagugauuagagagggagagaaucacacgcucccuacuacuuuuuguuuuucuccccagagggagccacuaucuuaauuucuaacauuaucauuuaauuuugacuucuuggacuuuauagaaauuguaugauacaguauaguuucuuuugaguuuuggcuucuucagcucagcauuaauguuugugacauucauccauauuuuuacauguagcuauaauucacuccuuuuaaucgcuuuaugaauguauuacaauuuaguuguauauccaauuguugauggacuuuuggguugcuuccaguuucuggcuauuaucaauaacgugacuaugaacaauacuguacaugucuuuuggagcacauauauacauuauauacauucauuucuguuggauauauauguaggaguggacucauauucuuuuuuuuuuuuuuuuuuuuuugagacagaguaucgcucugucaccuaggcuggagugcaguggggcaaucucagcucacugcaaccuccaccucccgggcucaagugauucuccugccucaaccuccccaguaacugggauuaaagacacacacuacuaugcccagguaauuuuuguauuuuuaguagagauagggcuucaccauguugaccacacuggccuaggacuccugaccucaagugaucgacccaccucagccucccaaagugcugggauuacaggugugagccacugcgccuggccucacauucuugauagucucuuucucauguauaaagcauugcuguuucuuucaagaucuuugguacugagauaccgaguacauuucucaagaucauauuacaaauaugguagcagacucagaauuugcaccuuuguuucuucuauaaacugucaccuuaaaaacaaaacaagacaaaaccaaaaacauuugaugagaccuguaaaucuaacuauuuucauuuauuuugguaguuuuuauaaguuuuacaaguaauugcauauauauauauaucucugucucucucgaaagcugaacaucuaaccuuuuuauuuaacugcuuuuuaaaguuuucaaccuacaaaauuuuaucuguugguucauguggaaguuuaccuucauuuagcaugguuccaaguguugagucguuaauagugaggagacauaaaguacauuuuaaagauccuguugauggagaguaaauauguugcagcuuacugcauuaauuggaaaauaagccaucauaaaaucccccuacuccuguuuucucuuaaaaguucauucuugaaaaugucauagaacaaauaggugugcucguuuaaguugguguguacuaacuaucucagcaaaugaugaguuaaaaauuuugggguuuuuuuuggcauugccuucuuuccaucaccccuucaugcacaguguuaaaacauuauuaauugaauuuucucuuggcacaauuacaagaugacuuuugcaaggagggcuuaauguuauuuaaaucaucauuuuacauagcaacauugccucugggacuuuuauacaaugcaacugcuuugguagaugaaagaaaucaaguacugcugcacagacuuuuaggaguguuaauauauuuaaaaagcaaguaaaaugccgauguacuagcuugugauccaguaugaauggaaaauaaguccaugggaaugguuacuuuuucuugaauagaacagaguaucaugggaaugugagcuauuucuaaucuuuuuuugugaaugaguuuucuuuagauuaacagauuuucaccugauuuggggggaaaagaaaaagcuuucagccaggcaugguggcucaccccuguagucucagcaccuugggaggccgagguagguagaucgcuugagcccaggcguuugagaccagccugggcaauauagugagaccccaucucuacaaaaauacaaaaaaauagcugggugcgguggcacgugcuuauaguuucagcugcuugggaggcugaggcaggaggaucacuugaacgugagagguggagguuacagugagcagagauugcgcuacugcacuccauccugggcaacagugagacccugucucaaaacaaaaaacuccacaaacuuucaagccauuuugaaaauguucagaaauuucuugaauauuuuauuaagaacauuuuaucuuacuagauuugaaaaauauuuugugguuuauuuauucauuuuaaaaauagaauuaaaaaaauuuuuuucagagauaaggucuugcuuugucacccaggcuggaguguaguggugugaucauagcucacuguaacuuuaaacuccugggcgcaagcaggucugccucagccacccaaguaguuagcacuacaggugcacaccacuaugcuagcuaaucuuuaaauuuuucauagaguuggaaucuugcucuguugcccaggcugcucucaaacuccugaccucagugauccucccaccuuggccucacaauaugcuggaauuacaggagugagccacuguaccuggccuaaaaucgacuuuguuucuuagaguaguuugaguucacagcaaauugaacagaagguaaagagacuucccaaauacuccguguccccauauguaugcagccuccccuacuauaaaauucccacaucagaguguuagauuagaaccuauacugacacaucguuaucaccuaaaguucauagugcaguguaaauuuuucauggccuuggaaggaauacauuuaaaucucaaguuuuuguuguauauaccaccuacaaaauguuuuuccuagaugucuacauuuugauuccuuagcuuauuucucuuuugacuuuuugaaaauggaauagaaaguauauuuuuugcuuuuugcccuuuuauguuuuuaaguuuaacauuaaaugucuuuggaaaauauauuuuacucuaugccucucuuuucuguuucuguuguacaucggguauagccugaaagggauccagguagauccuaggucacauauguguaugcuuauagaaaccaggcuggugauaggaaugaucuaagugggcuggggugaggcaaaacugaacacaugccccauguaaaggugucagcucuagcuguuacuacgcuguagggcaagcucaggggugccacauuuuccaauuuuuuuaaagaauuuuuaaagaaaaccaagauguuuuauguaagacuuuguaauuuuuuuuuuuuuugagauggagucucgcucugucacccagcuggagugcaguggcacaaucucgguucacugcaaccucugccucccagguucaagcgguacuccugccucagccucccaaguagcugggauuacaggcacaugccaucacgcccagcuaauuuuuuguguuuuuaguagaggcaggguuuuaccauguuggccaggauggucucgaucuccugaccucaugaucugccccccacggccuuccaaagagcugggacuacaggcaugagccaccacgccuggccaagacuuuguaauuuuacaucagcccuaauuggaaugaaagaaaacugaggguccaacaacccauggaccacucuuuucauuuauuuaucuuuaucaagucauuauuucuauaacaauuaaaugugcuagagacucuucgaagagguuuauagaaaucaacucauugaauccuugaaaaccccuuugagauugguacuuauauuauucucauuugagacaugauccaaguaagauacagagggguaagaauuccaagguagguggaauucuaagauguuccccaagauucucaccuucagguauauacaccccauaugauucccuucccuuaaguuuaggugggaccugugagcaucauggaugccauucuugugauugguuacauuauauggcaaaggcaaugggaguuuauagauauuauuaaggucccuaaucaguugacuuugaguuagccaagaaggagauuaucucuggugggccucacccaaucaggugagcacucuaaaagagggcccaaguggagacuugaagcaggagaaauccucauauuuugaccuugaagaaguaaacugccguccuguggggaggguuaugugacggggaauggcagguggucucuaagagcagagggccccagucuuacaacugcaagaaacugaguugugaacaaccagugaacuugaaaguggcgccugagccuuagaugaaauccuagccugaugagaccaugaacagcggagucaauuacauuacagaaacagagagauaauacauauauauuguucuaaacagccaaguucugugguaauugugaugcagcaguggaaaaguaauacauacuccuaggaucacauugcugaugagcgacagaugcagguuuuggauccaggugcccaacuacagagcgugcugucggggaucauuugguggcuccugauccagagaacucuuugaacaaauaauuuuaagaauuuuuuuuuuaaguuucaacucuuuugugaacacaaaguuuauauuccauucuaugaaguucugcuuucuaaauccacuuuuauuugcaacucaaauuuauuucuuuuuuauuuauuuauuuauuuauuuuuuauuauuauacuuuaaguuuuaggguacaugugcacaaugugcaaguuaguuacauauguauacaugugccaugcuggugugcugcacccacuaacucgucaucuagcauuagguauaucucccaaugcuaucccuccccccucccccgaucccacaacaguccccagagugugauguuccccuuccuguguccauguguucucauuguucaauucccaccuaugagugagaauaugcgguguuugguuuuuuguucuugcaauaguuuacugagaaugaugauuuccaauuucauccaugucccuacgaaggacaugaacucaucauuuuuuauggcugcauaguauuccaugguguauauguaccacauuuucuuaauccagucuaucguuggacauuuggguugguuccaagucuuugccauugugaauaaugacacaauaaacauacgugugcaugcgucuuuauagcagcaugauuuauaguccuuuggguauauacacaguaaugggauggcugggucaaaugguauuucuaguucuagaucccugaggaaucgccacacugacuuccacaaugguugaacuaguuuacagucccaccaacaguguaaaguguuccuauuucuccacauccucuccagcaccuguuguuuccugacuuuuuaaugauugccauucuaacuggugugagaugguaucucauugugguuuugauuuacauuucucugauggccagugauggugagcauuuuuucauguguguuuuggcugcauaaaugucuucuuuugagaagugucuguucauguccuucgcccacuuuuugaugggguuguuuguuuuuuucuuguaaauuuguuugaguucauuguagauucuggauauuagcccuuugucagaugaguauguugcgaaaauuuucucccguuuuguagguugccuguucacucugaugguaguuucuuuugcugugcagaagcucuuuaguuuaauuagauccuauuuguugauuuuggcuuuuauugccauugcuuuugguguuuuagacaugaaguccuugcccaugccuauguccugaacgguaaugccuagguuuucuucuaggguuuuuacgguuuuaggucuaacguuuaagucuuuaauccaucuugaauugauuuuuguauaagguguaaggaagggauccaguuucagcuuucuacauauggcuagccaguuuucccagcaccauuuauuaaauagggaauccuuuccccaaugcuuguuuuucucagguuugucaaagaucagauaguuguagauaugcggcguuauuucugagggcucuguucuguuccauugaucuauaucucuguuuugguaccaguaccaugcuguuuugauuacuguagcguuguaguauaguuugaagucagguagugugaugccuccagcuuuguucuuuuggccuaggauugacuuggcaaugugggcucuuuuuugguuccauaugaauuuuaaaguaguuuuuuccaauucugugaagaaagucauugguagcuugauggggauggcauugaaucuguaaauugccuugggcaguauggccauuuucacgauauugguucuucccacccaugagcauggaauguucuuccauuuguuuguauccucuuuuauuucguugagcagugguuuguaguucuccuugaagagguccuucacaucccuuguaaguuggauuccuagguauuuuauucucuuugaagcaauugugaaugggaguucacucaugauuuggcucucuguuugacuguuguugguguauaaggaugcuugugauuuuugcacauugauuuuguauccugagacuuugcugaaguugcuuaucagcuuaaggagauuuugggcugagacaaugggguuuucuagauauacaaucauguugucugcaaacagggacaauuugacuuccuguucuccuaauugaaugcccuuuauuuccuucuccugccuaauugcccuggccagaacuuccaacacuauguugaauaggagugguaagagagggcaucccugucuugugccaguuuucaaagggaaugccuccaguuuuugcccauucaguaugauauuggcuguggguuugucguagauagcucuuauuauuuugaaauacgucccacaaugagaacaaagacacaacauaccagaaucucugggacacauucaaagcacuguguagagggaaauuuauagcacuaaaugcccacaagagaaagcaggaaagauccaaaauugacacccugacaucacaauuaaaagaacuagaaaagcaagagcaaacacauucaaaagcuagcagaaggcaagaaauaauuaaaaucagagcagaacugaaggaaauagagacacaaaaaaacccuucaaaaaauuaaugaauccaggagcugguuuuuugaaaggaucaacaaaauugauaaaccgcuagcaagacuaauaaagaaaaaaagagagaagaaucaaauagacacaauaaaaaaugauaaaggggauaucaccaccgaucccacagaaauacaaacuaucaucagagaauacuacaaacaccucuaugcaaauaaacuagacaaucuagaagaaauggauaaauuccucgacacauacacucucccaagacuaaaccaggaagaaguugaaucucugaacagaccaauaacaggaucugaaauuguggcaauaaucaauagcuuaccaaccaaaaggaguccaggaccagauggauucacagccgaauucuaccagagguauaaggaggaacugguaccauuccuucugaaacuauuccaaucaauagaaaaagagggaauccucccuaacucauuuuaugaggccagcaucauccugauaccaaagccgggcagagacacaaccaaaaaagagaauuuuagaccaauauccuugaugaacauugaugcaaaaauccucaauaaaauacuggcaaaccaaauccagcagcacaucaaaaagcuuauccaccaugaucaagugggcuucaucccugggaugcaaggcugguucaauauaugcaaaucaauaaauguaauccagcauauaaacagaaccaaagacaaaaaccacaugauuaucucaauagaugcagaaaaggccuuugacaaaauucaacaacccuucaugcuaaaaacucucaauaaacucaaauuuauuucuucaaguuuuucucuuuacaaguauacauaccaugaaaaauuaguuuauuaaaaaguaauauaucuucuguauugugaacuaauuuuaauauuuauaaucucuuaggaauaaaauguuaaacacugagcauuuuagaauauguauuuacugaaagcuuuuugugguauuguagaaaguuuauuuucuuugauucaaauuuuuuaaagaugauauaauauuuuagaauuuggcaguuuaauuaaugagguucaucucaaauauuuugaccuucaaaauuuauggcuugccuuacauuucaaaaucaugagauagaauuuaucuuuuaucacuuugucuucaucuaguuucaaauauguggaugugaaaugagaccugcuuaaauuaguggagaggacaugguguggaguauaaucuaccaagugggcaauaaaaauucuaaggaaaacauaauaggcauuuaucaauucuucuuauaggcauuaauuugacugauccuaguuacuaauuauuaaggauuacuaagauucugaaauugccugaaauccaggcuuaaaaacaguguucuauuuuggaaugggaaauaaacuuacaacauugguuuuaugcaacaugcucuuuaaaauaccaagagcuguuucuggaccaugauacuaugaccauggauuagucauuaggagacccagauucaucugucuuccucugugaaucuuuguggcccgagauaccuugcugucuauuguacuuuguguaaaacaggugugacugaauucacaucugugauugaagacucuguguuccacauaagugagaagauuguuuuaaggaucaaaugagaauguauuggagaacauuuugaauguaaggcgaguuuaacuuucagucuuugccuuugcugguauaauauguucauugcuuuaaugggccaaaaugagaaauaaaacugccagcugcccugaacaguaggcaaaauauuuuccacaugaugcauuaccgcuuucacauuggguaggauguucaaggagaguuacugaauuucguucaucuuacuacuguuuaucauccugguaucuaguaccuacugauaaagaaaacuugguuucuuuuuucauuuuuuauccuaauuggcugcagaauuauugguaauccagugacauuugcaaaauaauuuugcugaccuguauauuugagauagucucugagauuucaugggaaguauugguagcaggaugcagaugaucugcucccucucaucccccagugcccucuccacucccuguugcugcauaucauauugccuuacacacucccugcugcucaggauaucaucucauguguaugguauucuuuuauuuuuugagacagaauuucacucuugucgcccaggcuagagugcaauggcguguucucagcuuacugcaaccuccgccucuugaguucaagcgauucuccugccucagccucccaaguagcugggauuacaggcacccaccaccaugccaggcuaauuuuuuuauauuuuuaguacagacgggguuucaccauguugaccaggcugaucucaaacuccugaccucaggugauccacccaccucagccucccaaagugcugggauuacaggugugagccacugccccuggccuauguguaucauauucuuaucauacauauguuacauauguaauguaugugcauaccauacauauguuacauaagcauacaucaauuaggcugcucaggauaucaucucauauguauuguuuuuagucuuucuaaggaaaauguuuagaagcuagauaaagauuauuagaacgugaguuaucaccugucuuuaccauugccacugggauaaaauaggugaccaggguucacaaauacuccagaaugcucuggcucagcaugguucuuuaaugcauuacucacauucuuuucuuuaugacuucgugccuuuggcuguugccugugguacaucuuuugucaaauucuuccugcaccuuuccccaaggugaccuuaacuagaauauauguggcccugccuuggauuaugauuuguuuuacauacuuuauuuuuuauauauauuauaacagauauguauauuuuauaauaaaaaugccauaucuuuggcaugagaaggaaucccagaaucuggggcauaugugcaugcagacuagucgcaccuauaacuccuucuccucaaacuguguuuuuggcuuuggugguaacaaauauaagcauucugcaguuucccuguucuuaucuugucuuccccccaacgccuccucauaaggucuuggugaccuauaaaauuuccucugaauucaccagcuucaccuauucuguugcucuuaacuuuccaugauacaaucuccuucuccaauacaaugaauucuuccuuugaucugugcccuuaacgcuauguuuuugaugccugauuaaagaaauuauggcauagcuguucuauguaauauuaugcaaggaugcuaugaaaucauuaaaaauguuugucuguauaugcugacauggaaggucaucuuuagugaaaaaaaagcaaguugcagaauagcauuuuuagagaaagucuggucugucuuuuguuuuaaaaaaagaauacaccacauucacacaaaugccaaacucaugaaccaauucuguuuguagauaacauguagauacacaucaaaaaagaucugcaagauaacagcccagaccuuucacuguggcuaucucugggcaguaagaaaaccaaaaaugcuuauuauuugagugucauggaccuucuugugaauucaaaugguaaaacguuuauuccuacaaaaauaaauauauauacauauauauacacacacacacagaauauuuugccaacaauuuuagggaguuuaggaaguuuccuuacuguccaaaucauuccccugaauuuuaaaaaugaaauuuuauuguauauuaaguguaauuaacuaaugcuuuuuaaggccaaauuuguguucuguuagucacauauuuauaagcuguauauguacuuuauaguuauuggauccuucagacaaucaguauuuggaaacauaauuuuacuauuuuaaauuauuccagagacuaaugguauuauauguguguauguuacaguuauuagguuuaacucugauugauuuaauaacaaauuccaauuauaaaauuguuucugugggcacauaugaucuacuuuucaauaugcauuugauacacuuucugggaaugcuuuaggcaaagcguggaguugcuuauauaucauuagcaugaaacuuaguaaguauuaauaacugagaacucguuuugccccuacaaagcucacauauuuauuuagacccuuuauccaccaagugaaggucacaaauaaagcuaucucuucucaaaucaaggcuuaaauuagagcauuuaaucagccuguauuaugcagcauagaugucaaagauacuugaagggauuuccacuauccagcuugaagggaugcuaucuaaccaaaccuggauaaauugagcauuaaaauuaaaaggauggaaacaaauuauaaucuguuaauuaaaauagaaaaccauggccggguacgguggcucacuccuguaaucccaacacuuugagagcccaaggcaggaggauuaccugaggucaggaguucaagaugagccuggucaacauaguguaaccccguuuacuaaaacuacaaaaguuagcuggguguggcacgagccuguagucccagcuacuugugaggcugaggcaggagaauugcuugaaccgggaggcaaagguugcagugagccaagauugcgccacugcacuccagccuggguggcagagagagacucugucucaaaaaaaaaaaaaaaauaggaaagcaugagcccauuguaauuaugauaaguaaaugaaugaaaugaaauuuuuacaaggaaugggauuuaauguagucuuaaaguaucuuccuacagaauacaaaaacuugcaaauuaaaaaggaaauaauaguaacuuuuauaguggaggaaacuggcagacacuaccuuaauaagagacaaaaguuaucaucaucaguacugggacaaaucaaaaugaugugccaccugaugggaugcagugagaaacacagcaucacuucugugauauucuggccaaaagugcauauccugaaucuaaucaugaggaagcauacaaaccuaaguugagggacauucuacaaaguaauuggccuguaauaaucaauguaucaaggauaugaaggucaaggacagggcagaaagacuguuccagauugaaggaggcuaaccagaaugguagcuaaaugcauugggugauucugacuuggauccuuuugcaguaaaggauauuguugggacaacuaguaaaaauugacaggcucugaggauuagaagauaguaauuauucaucaauaguaauuauuccucaauguuaauuucuugauuucgaugguuacaucauuuaggagacugcaguaaguacauacuaaggcagcauucucaaacuuuuuagucucagagcccuuuuuacucuuaaauauuauugaggacuccaaagagcuuuuuuuuuuuuuuuacuuuuuuuuuuaaauuauacuuuaaguucugggauacacgugcagaacaugcaaguuuguuacauagguauacacgugccauggugguuuguuccacccaucaacucguaaucuacauuagguauuucuccuaaugcuaucccucugcuugccacccacacccugaacaggcccuggugugugaugcgcccuucccuguguccauguguucucauucucauuguucaacucccacuuaugagugagagcaugcgguguuugguuuucuguucuuguguuaguuugcugagaaugaugguuuccagcgucauccaugucccugcaaaggacaugaacacauccccaaagagcguuuguuuacauaggauaccacuaucaauguuuaucacauuauaaauugaaacugagaaacuuaaaaaauaauuauuuaacucacuuaaaaauaauaacaguaaacccuuuacauguuaacacuacacauuuugagggaaaauaacuauauauucugaaacaaaacaaaauauagugagaacaaccacaucauuuuacauuuacaaaaucucuuuaauaucuggcauuguagcaggaugagccacagacaaaacuccucagacaccggauuaaagaaggaagaggauuuauucggccaggagcaucagcagacuugcgucuuaagagcugagcucccucaaaaagaaauucuuggcccuuuuaagggcuuacaacuccuaagggguccacaugaaagagucaugauagaucgaguaagcaugggaaacguuacugggggcuacaugcauaagcuaacagaacagaaaguuuugcaaugcuuuuucauacaaugucuggaauuuacagauaacacaaguaguuuaggucagggauugauauuauuauuauuauuauuauuauuauuauuauuauuauuauuauuuuaacugccagggccagauggugacaccaggccaucuggcuauuuaucuucuuuuuaacuuuuugcuuuuuucuuuuccuccugucuuauaaacuagacaagggcagguggggguggggggcagcaggagaaaugguggucuccuuccuuauuccccccuuggagaauuucacuuauuaguugaaguucucacuuuuauuuuuacuuucugagucucuuugugagacagagugauagugauucauguaauacacuugugcugaaguuuucugaugaaccaggguggcaacaaaaccuuuuaucauuugaaggagcaaggguaauacgcaggggagcagcaagcaaguucuuauuacuagcaguauacuuacaaugaggguuuuaaaucuucuuauagcuggaaacuauuuuucuaaauaaagacuuaggauuaaaccugugcuaaaccuguacagacacaugugccaacuuuaucauguucuaagcagguuuguucuuuuacugggucuuaaaagccuuuuuuuagugagcagcauaguauuucuuaauaacagaacuuuuuaaacgccagacacuggaacuugugagcaucuguuuggggaaagagucaguuaaauuaaaguuaucuugaggcauuaacuuuuuugcuucuuaaggcuauuggucucucauguuagcuuuucuauaaacauaacaugaggaaaugcuuaggcugcugacaguguuuucagccagcuaaguaaacaggguuuuuuuuuuugcuaaaugaggaggcucugguaacuucugguuuauaugcuuaaagaaugacuuaaagacucagaauuguugcugggccagacagguucggguuacuugaccaaguaguguguguacaguggggacaucuuucuauagguguuucuucuagcaugguuaagggggauaacaacaacaaaacaauauacagcauauucauaucuagcaaggacaaaagagguccuuaccugggaaaaagguugaauacagcgacagaacaauaggaaaacaguuaauauuacaugaaaacuauuagucuuaagauuuuuaacuacauuuacuugcuugaugaguccucaagcuuuggcugugcauagacuagucagcuuccaggaugugacuagagcagagcuugcucuaguccaaacaguuuagucuaaaacauaguuagauuugcauaucuacuucugcauucagucugcugcaauuuguuauuuugguugaaguagaaggaaaucuggcuuuacauggaugcguaguuggagaagagaaagcuauuuuaauagcuucuuuggaugauuguggauauucuuuugguccaucaaaacauucuaagugaaagcuucuuaaaaguuaguugcaauauggaaucugaaauuauaucaauuuuuuacacugagugacauuaaaauauuaaaguucauuguucuaccucauagucugaauaggucuuuuauccaucaugacuuuguaacuuuaugcauugaucacuuggaaaauauuuguuccugaauuuugcagcucuuccaaauguugacacaguaucaaagauaaucacaauuguuaauauuacccccaaucuuaucagaaaaguuuuuucucuuaagcugauggggguggauacaaguuuuccaaaacccuuauuuucauuugaaaacucaaauguuaucauggacaacaaauacuguugcuuguuuuucuugaagugacaaacuaaccucauucauuuuugauaauaugccugccaaauucaaauaagcaucguuuuucugucaguuguucuuucauauaaaguggguugcgugaaaaaaggggcuaauucaacucacgacucaauugcacaaaugcuuuuccucaagacagccauuguauuaggaacacagaaaaagugcuucaugcauacuuuccauuuugucacacagaacaauaaaaagauuuguacucaaauagagguuuaacaaaauuaaugauuuucacugcuucaucaagggauauuuuuaaaugaaacugacuuuuuucuuuuuuacuacaaguaugugaagaauacaaugacuuccaauacagccgggugccacugcuuugauucuuguuuagguucuagcaguuuuacccaccauugcuuuucucaauauagugaagagggcagagaaugucaguauuuuugacucucagggaucauggaccacauuuugagaacuacuacaucaaaguauuuuugggugcugggcaucaugucagcaauuuaaucuaaaaugauucaggggaaaaaaguuacuuguagaauauuuacagcuuuccugguuugagauuauuucaaaauuuaaaaaacaacaugaccuuucaaauguugaaaacugauauuugugagaauaauuauuuuaaacuucagcaauauaccaguaaguucuuguacagauuggauaacuuaauguuauuuaguagcauucuuggaguauagucaaugcucagaaauugauaacuguauuauuacuccugucuuguugguagaauauuaacuauaucucuauacauuuuauaugguaccuuuagggaauccuagggucaaaaugacuuuguucuuuguuuguuugcuuuugagacagagucuugcucuguugcccaggcuggagggcaguggugaucuuggcucacuucaaccuccuccuccuggguucaagugauucucaugccucaaccuccagaauagcugggauuacaggcauguaccaccaugucaggcuaauuuuuguauuuuuaguagacccuggguuucagcauguuggccaggcugaucgcaagcuacugaccucaggugauccacccgccuccgccucccaaagugcugggauaacaggugugagccaccuugccuggccuuuaaauucuuauucuuuguucugaaaguguugcagaacagauuguguaucaacugccuuugcuuuuauuuuguauuaauauguaaaaacuaugcucuuuugguaaaugaagagaggcuguuuucuguguugaacagaaagauuauucuacucuugacaaaauauuguugaacuaucuugaucuaagcauaaauggcaaugaaguaaauacuuggccgggcacgguggcugacaccuauaaucccaacacugugggaggccgaagcggguagaucaccugaggucaggagaucaagaccagccuggccaacauugugaaacuccaugucuacuaaaaauacaaaaauuagccaggcauuguggcaggcgccuguaaucccagcuucuugggaggcugaggcaggagaauugcuugaaccugggagguggagguugcagugagcuaagauugcaccacugcacuccagucugggugacagagcaagacuccgucucggaaaaaaaaaaaaauaauaauaauaauaguaaaguaaauacucauuucaauagcuauuuuaaauuuuauggugaguuuucugcccccaaaguucccuuuuuaaagaaaagaaauaaaaucaacuguuaagcuucuuuuuucuaacuaccaaagugggagauccagaccuugaaaagaauaauuuuuuccuguggcaagauuuuacaaaaccagaguggaaucucauaagaacaaagugacagguuaaaauaaaaagagauuacuuuuuuaaaaaaauuagcucaaucagcauuuuuaaaauaaagguacugugugauauuugacuucuaauuaauuuuagcuaucuuuaugugugaaagaagaagggagaaauaguaugguggguuacaagaauaucucuuuuugcuuucuaacuugauuuguaggucacgguuauccugcauggaaaauuggucagcucuggcccaaaucuucuugguagucauuucauuuuucaagcuaacaaagagagagaaguaacuuaccucaagaaaagauucguuuuacuaaaaaauaacagagagacacauuucauaugauuaaaaaaaaugcugagacauaaucacaggaacauugccucauaugcagaacuagaaagacuguuuuagcuauaaaaugugauguuucauuaaccagauuucuaaagcaaauguuuauacauuuuauaacccuuguguucugucucuucauagagcuguuugucugcucaguuguacaguccugugggcucucacucagaagucccucccagccuagccugccuuccucuucccacugcugucucucucuccaugggacccuccucucucacgggacuaaugaagcagcugcuuuguucucugccugccaccugucgcuuuuuauaacaagcuguguaucuucuacucugccaccgucauuuccuuccucaaaaaaaaaaaaaaaaaaaaaaaagaagugugaucuuguaacuucccaguuuaauaaccucuccuaaguaauuguaacacacaggaggaaauauaaacuuguuauaggaccaauuccauaggccugugaccugagcauuugcauggagccccacacuuagaaggguccauacuugguuuaaugcucugcuauugccaucuugaaauucuuaauaacuuuugaaugagggggccccacauuuuuauuuuacacugggucccacaaauuaaguagcuaguccuauuuguuaucuuggaccauacaaccuccaccagcugucuucuacgaauuuucuuuccgcuucucugugccauccacagggauucuuaaaacaugcuguucguuuucugcacuuucugguuuugccaacaucugcccuuucuugauagggucaauuccuacucuucaccaaaaacuccacacaaauguuaccuaguagguaaaauagcacucugcaagaaugaguugcuuucucuuugaugcuuuguuuauauuuauuagagcagcaauuggguuuacacauaucuccuucaucaaaauauaaccuauuugaggguauuuguuauuguccucagggugaagccugacacaugggcacuacuuaguauguauuucuugaauuuauucaaucaaaacauuuauugagcuccuauaaaguaccaaguacuguugggcuuugaguaaacaguaguaaagagcaaaaaacagacacagauccugcccucauagagcuuacaguuuagggagugagaugcuuugccagauugcaacuugccaugcuccugaauaaaugaaugagcaccugggccuugguuuagaaugggaaaucuuuuugucucuuugacuagcaguggugguggaauauuaugaucccuagaguacugggaauuuuguauuuggaagcugacccaggucauuuggugacauuaaagagaaggguaggcuagccauugugguuucaugccuguaaucccagcacuuugggagcucauagcagguagaucacuugagcccaggaguuugagaccagccugggcagcaugacaaaacccccaaaauuagaugggcaugguggcaugcaccuguggucccagcuacuugggaggcugagaugggaggaucucuugaacccagaagguccaagcugcaaugagccaugaccgcgccacugcacucuagccugggugccagagugagacccugucccacugcccacugccucccccccgcaaaaaagagagagaagcgugacugucagcaggguucccaggcuucuuucaucaaaucugagauaccauugaucaugaagcaacaaugcagcuuauaaccacuaagaaagaaaauucaccaauuaaacugacuugccaucaauuauaaaacaccuugauuucagagaugaaaagugaacuaaaauguacaccuuggaauagauaacauacaauaauuuaaagguuaauuacaagcaaauugagucaaggaaauacuuggacgcuaaaagcaaggcuaaaaauaguacaucaugaccauugauuccauggaugauaugguaaugaaucacuuuuugaagcagagucagauguucaugccagcuugaaaaaauaugcagcugaugcaaggagguaagaguuaagaauacagauuauaccuacagcagccuaugcuauuaaggaaaaaacaacuauuugccaagcagccaucuuuguagauauuggcagauagaggagucccccccgugucugcaggggauaugccacaagauccccagugaauacuugaaacuguggauagugcugaacccuauauaccuauaugugcucuuuuucugaucugauaaccaagagagauacuaagugacuaaagagugggugguguguacagcauggauaugcuggacaaagguaugauucacacugagagcaggacagugcaagauuucaucaugcuaauuagaauggcgugcaauuuaaaacuuaugaauuauuaugggccaggcacaguggcuuacgccuguaaucccagcacuuugggaggcugaggcaggcggaucaccugaggucaggaguuugagaccagccuggccaacauggugaaaccccaucucuaauaaaaaaauacaaaaauuaacagggcaugguagugggugccuguaaucccagcuacucggaaggcugaggcaggagaaucgcuugaacccaggagguggagguugcagugagccaagauugcaccauugcauuccagccugggcaacaaaagcggaacuccaucucaaaaaaacaaaaaacaaaauaaaaaaaaacuguguaggguggguauuauuuuuugugguuuucuaggcuaagaaaugguauucuugaaaguucaaaggcuugagugaagggccuuaggccagcaaccaguugaguuggcacucaagugcaggucuucuaacugcaucccaggcucuuccagugaacccugcuuucauacugcuagcaguagcaucuuggaaucuuaaguguaguaaucuuaagaaugauguuuugggccgggagcaguggcucaugccuguaauccuagcacuuugggaggucaaggcaggcggaucaccugaggucaggaguucgagaccagccuggccaacguggcaaaacccugucucuacuaaaaauacaaaacuuagcugggugugguggugggugccuguaaucccagcuacuugggaggcugaggcaagagaaucucuugaaccuggcaggcagagguugcagugagcugagaucacacuacugcacuccagucugggugacagagugagacucugucucaaaaaaaaaaaagaagaagaagaagaagaggaauauuuugccuuuuucuccccucaaaaaacaaaauucagguacuucuguugaccuuuuguuuaccaagugcagaaaaaucaacguuguuauaugaaaauuucuucaagagugguuuguacaagagucuacaauuccuggaccaacuguagaacccagagcuuucaaaaggauggagccuauucacguccuaucaauagaacagauucacgcagcauaagguuuuuauuuauugcaagugguuguucuaguuaaagaggcuauaaugaaaaaaauauaauaaccuuggcuuaaaauaaagaaaugcuugguuugagauagaauccugaugagcuaugauuaauuuuuuggaaaaugggucucuucauaugagauuaaaauugucaugaauauuuuuccaagggcaacauaaaaaaggaaauagaccauuauuuguguggcaucucugcucauuguaauuaaaugggccuuuauaaauggagucagaucaauuauucccuucugguacacaaucaccuuuuccaaagucauguaaggcaggcuuucuuuguugggggaugucucaccccaagggauaguagggauguaaggauacgguaaggccuaggaguugugggggaaagaagacaggaaaagaagggaaguggagagaaauugguuaggguacuuuguuuuucuuuuccccuuaaaauuagagaaaguacaaaagacuugucuugcaucuuuuaaaucucuaaauacuguaaaacauaauuuuagugaaaauggagagguuuuuuaaaaaacgugcgagacauuuuuaugguuacaaacugaauuuuaugaauuuauuuuuaagaugcuaaaauugguacgcauugaauauagugcuguuucucuaagagucuccucuccccaacucauuaucuuuuccaagacuggaauaagggagauugguacaugacuaaaauauccucaaccuucauauaugugccccugagccaagcuuagaguacuuuauucaugagaugggaugguuucuaagguuucuuauaacucuaaaauguuugaauuuauaugagaaugauaguccagacccguguaugacagauggaggaacugaauugucucucaauguaaccuuuuuuuuuuuuuuuuuuuuuugagagcuggagucuugcuauguuguccuggcuggucucaaacugcagggcucaagugauccucuugcuucagccuccagaguaggugguacuacaggcgugcaccaccacaccccacucuagcuuauauuuuaauaugccuaauguucugucuuauacauacauuucuuaccagcauguaagaaauguaauuucuauagggaggaauucaagaaguauugagaagaugauuuuaauaaaucagcuguguuggccuagcuuuauuuacucauuuaacaaacauugagcagaaugaccucugcuuuaugccagacauggugcuagcugcagggaauacaaauaugacaaauaaugcucccuguuuaagaaacagacucuuugcuuaauauauuaagugccucguaggguuauauagaagguuucuaggagcacagcagagaguggaaguagcuuuaccuuggaggaaauaggaauagugaaaaauauguccacggaugcaguaacaugacuugaaucuuaaagaauguuauaauaauguuauaauauggaaaaagugaggaagggugauaugacagaaauuucauaauggauaguaccuaaaacuuacaggggaaggcaggcuguuuauuuggagcagauguggggacaaaggagagucaacauauauauuuugguuuuauuaauagaaaaaacacaaauaacacacaaguuuauguaaauuagacuucuuuuguaacauucucagacuuaauauccccagccaccuaggggaaaaacuugaggaaaguccuucuaaaaucuauaaaauuauuuuuauagaaagagaaauuuaaaaggaaaugccaauuuguugagcaaaaugaaaaugaugauggccagagcuggaaguaugguaaacauaaagccauucugaauauauuuaucaccuuucuuggcuuguaccuaaaaaugugugaguuuuaauauugagagguguuucagcagcaucuugagacuauuugaggguucaguuccuuuucugucaauuccagacuugaccuugaaugaauucugaauacucugugucguaaacagcagugugacuguaggaguggugcaugugcucuugcaggugauggaauggcuugaggccagugaggauauucauuauucuauagcacuaucguuauaaauaauauuugcuuucugcuuuuccacaauuguaguuaucugguuuucaauggagcaguagauagaaagggagugaauaguaucaguguagcuuagcuucauucuccacuuuuuaugccagaguugcauuucugccuccauuucuaguuaguugacugccucgagcaguucauaccaguuuuuuucuucuugguguuuggucuuagccacuaggcugagaggcaguuggccaagaccaucugauaauuauuuucaucugaaaauaaaguugggaugggucaugacuauauguaaccacaacuguaaguagugggaugcuagcucauacaauuucagauaccgacugauuugucaauaggcaucaauaguauugaguaucuguauauaucauggaauucuuuaagucuuuaagaauuuacaaccacaagauuuuacugugagauauuuaaacaaaacauuugaauaaauggagagcccggagggaaugccacauugucauucuuuaauugaaauguuuaauguaaucccaaucaaaacugagacuaaacaggugaggauaagcaauaaguuuuuaaaaaagaagaacaaaguagacuugcacuacuagaaauguugaaacccauuuuagauguagcauaacuaaaacuagggcauugugaaagaacagaaaaauaagauaauaaacagacuauacuucuggaaucagaaucuuguagguacaagcuguccaaucacuuuaaacauucaccgggaucagccauuggaugaggaugcuacggaaagagcgugaucuuggacaaggcaacucugcagcugaggcugacacccaaaagcugucugcuggugauacucccacaauuagggcaacaugaguuucacugaagggguaauuguguggcucauaucauauucauugcaaccuccaaauccaauuguuugugcaucuuuauccuacacacuugugggauauugauuuuaacuuauuucaacuccuacucuggaaaaaagagagaggcugugucauuucuuagaccuuuguaaugaggcaaggaucagagucccagaagaaguacuacuccaaaaacuuugguaaagugcuuauucuucccuagcaguaggcuguugcugaguuguagacuggugguuuuaugaaaaaaaacagguuggggaggugugaagauggaaaugagggcuguguuauguauaucugguaucuacuucuguuccaggugcuuaauucacccucauacugauguuuaaaguuagaggauucuuguccauuugucuugucuucuguuggcagggucacaugcaggguaauaggcuaugggaagggggaagaugccuagauuuacuucuaggcuggucuccaagccccaaguucaagccuccugaguagcugagacuacaggcacacaccaucguucucaacuuuucuuuuuuaacauaggcuagcuagcucccaccuuagccuucuagaccccuccauuauaauucuuauucaauugccuuggcccagaaagagacaguuccuguccuauucuuauauaugcacaucuauuuuugauucacagaacucgaugguggagguggaggcaguugauggaauucugaaaguccacccaaccaugucccuggucaauagcaugcauguaccauauuccuuggaaaggaaacguggugggagucugcuggauucuucuggggaaauuuucucucuauaaaagggacauaucacagagacauacaaucucugccuccgaacauuguugucugcaugcgaugcauggaauggcaauggcccuccaggaaaggagccagccuaagggaaaagagaggagggugggaaaaucccagaucauuugugccauuguugagcaacugaacaaaacagaaccaaguccuugucuucuugaagcuuaauuugagucaagacauauagacaagcauguacauuauuaaaauacacuaccuaguguauuagaaggugguaaguacaaugggauaaaauaaagcagggaagggcaugaggagugcugggggggaugguugcauuuauuaaagggugggcaaggcaggcuucucugagaagguaacauuugcucaaggacccaccagagacaagggauguggaagagcauuccaaacauagggaaugguaaguuuaagucccgaguguacguggacaacauucuguaucuaaacaacugcuaggauccccuauggcuagaacugaggagcaacggggagaguaguuggaggugaguucagccaauaaacucacaccguuuauuaggcuguugccacagccuuuuggcucuuacucugagugagagggaaaucucuggagguuugugaagagguggguaucauggucugaccuacguuaaauaggaaaagccgggaacgauggugugugccuauagucccagcuacuaaggaggcuuaagcccaggcuugagaccccaucucuuaaaagaaaaaaaaaaauggaaaggcucacaauagaggcagugaagaaaaguuguuuuuuaaaaaaggcaguggucacuguauuaguacaugauucugggaaaucuagguaugaguucagaaauuuuaauuaaccugaaaaacuuguaccagaagccauuugcuuaugcuaaugugaauacaaagagcuugcuuugguucauuacuaaauaacauucuucgugaaagugucauugaaucuuuuuagcaacauaucuauacaaaacucuacaauguaaguauguacauucagcaaauccugugagaugcagaagagugaauuugguucaggaguugugaguuggcuuuuauugguagaaaauuuccugaaugucaauaccuaauacuaguauggaaaaauaauuugcuuuucaaaauaaauagauaaauuuaccuuauguuauucuugaaugaaguuuuucauuuaaucaaagguauuuuuaagcuuuuguuuuggggcuuuuuuuuucccuuguggaucuguggcuauaauaaagucagcauucuuuauuuacuggugauaaauucugugaaauguuaaaguagacauguuggaccagcuauugugaaauuacagcucugucucuaacuucccauuacaugagcacaccuauaacucauuuauauuagcacaguaaguauaccuuuaacaccaaauaagguauuuucuaggucaauucuucuuuucaguuuauucauggauuucuaccuagggucaguacuuuucauuaagucuaacuaagaaucagaucucucaugaaccaacucuuuaguuuuagacagaaauccuuuuaggucaagaauacauaccuccuacgaggauuaauccugcaugcucugugaugagcugacauugacuuugacuaaagaaagauuuauuuuuggaagcaggauuuuaaaauuaguucuuuugaauucucagcaaguucuaaagaauaagcauuccuagcucacuggacuugacuaaguaagcugaguggagaugguugaggagagaaagagaaucuagccuuuauggacugccgucugcguaccauagguaucaugugagccucacaucaucauuuggguaaaauuaucuucauuuucaccaaaggauggugaggcucaaagaggaugugugacuugcuuaaagucauuuugcaaauauauguggaaaugaaauugaugcucaugucugugugaccucagagccugugcuaucucuucacaggggcugucuauugaaggcaaaaguaaauacuguacauuaacucagaugaguuuuguuccuccagggucucauuucugaagcuauuauuuucaucagcacuguuuggaccuuaauagacuuguguaaaguagaauacugaguuguuucucauguuacuuuauuccuuuauuacugugcauuuuguguggauuuuaaaauguagugauuauuaacuauuaaccaagcucccaaauuauaagaucccauucauuuuauuuccauugugauaagauagacuuuuuguuuuaaugugucacacuuuaaaauauuuuacaacaugaagacuucuuccugaaguuacaaagcaccaauuuacaauuaaaaucacaaagccagugauauuuaaagaguauauaacuuuaugauaugaaucauguuuuauuauuuguaccuaagggucuaaaaguaguuuucauuauugauuuacaaaagaagaacugauuaaggaacauucagccagcucucugugacgacauuagaauuuuuauugcagaacuaauguguugacucuauaucaucucuuagauggucucaugauugcuuaaaauuauccugguguaaauuuuguaucaaauuggguggggagaaacgucugaaaggauaaugcuaucaaaugccuuaaucuucacugccauguacuaauuuucccugucucuccccguuuguguuuucuuuuucccuagaagaaaaauucaaaguggagacaagaaccauugcuguugacuuugcaucagaagauauuuaugauaaaauuaaaacaggcuuggcuggucuugaaaucggcaucuuagguuuguauuuuugccacauuuauagguucuucuuguauuuauuauuugacuuuaugacuuuggauguuaagugguaaaaugacuagugagaaaauugucuuaugauuacguaagacauuaucagugaauaauaucacuaggugacauuaauauauacauuugaaucuguguuuuuaguucuauauuaacaacauacaauuuugguuauuuuccuuguuauuucucuuauucucuguguauauuuagauauacaguugucccuggguaucuauggguauagguuccaggaccucuucauaugcucaaguuccugauauaaaaugccuuaguauuugcguauagcuuaugcgcauccuucuguauacuuuaaaucaucucuagauuacuuauaguaccuaaaacaaugccuacacaucacuucauuugugcagauuuaauguguagacacacugguaaacucaaguuuugguuuuuggaacuuuguguaauuuaucccccugauauuuuugauuugucucuuuucuccccaguauuuuugacccgucacugguugaauccaugaauguggagcucacagauaauaggacugaugguaguuauauuguaauaauccuuuaaaguggauggugcugacucauuuacauacaguugaggaaaugaaggcuuagaauaauuuauucagccuuuuguucacuauuaccccccgagaagacuuuagagauuuuuccuaaucuaacucucaugaaauuuuaauaccacaaauacacuguauagauccgauuauguacuauauguauaucucugcuuuauaaaaaaaaauacaaauaagauucccaccccacccugaccaaauuucaucuacucuguggagcucugccccaguugaaaauggauuguuuagaagggcacauaaagauugagugguucagcugggguucagucuuguauuuuuuuuucuaagucuuauaccccuuuuguuacaucucagcuaccuugcucuuauuaccagaaacagauacuuuuauugggauaaucagaauauugaacuuuguuauggaaacaauucagaaaauuguauaggaaaaaaaaugggcuuuguuaacuuucccaccgcucuuugagagucguuucuagaaagaaacagggcaucuaguuccaaaaaaaacuaaacuuccucauuaaaucuguuuaucccacugccaaaauuggugggaaccaacuaauugucauuguuuguuuaguugggcuauaaaaguuggauaaauuaagauaauuuuuaaaaacauuuucuaacauuucuuuagucguaaagaccccacuucccuuucucauccuauaaaagaauggucuuuuacaugauuuccauaauagauaagacaguuguuaaaaaucaguuaaacaaguauagcccugcauaguacuguugcaccuggcuuucacaugcuauccuuucccagcuccugccugguccauaucacacaucaccaugccccauauaccgacaccacuacucccucacuuauaggaagaccaauagguaaaaaugaaugcaaacacaggucugguuuuugccuuuguguuugcauguucuuaaauauauguauugcugggaguccuucacaguuuccucuuccuuagccuagaucugaaacacauaaagcaccacugacaucuauaaaaaaaucuugacuuccuucaccuagaucuggaauacauaagucaccacugacaucuguaaaaauccaaaucagcaaucauaacuuacaguuaguauggaagcugucaugguucaucuuaaccuccuuucaaacuagagauggacuaggggauaaaggcuagcuuaggcuggaagggagauugagaaucccuaaugaaaaaagacugagggagaaaaucuuacugcuucucuugagcuugugcucuuagagaaugacuuacuuucagaaauaguuaaauucaucacaguuguguuuaguuuugcauaaacuuuaguugcuuuucauggaaacuauagaugcucugggacuauggcauuggcauuggaaaauguugggcaucauguugcugcagggcuggaggauuguacaaggcacucuuuagcuguucuuuccugcccccuauauggaaaggcuucaauaugauuuuaggcgugacagaucuguuaaggauaagcauacaggacacauguucucuaaauacuuuuuccccauuucuagaauccuagcacuuguaucaauacauaaauacugauauuuggacauaaggacugauauuuucccaggccucauacacuaaugaaccauuguuuugauagccuaguuccuuaguaaguugcugaguuaacaauuugugccccuccucauucauucauucauucauucaucaaucagugaacuagagauacaacaaugaacaagaaagcuguacugggccgggcgugguggcucacaccuguaaucugagcacuuugggaggccaaggcgagaggaucaccugaggucaggaguuugagaccagccuggcuaacaugacgaaaccccaucucuacuaaaaauacaaaaauuagcugggcaggguggcacacaccuguagucccagcuacucaggaggcugaggcaggagaaucgcuugaaccugggagacagagguugcagugagccgagauugcaccauuacacuccagccugggugacaaagugagacucugucucaaaaagaaaaaaaaaagagcuauacugcauuauuuauguaguauaauguucuaauaggaaauauaacaugaaacaaaauaauuaucugugggauaaguguuuugaguagggaaggacaggguguaauaugaguaugugggggacaggggaguugauacagggagaaauaaugguaacuuguccuagccagugggguaggaaaaaggaggauuccagaaacauuuauaaaugaaguagacgaagcaagacuuuguaagagauuccaagugggaagacagagaagagagaauuuauggaugacuuucagguuguggcuugaacaucugcauuaacacugcauuugcugaaauggagaauccuugaggaggagccuuuuggggagugaagaucauuuaaaacuagaaaucuggggcuccucuaagaugucuaaguugacuuguuuaguugauaguuggagauauauauauauauauauauauauauauauauauauguauauguauguauguauauguguauauauaucuagauuucaguagagcucuguccuacagauauaguuuggagauuagucaucuaugaguaguaauugcacugaagcagugggccuggagaucauccaaggagaauagagagaauguaaagagaaaacugaagaaagagcucuuuugaguucccuuccuucuugucaaaggcugccuggaauagauagcaugaagugggggauaguuuucugcaugaacucaguacuguucaauagaaauguaacacaagccacaguaauuuuagcuuuucuaauagccacauuuuuuaaaguaaaaagaaacagaugaaguuaauuuuuuuuuuuuaauuuuuauuuuuugagacagagucucacucugucacccaggcuggagugcaguggcgcgaucucugcucacugcaagcuccaucucccagguucacaccauucuccugcgucagccuccugaguagcugggacuacagguggcugccaccaugccuggcuaauuuuuuguauuuuuuaguagagaugggguuucaccguguuagccaggguggucucgaucuccugaccucaugaucugcccgccucggccucccaaagugcugggauuacaggagugagccaccacgcccagcccagaugaaguuaauuuuaauguauuuuauuuuagccuaguauaucuaaaauacuauuaauauuucaauauauaaucaauacaaaaaaauuuaaaaauauuuugcauacuuuuuuaauacuaagucuuagaaaucuaguauauauuuuccacuuaauagcauaucucaauucagacuagccacacuuucagugcuuaguagcuacauguggccagugguuacuguauuugacaucucaacucuaguucaccuuggccaucucucaaccucaguuuguaugagggaauuaugaguauaauuuauugauuugucuuagcuuuuaagcagugguucucaaccaaggacaauuuugcaguguauggcaauguucugaaacauuucugauuguccuucuuggcuaggggaggguaguucuacuguccccuaguggguaaagcucaaggaugcuacuaaacauucuauaauguguauaggacagccuuccacagcaaagaaugauccauccaaaaugucaguagugcugagguugauaaacccugcuuuaaaauuaugcuguccuuaaacaguucagauacucacacaacuuugauuuugauuucuaguugguugcaaaucaauaauaaaaaucauuauagcuaauguuuacauaauccuuuaaaguguauagcugaacuuuugcauacauuaucucauuagcugagcuguaaguuuaguuuucuuccuacucuaccacaaaugucuccuuaaucauaagauuuauguaauuauuauugacauuuauuagcacauauuuuacacauggauuguaauuuuaauuucucaagauuuucgauggaacuauuaaaauacuucugugaguuaaauuuuauuacuaggucauauuucaacuccauucuuaugguuccuucacuaguauggguauaacccucuagaacuuguuguggggaggucugauguguauauguuuucuuucucuuaugauuaccugaauuuauagccccaucaacuuucuucucucccgcauccccauccagaucccacauacucucaccucugucuaguaagggcaaaauaauuuagucucuuuccucugcuuaugcaauucucacuuuuauaacauucucuaaaauauucuauguauagacugauuucuaguaagaccuaggaauccauauuaagucauaggaaggaauuuuuuucuaccaaguuuuaaugaaacuaguaaggauaauaagaaaaauaaaucaccaggguacaccccauuuguuugaaguguuaagcaccaaacagucagugcuuaauaaagaaaauuaauauuuucagaauuacaaaggaaaaugcuaaagcccuuagucaugaaagaaacauuaaguuuucaguaagauaaguggaaaggaaacagccaugaauugugagaauuuauccugaaaggucaccauaacuugaugagacuauaaaugcuuaagguugagaaguuggauucuuaacuccguuacuuaaaaaaaaacuaagcaucuacugucuucuuucaggcaaaugccaagaaauacagauuucagaaagcuuauaaaacuuuggcuauuuagagaaaaugacauccuuacugcuuugaguaagcaaacaauugguuaacaaagugugauuaccguaaugcuuacuugauuccuuaggagagacucucaugugugcuccagauugguuuggaggacuuugcacaauacaacucagggaggcguaauuuaccaaggccaaaagaguaggcuuggcuuuuaaguaugccacagacaauacuuuuuucaaauucuacuacuaugacuuuuuuaacuuugugagauucuguauuauagaaggagaaagaaagguccucuuggaaaaauauacuuaguuugugauucauuuaaaaaaucaaccauagcuuuauuuaagcuuuuauugcauucuagacaagaauuuccccaugccagaugcucucaaggccuucucuguccauaguguugauggcguauacaaguuguagcauccucagcugguacaaggugaccuguguugcccuacuggcuuagugcauucaggacuuuagucauccaucgacuuucuugauucuuuccauacgcauugcuaauaauuuuaagaagccucauuuuaacaacaacaaaauguguagauaauagaggucaguugauugcaaagaaucacugauugccaaagcuggaauagaacuuauuauucucuuuucuuccugugcccuuuauaagugaacacuugcuccacuaauguucuuggugaauuauuuuuuaauugguguccuuccuuuuucagcugaaugcaaacucuuuguuauccuugccugugccaccacuuuccucauuaaaccuuauggauuuggggaagcaauuguguugcauuuuucucccgaaaaccuaguguuucccagaagguucuaggauagagaauaguugaauauaaauauuuuauuuacuaaacuaaaagauaguuugagcaaagauacccaucagaguuaagaucagaguaacucugucucuguguauacuuacauuuucaaaguuucuuaacaaaagacccaagaguauuauuagcuacuuggggaaaggacuaguuagcuuccaaauggcaaacuccuaguuaauugguuugggauccagagauggcuuccuuauaauucaguccccagagaagcaaaggaagagcaauagauguaggccuaggagagagaaccaaggcacuacaggaacagugcugaggaaaacuuuucuaggauugcuuggaaggaaggaaaauggagcauacuaggaguuuaugcagcuuccuggucccuguugauuaaggaagucacaaauaaaagagucuuauuucuucagaggcuuuagaaauacauaaugcuacagauucucuucuugcuguucucaauguuauaaauaguuuuaaguugcucucauuugaaguguaaauaccucuaaagggcuaauggcaccuguuauuuaauucuuauuggaacuaguauauucaguuuauuccuugucuacuucuugcugggucaguuggcuauuuuaguuagugaaagacauggaaaagucauuuuaaaauggagaacaauagucuuaaaaaaggaaacuaugugguagguugauaaucaguggggugcagagauggagacacgcagaaggacaaaauaaaauuauguugagagagcaccaaagguaaacuuaauguaguuagaauuauuauccccuacucccgcuuuuucucuguagcccaguauaugaggaucaggcuuaaggaagagcagaggcuauuauucuagguauauaggaaaggguuauaagaggaucaugggaugauuguuugggaaaagggcaggauauaacuuuugugcuuucuaaggguauaaaacacuuccaaaacuucccuuuuguaauacugcaaucacauuuuguugcuaaccacccagaguuacugcagacuccacagguucaggaacacagccccccaaaaaacugcccucaguucacaugcuagcugcaaguuuggagaucuucagaccaucuacacuuuugacuaacuggcuacaaauucuuggguucguaugacacccucggguucaauaauuagcuagagcgauucauggaacucagaaaagcacuauacucaugaucuuguaguuuuauuaugauggauaaaagucaggauuagucaaaugaagagaaaccauagggcaaggucugcggggaguccccaacacagagguucuaagcccuguccugguggagucaggacaccuuaccuuccaggcgcauccuuguguucauccacaaggaagcucuaccgggcuucaguuuccagaguuuuuauuggggguuucauuacccaaguaggcaugauugauggaaucauuggccaugugguuuaacuugaucuccaauccuccucucuuuucuuuagguugggcuggcuuaaagccccagcccucuagucacagaguuggucuuucugguguccaaccccauccugggucaucuugauuccacuacugaguauauaucaaaaacgaagaaacucaauauauugaagagauaucugcacucuauguuuauugcagcacuauucacaguagccaaaauauggaaucagccuaacagucuaucagcagaugaauggauaaagaaaauauaguauagguacacaauagaauauuauucagccauuaaaaaaaaaaccuggaaaucuugucauuugcagcaauauggauggaacuggagguuauuauguuaacugaaauaaaccaagcccagaaaggcaaauaucacauguucucacucauaugugugagcuuaaaaaguagaucucaugaagauagagaguagauuggugguuaccaaaggcuaggaauggugggaugggaauaaagagagguuuauuaauggguacaaauguauacuuagauggaagaaauaagagcuggguuagaucauuuggaugacuauaaucaauuguauauuucaaaauagcuagaagagaauaauucaaauguuccuagcgaaagaaaagauaaagauuuaagguuauaaguaucccaguuacccugauuugauuauaugaauguaccaaauuaucacguguacccugaaaacuuguacauuuaauauguaucaguuuuaaaaauaaaaacacagaugugauccaagggccugccaugaauaagaaagacacuguuaucaggaaauuccagugguuuaaaaccuccauccuauuaacaaagaucagacaaaauguuaacuguacaguaccuuuucuuuccuuuuuuuugauugauucauucaaucaaccguauacuaauucauuaaacaaguaaaauuccagagcuauaacaguagacaaaacagacacuguuucugcuuuucuggaagauagccaucgaacaaguagugggaacguguugcauguaaugaaggagaauguuacugggaaagcuaagggugucacagauaguaucccugagaaagucauuuaaguggaaaccugaaggcugaauaauacugggagaauagacaugggaaggguuuccagguggaggaaacggcauguacaaaaggccugaugugaauauucuuagugugucaguagaacugacaaaagcccugugaaucuggagcaaggguuucaaaggggacaguaacaaaagaugauucuggagauuaagcagacccagaucaugaaagucugagaaaaccaagacaauaaguuuagacuucauuggaaguacaaugggaaaccauuuuagaauuguaagcgugacuugacaacauauuagaauuuuagagagaucuuucugacucccacauagaauaagacaagaauugauaggaggaggccaguaagacuauuucagaagugagacauaagaugaugaauguuuacauuaggaggauagcagaagugaacugacaaagagagguguuuaggaaauagaaauaggaccaauuucugaugaggguccucaucggaggucuugaguaaagaagaagaagaaugguuuuguguuuuuuaagucauuauugccgacaugcauugagcacucuuucaugccagccaccaugcuaaugaauuucauuuaauccucuacaacccuauaagguagauauugauauuucuaugcccauuuuacagacaagaaacaguuacagaguuagacaucauccagaauuagacgacuagcaguuagcaacuuccagguucugacaugagcaacaggguaccauuuccccaagacaagaaacccuggaucaggagcaaagucuguugagaaaaaugaugauuucacuuugggauauguuaagcuuaagaggguggugagaaagccauguaggaauucaaguaguugggucgcugggcacacaugcccuuccuugcuagaagggaaccuucuuuguguuaaauguugaagaagccugguguagacaaucauggcaaagagaauaggugcauggauuuuuuuuuuuuuuuuaaugugcuaggagacucaucaggaacauuaucagacuaaguauagugccuuguaguuccauuagguauguuggcugagauuggauuuguaaagugagcauaggacuucuagaauucauauuuauuucuguuuacuugaaaaccacucacuaaugguauuaauuaaagcagaaccuuuuacuuaaaacuggguaauuagcucuguuauuucagaaauguaaauagaacuguaagucaugaaauuggugaauguucuucccaccagcuaacauuuaacuaccaaccucaugucaucuuucuucauucccucuuccaauuuuauguauagcaaaucuuaccuaguuuuguaaugaagaucacauagcaauuuauaauuaaacaguggaagugaaauguucuguuguguugcuucugauucagucuuaauuuuucaauuucugauuaaagcacugcaaauuuaaagucuuguaaacucucuuuuauuuggaaauugcuacucacaaauguaugaaaacuguaaaguuugcaaaauguuuuacaugguguuccaaauaucaucugucagaguaugaacaugugcuagcuaaagcaauauguuaaauaaggcaaagauggaauuuacuuugcaucacuuuccaaacucucucuauaggcuguaagaguggaucuaauugaaugaaauaaagaggguagaggagcaauuaggagaaauuuaaucaguauaaauagcagcagcucugguuaauggauguccagaguccacucucucagaaggaucucuccacuuugauucuggucauacguaauaaaaguaggguacuuugggcuugggcacaaaacaggaguuugauaaauuuuuguugaauaaaugaccauacaacaauaacaacucuuccucuuccauuuauuaacauauuacuacgucccaggcauuggguuaaagauuuuauguauaugaucucauuuaauucuuaaauuacuauccccauuuuaugucaaaggacaaugaggcaaucacuaguuucuuguuaggagcugguaguaguggagcugggacugaaaccugguucuguuaggacucuggggucuguauucuuuuagcucaaaaauuuaagacaggaaguuucccccacuuuugguauauacacuguuacuaaaguauacauuuuaaaaauucaguuuauuuugaaauauagugagguagcagcauuuuuuaaaaucuccuuuuauuggccaggcgugauggcucacaccuguaaucccagcacuuugggaggccaaggcaggcggaucaccugaggucaggaguucaagaccagccugaccaacauggagaaaccccgucucuacuaaaacuacaaaaaauuagccggucgugguggcgcaugccuguaaucccagcuacucaguaggcugaggcaggagaaucgcuugaacccaggagacggauugcagugagcugagaucgagccauugcacuccagccugggcaacaugagcgaaauucugucucaaaauaaguaaauaaauaagcaaauaaauaaauaagaugucuuuuuauuaacucuaagugcuggaacuggauuagcauuuauaaccacaaauguuagugaaauauaaacuuuuucuccuuugauacaaugagaaggaaacaggagggguuacuuugcauuauuugauguaugucgggaagcccggccauuaggcaacauauuuuuaaaccaccuuaauuuccuauaucucugauuaaucuggaaaaagaaacagguugaaggugaucuguaggggguuacccguaucuguuagaauuguuuguucaaauggauuuuuaauuucuaguaauuuauuguuguuugcuccucucucacgccuaacccagauaccaaaaaucuaauuuucugaugacaucauuauaucucuauagcagcuggcuuugagagaggauucuaaguucagugagaucagcagcaaacgaacuuagaagaaacagaaaucuuguaaauauucuuuuuuuaagagcauaaaauuuggaaaugauuuuaaagcaguauaauuuagaaauuauauauauauauauauauauauauauauauauauaaaauucagaauuauuccguggauuuucugugucuuuaaaaugcaacacauaaugauauuaguguuuucugagguucuggaugggggccgaggagagcguagcuaagcauggccuaugucaguucuucucugcaaggaucaacucuuaagaggauggcuccucugcccuccaccaccuuuucuuuccacuuccuuuggcauuauucuuggucuguuuucaccucuguucucugccugccucaucucuuuuauugagcgcuucccagucuuagaccucuagucagaaaccaaugggaaagauuuuguuacuguccagcacccuacagugacugggaugguggugggaauuccaugaugacauagauaucuguuguuuccugagagacaucauguguuguuacacaauaaaaagguuuuucacugaaaaaaauguuuaaaucugucucuagugccucacuucaagaauucaagaaaacucacuaauaaacauguuuaaugcuaauuuaagaugcgaccauuuagaagggaucuucaacuaucugaauaauguuggagcaacaugugccauuguuugguuuggcgaauccuauaaugaauccuguaauauguaaagauggcauugcgugcacccauucuuaaugagauuauauuauaaugggaguauuuccauccuucacuccuacucaaagccuguucuuucucuuccuuuugcaauucccugaaagcuuucugccugcuguuagguuauugcugccaccugacgucucaaaauaaaauugccguggguuugcuuuuccaaaagauucgcacuauucugcauuuuauggaaauaacuauuugagagcaacaguuuuuucucuauacuccuaaauaagagcauucugaagugauuacuuaugguggggagauuauggguaucauucauuccacaagcaaaagguggaacuaauaguacaggagggaauguaggaguccuaaucccuagaauaggacaaaucgccauugugaccuugguguguacuucaccucauaaaauuggacucagugcucuuaacagccuuauuccagcuuuaacauuguuuuauuguguguacuuuuauuuaugaaaacauagcccuucuccgugauacuauuuacuuuuuuggacuaaaguucucaguguugaacagguuuucucucuuuuuuuuaacagauacauaauauuucuacauauuuauaggauacaugugauauuuuauuacaugcauaggauguguaaugaucaugucaggguggcugaaguaucugucacuuugaguaucauuucuauguguugggaacauuaaaagaccucucuucuagccauuuugaaauauacaauacauuguuguuaacuauagucacccuacucugcuauugaacauuagaacuuauuccuucuaucuaacuauauguacccacuaaccauccucucuucaucccucacccacccacacacaccugccccaccuucugguaucuauuauucuacucucuaccuccaugagaccaacuuuuuuagcuccuacauaugaaugagaacaugcaauauuugucuuucugugccuggcuuaucucacuuaacacagugaccuccaguuccauccauguugcuauaaauuacaggauuuuauucuuuucauggccaaauaguauuuuauuguguauauauacuaaauuuuucuuuaucuauuuauuuguugauggacacuuaagucaauuccuuaucuuugcuauugugaaugaugcugcaauaaacacgggggugcagguaucuauuugauauacugauuuauuuuccuuuggauaaauacuaguagugggauuguuggaucaugugauaguucuauuuuuaauauuuugagaaaccuccauacuguuuuccacaguggcuauacuaauuuacauucccaccaacaguggauaagaauucugcuuucucugcguccuugccagcaucuguuauuuuuuggcuuuuuaauaacagcuacucuaacugggguaagaugauaucucauugucauuuugauucagauuucugugaugauuggugaugagcauuuuuucauuuaucugcuggccauuuguaugucuucuuuugagaaauaucuauccauauccucagcccacuuuuuaauaaguuuucuuguuuuuuaaacuauucaguuguuugaguucuuuguauauucuagauauuagucucuugucagauggauaguuugcaaauauauucuuccauucaacagguagucucuucacucuguugauuauuuccuuugcugugcagaugcuuuuugguugaauauguuuucuuauagagcuauguuaaauagauguucacauuuucauugugugaauaaauagcuuugauagcuuuccuuugcucaauuaucagagacacagcugaagacucucuauuguuuguuuuuguuuuuguuugagacagagucucccucugucacccaugcuggagugcaguggcgugaucucggcucacugcaaccuucgccuccuggguucaagcaauucuccuaccucagccucccgaguagcugggacuacaggcacgugccaucgugccuggcuaauuuuuuguauuuuuaguagagaugggguuucaccguguuagccaggaugaucuagaucuccugaccucgugauccgccugccucagucucccaaagugcugggauuacaggcgugagccaccacgccuggcaacucucuauuguuaauacagucauaaccagaauaacacuucucugcuugcuuaguuauucagggacuuccuuugcuuaacuuuguacuuauaguacauguaaagauuacaaagucaacugugcugcuugcaaaguuccuagauuuuuuuuaaaaaaaaugaaaucuggauuuuaaaagauuuauaauuacacuguucaauuuuccuuugcauuuugaaauauagcauuaauauucccauaggcuagagggaaaucugaagaaaguuuucuugauaugaagagugaagggagauaguucacuguacuucaugaaauuuuuuuuaauucugaugaauauuacaacuuggcaaagccuuuccuggaagauucuguuaucuuaaacugauauaaagaauauuuuguuuaugugcaauauuuuaacagauauuuuggguuuugcuguuucuuuuagucauauucuaaauuauucauccuuuguaauucuguaggugguuaaagcaaagucaagugaacauaaagccuuaccuucaacuaguuuuggccuaauuguuuacagaucuuuuauagaauugacucuugggaugccugguggguggagaaccuauugaauaaaauaaaaauggaucuggaccugcuguuauuaauuauguuuagauacuaucccuauucagaugaguaugaauccuaauuaaauaaaguuugcuuugucauugucuuuugcuuacauuucuucugacagguuucagugguauuguuguaaaaucuugcaacuuacagccucaagugauuggcuuauaauuaaauauaaaacccuuacugaguuccuuugaacuauuaauuuuguuagacuauugaaaaguuauuauuacuaauaucagguuuauauggcauaauuccuuauaagcuguagcagacugaucauaaugucaucaucuucuugcaacugaaacuucucuuuuuuaaauacuucauaauuuuauuaaacauuguuaugagauguuuguuuauuauucaguuauuaugauuuuuuuuuuucugaguugaauacuggauaaaggugugugaagguuuuaacauagugguuaaaagccuagucucugaagucaaauuucacgaguuugaaucccggcauacuuugcucuaucaccgggcaauuuuuuuaacugcugugaacuucaguuuccuaauauguaagaggaaaauaauaauaggaacuaccuaauaggguuguugugaugauuaaguguagauaggcagauagauagaucaucuaucucaugaguuauuuauuuaguuaaaauaaauucuaagauauuuuauucauugauugauuccugcaaauguucuuuguucugggauugucuuugucuuuccagggcuggggaaaaccauaggauauuugaguauuaaaaucuuauaucuaaauauauauagguuuauucauaucuugucaauugucuuguagccccaacuuuaaguuaggugauugggaagguaagggggugugguauaaggaaaauuaagauaugaccucaacuuuugauagaugguuuauuggagacauuuagucugacccacucccuuggccaccagaaagaagccuucccucacuuuccaguugaagucaggcucugcaggaaaggcucccauggcacucuguucugucaugaaauaauuguuuguuucuuucuuuuccuacuagauuguaugcuccgugauaccaacauuuuuuccccacuuuuuaaaguuccuagcacaugucuuacucaaaaguguauggcacauauuuuuugaguuauuaaaugagcucucauucuggagcggaacaaaaugcgaugcauauuguacaugacuuaucccaaaucacauguuuucugaaaacuguuauaacuagaacucaaguuuucaguauccuggaccacgguacucuccacucuuucuacugcacuaugaaaauuuaaggucuggagaagaguuaaguaauaucuccaaauaacaguaugauagaggcagaauauacauaucccaaagggcuauggaaagugagaggcaaguauaaguucugucaguugcuggaugguagguacaggaagguuuaaugaaggaagagacauuuaaguuggacuuuuaaggauagauuuuggacagaaagguguggaaaagguuaugcuagccauaaacagcauuuuauauaauuauauauaucauauuagucuugauaucuuuaaugucauuauuuuaacaaaucuuuaaaauaugcauauguuacucagcuaaucaucuuguucuauuucagugaacaacgugggaaugucguaugaguauccugaauacuuuuuggauguuccugacuuggacaauguaagucuuucuuuguguauuaugguaacaaaaauaaugcaugcagguauugguauaaugauucacacuaugacacuggaguccagcugccugugguucacacgcuggcucuucuguuuacuaccugaguucccuggguaugggccuagccauacuuagucucaguuuccuugcucauaaaaugggcagcuucauagggguauuagaaagauagaaugagaaaauauuuauaaccucacuuauacagugccagauucaauaauagcucuaguuuuguuauuacucuuauuuuuguuuguguuauaucaaaauagcucuguuguaaguuuuaugauucuaaacaucaacuuaaaaauuguaaguauguuaauauacagcaacgugguugauucagguaaaccagcucuaccaaaaugaaagugacauccuugaugcaugcauaauccuuuacugaaaacgagaaaagcauaucauugaaggacuauguaaaauuuuaaaaauuauugaaaauccuagguucaguaauuucuaugcuccauacuagcagaaaggaaauugcaaaguguucuauuuauuuuagauuuaaugugucuuuuuacuuccagauuuuacuugcacauacacuuuggauucugcauguuagcaucaauuaucaccuuaguuaggaaaauauaacacggagaguaaaaugaaaucugccucucuaccccaacucuugucauuuuuccaaaaucucugcaauaucuggggaaauguucaaugcuucucuagauuaccuaaguagauaucuaauagggucacuuucaugaucaaguguauauaaaauucucaauauuuuuuugcaggugaucaagaaaaugauaaauauuaauauucuuucuguuuguaagguaagcauccuuguuauaaagaugucauccuuuuuugguuccuucuauucaaaaacacugacauaaucagcuuguucaccugagucuacucuuguuuagaugcagauacauguauuccagauacaaguggucuauuaacuuauuucuucagaaaacauaaagaacugaagaccaagcaggugccuguauuauuugacuuuucauuuauuuuuauuuuauuuaauuauuuaauuuuuuauuuccauagguuauuggggaacaggugguguuugguuacaugaguaaguucuuuaguugugauuugugagauuuuggugcacccaucacucaagcaguauacucugcacacaauuuguagucuuuuaucccuuacccucuuccacccuuuuccugaguccccgaaguccauuguaucauucuuaugccuuugcauccucguagcuuaguucccacuuauaagugagaacacaggauguugguuuuccauuccugaguuacgucacuuagaauaauagucuccagucucauccagguugcuacaaaugccauuaauuaauuccuuuuuaugacugaguaguauuccaucauauauaucuauaucuauaucuauaucuauaucuauaucuauaucuauaucuauaucuauaucuauauauauauauauauaucucgugguuuugguuugcauuucccugaucauuagugaugcugaacauuuuuucauauguuuguuggccauuugcauauugucuuuugagaauugucuauucauguccuuaguccacuuuuucaugggauuauuugcuuuuuucuugcuaauuuguuugaguucauuguagauucuggauauuaguccuuugucagaugcauagauugugaagauuuucucccacucuguggguugucuguuuacucugcugauguuccuuuagccgugcagaaguucuuuaguuuaaugaaugaguccuagcuauuuaucuuuguuuuuauugcauucgcuuuuggguucuuggucaugaaauccuugccuaagccaauguuuagaaggguuuuuccaaugauaucuuuuagaauuuuuauaguuucagguccuaaauuuaaguccuugauccaucuugaguugauuuuuguauaaggugauagauggggauccaguuucauucugcuacauguggcuugccaauuaucccagcaccauuuguugaauaggguguccuuucuccacuuuauguuuuuguuuguuuuauugaagaucagugggcuguguuuggcuuuauuucuggguucucuguucuguucaguuggucuacgugccuauuuuuauaccagucccaugcuguuuggugacuauggcguuauaguguaguuugaaaucagguacugugaugccuccagauuuguccuuuuugcuuagucuuuuuuuuuggcuauguggacuuucuuuugguuccauaugaauuuuaggauuguuuuuucuaguucugugaagaauggcggugguauuuugaugggaauugcauugaauuuguagauugcuuuuggcaguauggucauuuucacaauauugauucuacccauccaugaucaugggauguauuuccauuuguuuaugucaucuaugauuccuuucagcaguguuuuuuaguuuauuaaaugcuuuuuguuuauuaagugccuucuauaugcaagcacugugguagcuacugggacuacaaaaacuuaggcuggagacuuauuuuuacaaagauuucauccacacgcuauuugucacugauaaauuguuuccauuuugucuuccccaugauucuuuucaguugaggaacuuaaauguugugauaagcauuguacggggaauauggaaguauaaagcaaugggugugauuuuuaauaguuacucauaauaacuagucugguugcuaguugcuaagcauguguuauagucaugucacauguaugugccaacaaaagacaacaagccaauaccugccaaaaggaggaauacuuagcaaguaugagcaucucaacaccauuuuuucuuauauuguauuaguaacuacaaaaauauacuguacuuugauuauacauaccagagcagugaaaaauaauugccugaggcagaauucucaugggcagugucagauacuugaaauuugaacauacucauagaaagccaaauccauuuucaguaacucauauauacuaguuuaaggaaauucaaagcauguuuaacucaauguuuaacuuuguuguuauuagccaaguuuuuuucucauauaagauucaguuuaagugagguaaacuaauuauaaguggaccugugagugagucuggagcaagacucucaugcacaaaauugaugcauuuaaaacauggcuaauaggaauauaucuaauagucccaagaucauuauaagggcucucaaaauguuauuguuguucuuaaacucagagcugauacagauuuuaauaauauguggaacuaugacuuuauuuuuuagcaagcaaagguuuuugaucaaaaauaucacuuuuagucuacaacguauauauuuuauaauuuuugccuuuugaaaugaccaacguguacuauuauuuugauauaucuuuucugguacauuuggccaagugcuugaaaauaauaaguguuaaaaacaauguacauguguuucauaauaucuugugcugaguuaaugauaaaauauguuuguuuuaauuuuauuuucuagaauuguuaauacuaauuucagauuagucuucugauaauuuuaacuccucugucagauaaacuguguaagccauuuacuuuagauccauuaguauuuucucuuauaaccuccugcuugucuacacuuacauguuuguauacucuuaugguguaaaacccuggccucuucugucuccaugaacaugccaucccuuggcucacagucugcagaaaacuaaugauagaaagccaagguccuggccuuaaucugugagaaucagucauccugcugugcuucauggucacagacuuuauccuucaugcaggaucugagcacagaucagcauauucaguggucauuacggugagucucugcuuaaagaccaaauaggggaaaguauggauaaaacagcacaaaucgaagagcaccaugaaguaacuuucaguguuuuaaauauaaugaugaaauaaaaaugagauaucauuuuuaauaucuugacaaauuauaaaaugcuucucccaccucuucauccuuccucuucuucauucuucauugacauuggcauauauacuuguucccaugaaaugaguuaguggagacaaaugcuaauuuauuaaacacuugcaugccauauugaugguaagugucauuggcagaacuggauaucuacuuacaauuuuuauacauaagcuuucuuuugcaaaccuaaucccauuuaaaaagcacuaagggaguuugcuauuuaaagcacuucuucauggagccaaauaagcaucccuucauuuaucuuuaauaugaaucugaauuuuccuguaccuuugugauguguacuucuaauagaaaaacaaaucaaaacucucaacauguggaaucaauggaucauggaauuaauaccaucuggaggcuuagccaauuaguuuuuguuguacuacaugcagaagcaauguaguuaacauugcuucugaucacaguugacuagugaccauucagauagaaaauggcuugacgggagcagugggaggugagugaugugcaguggcuaaccagcagguaagaagaggaaguuagggcaugacugggcaagaccuugagugcugugcucaacaggcuagagagcuacagaaagccuucaaguagauguaaggugugaucugaccuauguuuuagaaaggcaguucuauuggcagagugacacgguaauagguauuuuaugaugcauguguuuuucuuacuuauacugagagaaaggcauucaccuugacgaaauuugugugacgcucccagguuuaggacucuuuggugcugcugugauuugcccuauaauauauuuggaugaauugcaccuauuguucuuuaguugacuguguuacguugccagggccagggccacauuuucaguagcaauggcuguuuggagcccugggguaacuuaaaagaagaugaaaauuggugcagcuacagaaucuccaaagguuuuauuguggcuggacaucaggggaacuggggcauggaugucugcagccuaaugccacaaugaauuucucagaaaaggccuguauaaggaagagagcaaccucuucucaccaucaauguugggccaaguuuuaucuccucacuaaacuacaugacagggaauaacuggcugagaaguguuccaggagagauuggugaaaucagcuuggccuugugacuuugggcuugugcccccuacuuuggagauguuugcugagaaggaccccagcaucuuauuguaaggccuguacugugccaugaacacugaaugaccuggcuuuacauuccuucagauccaccuauuuauguucuggaucaguaggucagaugauuguaaaaaucacauaaguuccguguuucaauagaggaaugacagaagugaaauauccugagaccaaagaaauuguaggucaccaccagauaaaaugguagugauguggccagaaaaauauuggggaagaaauauuaaucagaaaguuuuggcuauagacccaugauguuuaaucauaagcaguucuuccaggccacuuaguucuccaguuucauccgaugguuuuacuuuuuaaucuuauccagcauuuugaguuuauuccuuucuucccucucaguggcucacuucaaugggcucucccuuuacaagggauguuucaaagccuuguugccugcuuuuccaguuuuacucuuaaauccuucaggaauaaauuuagucuugcuccuguucccugccugcauacaguuaagugauauagaaacucuauauguagguaaccaauauggcagguagaucagucucaaacuguaagagaaguccuaccagacagagcuuucuucugauugcagaugcucugugacuaaaaucuaagauacaucuuauuucucaucaagaacaaugaccuuuaucccagaaacaguggaguuuagagacaauugaaccucaagacauugaaccacacuuuucuaaaaauaguucuaguuuuauaccuggagggauuuccaucccagaauacugagagaguuugcaaaugaaauuauugaacugcuauugauugcuauuagagaaaucauggagaaugggagaagugccgcgucuccagaggcagacaaauguagguuucauuucaaacaggguguacacugagguucacaucaguccaaagacagauucuaaaacaaauauugcugugccguuuguuucugauuugagagcaccuguuuuaacagcuaccaaauuugggguugccuugcuuuucugggccagauuauucuuuuuuauucgcaauuuucagacuucaagagacccuagacucuucacuccuuuccagauaagcacugcccaaacaguauuaccugaacugccuguggugccuauggaaaggugggaaaaccauuccuucaggugauacugaauccuaaaacugcugcugcacuuagugaaugagguggaagcuagacaauggcccugccuacagcugaaucucuuaggaaauguccaggccaccauucugacaaguagacaggauguucuuaccuucuuuauuaccuuuuucuuagagcagagaaggaaauggaugggugugcggcccaaagugaaauauauuaacagccuccacauauugcaaaauacuguucuguuuuguuguuugcuuuauuugggaauggggaagagcaucucaagcaggggguuauauaguaauuucuuuuuacuuuuuuaagucaacuugagauuuaauauuuuuuuauuauacuuaaaguuuuaggguacaugugcacaacuugcagguuuguuacauauguauacaugugccauguuggugugcugcacccauuaacucgucauuuacauuagguauaucuccuaaugcuaucccuccccacuuuccccaccccacaacaggcccuggggugugauguuccccuuccuguguccaaguguugucauuguucaauucccaccugugagugagaacaugcgguguuugguuuuuuggccuugcgauaguuugcugagaaugaugguuuccaccuucauccaugucccuacacaggacaugaacucauccuuuuuauggcugcauaguauuccauggcguauaugugccacauuuucuuaauccagucuaucauuguuggacauuuggguugguuccaagucuuugcuauugugaauagugccacaauaaacauacgugugcaugugucuuuauagcagcaugauuuauacuccuuuggguacauacccaguaaugagauggcugggucaaaugguauuuguaguucuagaucucugggaaaucgccacacugacuuccacaaugguugaacuaguuuacagucccaccaaccguguggaagagcaucucaagcaggggauuauauauuaauuucuuuuuacucuuuuuaagucaauuugaaauuuaauauuuuuauauuaauuuaauuuuuuacuuuuuuugggggggucaguauaagacuuaaagcaggggcuuauaauuuaguucuuccuucaucagacauucaaccaaggugggggcuugaaaccauuucuuauuaaggguggguguggguagggcaccuuucugaacccuccagagugucaugcgcccacugcaugucuucccuucacugagcauuucauuuuuagacucuuucuuucuuucuuuuguguguguuuuucuuuuuuugagacaggguaucacucugucacccaggauggagugcagugacacuaucauagcucacuguaacgucaaacuacugggcucaagcgauccuccugccuuagccuccugaguaguuaggacuacaggcaugcaccaccaugccuagcuaauuuuuaaauuuuuuauagagauggaguguugcuauguugcucaggcuggacuggaauuccuggccucaagcgauccuccugccucagcuucccgaagugcugggauuaccagugugagucaccaugucuggacuagaguuuuucuuagauugagucucucuuucaguuuagagccucucuacagauuguaagcaccaugaggguugguaucauguccuuuuccuuuccugcugaauccuaccugggccucgcauacguaaggugcacaacacauuuuuuuuuuauucuaagaaauaauaauaaaugaaugauuuuuuaaaaacagaaaauucugaacugaaaaaacugaacugaaauuuuaguucaaguucuuugggaauaagggucacacugauuguguguggcccuagaagguugaacuugaaucaaucgcuauuuauacugaaguaaauugugagaauguccuaaucuuugaaucugccagaaguggaagaggcggaaggugaguauccugggucagagguuguaaacuguuggucugugggccagagguggcugacgaacacauuuugauuggcucaguuuucaaaguuaggaaauuuuacaccgagauuucuaacuucucuugggaaaaaucugaaaauuggguaacacagaccugaauuacuacauggcagcaagugacuagagcugaguagcuuccggauauaugcaguaaguuaggccugcagcucucuagauugccacaguccccaccagucccuauuguuugacuucucucacucauuuacauuaccucucugaccuuucaggcacuugaguuuggguucuucuguuccaggugacuccaaguguucaauguacucaaacagaauaacugcuuggagaaauugaaggacuagaaugacaucgacuaaauuaaucucuucugucuuagucccucugggcugcucuaacaaaauaccuuagauuggguaguuuauaaagagcauaaacuuauuucucagaguucuggaggcugggaagucuaagaucagugccccaccagauuuggugucgagugaggaccccauucuucauagauggagccuucuugccauguccucauguggcagaagaggcaaacaagcucccucaggccucuuuuauaagggcaccaauaccacgugugaggguggaacccucaugauguaaucauuucucaaaggccccacccuccucuuaaugucaccauauuggggauuagguuugaacauacaaguuuuggagggguggagguugggcgcagcggcucacgccuguaaucccagcauuuugggaggcugagauggguggaucacuugagcccaggaguucaagaccagccuggccaacauagugaaaccccaucucuaccaaaaauacaaaaauuagcugggcaugguggcacgugccuguaaucccagcuacucaggaggcugaggcaggaggaucacuugaacccaggaguuugagaccagccuggccaacauggcgagaccccaucucuaucaaaaauaaaaaaauuagccaggcaugguggcucacaccuguggucccagcugcucaggaggcugaggcaggaggauugcuugaacccaggaggcagagguugcagugggccaagaucgugccacuggacuccagccuggcuggcagagugagacccugucucaaaaaaaaaaaaaauuuggaguggagggacacaaacauuuagacuauggcaucuuccaccccaugauucucugaaaucagaguaugagacccuuugcaugcuuuuugaaaaucuauuuuuuccuuuuuauaccacaguguauucauuguaugucacuuagccagaagugucuuaugcgaugcccugcccauggaguagaugauaaaaguuuagaugaauggacagaugggugaaaagcacggaaacauuuguuuuucucaccuggauuugccucuggcaugugacacaaugccaguagggggagcccucuauuaauuugaaaauccaugagaacagucuccguucagcagucuaauuguauuuaauuuaggaauuauguuaagaaugcauccgggcacccugcuucaagaauuuaacaacauuaggaauaugauaaauuaugggaaggagaguaaaacccucaccacuaauccccauccauggcuuuucuagaugaaggcauuccaaguuaauagcuagucuuuuaauucauuuugaaauuaguuaucauuaugcuccuaaaaaauuccaaauuauuggauacauuuaguccuuagagugucauaguaauggccugcuucaggcauaacuacaaaaugaugguuuugccaaacggcaugauaaccacucugcauuguuuucuucuuccaaaaaugagagaguaguuauagauugguacugauguugcuuuucaccuccaaaugaagcuagguuauaggauaaaugccuuauauacgagugaaaaugaaaaaucucugacaacuuuagaaauuauuuucuccuccccaaaccugucacuuuugagaaguuagcuuauuuuggaaaaauuuagguauuggaaacucuuagcauacuauaguaugugaaacuuauaaaaacuguguaugauuguauaugcagucuuuuuuuuucuuuuuuuuuuuuuuuuuuugagacggagucucacucugucgccaaggcuggagugcaguggcgugaucuccgcucacugcaagcuccgccucccggguucacgccauucuccugccucagccucccgaguagcuggaacuacaggcgcccaccaccacgcccggcuaauuuuuuuguauuuuuaguagagacggaguuucaccguguuagccaggauggucucgaucuccugaccucgugaucugcccgccucgaccucccaaagagcugggauuacaggcaugagccacugugcccggcugguauaugcauucuuuuuuaaaauuuuguuuagaguuuaugaauuauggcuuuggaaucauuauuaauuggcauggagcucuuuguucugaaaaguucuuuuucuuuugauaaauuaauguagaucaaaccaaauuuauuacaaaaggaaaaauuuuauuuugaaugauauaggauugaauuuaagguuaaguaauauggagcugggaaaauggcaaggcagggcucuuaacuuucacaaaaacuuaacauuaauaaaaagggaaaucaaauaauacuuggagaucucaaagcacucuuagaaacuuugucuaauuaagcuuuccacccacugugcaauaaauauucuauuagcuauacaggugagauucuaagaauuucuaauuaaguuguguucuuuuuuaccgcggugcucaaauuacacaguuugccaaaggaaaugugugcugugucauuguagcaugauuuucaauggaguuaccaucuaauuucuccaaaccaggcauuguguaacacuguugucacuuucuguaauuauuuucacuguuacacugugauuuugaaaaauuauuguuaaugauuacaguugaaaacuuguuuaagguauuugcaucuaagaaauuguuuacuuccaaauuguguggguacguuuuuaguuacuuggauucagauccuauuuaugguaagcagguuucuuugggguagagggagggcagauguggacaaaguggcuauuugugguauccuaauucuggguaugaauauccuggauuccaggggcuuugccuggauucuagggugaguuguuauacuuuauucucuccauguguauuaugauaauacaggugauuaaagcaucuugaauuuuaauguaaucuuuuaauuugagcuuuugauugucuuuuugaacauuaugcaaucauguuuucuuuguacuguucucucuaaaaaaugaccaaaugccaaagauuacaugauaugagaauaauuugcuuauauuguaucauuuuucauacuaaauuaaugagugggaaaaucuacauuggcuccuggguauaaaauaaaguuccuucuacaaacuguugauuacugacgcuacaggaguaaaacagaaaaaguuuuauucauauuagguuucuuuuagaaauaagauuguggaggcuuuucuaauuguaaaaacaaugcaagauuguugccaaaaguaugagaaauauauacaaacacuaagaagaaauuaagucacuuuuagucguaacugcagaugguuacauuuuaauauaacauuuucaaggauuuucuaggccagccaaugcauuuuugcugaauaaucuaaucaucuaaauaaucuuaaucuaauaguacugauuuugauuuuguauaagcgaaauaagccucuuauuuauuucccagccagaauauacauugcuauaccaguaaauacuaguaaauauuuuacucuugacauugaaucaaauucuaaauuuagcugucaucaagacauucauuuuuccucauauauuuguauacuuuuuggcuagcuugcauauaaagugauaacaauaccuuaagugugauauaacauauauauuaaacuauccccuuuagauucuaggcaucuaggauuuucuuguggugaggauuaaugauacugucacugaaaauauauauguauauaaagaggaaacacuuucccugcaaggacaaggauuucacacucucacuguuguagaagcacaauuguagaaacuuuugucuacuucuuuuuuuuuuuuuuuuuuugagacggagucucgcucugucgcccaggcuggagugcaguggcgggaucucggcucacugcaagcucugccucccggguucacgccauucuccugccucagccucccaaguagcugggacuacaggcgcccgccacuacgcccggcuaauuuuuuguauuuuuaguagagacgagguuucaccguuuuagccgggauggucucgaucuccugaccucgugauccgccgccucggccucccaaagugcugggauuacaggcgugagccaccgcgcccggccacuuuugucuacuucuuaggaaagaauuaaaauuguucgcuauacacuuuuggaaacagucccaauggggaagaaaaugggucuggaaaucauguuuacuacuacuugucuaauauucuuaaccacugaacuugcaaguuaugguaaccuuuuuuuagaaguguguuaagaggaacaaaaauuuuucuggugcagcaauuaucaccugcagauggccuaauauuagcauugaguuaacuccagaaacagccugugagcugugaaauggaguucagauagauagugacaauucacagaaaugccugguauauucauauaaauaaccaaauaucaagauaccagcugaugcuuacagauaacucuacuaauaacuuagcuaaaaauccuauaaaaauuugguguuaaagaaaauuuaauuugaucugaauauaacgaagccucuuaacuaaugcguagaauauuaacgauuuguauauacauacucauauaaagaaggcuugaaauucaauuuauugugacuuauaaucugauuagaaggaaagauaauuucauuauagaugaaggcauuaaucaauuugauaaaagcaugcagauuucagguuaaguuuucucaggcuuuucauuguuauuauuugacagauuaaaaaaagauguuacauuuuaugacaaggacagagaauuuagagucagaauguaaaaggaggagcucaugagcuaugagaaagaaauuaacuuuugcaggggagaacuugugucuuugcugaugaauccucuagucguugagcauucagcaaauauuucuggccuuuaauagccaggcauugaaaucaguguuuaugucaaguuauuaaaacuucuugaguuuuaauucauauauauaaagaauauauuuugaacaugucccuacauaaaaggccucuugaugaaggaaacauuuaauguuuagcaugccaugauauaauuuuguaaguaugguuuuauguuaugggguuuuguuuugucucaugauuuucuagauaauuuuugccauucagaaagcagacauuuaauauauacaugacaugcauaugguauaagggaaaaaauagcuccugauauucccccaucucccugcccccaauauuccaacuggaaauagaagagggacuguuuaagagagccaaacaggcaguggcuaccccuucuggacuccacuuagcugcuuuauaguuaacagaucucauuuccuuaauacaaaugcgcacgcacacacacagacacacauacaccuggguaaagacauuuuuauuaccagucuccuuccuuauucuguuucuggugaucucagaacuuuggagaacugaauuauagcuucccuucacaaaaugcugggggaacucuuuauaauacuuuagcuaagcauuauggucccugaugaaaugugcuaaauaaaaaaaaaaaaguuuucaaauacuguuaggguuuuguauaaucuauccuuuacaauaaaauacccaccacuguuaauaugccugauguacaucuguacuaccauacaaagcuguucauaauacaucuggauuggauguucacauagcagaauuuaccuuguuaaaucuggcuggcauuuuauuucuucagaauauuucuaggaaaacaaaauucccuucucaucagaaugcugucuacuuuaauuaauaugaaguauuauucaagauagaaacaacaaaauuucuaugcuuagcaugcauugaaaccuuauuauuacaaaacagcaucuguuucuuagagaauugaugauauccaggagucagaaauucacguuacagccucgguauuuaacugugaggugauuuugacuaaaccauuggacuucugaacuuuucuugguuaauaauauaucaaaacagaguuuaaaaauagccccucucauuauauguauuuagucaacaauuauggaguccuuaaaaaaugcagaugucaccuuuucauguugguuacuagagaucacaucuuaacucucuuuaaggaugaguuuuacuuacagcuaacuagaccaacaagagaaaugaaugugaaguuacacuuacucuuugccaaccuaccacuuuaucguauucuuuuaaagacuuuuuuuggcuggaaaaguuuaugugagcucuugagguuagaaagcuuaagucaucuugguaggcaggauauuucuucugauaacauauauucuuuucugagaaugcauuuugggaaauguagauuuucacuguaaauccuucauuguuugaagaacucugugccaguauuacauuucaggcaagacuaauuuuagccagguucauuaaaguauucccuguguucucuccaguaauuucagcugguuccuuuuuaugcccucuugacacagucacauucuacaguguacagaaaauaaccugcugucuguagaaguggugaaugguuucaugauucccuucuuuuuagugugggugaguuuucuucacucuuuuucuguugccugcauccuuggccaucaugaauguuuugcuuucucucuugcagaugacacaauugguacugccuggcaugguggaaaggugagucacaagcucacauacaaacacuguggaagcagagcucaugauuauuuagagggagaauccuugcuuugaaaaaaucacugaagugacuaaugaaccaagccuccaugucuuagccacagagugauguaccaggcgagucacaguagagcaugagucaucggugguggaggccuuuuccacucgauucccuuuuuauuucucucucuaggguuguagugguuccuuuagaucaggaugaaaaagccugccugagucaccaucacuaacucaauugccuacuauucugagggggcggauagaguuccugggauauucccgggaauaccuucuuaaagcuguauucucucaaagccaaaaucaguggaguuggaugaagcaagaccucuuccucugguuuuucacuuuuuacugggagaauggcuguuauauaaagugauuauaagaugucaaaccaacccuuggaggaaaaggcaauguccacucgccccaucuuuguuccaguuugaauugguucugcuaguacaugccgaaugucuucauuuugauugagaaauauguuguagauuucuguuaucugaaauagcaugaaguguagaauuguaauuaagcuguuucuuccuuggaaaaaucugaaugaugucuaggccuucaaagaaaagcugcuaaaaagauuugggcuugcauccugagcuagcucgaucauuugcugaauuuagggcaucguagucaucuuuuuuucugcaaaauaacuaugaguuuggaagagacccagaggaaucacagcuuugaaaagggaagacccaaggacccuacuucuguuaggaaaccucuaugaccuacuccaggcagggauuacagcuuauguuuauugaguauauaguaagugccaggaacuuaguaaguguuaacucauuuaacuuugauagccucccaccauuguacagaugaggaaacugagguuaggaauccauuuguugagcaucuacagggacuaguuaagaaacaguuucucagcaaagcuccuuguaaucccauuuuauauacacuauuuuguguauuuuaauuguuuuauuuuaguaacacuucccuuuaaaaucuucaaacugccuauuguuaggugccagugggaguggaccccugauggucagauauauaaauggcagugguuagaccagaccagaacccuagaagaugguagaguuggggcaaaguagaacccaggagggauuaaauuugggccaucaccuuaauccuaguuuugacaucugcagguaacaugguauugguucagaauaguaaaucuauccauuaaaaaagaaacacuuauaaaccacagagguauuguaaaaggaauuuuuaauuauguugaugaaaaccauaucaaaagagauaaugguugcaaaaucauuuuacagcauaaagucuuagagucaaagagucacagaaauccagugcauuaaauuaauugacaguaacuucccuccuuugacagaugaaaaaauagaggcccaaagagauggagugcuaugaagcuauacaguuaguaaauaauacaaaaccaagaagcugggaacuucacugcuaucucuguagaccugacagccaugaucacagcuggagcauuacauaaaggcaaugcaaaaaaggagaguccauccauucaauaggcauucauuuagucaagcgucucaaggaugaguuggauccuugccuuuuaagaaaucaaguugaagcugggcgcagugguucacgccuauaaucccagcacuuugggaggcugaggugggugaaucacuugaggccaggaauucaagaccagccuggucaacauggcaagaccucaucucuacuaaaaguacaaaaacauuagcugggcgugguggcacacagcuauaaucccagcuacucagguggcuuaggcacaagaaucacuugaacccugggaggcauuggucgcagugagccaagauagugccacugcacuccagccugggcaacagagcgagacccugucucaaaaaaaaaaaaaaaaaaaaaaggaaagaucaaguugauuuuaaacugagguugagaaauggugggaaguuuucagaagcuaugacugaaccugacaccacauuaccauuuugauacgucuuaagagcuagugagaaauauauguggauguuaugaaucaauacuuuugguuaggaaaaggaacgucuaugucuacuugaauuaaagaacuuaguuacuagaugugucagucaagguaagcuaccugcugaaacaugccacucccaaaucucaguggcuuaacacauaaagguuuacuuuucccuccccucucuacccgucauucaggaucugaggcuccuuccaucuaggggcgucaucauuuucuagggucuuggaguucucugcauccagcugacagaugaaagacaagagaguaaagaugguuuuaagggaaguuucacuucugcccacauuucauugugcagaacucagucacaggcuacaacuacugcacagaaggccagaaauauuagcuguaugcccaaagaggagagaaaaauuccaaguuagcagaucauauugaaagcauucuuaccuuacauauuauaagugguuucauuauagccugcucuuuacaccauccccaaauggcuuauuuccuauggcugguuuccauagcauuaguaucuccauugaguaacagcagaguccuuuaucaugauccuuuguuguuguuuuccuuccacugcuuccaccucugaugugggagauuuuccaaacccucuagaacuauagccuagggccaacugacuaucgcuaaacaaauaccuauaaucaaacuaagguauuguuaccauagauguagaaaguacauaauuacauuauagaggaaaguugcucuuuucacuucccuggaauuauaaacauuguguacagcuggagccaggaggugguugccauaacaaccaugggaaagcuaaaaauagccccuuucauaacuguauugcuuaagguggaauuaugacauguuaugguguuuuagggcaaguaauucucuuucaugugcugaauguuugcaaacuuucuuccacaaagcaauauuuguacaauguaaguauuuggauugcugguucuaauuauacaccugaccccuauguucuaagauucuuuuugacauagaucucuauuuuuauagguuucucagucuucgugagcaucuguuacagaacugucugugccaauuucaguauuauauuuaagcuuuaauauauauauauaaugacaacccucccccucaagagccugcuuuuguacuccuugauaugaaguggaaaugugaagaauugggauggaauuuuuuuuuuuuuguacauucuuccuuggcuacaaucaaauucuguaugcaguuagcaguccccacuaggauuaacccugcaguuccgguuccucauagcagcaggucucucuucccaccugcacugugggacagugaugagguuucuaaggaagguagaaaacagugacuuacuucaaaggagaccuauuacguccucuaugacaguagaauuuuuauagagguguggacaaggauaccacaacagucugauagaauauuaaagcacuuauaaaauaaaggcuuggcaauuuuuuuuuaauccaggugacaauuaagggagucuuauugggaauuucacaggucugagggaauuccaugagagagcauaucuauaggaagcuguaagugugagggacugaguuuuauagaguugggcgaauuuaaugucuggcuugugggaggacuaguaauuaaagagaauauguuuauaugaaaagguacuuuccugucagcaauugguguuuucugcuuuggguuuuuucgcaacauuuuaguucuaguagauccucaguaauuuguaccacugagacagcauuguguggcuguuagcaaguaagcaguauaaugaauuaagaauguugcauuacagaaaacauugcuugacuuguuuauuuggauauuugucauaacaaacuagaaaaugcgcugaaguaugagcaacaugagucuucauuauagaacuucagcaaaaauucuuaauguaccuuccaaucuuagaauuguucccgaguccccagaaaaugagagauuaaccaggguuuaguuucauguuuguuucugugugcaauuaagcgcagcccauuuuguccuucugcuugauauaacagaguugucaugagucuggcugugccauggaaacugguuugacgucacuaauucugcuuagauggaggauuagagcuagacaacacgguugauuuaaagggcgagucuuuugugccuugcagucccaaaugcucagccccguuucuacauagagaacagauacuguauacaguacaaagauugaggcaggcuacaccaguauauuagcugugauucagacagaacuaaguugaauauuauugccuuuggaaagaaagagcgagagaguuuuacacuguugugugugugggugugggaggaagguuuuuguuagacaaauaugugagcuuaaugguaggacagagauuuguagaagggcuauuuucucuacugucacuuugguacaauuuuaaaugcuacucuuuuauuuacuuaggucgagugcauucuugcuuuaucauuuauuagucuuagauuuguuuucauguguuuuagcaugcaaauacuguauuuuguaugaaguacccucaaacucugacuuuucacuaauucaaagcaacuccaccuccuagaaguuuucaauaggauuagaauacuugagaaacaaaaucuuaguugccuuaaggagcaaacaaguaagggaggaugacugcaugaaugugacauuggauaauugaucuguauuguauuuuaauaugggaaaggaacuuuuauuaucuuuaaaugacuuuuccuguacuuagaucauugcuuuggugagugaaguuuuaagggucuguuuugaucaggucaagauuuaauuuuuaaagugcacuugauaauguuaaauuuuaccuuuuacagauuuuuaaauugcauuuuguuagcgagaaaugaaauuuaaaauguaagguuucuguucaagggcacauauaacaaccccagcuaacuugaguauaauggagcauuuaauccagcuguuaggccaagcagugauaggcugcagcuucaguggaaagccucauuuuucugcaucuacuucaaacuaguugugucuucacuugcugugaaugaguuuggacauagcuguucccaguuaugugagaaaagguuaaaauaaaacacuacccauaccuacaaggaugcuuaggaugcaggagaaggguugacuugucaagauugaggguuacuucuuagaaagcauauuguguugcauacgauacaauagcucucuuaguuuucacuugauugggaucugcucccaguuuaaaggugauacauuccaauaugucauaaauauuuuucucucucuuuucauagauuuguugagauaaauuucacauacugaacaaucuacccauuaaaguauacacuuuaaugguuuuuaggguauucacagagcugugcaacuaucaccacagucuaauuuuugaacauuaucaauaccccaaaaaagauaaagauauuuuaaauauuacaaauuaauacuaaauuaaaaaucuccuguaacaaaagugguuuuucuauuuucaucaaaggaauuucucagaaauauagauaaaaugaaaggacuagauauucauugcuaauuuaccaguuuuuauguucgaauuguuggguucuaacuccugauacaaauucuuaccuuaaaauuuaaaaagaaaagacuuuucugcuucugaggaagacacagacaaaaaauaccagaaugauauaauuaacccauugacuacuuauuuccaacuuuauucaaaacccuccuaauauuuuuaaauuugaaauguaauuuuuaucaucaaaaucuuaauggguuucacaguuuaggaaggcacauaauacuaauaaggacuucuguuaaacaacaacaacaacuucuuuccagugacacagacuaagcugaggacucccacuucccuuugaugguugaaguggcaucucaccuagaggcuggcagauggagcgggugacuuuuggggauuauuucauuucagauuuaugccuaaaauaacuuaaaugccauuuaaucauguauccuuuauuauuuugcauaaagggggucuuuauagucccuuuuuuaagcuaaaaaaauagguguugggaaguaaauucagacaaagaacaaugagaaaguggguuaaggaaaggaaccuaguaugggagauaggaggugggugggaucagguugcaguggcugaaaaaggggaauccucugagaagaauggauuugaggggaagauaugguagcugugacacuccuaaaccauaauucuacacuuuaccuaaccuauacauacuuuuuaacaacugguaucuuuauagcauugcuuuucucaagcuaauuuucacuuuuuuguagaauuagaaauuccugguaacuuugauuuuaaacuuucaguagucucuaaaaguuacaguaacaguugagcuuugccuuuuggcaaaagacacaguuugaugaacuagagucacauaauuuuagagucaacucuuuguuggugcccaaguaucuacaacccagggaaaguagaaguagacaguagaaguagaaucuacaacccaaggaaaggacauagccauucacucauugccagaaaguuuuauuaaguaccuguugguuaugugcucaguaccguguggaauauuuugagggaaagugggcuauuauauccagaagcuuaugguuuuguuggggggaggagagaauguuuauauacauagaaugauuaaauccuacaguaaaguaguaugugacgauauguuaaaauaaagguguaugcagggaauauaaaagaucuguaaguaaaaauucucagcacuguggcuagagaagaccucagaggguagagaucaacucgaggagacuggagaucugaucugguuaugcccuggguuacuaagacugggaaaugagcuaaucgugaagaagagcuauuuuuaguugauugaauuaugucucauuuacugaccaagcauagcacauacugaugaaaggcagggagagauaugugguagaaaaacagcuacauuauucuguuucgaauaauuauauaucucaaucuguaauucacaaacaacugcauacuguggcuucacuccuuuuacacgguacauuuuccuuuuuagauccaaaggggcuauucugaacauuucaucuggcaguggcaugcucccugucccacucuugaccaucuauucugcaaccaagguaaaaaauauuuucuuaaaucaugucaauauaguaauaagggguaauuuuuagucugagaaauuaacguagauuuaacuuuccugaaguucuguucuuggcaguuuuccaguagacugagaagaaaaggaaaauacccuacuugaguuucaaaagaaccagaguuggagacauacuauauacuuacaauaaacuuaauguaaacuuacaaaugggacaccaggauaucagauucacagaugcuguuuuucuccccccagcacucuacugauuuugaaagugauacuugugccuuccauagacaggugaccuaggcagauagcuuaguuaauuagaacaugauguuaaugagucuaagauuggagauuugauacaugaaugaguccacuucacacagcauagaagaaaugcaucuagucaauguguaaauguacauagcaggcacaagauagacugggcgagaguguauuuugccauguuguccaggauucauagauauucuuugucacuuuuggggugagacaagaauuuuccagaacucucuggacaaugucauaauuucauacaauaucaccauuaaccucuucacauuacugauaggaaaguaauuuagaaugagucuccuacugccugcaggucaauggcgucaucuucagauacauuguugaggcauugaauacaucucugaagggaaaaugaucacuuagauguugaaauuaagcaggcuuuuagggaaaaauaaacaaaaauauguacaguaagaacuugaaacauuucagggaaggaaaagagcaaaacuccgacuucuuuuucaugugaaaaaacagucaccacugucuuuugaaaagcuugguaccaccucccagccccuacaaucuacuuucuguaucugggaacauacuguaggcaaauuuaaaaugaaugccauguuucuugaagggauucgugaacuucaacuuaucuguucuacuccauggcuacaaaacuaugacuaauuaggacccuugaaaagucacuugauucuuugcauuucuagucugagguugcguccacauuugaaaaauggcacauuguauuuuacaaauagauuuaagguuguauuaucagaagaagaugggcugucacauucaccucuauacuucuuggaucuugucaucccaaagcaccaagaggaugcuuguucuguucuuuuuagcaacaacaaaauccccauagaacagaguugaauggacuucaucuuguguuucuauuugaguggcaaguggagagaugaaaugagucuuuuguuauauaagagaaaaauauuuuuucuuggaaaguaauuuucugaggggagaaaaagauaagaaaagccuuuuccaguuaaaucaaaauuugaucuggauauuauauuugguaauauaauacuucauuuaguggcagauaaaaacagcuugagguuuucagguguuuuucuaaguucucuucugcguuugaaaugaaaaaaaugaugagaaauuauagcauuaaaugauuaguuuauuauuuuguuuccauggcuacaaaucaggcagauugauguaauguguguguuuucuucucacucccacuccccucccagacuuuuguagauuucuucucucagugccuccaugaggaguauaggagcaagggcgucuuugugcaggugaguggaguuuguuucacuuaaguaucccuguuuuugugugguuuccagagcaacuguugcugucuuggcaauaacaaaaaaaaucauauuccuaaguaagugaaugugacauuagcacaccauuaaaaacgugguuucuuuuuccuuaaugcacuugucuagauuuuuaaaaaauuauccccuagaauuuucaaguagggauaccuaaaguggaacuaaaugcaguauaaauagcugaagcauacuuuuuaaguucuuaggguuuuauuuugagagaccgagacuaucggcaucucucucuuuuuuaauugugguaaaauaaacauaaaauuuaccauuuucaucauuuuuaauaugcaguucaauggcauuaaguacauucacauaucgugcaaccauugucaccguccaucuccagaacuuuuuucaucuuccaaaacugaaacucuguacccaucaaacaugaacuccccauuuccccuucccuccagccccuggcaaccuaucuaucucuaugaauuugacuacucuuaguaccucauauggguggaaucauacaguauuugaucuuuugugacuggauuauuucacuuagcaugucuucagaguucauccauguugaaguaugugucggaauuuucuuccuuuucaaggcugaauaaaaugccauuguauauagaccacauuuugcuuauccauuuacauguuagugggcaucuggguuguuucuaccuguuggguauuguaaauaaugcuaauaugagcaugaguguacaaauaucucuugcaaacucuguuuucaauucuuuuguauauguauacagaaguggaauugcugggucauaugguaauucuguuuuaaauuuuuugaagaacuuagcuauuuuccaugucagcuacaccaguuuacacuuccacuggcagugugcagaguuccaguuucuccacaucuucaccaacacuuguuauuuucuauuuuguuuguuuuuuauaauagccaucauaacggguaugaagugguaucucauugugguuuugauuugcuuuucccugaugauuagugauauugagcauuuuuucaugaguuuauuuggucauuugccuaucaccuuugaagaaaugucuauuccaguccuuugcauauguuuaauaaaaucguguuguuugguuucuugucauuggguuguaggaaugaucuauauauucuggauguugucccauuuuagauacaugauuugcaaagauuuucucccacuucgugaguugccauuuuauucugucuuuagucugcauaauaucuuuuuauucacaaaaguuuuuaauuuugauguaguccaguuuaucuauuuuuuauuuuguugcuggugcuuuuggugucaaauccaagaaaugcuugccaaauccagugucaugaagcuuuuccccuguuuuccuguaagaguuuucuaguucuagcucuuugauccauuuugaguuaacuuuuauauaccuuugaguuuauuauguagcuagcagauauaaugcugugaaaacacaaaauaugagagaaagcaaauauaggaguuuugaugguuggcaauuucaaauuaaccauucuucaauugaaagaaauaguauuuccaugcucaggcacuuuuaaaaaaugucuugggagaaguugcaauuuguaccucuuugcugcuccugccuaucagcuaccccaccucugugcacgucugguguucauuguggcuuucauuccugugaggcaaguauuucacuuuuuguauccugaagccacaaaugaucgaucaaaauaauaauagugaauauuugaguggauacuuuucagguacagugcuaaacacuuuaauauguaucauuucacugcaucucauaacaaucucauacaauggugugaugaugauuauuauuauuuuuaauugcagaaauuggggcuuagagaggguaagccacuugcccauguugaacugggacucaaaucugggucuguuuggcacuaaagccuuuguucuuaaccacuaggcuacuugcuccaggccuguaagucaacauugaacacuuacuggauccaucugugcucagggagugauggaaccagaaggugguugguuaguuccauuuccuccuuuaugccuguagagcaucaagauggguguaaaugucauguagauguagcuucuaaaccuuuuuauugaguagauacuggugggagcuaagucaccuacugugagauagaaugguaaugaaaggaaggggggaugacuguuuccucaucuuccaggaucaucuaagagccugcuuccucuaaaccccgaccugagcuuucauccaagggaagcuuagaugucauagccacuugguguuauuucugacuugcagcuucccauauguauagguuucauucggaaggacauguguucuagaauccuggauuuuauacuaaauuacuguacucucuuuuuccccuuuccuugacaccagucauuuuaauguuaguaaugcgaauguucuauguagaauauguuguauuuuaguaacaaggacaccaguaaaauguucuugagaagcuauuacauuccaugagaagguauucaugggaagguaucacaugccaggcaaugguauaccauuuucuuucugaugaaucuaauuguaauuacacuauuaacugaauaguuuguaaacaccuauugcgacuaggcaggaauccuaaaaagguccauuggugauugacuauaagcagagugaccagaagcuguaagugucucagugacagaagguagcauuaggccuugugaacagacaaucaauuucuaaaauuccguuaauaagcaagacugucuccucucucauucucacaacuuguuucccucaaagaucuuuucuccagauuuuccaccuaguaaucuggugugacuagaagcuacuguaaaaacacauuagcauuugucuucugaaauauuuuauuuugauaaacuuuuguuuuucccuaauaaugaaguauaaacugucauuucaucugucauuguguuuugucauaugaauucauucaagguuuaaacuuugaaugaauuugaugaaaaaauaaagacucaaauguuugugagggaaagcacagucgucauucugugugaauacaucagaauguugaaguagaauagaaagagaaccucuuauuaauucugaucaaaggggcaaaaaaaauguagucuaaaugaagcucagaguuaaaaaugauugguuuuucuuuggcgguguuuaugcccacaaauuuuuuggacuaggaguauuuaucagcugauucugccucguacuccagcccacacauguuuccugggugaucuuauuaaaauacaaaucagauaauguugcuuuccuuccuaguccuccaguggcugcccauaagguuuaggauuaaauucgaacuccacaaggccaucuccuuucuugccacuccauuguccuccccgacguucaggccagaguggacaucccagugucuaguacaugcucugcccucugaagugcccaugacuggcuccucuguuggcauccuuuccccaacuccucuccaguucuucucacuguaucuccucccagcccuauuugcaccugaacccuauggcugcugucccucucucaaggcuugggccacaguuccccugcccuggaaagccuucucucagcuccuuggcacauuugguuaggccuuucuuugggcucucguuggagcuccuuguauaccucugccugcuacugucuggcccuucccugucuccccacuuccauguauucucgagaacagggcuuuuuaucuuauuugucucuguguugcuggcggcacuuguuguuugugguaaacgggagacccaccuuuuccauggcaucacagaaaacucugguugugcauggucaagcuuugugguacacaggcaucuguuuugauggcuuuuugagcuucuucuauugcucccauaugcuccuggccuugaauuuucagccucuuuaucugaauggcuucuagacuaaugcuauguggccauguuuccauuuuuuucuaagccuugcaaagaaugcuaucuuuuuaggucuaccuccgugugaauguacaucagauugcucuuuuggggaaggaagaggguauauuguucaaauucuagauuguuucagauuacuucuuaauauuuuucuuuugcauuucucuccccaucuuucccucaacuucuuaacuucuuuccuauaauuuuauaagaucauuuaaaauugccuucaagaauucagauuugccauuauauaaucauuuccugggaaugcaaaaacacaguaacaacaacaagugauguaaaugcccuggaggugaaugaugggccugagagacuauuugauuuugaacagaggaugagaagcacauucucaaggaaaccuuaucauaaguguagucuguugaugaggacuguuuguucucauuaccuuauaauuaaaguccagucaaaaaaaaaaaaagacacuugugucuuucaaaaggcaaaauuauuauaaguaauuugacuggcuagguagugggcccuagcccugggcuccuucugucuacccuguacugacuagcaguuaauacugagcaagcaggaaguagcuaagacuaagacuaaauccuaaaacuauaccucuugaacucuuauucugcaaaauuuucauaagccuucuguuuuuaaaaaaauuauuuggaaauaauuucaagucuacagaaaaguuacaagaauaaaaauagugcagacaauacucugauacccuuugcuuagauuucuuacuguuaacauuuuaccgcauuugucuuaucauuggagaguaagugcaaacauuaugguccuucaauucuaaauucuugaguguguacuucugaaaaauaagggguuguuuguuuguuuguuuguuuguuguuugaagacagguucucacucugucacccaggcuggaguguaguggagcuaucauggcucacuagagccuugaccucccaggcucaagugauccucccaccucagccuccuguguggcuaggaccgcaggcacaugccaccaagccuagcauuuuuuguugagacagggucucacuuugucaccuaggcuggucucaaacuccugagcucaaguaauucucccgcauuggcuucccaaagugcugagauuacaggcgugagccaccacacccaaccagaauaaggauauucucauauguaaccacaauacccguaucaacucagauuuaacagugauacaauaauuuuaucuaauguauuauuugugcccaauuuuugaucuuacaauauucuuuauccucuccucuuccuccacuaaagaaugcaaucuaggaucaggugucauauuuaguuguccugucucuuuuauuuccuuuaaccugggauauaucuaaaaccuuuguguuucaugacagugacauuuuuuaagaguacaguauuccuccuuuuuaauuauacauuccucauuugggguuucuuugaugcuuccuuagagaaacccaaaagugagauucggauuaugcuuuccgggccaaaauaucacauauguaugugauguugugucgucagggccucacguggggagacacagaagauccaucugcucuucauugguggcgauguuucugaucccccacucuagguguuacccaacuucucugccauauaauuacuauuauuucccuugcacuaacaagcaacuguggggagacccuaaaacugugcaaauauuuuggcccuuaucaaaauuuccccuagauguagcaucagugauguuucuucacaaaccugccucauaaagagauuuuugaugcuaaagaauuccugaagcccugccuggauauuucgucauuucaaaaugaaaagucacagcuaaagcauggucacaguguccucaguccaggcugugguuuuaugaaaacugcauuggucaucggugugccuugaggcagagaggaaaggacacugagcuuggagucagcagaccaagguuugaguucugccuucaacauccggugaucaucugaccuacagaaaguugcuucauuacuuuaugccuuaaucuccccuucuggcaagugggauaagugaugugagauaaaagcacuccaagcugggaaaugauauauaagggugaagaagagaggaaagagacuuauauucauuggauaucuacaauaugcccaaguuuucaccucauuugucaacucauuuuacauagauauuaaccuagucccauuuuacaaauaggaaacaggaucaacaggagcccugugcugggcacgguggcucacaccuguaaucccagcacuuugggaggcugaggcaggcagaucacuugaggucaggaguucaaggccagccuggccaacauggcgaaaucccgucucuccuaaaaauacaaaaauuagccaggugugguggugcaugccuauaaacccagcuacuguagggggcugaggcaugaaaaugguuuuaaccugggaggcagagguugcugugagcugagaucacaccccugcauacuagccugggcaacagaacaagacuuugucucaaaaaaauaaaaauaaagaggaguccugaaacuugcuuaaagucaauuuaguuuaucaaacagcuccugccugcuauuuauuagacccuuggcuagacaucuaggaaacaaagguaaauaagacccagucccugugcugaaggcacacacacacaaaagacaaauauuuaaacacauuacacccacaguaaguccaaaacuggagguauauaucauguuccacaugucuucagucaagaaauauuuagaaagcaccuaauaaucuggcaaaaggcacacagagccucugcugugguugaauuuacauuuauugggagggagacagacauuaaacaaauccacaaauaagacaauuguauagagugauacguucucgagaagaaacuaaaaaagagugauauguucaagaacauggggaaguguagagagaauguacugaucuuggugugaguaacuccgucugcagugccauccuguuucucaaagagguguugcucuccgucacgcaguuuccuuccuuugaccugggaggccgggucucuggaaaugcucuuaacaaggagaucaucugccaagggacaccauccccugagguuuucuuuaccagaagaaagguggggaugcagauagaggccaucuaaacccagagaacuuucagcugcccugaaaaugaaguggacuuuuucauucuuagcaggagauuacaaaagaauacuccauuuacauuugaacuuauuguccugaagaaauccucugggcgccaugcacgguggcucacgccuauaaucccagcauuuugggaggccaaggcaggagggucgcuugagcccaggaguuuaacaccagccuggguaacauagugagacacugucucuacaaaaaauagaaauacauuagcugggcgugguggugcaugccuguggucccagccacucaggaagcugagacaggagaaucacuugagcccaggagguugaaggugcagugagcugugauggugucacugcacuccagccucggugauggguggcagagcaagacucugccucacaaaaaaaaaaaaaaaaaagagaaauccucuaggcuccauuugcuuguuacuacuuuccagugccuuugucuuggugaugagaguuggugguuuuguuaguucagguaaaaguguaguuuuuaaucagaauagacuugauuuggguuaauccaugaaauuuagaaaacaaauaggacaaauugagaugagagaaaacacaauuuaagaauuuuuuaaugaaagaagauauuccuucuuuguauuuuuguuacaguauuuuauugcuuaggguauucauauaguucuauugggcuucaaagaacuagaaagcuaaauauugagaaacggcuaccgggauuacaaauauaagucuccauccuuucuuccuguuaauugccagugacuaugaaaggaguuaauagagugugucuuuugugcauauggagucuaaauagggagaguuauaaagcaauauaaagauucucgcuggaaauguucauguauggccaacuauaccaauuuugaaaaauggcuuaagaauaguaaaauuaguccuuuugggcucauuggacucagaucccuuccaaccagcugaaucucgauuuuuucagugaucuccuuuuuucuuggccauuuacaacaguguuguaccacaagaccuacaagcuuaagaggucccuccaaaccauuacauguguguccaggagaacuaagauauucaguugguuaccucaacagucagauauucuccauggaaaauggcauucuuaugcgucuuauuggauauaaaaagucagccaagcucuucuuuccaaauucauucuaaaaauauagauuuuggaaaacuuagaaaauaauugcuaauacauacuaaaguuucaaaucccacacucuuuaacugauaauauuuuauuuaauucucaugauaguauaauaaggaagauucuauagccucuaauuacagaggaagaaacuaaggcucagucauugaguguuuugcucaagaucacacaacuaguaaguggucaagcuggaauuugaauccaaguuggucugauuauaaccaaugcugauuuuuuuuuccuguuacccuaccaccucuauuuucacaucccaaacuuaauccuuuaggaaauccuugcagcauacccacuauuugacuacuucucaugaccuccacuacuaccacucuaucugagccaccaucauagcuuguccuggacauuuugcaguaucuuacuaucuggccuuccuacacccaucgugguuuaacagccccuauagccuacucauagcagccagaaugaucucuuuaaaauaaaauccagcugggcacagugacucacacauguaaucccaacacuuugggaggcugagauguauggauugcuugggcucauugaguucaagaccagucugggcaacauggugaaacccugucucuacaaaaaaauuaaaaaauuagccaggcaugguggugugcaccugugguccuugauacuugggaggcugaggugggaggauggcuugagcccgggagguggagguugcagugagcugagaucgcaccacugcacuccagccugggugacagagcgagacuaucucaaacaaaacaaaacaaaacaaaaaaauccaguuacuucacugcuaugcuaaaaauucuuccuuggcuucucaucucuuucacaaugaaaccaugaguuuuuaugacccucaauguucugauuucaaacuuccacguuaucauguccccuccccaccuuccuacuucuguggccuccuuccaauucuggaaacacuuugaggaugccuucaccucagggccuuugcacuuguuccuucagucucaaaggcucuucacccagauauucuuuuggccaacuccaucucuuuguucagaucuuugguuauaagucaccacaucaaaggggccuuucuugagaacucaccugcaggcucagccucuaucagcucuuuuacccagguauuuuuuucaucuugcuuuuuuaucauugccugccaauacuguacaccuuuguuuuaauuauuauuuguuuguggucuauauccuccuacugaaauguaagcucuguaagauuagggacucuguuuuuauucacaaugaauuuuauucauuaaguucccaugccuaaaacauuguucuaguaggugcucaggaaauaguuuaguguuaagugaaugccuuuugugagauuacacuguuuuucuuuuuguuccuugaauguuaacauacaaauuccacaucuuuggagguagguuauuuacaagauuaucagccaacauuuaucaaggaucuuuguguagagcacaauacuuugaacuccuucauuuuggauuuagaugcuaagauuuauauguauuguuauugcagggccuuuuuucauugcuauauaaccagggaucucugcaccagcagaacaacuccuuuuuccuaaaauuucuagaaagucuaaggguuucugccaaguagauaaucaagggccuuuauauggaaaagcuaauuucguggucugcaaguaaaguaauacgcacuccaaaacuauaauauagguguauaauuauuuaaguuuuuguauaccagauccugaaaucguagaugaauacacagauuucaggaaauggaguuuuccuaauauucuucauaggagccccagcuucugccuuaagagugugugcuggcuacacgguugaauuuaaugcucgguaaaggcagaugugacaccauguaugaaaucucauacugugcaaauacacuagacccuaguguauucugggucuucauuuucccaggucauugucaucugauguucuggucauuuuucaguugaaaagcauguuuaguacacagaugaugacaccugaaagaugcccuaccauguuaaguuccaagguucaaucccugauucuugaauaucugccaugcaguuucaggcaucuuucuuuccacuacuccauggccauaagccuuccucuucugaaucaagcccccugaauuguacugugcaguccaguuaucuaagcaagcugcuccagugggugagaaaaaagauaccaaguugucgggccuggugcggugguucaugccuguaaucccagcacuugggaggcugaggcaggcggaucaccugaggucgggaguucgagaccagccuggccaacauggagaaacuccaucucuacuaaaaauacaaaauuagccgggcgugguggcaggcgccuguaaucgcagcuacucaggaggcugaggcaggggaauugcuugaaccagggagguggagguugcagugagccgagauggcgccacugcacuccaggcugggugacagagcgaggcuccaucucaagauaccaaguugucuccagugauuuuauuuuuuuuauuuuuauuguuuuaaaauaggcugagcaaggaagcaccaacagcuuugcuuuauggccuaauuaauuauuugccaugugggaaugcuaaauuugaagaccaggauacuugcccacaucugcagcucucaaggucagguuguuucugagcuggcaauauuuguaaugggaacuuguugaaauugagcaacuugaaaaaucuguucugcccacaauuuccuauaaaaguaugaguaucuucuugaccuguuucccauaauguuuuccugaguaagcaggagaaaucaacuaauuaucccuuguuggguuuuuauuuaacaguugaaggguguaccuagauggcuuuuugauaucuaagauauuucuuuacuuucauauaacuuggaauauuuauuuuuaaaucauuggcaaguagcuauaaguaugccuguuuagauaggugcucuuauauaugcuucagaauuucuaaaauuuuggcuuaaacauucauauuaucaacuucuugguguaauuaauuuucuggaucauagcaguggaaagagaccccaguacucuucuucggugcuguccauaaugaagugucuuucaccaauucauucaauagauauuaauuguaccccugcuauguaccaaguacuguucuaaaacauuaaaauauaugaauaugaccaagccuucauggagcuuguguucuagaaauggauacugcccagugauuggauucaguuuucuguaccguuuugccucccuccugccacucuucacacauuuccaacauuugaaccauccugagcuaugcaguucccugaaaaacaucaugcucuucuguggcuccuuuucuuggcuccugcuguucccuuauuuguuuacaauuagggaaauucuugcacuucauuuaagacuuagcucaaacgcuguuucgucuuugaacccuccacuaggccauguuaacugccuugauuuuaaaccaucguggaaauaaauauacuuucuagaaaagaauuuacauuucuuagcuggaaaaacauaacccaacuuggaauuccugaguaugcaucucuuguccccaccccuugaucuggggguucucuagacuagcucuaugguuuagcugcaugaagaguuaacuuguggcaccaccaagugguucagucaggcagugcaacuuaauucuccuacaagaucaaaguaguccaauuuauaccauguuacauacgaagggagggaagaagauggcaaaaaggauggacgaaaggaacaaaaaauuauaacgcaguugagagguauaaugauuagaccaucucuaccucuagaagcucaaaaucuuacaauaccuuuaccaggcuugugaucuauauuuggguuuuuuuuuuuaaucuucacuauuuugugaccuuuaaaccuaaugcauagaaaugagaaaugguuugcuuauguuccuucauuaugugagaucagaguauuuacauauacucuuucuuuccuuacugcucaacuuuacucugggaaauaaccuuuucuuuacugacccauugugagagccucacugaacucugcauuuccuacucagucugagucggagaucucacccuagugugugcucucauagacuauauccuuguggcaaaaugguccuuaaaagaugugacaaaaaauuuuuuuuucuaagugagggauaaauauauagugauaaucccaauaaacaaauucucagaaaucaaaaguuaccuaaucaaaguuggcucaaauauugaaguacuucauacuuaguaugagucuguggcugcagcaacaaggaaagaggaagauagagagugacagcacuccaucugggguucuugguucuaaugaagaggcugagguuucaucuaaccugucaaggagaguggguugcauuccuugacuuagacuucggagugggaaaaaugcaaagcacacacguacauaaaaacccagagacggccgggcgcgguggcucacgccuguaaucccagcacuuuggaggccgaggugggugcaucacaaggucaggagaucgagaccauccuggcuaacauggugaaacccugucucuacuaaaaauacaaaaaauuagccaggcgugguggcgggcgccuguagucccagcuacuggggaggcugaggcaggagaauggugugaacccaggaggcggaacuuguggugagcagagaucgcgccacugcacuccagcuuggggacucucgcugagacucugucucaaaaaaaaaaaaaaaaaaaaaaaaaaaccagagacaugggaccacuccuucuaggucucagcaggacggaaauccauagaauggaacagaucucaauuugauugaaauuuuaagauuuugaccaccauguguuagaaccauuccuuuucuuuaauggaagugucauugggccaagcgugguagcucacaccugucaucccgacacuuggggaggcugaagugggaggaucacaugagcccagaaguuugagaccagccugggcagcauguugaaaccuugucucuacaaaaaaaauuuuaaauuagcugggcaugguggugcacaccugugguuccaacuacucagaaggcugagacaggaggaucccuugagcccaagagcucaaggcugcagugagcuaugaucgugccaccgcacuccagccuaagcaacaagcaaaacccugccucaaaaaaaaaagaagaaaaagaaaaaaagaaguaucauugcagugauacuucacacaugugagauaaacaauacauucacucuuuguugaacuaccaugcccagguuauuucaaacuacagaaggaccucuuguaucaugacucaggacuuguuacaauaggguuuccuuauacucuguguugaaucacauccaaaaugcagcaagcuuaagcaauaaagaaccuaacauuauugaaguuccucuaaaggucauguccagauuugucacccuacacccauccagucaggugucuuuuaguuacccaaacaguuuccauauuguuagacuguguuucuucuaaaaaagaaaaaaagggaggugguucuaucuuaucaauaaaauuguuuauaaaacucagaaguagaauggugagaaacuagggaagaaaaguaguaacgcaagucugagaaauaagaugucuauuuuagaaggaucaaagcugauagaacaagcuuaauuagccauaaauuauggagaaaguuggcauuaucccauuagaagaauaaaguaucaaagaucuccuacuuggugguucugucucaauguugaguuuacuaagugugaaaaguauccuauccugaaucugugcucucuggauuauuuaaugcuuuccuuuuuaaagguucaaaaagguagauuucugcuuauuuuuaauacuuucucuggucucaaacucuguuuuauugagagauugauuuguuacaauuuguuuuaugguaucauguguucuaucaaguuggcuuuagauagccacuucucuuuucuucucucucuguaaagauacagauguuucuaccacuaagagcagucaagcaccacuguacauucugaguuuguggccuuacuaaucaauggcauguuuucugggguggguguucccuuucuagaguguccugccauacuucguagcuacaaaacuggcuaaaauccggaagccaacuuuggauaagcccucuccggagacguuugugaagucugcaauuaaaacagucggccugcaaucccgaaccaauggauaccugauccaugcucuuaugguagguagauuuuuugaaucacaaaucaauacuuucuggcuugggguuucuuucccauugaguuacaggauaguauguaauagauuagcacauauacauuguccagccauaguaacaagauaucuauaucuuguuauaauuauaauggucguauacccaagaacuuuaaaaucuaccuauaaauaaaaacaacacuauaauaaaacauuaaaucauaugcuucaauuuagcccaaauuguaggcuauaauuacauaucucucucauucuguuucccuagggcucgauaaucucaaaccugccuucuuggauuuauuugaaaauagucaugaauaugaacaagucuacacgggcucacuaucugaagaaaaccaagaagaacuaagcauugauaacugcauuguaacuuggccagaugcuccagcauaugcacguucacugcaaagcacccuacugguuuugaaaaucugaccuugucauuucaauaguuauuaacaugacuaaauauuaucuuaauuaagaggaaaauagaaguugcuuuuagggguuucugacauauauucuggauacuauccgagguaauuuugaaguuuaauauaaaugcucauaucaaaugaauauagaacuaauauugucgggaacaccuaauagaaaggaauacuauuauagcaaaucacagaaugauagacucaagcauaaaacuuggcaguuuuaucugcuucaaaaugccauugaucauuauuccuguauuuucucugaaacugauuauaaaaaccaauguccagcuacucuuuuguuuuugacacuugaagaaauggagaucgauuugauuuguuuauaagcagacacacugcaauuuacaaagaucucuuuacgguuuuauaaaauuaucuuccaguuuguacauuuauauggaauuguucuuuaucaaggguagcuaaugacaugaaaauaauugugaaauauggaauuauuucugacacaugaagcccacuaaacuaugcuuucuuauaaugcauauuucuucucaguuuaaauguauguaaauaucgaagcuauaugguaugauuuauaaagauaaaugggccaaaguguacauugagacuggcagccaucuaugguaccacugaaacccugacccagaaaaguggcuugcuuggacacccagcugccuuuguuucugcauuaaaccaauauugaucacacauaugacacaggcuaguccuauaaaaguaaugacuucauagaaauggcauuauaauuuuuaaguugauacucuacagguagcuauugauauaauuaguuuuaauaaaacaugcugcaaccaugguauacaacaaaaa

SEQ ID NO: 13292 - RNA, 136051 nt, Homo sapiens
cucuucaagauggcgggcgccggagacuagcuuccgcuuccggugugagcggcccggccgggggggcaagauggcggcggcaguagggguucguggccgguacgagcugccgccuugcuccggcccaggcuggcuccucagccuuuccgccuugcugaguguggcggcacgaggggccuucgccaccacgcacugggucgucacggaggacgggaaaauccagcagcagguagcggccggggcgucccucuucucccgugcccgcccucgccccggggggauuacccugcuuggccccuggcuguugggcuccgcgcggccccgcccccagccuacccucacagggagguggcaccgcgaccucggacucccugcauucggaccaggcaggcacuucccgcuccccacuugucuccugguccucguuuggcccccuagaaguucucacccuuccaccucgcgggccgcgcgccgcguggggaagagucgcccagcugcgggagacgggcccuacggaccuuuuuuuagcucgggguuuagaaaucacagauuucaggauuccugccuuuggugccucucggguucacgcgucaccggcccuccccgaggaaauagaaagcagguggcagcuccagggugugcgcgagucccaugguaugacagcuucuggaccccuagccuguggaccauucgugcugcuccccuagucucgucuaccacaugguggauuucguuucugguuguguugguuucagcuuguaccguuacucaggucagcaguggcucauuagaaacaacauagaaacacuccccuucagaaggaaugcuugaagaugccgcugguggcguugccugcaucuuuucagcuguuacugcccucguuucccagugcacuuugcuuuguuucuuuaccuaguucuugugacccagccucgcauggaggauaugcgauuuccuggauucuuguaugccugaacuaauuccucagaggcgagacugcuuuucuuauauaacuuuaugauugccugcguuuuguaaaugcugcugaugccuaacgagugcguguguguguuccgcuacagaauauugguaaacuuacugacuucgaacacuugaggacaaucuugaagugucuagcaaacauuuagaaagugaauugugugccccaugcaauuuagcccacugaucuaaaacguuuuaacuaguguggugggaaauuacugguccuuuggauuguguguaaugaaucaugauaggaacacauuccaacguuuaaggugagguuuagauuuagauuugccguguaauguaauugcaaauucuaucucaaguaaguuaaguauaacuaaaaauccgccuagguauucaugagugguuuucagcauaucuaagaaaagaccguguuccuauuggguaacguuuucuauaugacauacauaaagaacaguuuccuuuucauugccauacuaucugagacuuuaaauauauguguauguguuucagaaacccaagaaaacacuguaagaccauaugugagugcugguugcuuccacccuucuuuuguuucuugauagugguuuucccugaggucucuaugaagacguggaauuaagucacuccugcugcauuuuggggagccuuucuccuguuggcucuucugcaauauuguuuuuggccacagcuauuuauacucuaugacauugacuucuccuucccauuuugguguccuaccacucagcugaaaaaguagcccaucuaaaaagugaaagcugguagaaauguuuuauguauauacuuaacauugcaaugggaaaguagagucugauuuuuuuuuuuuuuuuaacaaauuccuucuuuuugcacuuuggauacauauguauuaaugggggaaggcagggguuacuggaaacuugccucagagaagcagggaagagcugaagaaucuuuuggaucucugccaagucacugcugagcuaaguaauuaggcuuaaaguuuaaaaagcaagauuucucuauuacaugacuuuuuaagugauccuuuucauugaauuuuccaauacuuugcuauacauaacauuuacaauguuauguucaggcagccacaagauuuuaugccagaagaaauaagguuggugucugcaguguaacaauaagaggccaggggaggaaaguuggauuuaaucugaagaaaaggcaccacauauaaauaaaguaaaagaauugggugcuguggugagcugccgaguuccacucugauagcugauugugcaugacccaugcuucccuuccuggccauaauuuguaugcagguagaauccaaacuaucaauuuagaucgugauuaauuauaauauuuguauauacuguacuuaaggacuugaaagaucacauuaguguaugaaauccauauauauugcagauuuguacauucagaaacauaauuaaaagcuuaguauauacagaugcuccucagcuuaugaagggguuaugugcugauaaacucauuguaagucgaaaauacuguaagucaaaaaugcauuuaauguaccuaccaaacauuguagcuuagccuaaccuaccuuaaacgugcucacaauacuuacauuagccaaauuugggcaaaaucaucuaacagcaucuuuuacaauaaaguaucaaaauaccucauguaauucaugaauacuucacugaaagugaaaaacagaaugguuauaugggcacucaguacaguugcuaccaaaugcaugucacuuuugcagcauuguaaagucaagaaauuauaaguugaaccaucgaaagguggggaccaucuguauacuuuguccugacauaccaaauucuugcugcuuauucuugguuacaauauuugaaugagagcauaagugugauuucaguuuuaaagugaccuacuaccaggcaaagggcuaagggcuaacuggauuaacagcuuuuagaaaauuagagugguacauaccuuuugagaaccuuuaauauuaaacacacccagauuagauauaugggucauuguuuuccacagugaucauaaagaaguacuuaugacuuaaaaaucugaauuguccaaccaucauuauaacuuuuuuuuuuuuuuuuuuugagauggaguuuugcucuuguugcccaggcuggagugcaauggcgcuaucuuggcucaccacaaccuccgccucccggguucaagugauucuccugccucagcaucccgaguagcugggauuacaggcaugcacuaccacacccggcuaauuuguguguguguguguguguguguguguguguguguguguguguguauuuuuaguagagacaggguuuuaccauacuggacaggcuggucucaaacuccaaaccuugugauccgcccaccuuggccucucaaagugcugggauuacaggcgugagccgcugugcccggccauuauaacuuuuuaaguacaucaaggagucuuucccaggagagaugaaaauucauuugauuuuuuauauuucaagguuuagcagacaauaaagauaggcacccaccaguuacauaccgcagacuugucaacaugcguauguauuggaaaugguacauccuuugguggguugaaaaggggguuaaguaagagcaaggagcauacauuccugcaggcaaccucuucacagucagagcuggggcugcugcaggcagcagcugguguccauuacuuggcaugaugguuaaaggaauuauuucuuuuucuuuuagagaugggggucuuucuuuauugcccaggcugaagugcaugguuacucccaugcauugcagccuuaauugaucuuccuaccucagccuccugaguaggugggacuacaggcuugugccaccaugcccagcaaguuguugcauuucacaaucccugccucagcuaggaagcauaccuuccccaauuuuuagguuauguuuacugagcugccacugaauucccaaauaugguccagggaauccuggagcugggauguggagagaacauuccaaucacuaaguuccuuuuccacuggugucaggggaaggcuaagagaaaccccgucuucuucuccucuccgcucugugcuguuuuccuagcuuugggcuuugacauaccucugaugcccuagugucugucgcugguaccugaaaccuaguaagcccaucucacuuuauuuaagcagggguccuuaacuucgaccccauggacuuaagaagugagcuauuauaaucuaguuacuaaaaggagcacuagcguaaucaggccuguggcucuuuugguugacuuuuugaaaaauagguuucaagauaaauuuuguguuguuucauuuugauguuguuuuugcuuaaucccuaguuuggcaauaucuacuuucuguauucuauuuucuauuuuuuaaucagugucugguaauuuacuugcaucaaagguuaaacuugugaauuugccuaagagccuaaccacucuauggcacuucauuuuguugaaaaaaauauauguuccaugcucuagguagcagcuaacagagaaacucuugaaauguuaccaguuuguuaguuguagccuuacugaaucaagaaguuguauugcuaguacugaguucucugccucuggauauucuuuuucuucauaauuggagggcuaaaaauuuaaguaaauuaagaguaucaucuguaucagcugucuuauacauuuuaauauucguauucuuugucacuauuucccucuucuccaaucuuacuuagaacuguggacuuucagauuuggaaaacauucuuaaagauuauguaguacaacuccuaagagagaaagucacucaaagucguguaacuaauguguggcauuucguggcaauaguaaguaaaaauggauuagucugcaguagcaugcaagugagcaccuuguacucaguagauuuuuuuuccucucauaacacuuacaaaugaaggacuacaaagaaacauaaaagcaaaaaugaaaauaaugaaguaaagguaucuucuuuuccaguuugcuuuaucuccauagaauguuuugugguaacuuaagauucaggguaaguggguguggaaggguccuaaauaagugugaguucauucggcauuuacuuaaucguuuugucccccggucaggccgguaucuucggaguacagauccucuuuuuuuuuuuuuuuuuuuuuuuuuugagacggagucucacucuuaucacccaggcuggagugcaguggugugauucuggcucacugcaaccucugucuccuggguuuaagugauucuccugucuuagccucccaaauagcugggacuacaggugugcaccaccacaccuggcuaauuuuugaauuuuuaguagagacaggguuucuucaugucggccaggcuggucuuaaacuccaggccucaagcgauccuccugccuuggccucccaaagugcugggauuacaggugugagccauugugcccagccauuaauagcuuguaagugaaggccugguuuaauuuuggucugauguuaaguaauuugguuaaucugggagagagcauccauauggcacugugaagcugacagcuuuauuucuguacuuuucaaaaguaacucaucuuuuuuugucauaaaggacuguuucuauguuuauacacuuccaggauuuaguuacaccuggagaggucauggugguuauucacuaauuugcuaggcaucugccaaaccuuugcaguuuguccaagaccuuugcuucaaaaugauucucauucaguccauuuuuucagauauuguccacuauuauuuuucuucuuauaaauuacugagauucugacuuuguuuaugcuguagggcagugagaggagcuuggaaauguacagaaauaaauuagaacuuuaaauaauuuucccacuuuuucaauuuuuuaaauuuuuauuuauuuauuuauuuugagacagaguuucgcucuuguugcccaggcuggaguacaguggcgugaucucggcucaccucaaccuccaccuccuggauucaagcgguuuuccugccucagccuccugaguagcugggauuauaggcauguaccaccacgcccggcuaauuuuguauuuuuaguagagacaggguuucuccuggucaggcuggucucaaacuccugaccucaggugaucugccugccucggccucccaaagugcugggauuacaggcgugaacccaccacgcccggccauaauguuuuuuauuuuuuaaagacaggucacucugucacccaggcuagagugcaguggcaccgucauagcucaccgugaccuugaacuccuaggcucaagugaucuucccaccacaaccucccuaguaccuggaacuacaagugcauaccaccacaccugguuaguuuuuuuuuauuuuuuguagagauaggguuguaccauguugcucaggcuggaauucaguggcaugauuauggcucauuguaaacuugaacucuugggcucaagugauccucccgccucagccucccauguagcugggacuacaggcaagugccaccacacccagcuaauuuuuguauuuuuuguagagacgggguuuugccaugucacccaggcugaucuugaucuccugagcugaagcaaucaccugccuuggccucccaaagugcugggauuacaggcaugagccgccaugccuggccagcucaucuccuucuuaacuuuguuguuuuuguuuuuguuucuuugcccuugcucuuuuucauacucacccuuuagauaaguaguucucaaacuuuaccuuguacaaaaauaauuggggaauugggaguugcuugcuuaaaaugcagauuuccaagacacccagaguaucugauucaguagguuggugguaaagcgaaggauucuacauuuuuaucaaacuccuugggagaguauaaugcagguagaccacacauagucuaagaaauucaguuuuagauauugccauccuuccagcuucuguuccaguuuuuuuaaacucuguacauacaccugagcaucaguuaccauauguaugcugagaguaucugcauuccuuuuguaacuuaguuuuuuucuccagaguuguagauuuaagaccuuuuuuuuuuuuugagauggagucuugcucugucgccaggcuguagugcaguggcgcaaucucggcucacuacaaccuccgccucccagguucaagcaauuuuucugccucagccucccgaguagcugggacuaguucacgucagaaaucuaguugucuuuaauuccuuagucucccuuagccaucaccaagaucuuuguuuuacuaauuauauuuuacuucuucccauagcuacuaucauuacucuaauucaggccaccuuauuauugccgcagcuuccuguucuucuccuuuguuuuauuuaauuaaaaauuuugaaaccauccugggcaacaugguaaaaccccaucucuacuaaaauaccaaaaaauuagccgggcaugguggugcgcaccuguaaucaaagcuacucgggaggcugaggugggagaaucgcuugagcccgggagguggagguuguagugacccaagauagugccacuguacuccagcuugcgugacagagugagacucugccucaaaaaaaaaaaaaaaauugaauucagaaauaaugcauggcauuguaaaaauaaacauccaccaugccagcaugggaauauuuaauaaagugaaaucccuccaccucuaugcacucucacuccccagggaaagcuaccuuuaauaguuuggugcauaucccaggauaugguccaaacucuuucuauugacaagguuuugguggcagggagggagacagauucucgaacauaucuuaugugaccuggcccuuccucucuagccuuaucucgggucauccuugaguaccccacccuaacccuagaguaacacacacagccauacugacuuagcuuuugugagcauccccaaauaugccguguucucacuucuucugggccuuugcauauguuguucuucccccaacacucgagucuagcugagucauacucgucauaauauaaacaucauuuucucagugaagcuucugguaugcccaaauuugaauaagcuguucuaugugcuuccauagcauccugaauuccuuuaugaaaggaucuaccauacuguguugggccuaccuacuuagguaaaugccacacuagacauuucucaaugaauccuuauaguauucaguaauauuuuagucaucuggggacuaagccuaaaagaagccucagacuuccaugucuuuaaagcuuugagucacgcauuauugaaucagcccguaggcccucagaaaaggugcacaguagaugagaagagccauaauuucagagaucauuccugcuuaccuacuguagucauguuguguuaugcaagggaaaucauccucgcugucuuuguaccaguuuagauaucuaaaaggucaacuuuaaugcgcaggcaucaaaaagcaaaaaguauggggcaacaagagacaaugaaaaagauaagcagaagaaaauaaucagaaaaaacagaggcgugguagaugagaaauggcagcugcacuguugaggagggauuagaaccagcugugggguucagcaguuguugcaguuuagaagucacucuggugaaaguaaacagaaggcgcucugauagugaagaauaaauaagagggcucacgagcugcucacgucaaaaauuagaacaacuuugcauuccaaaauguuaaggagcaggguguaagcuaaaaccugcgucucagcuguacuccuugauagcagaagugaaaacaaggggaaugucugugugugugugugugugugugugugugugugucucuuuuacagacagacacccuaaaagaguuaucugugcucguggagucuccucucucuuccuuuuuuaagcccccuccaauucauccuucaucccuauaacucuugucaagauacccagagccuaugcucaguucucacuaaucuuaaguucuuagcagcccagcauuugucuucauaucuuacucagcuauuuucuuacaugcuuaccuaaaagaguggcugacacauaguauacacugaggaaacacugaguaagggagagagaaugugugcaacuaagcaacuuuuuacaccuguaauagcucuuacaugcauuagcauacagaagagccaacacguauuccugguuuuucuucucagucccuggcccugacuucucauuuucuucugcugaauucaccuuuucuugaugagucuuagguguuggugugccccuuuucuucccucuguacauauguucaccagaugaucuuuugcagucucggggcauaaaguaccauuuauauucuaaagacucucaaaucuuacgugcaguuucaacuucuuccugaacuucagacucauauauccaacugccuacugaacaucaccauuuaguugucaucacaaauacaucauguccuaaacuaaacucuugauuuucuaccccaccacaccugaucuucccccauucacaaaauugcccagguccaaaauuuugguaucuucuugacucuuucucauaucucaaacccaacguaguaauaacuugucagcccuacuuccagaauguuuccugaauccagccaugucuuuccaccuccauuucuguaauuccagucaauacugucuucaucucuuugcagaaccuaugcaguggcuuccuaccuggucuccuugcuucuacuuuuguccccuagaucuguuaucuccagagcagccaaaguaaucucuuaaaaagcacagcuggucaugucacucccuuugggauaggagggaaacaaagaacaucagaaaaucuucaguaguuucccaucauacuuagauuaaaaucuggaguuuuccuuauggccuacaagguccuguaagaucuagaaccuggcaccugucuucuccuccagccucagacaccacuuucuuucuugugugguguggugugcucugccucagccauaccagcccucgggauguucuucaaaccaccaagcuugauucugccuuuggaccuuuguccuugcuucuuccucugcagauggcaucacggcucagccucucucuccuuucaggucucuuuucacaugucaucucuuguucuaacuaguuuuaucuaaaacagcgucuauuugagccuugacuauugugucuugauccagcuuuucacuuaccuuccuuuuagaguugcaaauguucuacuuuauuaauuauguuauuuguauaugcccuggugacaugaauuagaaaauguggacugguagcacuauuauaggaaguuacucauuugugguucauguugaaaaugguuacuaacuugcuugucaauuaggagaauggugauuguuuacagacaugaauauucucauaaaauugacugcaacacuauagauguucaaaucuagauaacaacugugcaauacgugucccuuaccuagauuauuuuauguaaauuuacagcuguaaggauacauuuguacauuucaggaacugugaaaaugagaagguaaaauccaguugaggguaaaacuuuagaaaacagggauauaaggccauggaaauucaggugauagucaagguuuagcaugauagucaagguuuagcauuuucauuaauuugaaguuuguuuuuuccuuugaugacuugauauccuguaagauuaaaauuuguuucugauuucuuuuuuuuuuuuuuugaaacagagucuugcucugucacccaggcuggaguacaguggugcaaucuuauuucacugcaaccucugccucccagguucaagugauucuucugccucagccucccgaguagcugggacuacaggcacacgccaccacaccuggcuaauuguuguauuuuuaguagagacaggguuucacuauguuggccaggcuggucucgaacuccugaccucaggaguucucccgccuuggccucccaaagugcugggauuauaggcuugagccacugcacccggccucugauuuuucaaaaauacuguacaaguacucuagcuucaaaaagucauaauuaacaaauauauuuccaaaucuuggcaguucauuauaauaguuuucucaaucucauacaaugaaauguuucuaguaaaagaucuguuuauauuacacauuuguuuugacaguuauagccaggagcccaugcguaucucucucaagaguggaagcugggcugcuauuuuugcgaaccuguacuucucuaaaccucaaagaagauguaagcccaugaugguuagacuugaauccugaagagauaauuccaugagaaguggagcaacagacuuucugccugcgucauuccaucccugugaaacucaucuugcuugcuaccauaguagccuggaagggaucgcaaacagaagggucucuuagacaaucauuugauuguuugagcuagauuugugauaaggguaaaaaucugagggaagaaagguaaggagcaagaaaauacaaaagauguuucauuuuugagauguucuaccuugguccuuaucugugagaggaauuuuuuuucucuauaagugaauacacgagggaaaaauacaagauucuuccucagaccuaagcuuauauuugucauuacaguuuguuuaaggaaaaaaaaaaaaagauaaaacauguuacguaguguucuaaaguuucaguguuaacaaacaagaugaccuguggauagcacauuaaaaaaaaagaacacuuuauaaauuuaaauaauacauguucacuguagaaaaaguuagaaaacacaaacaagaagagaauaaucacguaaagucauaucaacuagaaaccauauucuuaaaauaugauauauaaacugucagauaguuaaagagagggggcagguuuguuuguuuguuuguuuguuuguuuguuuuaagauggagucucuguuguccagucugcagugcaguggcacgaucauggcucguugcagccucaaacuccucaagugguucucccaccucagucucucaaguagcuaaaacaggcaugugccaccacacccagcuacuucuaaaaacuguuuuuguagagaugggguuuugcuauguuguucggggaggggaggugggggggggggucuugaacuuaucucaggugaucuuucuuuguccucccaaagugcuaagauuacaggugugaaccaucacacacaggugagauuuuuuauaaguacauugugaauggaaaaaacaucucaguuucucccacuguucucuuacaacauguuucugacaccaccaagcaagcagucaguucugcagcugccacaggcuagguggcuuccaauucaguucugacauugucuaccuggcaguggcaucagauccuacaggucaagagcucagugccacaagacuccucccacccaauucagucccagccucuucuaaccaaccagcuucaaguuggggcucccauagcugccucuuuggguucaauuaauuugccagaguggcucacagaacucaaggaaacuuacuuauguuuacugguuuauuauauuagaaaagacacagaugaagagaugcacagggugacguauggggcaaaggguguagaacuuccaugcccucuccaggaacuuccacauguuuggcucuccggaaucuccugaacccaguccuuuugggguuuuauggaggcuuuauuacaugggcaugauuggccuuugguggucaacuuaaccuucagccccucuucucucaccagagguuaagggguggggcugaaaguccuaaucaugccuuagucuuuccagggaccugcccugauccugaaacuaccuaggagcugccagccaucagucaacucacuacuguacaaaaagacagcacuuuggagauucuaaggauuuuaggaguuguaugccaagaaaaggugggugggguggaagaccaaauauauauuuuacaauaucacauacacaaaagaaauacauauggccaaggaagagacugaaauguauucauggccugacgcagcagcucaccuguagucccaguuacuccggaggcugaggugggaggauugcuugagcacaggaauucaagguuacggugaacuaugaucacaccaguccacucuagccuuggugacagagcaagacccuaucucuuuaaacaaaaaagaaagaaaaaauguauauauucacccuuuuuucugcauuccuaaggauguguaggaacucagucacuguuguuaggaauuuaaguugauucaacuguucuggagaaaagcuagcaaaaacuguaaauuuacaaaugcaaaaaaauaguauaguuccuuuaaccuaacgguuuucuuucuguuacaggaaagaaauaaucugauagcugucuaaaaagguucauggguuuuuuuuuuugagaaggagccacucuugucgcccaggcuggagugcaguggcaugaucuccuuucacugcaacuuccacuuccuggcuucaagcuauucuccugccucagccucccgaguagcugggauuacagguaccuaccaccacauccagcuaacuuauuuuuauuuuuuauuuauuuauuuauuuauuuauuuauuuauuuuugagacagaguuucacucuuacugaccaggcuggagugccuggcucacugcaaccuccaccucccggauucaagcgauucuccugccucagccucccaaguagcugggauuauaagcaugugccacuacgccuggcuaauuuuuguaauuuuaauagagaugggguuucaccauguuagacaggcuagucuugaacuccugaccuuaggugauccacccgccucagccugccaaagugcugggauuacaggugugagccacugcgcccagccaaaaguuuuaguauaggauguucauuguaauauuguuaaaaagggagaauaaccaaaaaccugaauuuuaguuaggaaccuggguaaauaauauuaaccacuaaaaauauugacauaggucuguauuuacugggaagucugacaaaauguacagaggaauagagagaggaaggaaauaauauaguagauauauuauuaucguauuuuugugaaaauauuuaccuacaaagcucuguguuuguguauguauguagaaguuauccugacaugauauauaucuaacagcagauaucucugaaagugaaauuucaaguaauuuuuauuuucuccuucauauugucuauaugguacuguguuuguuuuuacaguaaaauauauuuaguuuauaauucuaaaaaagauuuucuuaguauuaaguagcuuaaggauaaagagggcugauuuugccaugaacaacauaacugcucagaaguagccagccacugcuaauuagagccuugguuuaauuugacaaauugacaguuuaaaagaagcuuuuuuuuuuuuuuuuugagacagagucucgaucugucacccaggcuggagugcaguggcgcaaucucugcucacugcaagcuccaccucccagguucacgccauucuccugccucagccuccccaguagcuggaacuacaggcucccaccaccacgcccagcuaauuuuuuguauuuuuaguagagaugagguuucaccguguuagccaggauggucucgaucuccugaccucaugauccacccgccucagcuucccaaagugcugggauuacaggcgugaaccaccacacgcggcccuaaaagaagcuuuuaacaacagcuuuggaaaauauuccugcccagagugaguacgaauuuauaugggcaaauugaaaggaugauaauuucauauauuugaauaucagacuauuuuggggguauaggucuggcuaguaaaaaugugauacuuuuacgguaacguuaagucuuuuauagaaguaggauuugaaaauuaaaaggaguuuuagaaaucauuugcuugcgucccuucaguuuauagaugaagaaacagaagcccaggcagggaagaugaucuguuuaaagccauacaguuagucauagacuggucagaugcauauuuuguuucugaucucugguaccuuagccacuucacguuuuuuuuccaaauagucaucagugaaugauaaugcuuuagcagauggaguuggaguaucuaauaaauguggcagaguaucuaacagauacuguccucaaacaaucaacaguauauuaaaugccuagcauauaccugaaagcaaguuacauacugaagguagaaaaagaaauacauaaaaaaauuuuugugggaaagcacucccuauucaauaaauggugcugggaugacuggcuagccauaugcagaaguaugaaacuauaucccuaccuuuuaccauauacagaaauuaacucaagauggauuaaagacuuaaauguaagaaauaaaacuacaaaaauccuagcagaaaacccaggaaauaucauucuggacauaggccugggcaaagaauuuaugacuaagaccccaaaagcaauugcaacaaaccagaaauggacaagugggaccuaauuaaacuaaaaagcuucugcacagcaaaagaaacuaucaacagaguaaaccuauagaaugggagaaacuauucucaaacuaugcauccaacaaagaucugauauccagaaucuauaaggaacuuaauucaacaagcaaaaaacaacuccauuaaaaaaugggcaaacgacacaaacaggcacuucucaaaagaagacauacaugcagccaacaaauaugaaaaaaugcucaacaucacuaaucacuagagaagugcaaaucaaaaccacaauaagauacuaccucgcaccagucagaaugacuauuauuaaaaagaccaaaaaaaaaaaaaaaaggauguuggcagggcuauagagaaaauggaagucuuauacacaguugauggaaauguaaauuaguucagccccuguggagauuucucaaagaacuuagaacagaacuaccauuugauccagcaguuccuguacugauuauauacccaaagaaaaauaagagccacaguaguaauaagaugcccuaggcagagggacauaggugaaaauuagguggaaguuuagaaauaacacaucaauacuuucuguauuauaaaguuuucauuggaauguuugggcaaauuguaagggcugcagauacaguuugauucaggacucaaauaguauaacaaggaucaguuuuucuguuuuuguuucuuugcuucgucauccccauucucaggccccauguagauacaagauggcuaguuaccaauagcucaaaguucuggauuagagucucuuuaguaccagcugaccuuacuggaguaguaucucagaaauaaucaccaugaccaagggaaagaaauucucugacaacggcuucccauauggggaaggaagcaagugaggugcuuuugccacaggggggacuuauggauauuggauagcaaacacuacaaauacucacuaaacagaaccauuucagguuuuacauagaggcaaaaucuuggcgacuuugaagauuuugauuuauguuuuccuucauauugucuuaauauuuaaauaacuauaauucugaauuaaaauauuaaaauuauuuugucccuaguuucuaacuuaaggggaaaaauuuuaaaugagaauggcauaauuuaagauuauauucaucaguuuccaagugcuauuuggagaagagugaguuucccauauugcuuucguguaccuagaugaauaccauuuaaaaaaaaaaacagugaaaguguucaguauauaugaagaauaaguugcacaugagagcuugaauuaauguuacaacagaaauguucaguuuucugccauaaagaauaauuaaaaagugauugacucaaacuuguuuuuguaggacaucaaaaauguuuauacucuuagauugguuaaguuuaaaauguucacccuuaaucugauuuggcagugaaauaauuacccucauauagugagugauauuuccauguuaccaugugaacuuacugaauuuguugagauaggguuccagauuggagguguagauauuaacaauaucuugguuaauuaaagcaacaaauaacaugaacauaauuugauaggaguaaaauauuuacucauguuauauauaauuggauacauguacagguugaguaucccuaaucugaaaaugcagaauccaaaaugcugcagugaacucaaaaaguaucggauuuuggagcauuucagauuucggauuuucagauuaggaauauucaacuuguacuuacauaauguauucaaaggaaaaugaaauugaauugccuuauauggcuugucauuuucuuuauuauaauaaacugcuacaguaacagugaaauuuuguuuacuuggaacucuuagagaaugaaucauucugaauaauagaauuccauagagccuaauuuccagauacuugaucagguuuucccuguaguuuaaauuuuucucuaaaauacuuuucauaauuucuucaccuccuuaaaguaagugaaaaugauuauaauuuuucuuuacaauucagguuauuauuugcaucauuuauuguucugugcagcaauggaaguuuguaggguuguuuauccuuugugaaaaagccauaaagugcuuugagaucuuguguguucauuauguccuuuuuaaccuaccucucuguaauuccugucuccuuuuugcuucuggacuuacagcagccucuuuucaaugcuaaagacuuugaaggcauauuaacauucuuuuacacguuguauaugacacaggaguacauagacucuaaacauugacucaggacaucgacucauagugggccuggcuuauagaagcuuaauaaacacuuauugguugaauggauguuguaacauguucaugcauugcuuaaaaauggggguguguucugagaaauguaucagaugauuucagccuugugcaaacaucauagaguauacuuaaacacaccuagacuguacagccuacuacacaccuaggcuacacacuuguacagcauguuaugguucuguaggcaguuguaacacaaugguaaguauuuguguaucuaaacauagaaaaggcacaguaaaaauacaguauuagguugggcgugguggcucaugccuguaaucccagcacuuugggggccgaggcgggcgaaucacgaggucaggaguucgagaccaggcuggccaacauggugaaacuccaucucuacuaaaaauacaaaaacuuagcugggcguaguggcggacgccuguaaucccagcuacucgggaggcuaaggcaggagaaucgcuugaaccagggaggcagagguugcagugagucgagaucacaccacugcacuccagcccaggagacagaguaagauuccgucuaaaaaaaaaaauauaguauuauaaucucaugggagcaccaucacauaugcagucugccauugacugaaauguuauuuggcauauaacuguauuuacaaaguugucaaacauacucugauaaucuaaggaggagaaguauuugagaagugagaaauucacauuaacauuucccaaagacaagucauacaucuuaaaauuuaagaacuugaaaguaccucagaaaacauguaugucaggcuguaagucuucugcagucaacuuuuaucuggcaaagaucuuugccauuugcugucaccucaaaaagagaaacacagcugucagugaacucccuuccuucugcuaauaauuuuaucuuuaugccuccucuguaucuuugcugaacuaaaagcuucaaggaaaugauaaguacuuccucacaauugaauguugaccagauccaugcuauggaaauauuauuaaacuuuguuaucuaguaacuuuuuaaucuaaagcuaagauuaugcuuuaaauaguucuuucaaucuucauuuaucucauuuuuucuuucuugcaauucuucaaauaucagguaaacagacugguuaggcauuuuguuuuuugguuuuguuuuguuuuguuuuuuguuuuuuugagacagagucucgcucuguuguccaggcugaagugcguuggcgcaaucucaggucacuguagccucuaccucccggguucaagcaauucuccuaccucagccucccgaguagcugggacuacaguccugcgccaccaugccagcuaauuuuuauauuuuuaauagagaugagguuucaccauguugggcaggcuggucucaaacuuucaaccucaggugauccaccugccucggccucccaaagugcugggcuuacaggcauaagccaccgcgcccagccuugguuaggcauuuuggaaugggacugucacacuuccacaguuucuucccucccccaauuuuauuuuuucuaaaaaucucauuuaaaaauaccuguagagucauguacuaaauagcuaucucuugaugucuggacggaguuguaaauuaagcacuuucuccugcuuccuuauguaaagcucuuauacucuggucacuggcaguagcuuuaacauuuuuuccuguaucccauuccauuggacagugggucucucugucacuuuauugauuuacuuagguuguuucugauuguccuuuugcagcuacaaauguuguaaugagcauccuuauguauauccuugccuacuuauugaacaaugucuguaggauaguuuccuagacuuucuuuugcucaaagguuaugcaauuguaacauuuugauauauguugucaaaugacacuccaaacaaugagaacacauuuauaagccagcuaccaguauaugaguguucauuuuuucuacagcuucaacauaauuguuugauuuguugauccagagaacaugagcaauaaguaauaaaucucaagguuauuuuauauuaucuuugauuuaugacuucuacaaauagcuuucaaaaagagguacauuuaauauuuuccuuuuaucacuuccaagccuauucagauaugaaaugugcuaucaaaacaagacaauucauuuuuuauuauuacaggcaugaaacaucauuuaaggaaguuacuuuaucaaucauugccaaauacuucuuuacuauuauaucaccuguaaagucagaauauguacuuugaaugcuuguucuuccaaguuggaguucacaggacaacuguugcacuugucauucccuuugcuaacauuuacaugugaucacuuugaaauacuccuugaguuuugcugaggaauaacgcugauuacaauggcgaaugaacaauaauuuaaagcauauuaaugacuuuguuaauccaaaccagcauuaaugaaauccgagcuuuauuuauuuauugcuugcuugcagguggauucaccaaugaacuugaagcauccucaugaccuagucauauuaaugagacaagaagcaacaguuaacuaccucaaagaauuagaggugaggcaacugggcaugugagaugcagcugaugcuuguugcauuucacaggagccauuguguucaaagaaaagcuaaagcauauuauuuuuuaagucugagucuucugacuuuugcgggaauauacuaccugcaauguguguguguguguguguguguuuuuucuuuaucauuuuaucaaagugauauuugaguaguaguaagaaaaacagacuacucuagccuggguauaugcgugauucuuaaaacucauuuaucuuugaacagaauuucuguguuuuuaaguuuuuuccaucaaauaugaaaaugauauaaucucugaagauauuccuagaauaaucuggauaaaauaugaaaagaaagaaagguuuuaauagccuaaaaauguaauuauuguuuauucucagguaguaaaaacuaaugucuuccuauuauguuuucuuaugguugacgugaaaaacauuaaucaccuuguuccuugaaagcucgaaucuuauuagugcuaauaaaaucugacuuuuuuuaauaaacaucaguuuuccuuuucucuaacauauuuccauaaauugauuuugcuuaauagcaaacaguauuuguuauuugaaaaacuagguuuuuuuuuucucaugaaaucucugcuuuaaaguuacaguguaaauugaaucuaaauuguaaauaaacuguaaguuguagaaacauuaaaucaaauugcaaaaugagaaaaaaacuaaugggaauaauaaaaguaauaaaaguagaaucagaguauuugagaauuagaaggaaucauaagaucauccucauuuuagaggcaaggaaacaauuagaccuaaagacaaugaauugccugacuucacaaagcaagauauggcagaaccagaaacaaaagcuguaucucuugacuuaaaagcuggcauaccuguuuuuuguuuuguuuuguuuuguuuuuugagucgaagucucacucuugucggccaggcugcagugcaguggcaugaucuuggcuugcugcaaccuccaccuccccgguucaagccauucuccugccucagccuccugaguagcugggauuacaggcaccugccaucaugcccagcuaauuuuugugcuuuuaguagagacggcuuuugccauguuggccaggcuggucucaaacuccugaccucaggugaucugcccaccucggccucccaaagugcugggauuacaggcaugagucaccgugcccggccaaaagcuggcauaccuguuaagccaaguuggcauguauuuucuuguuauguaaaagucccgaauuucauuuacauacauuuaguauauuuaucaacauacauaugucuacaaauaguuauaaauauguacuuuuaaaaaaaucugugaauuaagagagagaagacuuuagcacaugguaaccagcucugccuaauuaguaguauauuuagaguguuucuagaacuugaauaccucaacauuguaaaaauaguuucucaccuuguuccuacugguuuuaucacuuguaaauuuggaaauguugauuuuuaucaauacuaggaauuagacaauagguauccuuauagugcuucaugcuuggaagcaugaucuauuuuuauuuaaacccgguguucagaaagaugcaauggugcagaaaaaaauuuuuuuuucagguauauagacacauuguauauguuuauugcuaucuuuuuagggaggcaguauuauauaaagagaaagagauuuaaauuggaggauauauaggaagaaagugccauuuauuaagucagugaaaaugaaaugaaaaauauugacuccaccaauuuuugguuaagguaguguaggaguuuauacuuauacuaaauauaaacuucuauuuuuguuuauacuuauacuaugaagcuucugcuucauaugcauagcagugccagguaaaauauaaaaauauaaaccaaaauaaaauguaggcaggcuugaaaguaguauaagcaucuccauaaaccagaaaugaggagaagcacuaaauugggaauguggccaaagcuaccgaccuuuugggcuccaaggccaggagcagacuauaguagugucugauaugcagcacuguggaguuaagggagcugacaguauuccaugcaagauguaggaacagaacgaggcuuacugcuugaagacuaggauggagccauucugcuccuagaaagagccuggcaaaaauaauaauaauaacaacaacaaaagaaaacauaucaaaaccagaaagacuaacccugauaaccaaaaaaaggaacugaaucauccaauaguucaauaauuacaucuucaguuuccugaauaucauuuuaggauagaauauuugggauaggaacucgaaaccaaaauuggaaggucugauucugagcuugguaacuggauagaaccuggaaacaaccacaaaacuaugagaccuagaugauggucauggaaugauuggaaagaaggggaugagacagagggcaugaagaaauacuucaggguuucugaccugagugauugcaaggcugagguugauauuagcugagauaaagaagacugaaggagguacaggauuggggaggaguuuggcuuugaaauguuaacguuugaaaugccuaucaggcauucaagaauggaugucacgugggcaguugguccuucuagugcaaacucaaggggaaagaugcaggcucaagauagaaauuuguuagucauugacagauagacauaaagccaugagacuagauaaaacaguuuaucuaccaaguagugacaacuauaugaacaucuuagauaacagaagacagugaaggguaagggaaaaucaauucuacugaaauuuuauauucuuuuaaacuaucauuuaagaaugagggcaaaguaaagauaauuucugacauacaaaagcaguacuaaccacagacccucacuucagcugaaagaaacauauuaaguauguauuucugcaagaagaaaaguaaaccuaguggaaguucauagaaugucuaaugauaaguuaaaaacauugaugaaaaaguugcuaaauuuauuuacuuauugggcucucuaaggucaaacuagauaaaauuaauaauauguaguuggguuggaguauguucaguaauuaaagcauguuagacuguuuugucauguucaaaagauaaaaauaacugaauaaauuaaaauccuaugggaaaauuuauuggcaaauauauuaaaaacuuaaggauguugcuugcuacuuuuuaaguagucuugccaaaaaauaaucaaaccacaauauaauuuguuauucaauguaauuuguuuccuuugucuuucucuuacauuuuauauauuuaaaagauuauucugagaagagauuuauaggcuucaucagacugccaaagaaguccaugacacaaaaagauuauuacucuagauccugcugucaauauucaggaaauacagaaaauagaggaacauguucagugaaccuugaguaccuagucagcaaauuccccuagaguggcaaacucuacagaacaaacaauccaauuuccuuuuucuuuuuucuuuuuauuuucuuuuuuuucuuuuucuuuuuuuugagacagggucuugcucugucaccuaggcuggagugcaguggcaugaacacggcucacuucagcuucaacuuccugggcucaugcuaucuuccugccucagccucuuguguagcugggaccacaggcgugcacaaugcccagcuauuuuuuuuauuuuuuguagagacagcgucucacuuuguugccuaggcugguuucaaacuccugggcucaagcaguccucccaccuugggcucccaaagggcugggauuauaggcaugagccaccaugucuggccccaguuucuuuaacaaauaaauuacaagggagugggggagagagagagagagugguauccaguagauuaaaagagauguaagagacaaaucaaccaauugcaguguguauggacuauguugaacucugauucaaaccaacuauguauuuuuuuauuuuuuuauuauuuuuuugagaugaagucuugcucuugucccccaggcuggggugcgauggcgcaaucucagcucacugcagccuccgccuccugggguucaagcgauucuccugccucagccucccgaguggcuaggauuacaggcaugugccaccacgccuggcuaauuuuuuuuuuuuuuuuguauuuuuaguagagacaggguuucaccauguugaccaggcuggccuuaaacuccugaccucagguggauccgcccaccuuggccucccacagugcuggcugggauuacaggcgggagccaccgugcccggccacaaacucuauuuuuaaaagagaagaaacaauugggaauuugaaugcagacugaauauuugauauuaaggaauuacuauuuuuuacaugugauagugguguggugguuuuauuuuuuacaaaagaggcuuuucuuuucaaaacauacugaaauauuuacugacgaaaaccaaaaacaaaaaaaaauaggggcaagcacuaaaauaauagacaugcaggccaggugugguggcccacaccuguaauccuaguacuuugggaggcuaaggcaggaggauugcuugagaccaggaguuuaagacccugucucuacaaaauaauuuugaaauuagcugggcaugguggcaggcaccuguaguucuagcuacuggggaggcugaggcaggagaauugcaugagcccagauguuugagguuacagugagcuaugauaguaccaccgcacuccagcaugggugacagagugagacccugucucaaaaaaaaaaaaagaaaucuauaguuaccaaacuuacaaauaaaaaaagaggauguaggaggagaggagagaacauagaaaaaguaucuacuaugcaaaugcuaagcaaaagaaaggugauauggauguauuuauacaaguucacaguuccuuauuugaaaucauuggggcuauauauguauuuaggaauaugguuucuuguuuugguuuuuuaauuuuagaaauguuaggccaggcacaguggcucacgccuguaaucccagcacucuggggggucgaggcgggcagauugcuugagcccgggaguucgagaccaaccugggcagcauggagaaaugcuguuucuaccaaaaauagaaaacuuagccagcaugguggugugugccuauagucccagcuacuugggaggcugagguggcaggaucaccugagccagggaugcugagguugagugagcugagauugcaccacaccacugcacucuagcagccugggucacauaccaaaaccaggucucaaaaaacaaaacaaaaaaaagaaaugugaugggcacaaauauuuuauauuucauucuacuucucagggcuauuucaaacucuacaaucagauacauuaauauuucuuuagugacauguaugaccaugcaugguaagaguauaaagacuguaaaauggcuuuccaucagguuuuguugccaugugaauuuuaaugcaaaaaauuuuuuuaaagcuuuagguuuucagaauuuuagauuuacaaugguaaagaacagugggccugucucaggcaaaauaagagccuaaaauaauuaauagacagauacuacuugcuaacaaccuaccaaaaaauauaauaucguauacuuguauguaccuaacaacucggccucauggauauaaguauguuuauaucaagacagcaaaaacuaacagaauuacaugaaaagucaaccagaggaagcgauuuugcagaucuuuaucagaaacugauaaguccaacaaaaauacuauaaaauacaggagguaacaccuuuggaucuauauauaucuauauguagauguauacagcaagacauagaaaaagagauagagggagcgaguaugcccuaaauugaacgaagauaacauacaguguuuucaaguagaauauuuaccagaauugaccacugccaggauauaaaggaaauaauuuacaaaguuuuguuaucaugcauaacauguucucugaucacagugcaauuaaguuaaaagaaauaaaauacacauacccaggaaaaaagagagaaaacacaaauuuuugaaaaucuugaaggcauucuuaaaucacccaugguuuaaagagaaaacucacaaaacuuuagacuauggugggaacacuucauuucaaaaauccugaaaugaagcuuagauauauuuagauaugaauuuauagaaaaaugcauuuauuaaaauaaauggcacaguaacucacauuuguaaucccagauacuugggaggcugaagcgggaagauugcucgagccuaggaguuugaguccagacaggacagcauagcaagagcuugucuuuaaaaagaaaaaaaaaaaaaaagacugaaaagaaaugaguuaaauauucaacacgaguuagaaaacauaauaaaccaaauaacuaaaauaaccuaauauaaauauggaaauaauauuauaaauaacauaagaaauuaaacagucucaagaaaacaguauuguuuauuuaaaaaauaaaccaaacucuagcagcaaggcuuaccagaaaaagaaaugacagaaaaaaagaaauguuagugaugaaaaagcagauaucagauaaagauuuuuuaaacuaaagacauaauuauuaauacuacaaaaacuagaccaauauauuugaaaacuuagguauaauguaagguuuuagaaaacaugaaauauaaaaauugauugaauaaauggggaaaggauagacuuuuuauaaaugauauuaggaaauugauuguccaugugggaaaaaaauaccuuucaauguacaaaaaaaaaaaaauuuccuaugcaguuuaaaaaucuaaguaugaaaagugaaacuuuuuacuaaaaaaaaauauugauagucaugcauugcuuaacgucaggaauaugcucugagaaauguguuguuaggggauuucaccauugugggaacaucauagaguguacuuacacaaaccuaggugauaaagccuguauaacauguuacuguacugaauacuguaggcaguuguaacauaaugguaaguauuuguauaacuaagcauaaaaaagguacaguaaaaaugugguauuauaaucuuaugagaccacugcuggggucccuuguuaaccaaaaacaucuuuaugugguacuugacuguaguugauugauguaauuacgaucucagguuugggaaggauuucuuaaauaaaacaaaguacaaacaauuaagaaaacaguugauaaaguugcccaccuuauaauuaaaaguuuuucuucaaaugacaaaauuaaaagauaagcuacaaacuaaaagcugauacuugccaugcauauaacucauagaggaugaguuuauagaauuacuuuuuccauaaauuucuauagauuaauuucuuacguauguauguauuuauuuauuuauuuauucauuuuugugagacagggucucacucuugccccagcuggaaagcagguaggaugaucauugcucacuauaaccucauugccugggcucaagcaguccuccuaccucagcuucuccaguagcuaggacuacaggcaagcaccaccaucauacuuggcuaacuuuguuucauggggauggggucucgcaguauugccaggcugguuucaaacuccugaacucaagugauccucuaggcuuggacucccaaaaugcuaagauuauaggcacaagccaccacgccaauccuacuaaucaguuuuuuaaagaagaaaagcuauuggggggaaaaaauaagcaaacuuaaacaguuaauucacaaaauaucucauaaacauaugaaaauauguucaaucuuauuaaauauuauucuauugguugauauaguccauauuuuauaguguauuagucagcuuuugcauuggcaacaaauagcccgcagaaccucagugcuguucucaugaaggaaagugaaggcucaaggaagaacaaccaaauaauauaagccugguuaaaguuucuacugagaagugacauacaccaucuuuacucacauuccauuggccaaagcaagucauguggccaugccuugaagucaguagggcaggauagcauaucuccaugaaaaguguggagggaauaauuggaaacagaucauaggcucuguccccauuaauaauaaccccaaaaaucuuaauggcauaaacaauaaggucaugcuaagugaucauuuggggcucuguuggggaucuguaccaugucacugugauccauaagacaggaccuaggccgacagagcagccucugucuguaauuuuggcauucucaguagcugagggaaaaagaaagaacauggugaagcacacacuaacucuauaaaaccuuuccuauaaaagggucacaugggacuuauguuacauuggccaaagcaagucauguugcccaagccugaguccagcaaaaacagugauguaucauguaaggaggggcaggauauuagugaauaguaauacaguccaucacaauaacauagucuacuaccauaauaaauauaacaaaauaauguuucauaccuauuugauuggcauaaguuaaaaaguaugacaaaaccaaacauugcuaagauucuggggauauagguguuaugaucuacugggacaauucuaauuguuauaaucacugugaaaagcagauugacacgucuauauaaaacugaaaaugugcaucccauaugacccccauauuucugcccuugcuagaauuuuucacauguauacaaggagacauuuauaagaauauaguagcauuuuuaauagcaaagaaaguuuuucuuaaagaagcaacauaaauguuuacaggaaaauggauaaauacauauuuauacauccauuuaaaugaaaaauuuagagcuauccugacuaauguagauaaaucucaaaaacauacauacuuuuuuuaaguuguagauacauuaaguaugauaccauuuauauaaaauuuuaaaacuuacaaagcaaugcuguauuuugauuuuugauacacauauaaugaaaguaauauuuuaggagaguaagaguaauguaguauuuuauacaaauauuuauaaaaauauacauggaaaugacacauaaauucagauuaauuauaagaaguuagagauuuagaagacauuaaagaauaccuugaacucccuuuuuuuuuuucuuuuaaaaaaaaaaucugagcugggcauggugucuuaugccgguagucccaacacuuugggaggccaggguggaaagauugcuugagcccaggaguuugagaccagccugggcaacauagugagacuccauuucuauaaaacauagaaaaguuggccaggcaugguggcugaagccuguaaucccaguacucugugaggccaaggcagguggauugcuugcacucaggaguuugagaccagccugggcaacaugguaaaaccccaucuguauggaaaaaaaaaaaaaauuagccagacaugguggugugcaccuguagucccagcuauuuagggggcugaggcaggaggauccccugagcccuggaguuugagguugcagugagcugugaucgcacuacugcacucagccugagugacaaagugagacccugucucaaaaaaaaaaaaaaaauuaacugggcaugugggacaugccuguaguccagauacuugggaggcugaggugagaggaucgcuugagcccaggaggucgaggcugcagugagcugugaucacaccacugcagcacuccaaccugggugacagcaagacacugucucaaaaaaaaaaaaaggguggaggggggagauaaaauauuggcauaugauagauacggguggugaaaauguggauauuuguguuauugucuguacauuugaaaaaauagauauuuuaugguugacaggaauuaacuggaauacccagguaccaauagcaacauguacuaugucuugaaggauugaaacaaccugacagguuuguuuucacugcagagccauuuugugccaggaaaguuaaguuaguagaugugcuucguggguagucagaaaucaucuuaugaaggcccaugugugucaguaugauaaauguuguguucuguuacuuucuguauguggacaucuuuuuugagaagcuuguguauguugacuaaguuaacuaagggcauuuucagaauucuugucuuccuacauagaggauucugacuucuucagcucagauuccccuuucucuucaaugguaguuagacuaaaauauuagaagaauccauucuguucuuacuuucuucucaacagaaacaauuaguugcucaaaaaauucacauagaagagaaugaggacagagacacaggacuggaacagagacauaauaaagaagacccagacugcaucaaagccaaggugcccuuaggggaccuggaucuauaugauggcacauacauaacuuuggagagcaaagacaucagguaaagaaguucucuuuccaaaaauaaaauugcuguuucaaacauuuccuuucucaaauuaguaagaaauuauuucuguaauaaggguaagcuucaaucacagaugaguuuucgaauuugaaaauucaaaauacauacuacauguagaauucuuauaaauuaauuuaaaauauuuaacaccacaguagaaaauggaacaacuuggcugggcguggugccucacaccuauaaucccaguacuuugugaggccaaggcgggaagauugccaacagccaggaguuugagacaaggcugggcaauauagcgagaccccaucucuacaaaaaaaaauguuaaaaauuagccaggcaugguggugugcacuuguaguuguagcuacucaggaggcuaaacugagaggaucacuugagcccaagaauucaagguuacagugagcuaugauggugccacucuacccuagcccagacuccaggcugggugacagagugagacccugucucuuaaaaaaaaggccgggugcgguggcucacaccuguaaucccagcacuuugggaggccuaggcgggcagaucacgaggucagaagaucaaaaccauccuggcuaacacggugaaaccccgucucuacuaaaaaugcaaaacaaauuagccaggcaugguggugggcaccuguagucccagcuacucgggaagcugaggcaggagaauggcgugaacccaggaggcagagcuugcagugagccaagauggcaccacugcacuccagccugggcgacagagcaagacuccgucucaaaaaaaauaaaaaauaaaaaauaaauaaaaauaaaaaaauaaaaaugaaaaauaaaaaagagaaaaaaauaaaauugaacaauuuguaguuaaaaaaauuaacaaaaacuaccuauggccaauaaacauggaaaaaaauuucucagaaauuaucaaaaaaguacaaaugaaaacauuuagauaguuuucaucuaccaaaauggaaagcauaucaaaaaaauaguaacugguaaaaauguagagagacugucaguggaaguauaaauugguuuaacguuucuagacaauugagcaguuguauuaguuauuaaaaaguccaugaucuuauucugugaccuaucuacuauuuucccugugauucuugacuuuaauucaaacucccaaaauguuugacucuucauggcagcuaugugaaaagguaugaauauugacuaacaauuguguaaaguugagaugcuaugagaauauggggaaaauuugacauuucuuaaaguauuauugacugagcacagugguuuacgccuguaaucccagcacuuugggaggccaagaugggaggaucacuugaggccaggaguucagaacuacccugggcaacauagugagaccugucucaacaaaaaguaaaaaaaauuaacugauugugguggugcaugccuguugucccagcuacuuggaaggcugaggugagaggaucgcuugagacuaggagaucaaggcugcagugagcugugaucaugccacugcacuccagccugggcaacagaaugagacccuuucucuaaauaaauaaauaaaauauuguuuaucucaccuuuuauucauucauugcuucuuuuugauuuuaguccugaagauuauauagacacagaaucuccugucccuccagacccagagcaaccugauuguacuaaaauucuagaacuuccauauaguauacaugcuuuucagcacuugagaguaaguagagaacuuuaggauuuuuuuuuuuuugcguugcguucuucuuucaguuggucucucacuuauaaagaccauuucucuuucuucucuccuuccugacagcuuuguaauuuuauagacaucucuuauuucuuaaaauuccaaaauauuaguauuucaaaauaaacacuacaagauacugaauuauuugucaucuuuuauauccuuugauaugucuuuugaaucuuuuucuucucuucaggguguacaggagagaguuaaucuuucugcaccucugcuaccuaaagaagacccaaucuucacauauuuaucuaaacgguuaggaaggaguauagaugacauaggucaccucauucaugaaggccuacagaagguaagucaucagucacuuaaagagccagcgggcugagccagcgggcucuguguaaacagaagauauuuuuaucuuggaaaauaccugacuaauuuguuuuuaucuagaagacgauuuaaaauuacacuuacauugaugcaaauugcauaguucagugcuggggagaaauauggauagacuagucuccuuucccaggaagagaugcuggaaaguuuuaucuaaacugaugaaaaacgaaauauaaacugacauaagcaacagcguuuauaggcuggauuauauacauuguguaaguaagaaaguuaauguuuuagugucguuaauauaucuauacacaauacauguauuauuacuguuuucugagacagaaaaagaaucaccaccagcaacaaaaucuucuguaacuuucuuuuaagagacuaucuacuuuaaaaaaaaugaaauagggaauuauguaacaggacccaggaauguaaauguaucauucaggauuaacgugggcauuuagaaaauguuuuugcuauucuuugugccuaaagaguaucauaaaaugcaguuuaguuucuaagcaguauuauagugguauaaaauaagauguauaauugccaccuuuguauacaguuuuuucaaauacauagcuuuguauauugagaggaauuuucagauaaaaguccgauaauaacuugacuuucagaugcuuuauaugguuauuucuguagcuguguuaccaucuucaucuuauuuuucugaagguaauguaaaacuuuuacauucccagaacuugaugaguaauaagagaaaacuggcccaggauuuuacaguguccuucagagaaugguuaguugagaguagaccauagugguaaguguucuauagaaaauuaaaacagaaaguaacuggguggcuacuuuagaucuagcaguugggguuauccuauccggaaacgugaaauuuaagcugacaccugaaucauaagaagaaaccaaaauucaaagaccacggaagagcauucuaagccacagcaaaggcucugaauccugauugagguuaggugguuguauuugucugcucaggcuuccauaacaaaguaccacuuuggaccguuucugcucaaaacacuucugacaccaaauguauggaguuuuuucucacacgacuaauucgguaguucucccgacaucaacuagguguucuacaacucaauacaauucugacacuaacuaccuggaguuagcacagaccccacaggucaaggacucagucccacaaggcuaccugcacuucagaugccagucgcaagucaaggccaccagacaaauuagcuauaaagucaggguguucccacagcugccuccccaaguuagaacagcucacggaagucaggaaagcacuuuaccuacuauuauugguuuauuguaaaggaugcaauucaggaacagccaaaggcauaagccagggaauagggggaaggggugcacagagcuuccauguccucuccagaacaccacccuccuagaaucucaauguguucaccaacccagaagcucucaaaacucuguuguuuaaggguuucuacggagguuucacuauguaagcauuauugacuaaaguauuggccaugagugaugaacucaaucucuacucucucuccccuccccgaaggacagggggaggaugggauucugaaagaucuaacccucugaucaugccuuggcuuuucugggaccagcaucuguccugaagcuaucugggggccaccugccuccagucaucccauuagcauaugaaagacacacauuacuccugugauucuucaaguuuuagguuugugugucaggaacuagggacaaagaccaaauauauuuguucuuaccacauacuagguggcuuaaauuuauuucucauagucuggaggcugggaagucuaagaucaaggucccagugauuugguuccuggugagggcucucuuccugccuugcauauggcugccuucucuccguguccucacauggccucaucugugugcaugcuugaagacagagagagaucugucucuuccauuucuuauaaggacacuuauaggaagaaaucaaauuugggccccaauccuuaugacuucauuuagccuuuauccacuccucacaggccugauaacacuugaacauaugaacuuugaggagacauagacuuucaguccguaacagguggcaugcagccaaauucaggccaauauugcuggagccuggugagcaagaggaaggaugauaaggaaugaagccagagaaguaggccagugccagauuauguaagggucugaaauccaggguaaggauuuuggauuuuacuccaagugugcugagaaguuggagcagagaagcaauguauugcaauuaauaguugaaaagaucacuuugauuacuauaugaagaaguuauugaaggggccacaacuggaaauagaccuguuagaaaacuguugcaguaguucaagagagagaugaaggugguuuggacuagcaauuguuaguaguggaaaugagaggacuugaacuauucaggagauauuuaggaguuuagaagcagaugaguuagauauggggauugaaggcaaaagaggaaucaaggaaaacuuaaauuuuugacuugaacaacuagaaggaagagaggguuggggugggagaagagaaaauaagaguucuauuugggccauguuaaauucgaaauaccuauaugaguuuggaauuucagggaaaguuagaguugggcacauagagauuaauuauuaaauaaugaauaucugaagccauggaacuggaugaagucaucuggggaagagugaaguuugagaagaagccagucugacuccugggugccucccacauguaguuaucaagcagagggggaaagccagcaaaaaagaccagaaaggguauccugcagaaugugguguccuaagagucaauggcagaaaguggucaaagaaaggagggaguaguucacaguaacauuagaacauuuauagauuugggggagauuuuaugagaacuacacaaagauauuucuuuaaauauauauuuuuaucuuaccuccaguaugcuaugauauauauuuaacuuaucaugaucucuucaguaguucauguagaacuuuuuuuuuuuuuuuuuuugagauggagucucacucugucgcccaggcuggagugcaguggcgcaaucucagcucacugcaagcuccgucuccuggguucacgcuauucuccugccucagccucccgaguagcugggacuacaggcgcccgccaccacgcccggcaaauuuuuugucuuuuuaguggugaugggguuucaccauguuagccaggauggucucgaucuccugaccucgugauccacccgccuaggccucccaaagugcugggauuacaggcaugagccaccgcgcccggccucauguagaacuuuuaauugaacuuuuuguccccguuuacauuauaaugugaaaauaaaagaugaaaaucaaaaugaaagcauuuguugauuugaaaaacaacuuucucaaaaggccaucaaaaagaaaacugaaaccucggccacaagucaguugugaagaauguacuguccuuuaaccagcuucaaguagaaguucauaguugaucugcucauaguguuaaaaucuguaauugcaucacucaaaaaucacauacuuuucuugaagauagaauacuuaaggaugaauaaugcaggauuguacuuauuguagucuuaaaaagcuacguuuaacuaaauucaaacuauuuuuaacuacauuaaaauaacucuuuuaaaaauaauugguccuugugaaagagucacugaaaaucuauaaaagaaaguaaaauuaauaauuucaaaacugguuuguaauauauucuuuuggaguuugauuuuuacacagcuuuauaguuaaaacguaauuauuccccauaggauacauuuuuaauaguagaauugugggagucaaaggguaaauguaauauacauuaauauguaugauaauguaauauacauuacauuuuuaaagcuuuuuacauacaugucaaauugucccccagaaaugcuauaguaacuuagcauuucuauaguuuaauaucuaaaguuaauaauauucaguaaguauuggcuuucuuuuuagucuuugccacuuuguaaaaggaaaacuuguaucuuuuaaguuucuauuucuuugugaaguuacacauuuuacauacuucuuagcuguuuguucauguuuuuggcccuuuuuccuuuuuuuuuuucugucuuuauguuuagaguaagccuguugguuugugccuucacucagauauuacauaaauagaaaaaauucuaaaauguuaauuucaggaauuucauguuagagcuauuucuaaguagaugaggucuucugacuuaacuucugaaguccugaaauagagcucaacaaguugugaucaguuggugggauuuuucuuauuucccucuuggaauaagcuggaguuggauggucucuauaugaagaucacacccuaaugcacgugcucagcugaugauuagaaugcucuucugacagguauaguuucuuugcacuguguccuguucuuuaucauugcuuaucauucagucuggcucuucuucaucuugaauuucagaagagccagaauauuaaaggugcuccuuuugaguauucuaaguuaaacugucuugagucguguuuguaauuuuacuuuuuuaaucucuagaacacuuccucguggguacuguauaacauggcuucauuuuacuggagaauuaagaaugagccauaucagguaguagaaugugccaugcgagcacuucacuucucuuccagguaagauuccuccucuucuggaccugauuuuccacauuccucaggacuguuaaagaaacaauacauaagaaagcaguaagaagcaacauugcauuauauacuuuucuccaucccuguucaaagaaauaagucccaccacaaaaaaaaaaaaaaaaucacagaucucaaaaaguucaaagugauaauuguguaauauacuuuccauuuccauuaaggaaaaaauauguagaugcccuaugauucacaugauacuugaauggaauuaucauaaacuaaguuuaacuuuucuuaaagcaaauauaagcccuaaauaaauuguaaaaucauacagugucugcaauaccuuauuuuagugacaaaauuuguagcuaucagauuaagagccaucaauaauuuaaaaaugaaacacuaugauuaucuuauuuucuccaccuauaucuuaguuuccuaagcacaaguaacuuugaaugucauuuuuccuugucaagugguucuacauaaucauggaauaugugcugcuuuccuuaggcacaauaaagacauugcccuggucaaccuggcaaacguucuacacagagcacacuucucugcugaugcugcugucgugguccaugcagcucuggaugacagugacuucuucaccagcuauuacacuuuggggaauauauaugcaguaaguacuacucuuuguuucaugagucaugcuaguugccacuuucuuuuuuuuuuuuuuuucuccccccucaguagaauguuacuuuuuuccauuccuuuuuuggucugaacgauggaaaugaaauuaggaggaagaaaaauccucaacacaguaauguaauuauucuagccucuugccaaaaaaacaauaauaauaauuaaauuggaauuuuaaacuucuacaggguacaccuuuuaagguuagcaauaccugccaacuaaaccauccuauaguaugccuuaauauuguagggaucuggucacugaucaaaauaauggucacuguagaguaagagguaggugugaucucauaaaucauuagaggauuuggacagaugcaaccaggccguggcuaacauuuuuuuuuccguguguguguguguguguguguguguguguguguguguguguguguguguauguuuguuuuugucucuucagaugcuuggggaauauaaccacucagugcucuguuaugaccacgcuuugcaggccagaccuggguuugagcaagcuauaaagaggaagcaugcuguccuaugucagcaaaaacuggagcagaaauuggaggcucagcauagguaauugagaggaaaaauuucacucaagcauuagcacuaucgaaccuuagguuaaaucuguguaggggauaucaguguuaauuugguaacuggaauuaagaaagaaaccucuucacuacugcaaguccuauccuuuuucuguaaguccuggugguuuagcacaauucagugguuguguagaggaauaucuuuaauuguauggauuccugcaacuagagaauauuuguaguaaaagcugucacuuaaauguuuacaauuuugaccauugauuacuuuuaugaagucaguugggguggggagacugggauacuuaguugacuacuuacuuuguugacugcauuuuuauuugcauagaauauacuaaguuucaguaaaaucacuuacaugugcaauaguugauauuucuccucuuggagagaggugguggcuccuaggguugaguuauuguuaagguaguuaaauggcauugagagacauuauuuggcccacguuuuaaucaugauuguguguuagguuguacaguaauggaauucuauuguauuugauccuugagguauaauaaguuaaaaaacauuuccuucaaucaguagggcuaguuaagaaacuucauguuaacucagaagugaauuuuucauaucucagaauuagcuguaauauuugaguuuacuuugguuaguagagaauuaaacagagauuuagaacucauuaaacuuuuguauuugcuucuuuuccaaucuuuuuaaggcauaaugugguaggaaguaaaaaggaugccagcuugcuuauucauaacugguuucuguuauaccuggcugagcuuuuuccaguaucaugcucuuaauaauugagcuggcucuaucuuuacacaaucuguauaguuccuaaaaucucuguauguuacaguguguaauaggcaguauggguuuucugauuaaauguaaucaggcagcugauuuacugaaaucagguggugaagcauauuccuuucgaagcauaguuucuguaguuuuuccuggccuguaaccaauaagcuagaguaugaaagcaaaguacuguggccccuaacucuuaacuuugucuuuaagcagaaucuagggaaaaagugaaaaggaggaaaggauucuagaaagacuuugaauguugauggaacuaaugcaaauuuuguagagagaaauagaguuguuaaauacauaaacuuguauaucgucauguauuuuuuuauggcaccugaaaaaugcaauauaccauuugaugucaugauaguuguauugccaggugucauggcugaugccuguaaucccaguuauucuggagacugaggcaggguggaggggaggaaucacuugaugccaggaguucaaaucuagccugggcaacacagcaagacccaguuucuaaaacuaaauuagccaggcaugguggcgugugccuguagucccagauacuccccaggagacugaggcaagaggaccccuugagcccaggaguugagcccaagaguacaaggcugcagugagcuacaaucaggccucuccauccagccuugacaacagagcaagaccccauuuuuuaaaaaaguuguauuuaaaggaagaauuucacauuuaucuuuuugcccuaguauucuugaacuggugauacaggguuguauguuaaauaaaaggaaaacacacaguaauuguugcugagaaccagaaaaaucugugcauuuaaguggguuuaaaauuuaugauuuuauagcucuaacuuuuuccugguauuaaaaaauguuaagaucucuccagcgaacacugaaugaguuaaaagaguaucaaaagcagcaugaccacuaccugagacagcaggaaauccuagaaaaacauaaacugauucaggaggagcaaaucuuaagaaauaucauucaugagacucagauggcaaaagaggcacaauuagguaaguagugacuccaaguaauugaagacagguuaggaaauucacuuuuagcaugcuuuacuaucauaacuuucuuguagccuuaaagcagugugaaguuguguuuaugacuucccuacaucucgaaagcaugauucaucacuguggguauaccaggaggccuggggagcugguuuggucuaccuugcuuuuuucaaauuuacauuuugaaauaaaaaacaagucuuguagauccuagaagucuuaacaguuauuugcauucuguguucaacaucaguuuuuuuuccuacccuaauaugcauaucagucuccuggagaucuuguugaaaugcagauuaugauucaguaggucugaauugaggccugagagucugccuuccuaauaagcucccaggugaugcuuguugccgcaggucuaaaaacucugcacuauggguaacaaggccuuacacuaagugaauacaagccagacccacccuacaaacaacccauccauacuccuuuuuuucuugcucucuuaaaaacaguguuuuagaaguaaaauuuuagacuggaauucuuaaccugggucaauggauuaguuucaggggguucugaaauccucuccaaaauuauauguagaauuguguauguguccaauuuuauuuuucugggaagaggguaucuagcuuuuauuaaaaucucucaagcaucugugauccauaaaaauagaaccacugguuuauaggaacuuggguuggcaugagaacaaugauuugguuauaucuagaauguuuuguuucuaaugacaagggagcagaucugacaacucaauaacagagaauaaauuaauagaaucucuuaauuauacccuucucccuugauaaguauguuggucaagaaagccucuuaaccuuuggcacuuagcugugaccauuuauaguuuauuuuacaauucccuuaacaaguuuucuuugcuauuaugaguguaaagaguaugcucagucuuuggaauuacuuacugcccaguauauugaaauguaaccagagcucuuauauaugcauuugaaacaaaauuaugaaguauguaaagcaaauucucuccagaaagauggccaaagucucuuaaaacgauguaaucacuagauuuuacaaucacagacuauaauugcugaaagauaccucaguaaucaucuaguggagucccuuuguuuuuguagguggaaaaacugggacuucuuagaaugauuuauuugauuaaccauuaaugaauauuucucuauauaaguacguccuacguaaguagccugcuaggcucugagggauacaggguugauacuaaaugacuuagucuaagaaaaucacauuggcauuguugaccuugcucaucauuuguguaauuuccuuucuuauuccaggaaaucaucagauaugccgacuggucaaccagcagcauaguuuacauugccagugggaccagccuguacgcuaucaucguggagauaucuuugaaaauguggacuauguucaggucuuuuucuugguccagucuaauucuuauaaacguuugcuuuauaaagauuuuuuaaaacuuuuguuuuuccucuugauucuuuguauauuugaucccuaaaauuugugauugucauuuagaucuuuaagauuuugaggcugggcacaguggcucacgccuguaaucucagcacuuagggaggcagaggcagaaggaucacgagcccaggaguucaagaccagccuggguaacauggugaaaccccaucucuacaaaaacauauauaaauuggccagguaugguggcaugcaccuguagucccagcuacucgggaggcugaggcgggagaaucaucugagcucuggaggucaaagcuguagugaacccagaucaugccauugcacuccagccugggcaacagagcaagacugugucucaaaaaauaaauaaauaaauaaauaaauaaauaaauaaauaaauaaauaaauaaagagcgagagagagauuuugauuaucuguuauguuguuauguuuacgaagucagauuuuauagggaguacucaauaacuccauggaugcuuucuauuucuuaaaguaccaucuaaauauuuauaugcacaugcauuugauucuuuucucuuuuaccaugggagcuagaauugggcuauuauuauuauugaacucaaagcuuucaucuccccacuuucccuuuuagaguaagaccuauuuaaaauuugagagcaaccaugcuauuuguuuccugaaguaaucaguccaauuauauugccucaaccaauaccaccaacaaaaugcucauuaucaacagaaaaucuuuauuaagcccacugcuagguguguacuuucucucacuuucugucgcuguauauacacacguguauacacacacacauacacauauacaauccuaaucuaucuaguugggaagaacuaacacauguaaugauaccagauaguauauaauagauguugaauaagugguacagacagcaaguacagccagaauucugaguauaaaaaaaaaagauucaaacucugaaacuuuuugagcacugacaugaugcucaaaagaaaugaucauuggagcauuuuggauuucacauuuuuugauugggaugcuuaacagguaaguguaauaaaauauugcaaaauccaaaaaaaucucaaaucugaaauacuccugauuaagcauuucagaaaacugauacucaaccuguauuagaaauaaaacauuuauucuaucuuagagaaaacucaucaugucuaaucguagauacagaaauuuccagcaauaacuacuuaagauaacuaagagauuaggagagcaucuauaggaggacaaaccacaaaaacuuagaacucuuuaaucuggaaaaauccagacugcauugggaaaaaauaagagacaaaaauuaagaagccauuuuaaaggggaaauagugauagggaccaaaagcuuccuaugaguauuguaaaccagcucccagcaauaucucauguuugguuuccaagggaaaaaauaaagaagaccagauucacacccucugggauuauagcucuuuaucuuaaaaccaagcauuuuaaagggaagaagggggauguuuagaaaugaaauagauugaaacccaauacaccuuuuggacuuuuugauggucucaagaccgaucauuugaaggaguguagcuuccaauagucuauauucauaaaauuguaucaccacuauauagugaaagaauccauuccuguucacaaagaccuagagcuacaaauucgucauauucauuccuuuuccuuuugucuuuccuaccccaucccauccccagucccauucucauuaucuagcaagguuucagaaauacacaagcaucuuuguaaguauauccaacauuguuccaccuugcuuugaaggaaggcuguauauguuuguguucucucaucuagguuacccuuucacccucaaaacuuuucuuuguaauugauugcacaacagucuguaauccuuaagugauaguuauagaacccuuaagaauacuuucuuaaguucccucgccucuacccacacacggcacaccaauuuuagaguggugagcauuuuaguguaggaagaaaaggggaauaaugaaccagauuucucaauuagcuaauuauuaaccuaaagagacuaaaucauaaaaaugaagcaaagggacaggaaaacgaccuaugccauuuuucucauacuccaauggcaaaguuauugaaaguuguuaacuauguauuauccaugaaagaauaucguuggggcauaguucuuaaaagauccaauugcuuuauuacugagcuacuuucugauuuucuacuaauuuugaauauucacucgcuuuuuuggugugaguuaaauuauaaucacaacuccuuuuccacuuucaauuugauugaacuuuuuguuucauuuucuaguuuggugaggauucaucaaccuccaguaugaugucugugaacuuugauguucaaucaaaucagagugauaucaaugauucggucaagucuucucccguagcccauucuauucucuggauuuggggcagggacucugaugcauauaggguaaguuaauagaggaugacgaagcaguuuucucaaacuggcaagauccauuaaagcaguggcccucaaccucacugauuaauauggccucuaugacuguucagauuaguucagcaaacguguaguacauuucuauuaaauggaagcuauucugcuagguagugaaugaguaagaugcaauuucugccuugaguuuuucccagucaaguagagcagauagacacccugauuucaguucaaagcuuuauccucugaguauuauuaccaaccuuaacaaguuucuaaacuugacccaagcguauguuuuuauauacuucacuuaaucggcauucuuuuauugaacucccaccugugugccaggcuaaugcuggcaguauaauagauaagcccccuugcucuucuggagccuacauucugguagaugauacagacaauaaacaaguuaguacaugugccugucuagacuagcuaagaaagaauuguagguuagcugaggcggauaccaagguaugaggacagagacugugugcuuuuuauucaccauuaaauuuucagaauuuaaucaaggguuuaacagaauuaaacagccacuuagauuuaauuauauuuaauauaaaucccucaaaguuugauagcuugaagauuuaaguuuaguaagccucugguacaucuuauuuauuuuuagagaaaauuaacauuuuacaaaucauaaaacaauuguuaaacuuuggcauuggcaaagaaaagaccuuaguucagggaaaaguaguguucaaugccagguuuuauaggcuuauguaugcuuucagguacaagucauaagcuccaccucaaauuaaauacaaagaaaaugugccuguuacuacaggaaguccagaaauaggauaaacuucagguuugguugauucaguggcccagugaugucaucagugacccauuucuucuuuuucuuuuuuuuuuuuuuuuucuucacucugccauccacaguauugguuucauccaaaagcuugguuuuuuucauggucaugacagccagcagcaacuggaacaacaugauuuuuuguucauauguaacguaagagccuaagacuugcuucucuuuccgaaaagccccaagcaagccucuucuugugucucacuggcucaacuggcuuauacccgcccaacccugaaccagucugugguaaagcagguagaauuacugacuuagauuaauaaucugcaguagcaggaauauuauagagucuaccauaaucuuaagauauuauaguuuuguucaauuauuguaguauaucauuuuaaaaguuuauuuagcauauugaaauauugaauccaaagaaauuuaugagaaauuuuguuucuuuaucaggacaaacagcauauucuauggccuaaaagagcagauuguacagaaagcuacccuagagucccuguugguggggaauugccaacguauuuucugccuccggaaaacaaaggacucaggcaaguggugauggauuuggcaaagcaccugauucugcaugauugucaucuagcgguucuuugagagcaccagccuuggacuugaaaaguuaagucuuuaucuugaagucacccaaacuuugaaaauaugaaucuuguuccuuuuucuugugccaggauccacgaacucagcagugaugauuauucuacagaagaagaggcccaaaccccugacuguuccauaacugacuucagaaaaagccacacucuguccuacuuagucaaagaauuagagguucgcauggaucugaaagccaaaaugccagaugaccaugcacgaaaaguaaggcucacuuaggcugguauuuauugccguccauucugggugacuucagaagccucuuaaauggaacaaaaaauugauagaagguagcuguugagcuuuaaguguauaaaauggaaggauagaguuaaagaauuggugaaaugauggcgaagucagucaugcuauuaaaggagugccagagaguuccucggggcugcuauacguagaucaccuaaacacuauuccucuaacgcagagcacuucaaagaugaguagcacagaacucucuguuaucuaauggaguugguguaaugcaggccauugcaaccacuaaaaguuagcuuugcauccuccaggccuccagaaguguauauaaauugaaagcuugaagaaucucucucuggccuuaucaacccugcugugaccuuauaugagguccauaggaauuuauauuaauuugauaaugacucugcaaacauuagaaguucaauuaugcucuuuuccuaaauuccuauuaauuauauauaacuacgaguguuuuauuacuguauauuaccauauuagauaucauuccauagauaaaaaugaaaaaaaaaauuaccuuuuuagcaaucacagaccaucacaaccaccuuuuuuuuuuuaaguuaauuucaaaacuauaggcacuuacuguuacuuauauucaauagacauuuccuuaggcaaaaaacauuaugugccagacauuguuuuggaugcuaggaauacaaaaagauaaacagaccaugaucugugccuuagaguuguuuaccguuauauaaaugcugcaggaacaugaaguagaauaauugaguaucugguauuuuccaggaaggaaagacaguagauuuuuauuacaucagauauugcaugcuguugucuuuugaauaauuucuucuuggguucugaacacuuaggcugacuuuaaugggguaugguagguuacuuuaauguguggggguauauaugucuuuuuaacuuuuuaguuaaacuauuacauacaugugagcaggucaacaccuguugguaugugaaugaauuuaugucauauauaugaucauaaauauuuguucaaauuagcuguuccugaggagcuuaagaaaagacugccaucuauagaaauucuuuucaaaugucuucccuguuauuuucaauugagucagucuuccuuuugauguuucagauuuugcuuucccguauuaauaacuauacuaucccagaagaagaaauugggucuuucuuauuucaugcuauuaauaaggugagucauuuacuuuagacaucuaaaacuuaaaugcuucuuaauuauaaguaaaaguuaaaaugcacuuauuaaaaaucuuauuuagaacaaguacuguauucuuguacuaacugaaguauuuuuggauuuuucagccaaaugcuccuaucuggcucauacucaaugaagcuggacuauacuggagagcaguaggaaauagcacuuuugcuauugccugucuucagagggcuuugaauuuagcuccacuucaauaccaagauguuccucuugucaacuuggccaaccuuuugauucauuacggccuucaucuugaugccacuaagcugcuacuucaagcuuuggccaucaauagcucugaggugagguuuuaagggauuucauaguuccguauacuauguaggguaacucaaauuuagauuacaauuuguauuuuucuagggaaagcauaaaaaaugucauguuuugucuuucacaguagcguuugcauuauuucaagagagugugaaaaagcuuuuguuguauuuugauguguucuuuaaauuuugagugaaauuuauaauuacacaguuaaguuuuuuuuuuuuuggaaacuuacauuuaaauaagaauaacauaagcuguaaaaauauacugccgcuuuuuuaugucugucugaaacaucugguuuguauuuuauccuacucaucacagcaugcacacugcuuaauauuacacuguuuuacaacuuuaauuuauagaaauauuuauacccuucaagccagaggacaguucaaaggugguuuugauaagaauaaauagauacauugauuuucaugccccaaaccucucacaugcagcuuauggaguuacaucagugcuuuguaguucaugguuuugaagauacaacuuugguuuuucauauuuuaacaucucugauaucaggauggauguuauaauugcugucauuuuagguuucaugaaauucaguuauaauaaauauacaauuaaauugauuuuauaccuaaugucuaaauguuuauagguuuuguauucaaagaaaccuucagaagggaugugcaugaaugguugagguuuauuuauggugucugaaaacugauuuuuuaaggaugagaagaaaauauugccuguuuucuuuugaaauacagaaauucacaacuggauuuuaagcagaaguuuacaaucucaauauuauguaacaggucacauugccagagaaguacaucaaauauuuaucuagugcuuacuguguaccaggugcugguacagugggaacagaugugauaaagugggcaauggaaagcgcaaugcagccguauucccuugaaacuuuucaugauucccuuuuuacuguuuucagccaagggacuuagguaguauucuucugaagaaaaaagaccuccuuuagugaucaguuaccuuuugauauuuuaaaaucauacuaaaauuuuaguuguuaaauaccauggugcuacaauaagaauaaaaagauaaauuaauggaucaggguggguaccccaaaaauauaccuuuuuuuuuucuuugagacagguucuugcucuguugcccaggcuggagugcaguggcguggucacggcucacugcagccuccaccuccuaggcucaaguagugcacccaccucagccucccuaguagcugggacuacaggcaugcaccacugcguauggcugaauuuuguauuuuuuuguagagaugggguuucaccauguugccaaggcuggucuugaacacccgagcucaagcaauccucccaucucagccuccaaaagugaugggauuacaggcaugcaccaccacacccggccccaaaaauguuccuuaaucagcacccucuucccaacuuuuggaaauuuuuccuuauaagcaugucuucuauacaaauauuucauaauguuucaacucuacuguacaggugaucucuaaaaaacuuauuccuaccuaauuuuaaagcccucaauuuaaaugguuguauaaaggaccaaugaauugauaugccacaaccuauuuuucuguugcugcauauuuagguugcuaacaguacuuagcuauuaucaaugaugguuuucugcaaaggccuuaaagauuguuagcaguggaauuacuaagucaauaagagaaugaauauuuugauggcucuggcacaaaauaccaaacaacccacuaaaaugguugggccaguauauauugccaugaauaaggucuaaaaauauuaauuccaccugugucuuuauuagaauugaacaacugaaauaacugccaauuuuuuugauuguuuacuagagccaggcacaauacuaagcaucuuacauguaguaacuaauuuaauccucauaacaacccugugagauggaauuuccccuuugauagaugaggaaacucuuaagaguuaaauguacagaguaagggauuuaugggaagucacagagcuuggugcuugguuuugaacucagggagauuggccacagggcaaauacucuagucguguuauacuaccucugaauuaacauuuauaaaacaaguuucgcuugcuuaaaaauaccaccucuccguuguaacguaaaguuuuaucuugugguuguuuuuguuuuucuuuuuuccuuuuuucuuuucuuuuuuuuuuuugagacaaaaucuugcucugucacccaggcuguagugcagugacaugaucucagcucacugcaagcuucgccacccagguucaagcucuucucgugccucagacucuggaguaguugggauuucaggugcauaccaccaugcccggcuaauuuuuguacuuuuaguagaaacaggguuguauuuuaauagaaacauguuggccaggcuggucucaaacuccugaccucaagugauccgcccgccuugaccucccaaagugcugggauuacaggugugagcccuuaugcccaaccuuguaauuguauuuuuaaaguaaaaguuuguauacacauuuuguucauuuuagaauuuuguuuuuuagauuuugugcaaacccuuuguaugauaaacucuuuaacuccaucucucauguguuaaaaauauuuucucucuuugccuuuuuaucuuagcauuuaaaaauugcccuuaaguuugccagucuuuucaauguugauuucuauuguuagauuucaaguguucucaauaaacuguuuguuuuuguuuucuauggcuuaaucuuugaauaguuggcucucaaauauauaaagaucuuuuccugugacgucuccuggauauuuuauaguuuuaggcuuuacaauuaggucuaugauucauuucaaguuaaauuuucuuuguagugugagguagggaucaaaguucauauuuacacggauauccaguucuucagcuucauaucuugagaagacugcccuuuuccuguugaauuacccgucaccuuugcccugaacuccagacuccuuuauucaacagcuuacuugacauuuccacuuagaugucuaaagggcgcucuagaacaaaaggccaaaaccaaacuccuuaacgcuguuccaaauuuauucuucccagucuuccucauuucaggaaauaauaaagcuaucuuuccaguugcucagaccaaaaacuuaggggcuuccuucauaccuuucuccuguucucagggaaaauucaguccacuggcuaaccuuguugauucuguuuucaaaauauaccucagauuuuacuauuuaucauugcuucuacugcugucccauccaaaccauaauuauuuuugucuggauuauuuuaauagccucuagacugguuucucugcuucugccauugucccccagucuguucucauacagcaacagugaaauccuuauaaaaagucaaauguuguuauuuguuggcucaaaaucccuguaguggcucuccauagaacucacgggaaaauacgaauuuguaaugauguagaagguccuacaugaccuuguuacuuuucugaccuuaucucugugaagucauuccuuagcacauucuauucuagccucacuugccuccuuguaguuccuugaacauacuaagcaugccccuaccucaggucuuuugcauuuucuauccucucugguuggaguacuucaucccaccaauauucuucauugcuuacuccaccuccuugaagucuuaugaauacuaacuucucaguaagucccucucauacuacucuguuuuaaauggugcacuccccccgccccccacaaucuagugcuaccuuuauuucuuccuucuauauuuuucuccgucccauuuugcucacugacauccccacacuggacuguaaggucuaugaaggcagcaguuaccuuucuuauuuucugcuguauccucaauguucaaaacuaugccugcaacauaguaaauacucacuacuuauuuuuucguucaagggaugaaguucaacuuuuuuuccaaaaugcuaaccaguuuaucucaaugcaggauauuuuuacagcugucauuuugucauagggauaauuauaacacuuuguuuccuuaugcaaaauauaaagauacauuugaagucuaaguaugggauuuaauuuuguaucugggugugaauuacuaaguaauaguuugaauguaaucugagcugcuuagguuagacuuccuuaaucuagaauauuuuuuauccucuggcuugguuacagugagacauuucugaugaucuaacagccccagucaaaagcagguaauuggauaaaucauaagcauuguuuuacauagggauauauuguacaguuugaaaauaaaacauucuuagaucuuuuuaacuauuuuuaauaauaaaauaaauuuaaaacauaugguuugcacacaagcaaauauaaaaacacuauagauguauuucaguuaaaaugaccuaaacugaauacuuugggcugcuuaugaaaacaaagucucagcaaacaauuggaaaauagcauacaaaguacacuguuuacaauagcaucaagaaaacaucagaucugcugugguggcucacaccugugaucucagcacuuugagaggcuaaguggggaggaucgcuugagccuaggagcucaguaccagccugggcaacacaaugagauccacucucuacaaaaaaagucaaaaaaaauuagccaaguguggugguaugcaccuguacuccuagcuacuugggaagcugaggugggaggaucucuugagcccaggaguuccagaccagccugggcaacagaaugagaccuugucucaaaaaaaggaaauaaagaaaacaucagauuucuaagaauaaaccuaaaagaagauauacaauauuuauauacugauuacaagauaucacuaagagaaagaagacauaaguacagguugagcauccuaaauucaaaaaucugaaaucccaaacauuccaaaauucaaaacuuuuugagcaccaaccugacacucaagggaaaugcucauuggagcauuuuggauuuuggauuuucagauggggauguacagccaguaaauauaauaaaauauucaaagauguuaaaaaaucugaaauccaaaacauuucugguucuaggcauuuuggauaagggauacucaacuuguaaagggagauauacaucauguucacacauugagagagucaauauuguucagauguaagaucucuguaaaucaauuuauagauucaauucaaucucagucaaacaccuaguaauugcauauauguguuuguguauugauaaguugauucuaauaucuacauagaacuggaccuagaauagacacacacacacacacacacacacacacacacacacacacacacacaaaugggggcagggugauggggaggaacagaguuggaaggcuuuuauuaccagauuuugagauuuacuauaauuaaaagaguaugguauugguacaaagauacucaaacauagcaauggaacauaauagggaauuuagaaguagaccaccaugaauauggccacugguuuaugacaaagggguaccuguaguucagugaggaaaaaacauuuugguuuuucaguaaguuagugcuagaauaauuggaugauauccuuauggagaaagauaagaacuuugacuucugccucacaccauacacaggauuaauuugaaguggaucauguaccaaaauaugaaagauaaaacaauaagccuucuuuaugaagacauaggagaaagucuuuaugaccuugcaguaggcaaagaugucaaaaagcacuaauuauaaaagaaaaaaaugauaagcugaacuucauugaaauuaagaaauucuguuuaucaaaagauacuauucagagaguaaaaaaacaaaccauagacagagaagauuuuugcaauaaauauuuucaacaaaagacuaauauauaauauagacagagagcuccuucaaggccuuaagggcaaccuaauuccuuuagauagagaaaagaacaggcacuucagaaaugaggauauccaaauggccaauaggcaccugaaaaaaaaaaaacccucaacauuauuacucaucauggaaaugcaaaggaaaaccacaguuagacaccacugcagcucacuaaaauagcuaaaauuaaaaagacugacaauacagagucucugaauucucacacuugcugguaggaguguaaauuugugcauccauuuggaagacuauuugguuguuaucuacuaaaacuaaauauaaaucuaccuuacaaccugugcuaaguauauacucaaagaaaaugaggacaaugugccuaucaagacauuuacaagaauauucauaguaacuuuauucauaauagacgaaaguggaaauagcccaacugcuaaucggaugaacaagcugugguguauucuuauguuagaacauuacacaucagcuuaaaaaacaaugagcuacugauguauacagaagcaugaaugaauuuuagauugagugaaagaagcuacaaaaggacacauauuacauguacucauaggagaacaugcaguuugauuucauuuaccugaaguucaagaacuaugaugacagaagucacaucacaacaaugguuacuucugggguuggauugcccaagggaaccuccuggaguacugaaaacauuuuaguaucuugagcaguguggcgguuacagggguauauacauauauaauuuauauuacauacuuuauauauuuuuuaucuuagcaaaaaaagugaacacauuuacauguauuauacaguuuagaauuggcugguaugaauaaaauggauaguuagcaauaacguuuaugggguaaccuaaaaagagccaaaagccauauacuguaaacguuuuguaacucccagaaaauauuaguucauuaacauuuugccgauuuuuuuuucuuuucagccucugaccuuuuugagccugggaaaugcuuaccuugcucugaagaauaucaguggggcacuugaggccuuuagacaggccuugaaauuaaccaccaaauguccagagugugaaaacagccugaaguugauccgcuguaugcaguuuuauccuuuucuguacaacaucacuucuucuguuugcagugguaagcagcuuucaaaugcugacaaacuaaugagcucagccagaguuccucuucugaucaaaagaacacagaaaaugauuuucucuauuuuacccaaggauuuuagauaaccaguauaauuccagaugcauaggaaaagauguuaauuccuuacuuacuauagaugccuuaggguauuaaggcuuaauucucucuuagaacucugguuaagaaaggcuaacuaaaauaugugguauauucaacugggauggauaggcuuugagauuuuuuuccucccuccaaaaucucugguguuuuauaauaacugacauuccuaguaaaguacauuuuuucuguccaugaagucaaaguauacaguuuuaauugaagcaguucuucuauauacucagucacugaaauacagcuccuugucuuucauugaaggugauucagaccuuuacucuaccuuuaauauagugacccaacauuaaguggcauauuuuucucuucuuccacucccucccacagcauauauaugggcauauaugccuguguauagguguauccaccuggguaaagcuaauaucuaaagcuguugcacuuucguuauuagaaccuucuuucuaagaaucacaugauauuugguucucuguuuaaccuucacuauaagaaaaaauaaaaucgugaauuuuaacucucugccuugaauugggaugggugcaguuuacauacguguggauccucaguaucuagccauuguagagugcacagugggugcuuuauuaauauucaaauuagguuauaauauuuaaucagauggauauuaguucagcuccuucacuuuugauauuuaaaaacaaaauccugacauccacuuauuuaugugacuuguguaaaagacaugaauaauuauuaguagauuugggaccagaaagugguuuuguugauucgcuauaccagacugccuuacaauuuuaauagagugauagacgguaaguagugcuugccuuuuaaauaucaaagcccaauuauuuacugaagaaaccaagaaucucccagcaauauaccucuguagcucaguugugggucaguguugaucacaaucugaauuaaaguucuuuuaugaaugucaaaggcccaaaacaguauagcaaggcaauagaguggaguggcuagcacuagaaucuuacagauucauguuugagcugcagcucugccauuacuuucuuuuuuauuuuuaaauuuuuuauauuuauggauacauaauaguugcauuguucuuaccauauaguagauacuggcuaaaaguaagccauuagaaauucauagugaauacaaggugcucagaacuuuaaaggugcaaauugugaauuuuuaucuucuuaauccuggaagauaugcuguggucuuuuuuuguuuguuuguuuuuaauucuacugcaucuucucgcaacacuguggucuuuuaaauguuguagguuaccuaagaacagccuuauaaaaaggauuuuacuuuuucaaugagcuuuuuauauuaauagaaucucuuuucuuaauuuacuaucaucucccucaacucuguugaaauuuauuucuguuuuugagaagaagcauuuugucacuguauacauguagugacccuuuucuaaaaagucuucuccuuagcauuaauuuuacauguuuuuauuuaguauuucaguuucuugaaauauauucuuaguacauguaacucaugucaaaagagggaauacaguugucuugaacuuuuuccccagaauguaaccucaacugguccaggaaacuaauaacuuggaacagaucuuucucagaguuguaguaucugauaguccagagaauucagagaauauuauuggguccaauauaauaacaauaagagaaaauaacuugacauggaaacacaauuuuuuuuaauaauaguucuuucagagggagcucaucaauaaaaaauauuuaguaccuuuuacauuguaauuaauuaauuuacuaaauuuaguuagaaugucugcucaaacucacuaaggccaccagaagaaguuacuuaauccuggaauauauucuguggucuucuuguuuuaaaaauucuacugcaucuucucagaaugcugugaucuuucaaaugucauaguuuaccuaaaaacagcuaauagucuauuacugcugguagacuuaaaaucauucugauaugaauuagaaaauaauccaacauuugcuaauaccuaaauaaauacuguuaccuccuaauggauauguaugcuauagcauuuucuagguuuaaaaauucauuaguaguagugaaacaauuucaauauuguguuuuucuuugacaaugauuuugaguuacuuauuuccagaguaaucccauucauucauaguuacuuugcugacuuguagcuuugaaaagcuaaaacuugaaagaagccaaacaccuuuauagaaaccaggaacuucuuaugcuugaaaucuaaacaguugcaucuauuccaguuaucucugagcuuugcuaaauaauugauuaaaaaaaaaggaaaaaccucugaaggaugauuaggauuucuuuaccuuuagugaaaucagaugauucuguuugccguuuccuuuuucauguuugcaauauugaaguaaguuuuauaaguuaucuugucugacaucuguuucaaguauuuauuaugacaauauagagguuucaagagagugacaaggcuuacgauucuuuuuccauguaauagucauggaauucaugagauugcuggcugggucacagaauucaugauaauuguuggccaggcaugguggcucaugccuguaaucccagcacuuugggagaccaagguagguggaucaccuggugucaggaguucaagaccagccuggccaacauggugaaaccccaucucuacuaaaaauacaauaauuagcugggcgugauagcgggcaccuguaaucccagcuacucgggaggcugaggcaggagaaucagacuugaaguucaggcuugaacccaggaggcagagguugcggugagcugagauugugccaccgcacgauccagccugagugacagagcgagacuccgucucaaaaaagaaaaauaaacaauuauuuuuacagcaacuauaauauaguagaaugucuuaaauaguaugaccuggugguaaaaggaugggcaguuuaacauuagcaaguauuuuguuauuuuucauauauaaucauggaauuuuuaaugcagauuuuuaauuuguguuucuuggaaugccuaugcagguaauguauuguaucacuuguaaauacuguuuuguucaacuuaaaaauacacaaucacuaugcuaaaaaaauuuuuuuguacuuauaaagacuuuauagcuaaaacuguauugauuaaugaaguauuauuuaucugacaauguuuucaaacuuuuauuaaccuacaaaucaauguauuggcugccauuuguuagauucauguguucuuauagcagcuguuuaucaucaucaucucucccucuuuugaauaaaauuucauaaauccuggucuuuuauagguaguuuuauaucacuaccauuucaaggaugcugugaagaacuuaauacauugauuuuuuuuacuugcccacucuugaauugacuguaaaaguuagugcuuucaguuucgauuaaacaucuuguuugggcaguuuuaaaauaccuacuguuuuccacauuuauaggcuugucauuuuacaguuuuauuuaacuuaagcagaacugaauugguuacuguagcaaacuuauucuucaauaacagcuucguccuuuuaaaaguaaaauagaaucuguuaaauaaacuuauaaugcuuuugaauauaagcaaugucuaugaagugcucaacacuuaaaaaaaacagccuuuuuuuauuggaaaaaauaaaagugucacagaaugaaacuuuauggaacaguaaagguuaucuucucuaaaaaauggaaaauaacuuuuaauaacaauaugagcaaaaugauuaaauauugaaucuguagaaaaguccagaaauacauugauguggcauuacaacaugauaguggacuuuccaagcauuuauuaccguaaaauauuuuugaaauacuaaucugcaaauuaaaaaguuacaucuagcaaagauauuuucuacuacuaaaguaaucuaggcugucuuauaucuuugauacauucgauuuuacuuuauuuuuaauggucuauauuuauuauuuuucuuauauuagcauaaaaccaauagguucuauguauuagaauuuuaugccacaaacagcaacuucgcuguuuacagcauauaauuaagcauuaaacccaagauuucugagcucuggucauuucuuaauuaauugaggcacacgccuacuuaaaaaaauuggcccagauccuuagaaagaaugaauaaauauuaugcagaagaacucagacuuuaauguuuagguguuccuguaauugucugcaaguuucucugucuaauacauauuugauaucuuuugucucuggaacaaaaaguagaauuuucaaaucauauacgugagauuuaauaucuauuccaaugugcagauggauuaucuugucuucacaguguuucuguauuuauagcaucuauuuauguaaaucauaucuccuuuuauaacuuguuucauugccuguaguuuuagucuguguucuucaaccuaaauuuuuguagauuuguaacuugcagcuuaaagcaauuuuacagaguucagauguugaagaaaaagaaauccugcacuuugcugcccuccaguggauuauccagcauauauacugccugcaaugaaggaucuuugcuuuaucacauccuuuuacauucuuuuauaagaauuagugaagguaucugcuuuuuaaaaaaagauauucuuauagacccaauuuuaauaguacuuuuuuuagaggcagggucucacuguguugcccaggcuggagugcaguggcuauucacagacucuaucauagcacaccauagcuucuaacuccuggcucaggcaauccucccaucucagccucccaaacaguugagacuacagguguguaccacugcaccugacucuuaaacagcauuuuaaauaugcuacuaguuaggucaccuccauuuauuucuguaaaaagaauuaaaacugguugauguauugcagauuuuaaaauccugagaugcagguauauccugcaacaaaaccagauguacuucuguguauguaaugugucuaaaucuguauauuucuuuacuuaaaagggcuguaguuauuugguuaacaaacaguuuuuuaacauguaucuuuaacauguauuuaacaugugauagaggagagaauaggaaaaagaauuuuuguauuuaugaaccuacaagcaaagauugugauuuacucaaauuacagucagucuuuggcggagcugaaacuaaaaagugaguccucugucuuccagggccagugugguuccugugcauaauucuucuaccuucagccaaucauaaauuauuccacugccaugauugaaagauuggaagaauucauauuuguagauaccugggacauuuuauaaaaaugguauaaucacuacacuuuuuaugucaucccucaaaagagaugcauuucuacguaaaacauggauguaaacuggauuauagggugcagucauaaugaaccccaagagcauaccuaaaauggucucucaguuuaacaugucacccugaucuuuucugaaucuugcaucauuagauugccacauagccuucuauuuuacguggaagauguuaugccuguacuuuuguaguauuagcuuaguagacaguauuuuucuuuugggauuuccagcauuuagcuuuuuugaacaaaagggauacuuuugguuuuuauaagaacuuagagacaguauuaucagauucugaugaccaaugguuuuauacuucagccucugaaagacauuauauauaaauauuuguugguuuuuaaugugaauuuuuuguccugcaugccaaaaaaaauguuuuauuuuaaagaaugagccuauuagcccuugccugagaucuuuucacagcuauucauccagucauuauagguuguuagccuugccaaauaauacuuaagaaauaugaaauuugauagaggauauaaucuucuaaagcaacaauuuguuuucuuucaaccaaagaaaacugggugugguuuauucuucauucauucauucauucaaugaacacuuaucuacuauaugccagucacuauucuaggaauuggaaaccaaacagaaaauaccuccagcucuuacagagcuacauucuaguagagggaaacagagaguagauaauaaacauaauaaaucauuuaauuagaaagugagugcucaagggguuggggucauuaagggaggccccacugagaaagugacauuugaacauaagacuugaggaaggauagagguucuaagccaugcagauauacagcauaaaagcauuucaggcagagagaauagcauugcaaauguucauguuaggaauagcaaggagggcuuuccaucugugguggagauguaggagaugaaagcagagauaaauaugguggaggauagagccacuuuuuugaugccuugcagaccauucuaauaaugugggcuuuucgucuaagagaaagauguaagacuaggaacugggcaacacagcaggaggugaguggugggccagcaagcaaagcuucaccugcguuuacagucaguccccaucacucgcauuacugccugagcuccaccuucugucagaucagugguggcauuagauucucauaggagcaugaaccuauuguaaacuaugcaugcacgggaucuagguuacacgauccuuaugagaaucuaaagccugaugaucugucacugucucccaucacacccagaugggaccauuuaguugcaggaaaauaagcucagggcucccacugauucuacauuguggugaguuguauaauaauuucaucauauguuauaauguaauaacgaagugcacaaaacauguaaugugcucgaauuaugccaaaaccccauccccacccaccccccagucuuuggaaaaguugucuucuacgaaagcagccccuggugacaaaaagguuggggacugcugacuuggaagauuuugaacacaagagugaaaugaacugauuuacaucuuaacauaauuccucugguugcucuguugagaauagacuagugggguaagagcggaagcaugaagaccuguuaggaugcuauugcaaaaauaucagugagagaugauauuggccuguaccacugggguggacagggagaaagugagaaaugauccuauuuggaauauauuuugaagguagaaccaaaaagacacuccuagaaagggauaugggaaaugaaagaaagagaggucaagggugacucuuaaauuuggaaccugagcaaucagguaaauaguggugcuauuuaaugagauacucaggucugagaaaggagcagauuuggggagaaaaacaaguuugguuuuggacauguuaaauuugaguugccuauuaaguguucaaguagagauguugaauagguaguuggauacaugaguguuauaaugauggggaagagaccaggcuagagauaauaauuuaugggucauggacguauguauuuucuaagucauuagcuuggaugaaauuaccucaauaauuacuauaaaaaggaaaaugggucaaaaaucaguuacuaggguauucuagccaacauuuaaaggucaggaagaaaaagagcaauaaaggaguagccaguaagcuaguagaaaaaccauugaaguauuuuaucccacaagccaagugaagaaaauguuuuaagggguuaucaagcauaucauuauuauuguaccagcaugcuauauccugagagauugagcuggaugugggcagagaaugaaccacuggauuuaguaacauggagauuguugguaaucuuguaaaagcuugugugaaaucgguuuugaaaggaggugaggaagugaggauggcaagcaacucuuaaguuuugcuauagugaagagcaggaaaaugggauauagcuggaggggccugugggguugaagguauuuguuuuuguuauucuaaaaauagaaagcccugcagcauguuucaguaggaaugauccagcaaagugggaaaaauugaagaugcagcuuagggcuaacuguagaagcagaauucuugaguagacaggaggggaugaaaucuaaggcacaaauguaagaguaguccuuaggaacaaggaugauauauaaguaaaguuguagguauguugaaagaugugauggugggacuucugguugcuucucagcaacauauuaggugacuugucagaugagagugaagagguacagagaauguuggagauuugaugagagaggaaaggcugaaaacaguugucucagaaugcgaauuaacuagagagguuucuaacuuugguaacuggauagacgucaauguuguuaagaaugggaauacagaggagaaaucaucuaugcauugaugugcugggaauagcaaguucagugauagacauguucauuuggagaugccucugauucccucagaaugugcaggaugugaagaaaacgccaagaauggaaucuuagaaaauacuaacauuuaaggaacagagucaggaaagagugcguaaauagaggcacuggaagagcagggucaugaaguuuagaagaacagagaguuugagagggacaaagaggacaauaguaguguguccugaauugauucauuugcaagcuuuuaguugguauuuuaauuuuaauauuuaugguuuauuuugaugagcauuagaaaauauauuuagcugguacauaaaaccucugauuuaugaaaaaugauaaugauuuucccuuuuaaccuaaauuaguguaagauuagacuuuagauucauuaaagaaaaacauuauguuaaguaaugauacugcuagcuauggaaaaaucaugauaguaauugguaaaugaauaaacugugggaagcucuggguuuaacaguuuagaaaucauuggugacuucauuuuaucaaaagcauuuucuauaaaaugaggaaauagcuacacuaaaacaacauuaauaaauuuuagaauaaugaaaguauuaaagugagcucucuauauauaauugaauuacuuuuagagcuauuagauauaguuucuaaaauauagcucauuuuauccuguuacuuagugacuaaaauaacuuuaaagcaaauaggagaugaaaccaauaaucauucuuuuuccuuuuuuuuuuuuuuuccugaggcggagucucgcucgcucuugucgcccaggcuagagugcaguggcucugucucggcucacugccaucuccgccucccugguucaagcaauuaucuugccucagccaccccaguagcuggaaauacaggugcccaccaccaugccuggcuaauuuuuuguauuuuugguagagacgggguuucgccaugauggccagacuggucucaaacuccugaccucaggugauccaccugccucagccuuccaaagugcugggauuauaggugugagccacugugcccggccaagaaucauucuuuaaaaaacauguaauaauaauagaacacaaaugaggaaagcuuucuuuaaaaacuucauuuguuagaaacaugaaaagguggcugggcaugguggcuucacgccuguaaccccagcacuuugggaggccgaggcaggcggauccccugaggucaggaguucaagaccagccugaccaacauggcgaaaccccaucuuuacuaaaaauacaaaaaucagcugggugugguggugcaugccuguaaucccagcuacugggaaggcugaggcaggagaauugcuugaacccgggagguggagguugcagugagcugagauugcaucaucguacuccagccugggcaagagagacuccaucuaaaaaaagaaacaugaaaaguuaauuguguauuuuuaauaaaauaguagaaaaccuugaugggcaauugaagaaauagggcauuucucagaaggauagucuaagcccuguaagcaagagggggucuguuuuauauaguucccccuagucauuuaacaagguauuuuuaauaugguuuguugcugcaauuguauuucauucuccuuacaggaacugaagggggcugacuucuuguuauauacacuuguguguagugaguuaggcaaguucauugcauguugucuaaaucuugaguuuucauucaucauucuagauguuuuggagacauuucaguuuauguaauguuaagcuuugccaucuuagauagcaagcauuuauacaacucuucuccauucagaaagaugauucuagcugggcuugguggugugcaugguagucccagcuacuuagaaagcugaggugggaggaucacuggagaccaggacuacgaagcuagggugcacccugaucacaccacugcccuuaaaccugggaaacaugaugggacaccugucucuugaaaaaaaaaauuuuuuuuuaauuauucuaauuggcaaaauacacaaccuauucuacguugguagagugggcucuuuuuaaaauuucuaagugauuugugccucagaaaauuauguuugcuuugagacaguugaaaugaguuccuaguuuuagacuauuuuuuuaaaacagcaccaacuauguaaaccccuuuucauauuuaaucauuguaugaucucuacucaguuccauggucugauggauauaaagcagcaagucugguaaucauuagaaaagagcauucgugagauuuuaaaacacauaagacugaggaugucugccauauauauguguacauguguaugcuguuuggguuuuucucccccuuuuuucuuucauuguuaguauuuauuacuagugguugaauuuauuucauacugagccacucuuuggccaggaaaaucucaguaaucuguuacuaaccagcaaaguauauuuaauuauuaucucaaagaugcaggagaaauuuaaaucacauuucacagauauugaaaaggccauagcuuuggauuugucuucccguuuaguugccuuuuauaggaacaaaccuaaauuugucauucaaauuuugccauccuuuaaaccucuuuagcugucaggcuuuguuaauaacccagucaggucacaaauauacagugagaugauuauggaaaauaauaagcacaauuugccuaaguacauuucaggaaaaagagcuagagguccguagcagcugagcggauacugcugucaagcaaguuuucugauuccugcugcaccucuguaauaauaaagcccuauuucacuugaugaugagaaauacagcuagagaaaaaccuaauaugaacaaauuaauaaucaauucaccaccccucucacaguacacuggcuaaaagccauaaauguugaaaguugggagagacugaguaagauccuggaaaccauguuauuaccugcaaaguggccacugaggugagugcaccaggugacuuucauuugguggcauaaagcaagaggaaacaauauguaacaaaaauacauaauaucaucaugugcuuuucacuuuccccuugaucaugcauuggccauauuuacuuacggguaaguagauauguucaaauuaaagugccuaucuuaauuccauacccuugaggcaggaucugcaaucaggguauuaggaaacuuuauuacugagauccauccacaagucucugcucauaacauuguuugauagagggacuucagcgggauuuuuuaaacuuugguuugaauaucauacuugcuaccucuaccaaugcaaaggacauuuccuagugcuugaucuuuuuccuucuaucuaggaccuaugagguauuacuagacucaaaucuugaucaauuauggaauaacuaggaucuugaguucucauuucaagauacuguccuuguaauucacuuaauuugaggagaaaaaaagacaaaauagccuuuauaacuucauuagccucagccuugcucuauauccuugcucuagggaaaaagacaagccugauaagcccaaaaagugcugggcauaauuaaggauugguuucugcucucaaggagcuaggagagucuuguuaaagaguuguguaauguacaaggucuguugguuuaaauauuauauuuacuaccuauaccagugguaaguuuaaauaucauacuuacuaccuaaaccaagucuaguuugcuaguaaguuuuaaauaccaauaccauauuuuaaacuuugguuuaaauaucauacuuacuaccuauaccaaugcaaaggacauuugguuggccuaaauaucauacuuacuacguaaaccaagucuguugguuuuccuacucgaucacuuuccugugugucagcaggugaccacuuguagcaggaaaaaggagaggcagaugguaaacacuaaggguuguggguagcuaggaaaucuaagcccccuccgacuguuuguaugcuuguucugaguuuaagaauugagugaagcagacucacuguaagagugugugauugaaucagaaagauauguuguauuuuacucacugaccguaagaacuuuguaacaucugccuuuugcagaauccguggaaauuguaccaaaucuugguaccaaaugaugaugcuauugcggguaguuaauuuucuugacuacauacauccugcuuugcuaguuugaugaguuagcacucauugcuuucugcagcucuaucccauaacucuccagcucuuucccacaacacauacacauaaaaguaccaauuuuacccaucuuucaagacccacuuccaccauaugccuuacuugaucuucuaauuauaaguaauguguaaucagacaauuuaacugugccucuccuuuggcuccugugacuugccaugguaguuaucuguguacaucauacaacucucuaacaagacuccuagcuccuugaguacagaaaccaauccuuuuuucaucugcauaccccagcucaccaagcauuccauacccuccccccaacauuuagcacauagaauauucuuuaauggcaaaguagcugaugauauuucaagucugaacuacucagauaacuaaguauuaaauguaauaaugaguaauuaacuuguauccacccaaaguuugcccagagugcuuucuaggaaaccccccucaauauacauaaguagauacaaaucuccuuuuaaggucuacaguucccacuguaagagggggaagaaaaauggaauuguauugucuuacugguccaguaggagcuaacaugucugacaaguggccuguauugucccaccuucagucccuccuguuuuuaaugaaaguuauaaacuagugucucucucgacccucauugaaaacuaacaccuaugagucagucucaggaagucuguugaauuuguuuccccaguauucuugcuuaaagaaaaguucccuaggcugaaguaagccagagauuuaaauuaaaaaaaaaauagcuaugucaguuaauuuucuuuuucaauauaauuucugcauggaaaagucucauaguaaacuuauaaugaauuuuaaauuugcuuuagauauguaaucugaucauuuaccuuucuagaagcauuuauaacugcugaaagccuggauucuucauuaaaauaguuucuaacacagccuacaugucaugguaucugugucucaacuggugcugacuuugcuuuccgugcuguagucauuuaagagaaggccacauggcaagaccaagaggccagauuuauagccaguucuccuuucucuacucuaaaaggcagcagggcauaugggaugcaggggcauauaggucugcagaaaccaauucagcucuaaauucuugggcaaagcaaguuucaggugugaccaugugugaacagaguauuucccaggacagaauuuaacuccagaauauguaguaaaaggaaaacacacacacauacacauucauauuugggaaucacauacuuuucuuucuuuccuucuuuuuuccuguaaacucuucugacuuaaucaccucaccaggagagagugcugauuucuggucuuuacuauggucuguuuucucuuugccauuguacuuuugaggucagucagcacauaaccauuauuuuaaaaccuucugcaaagaauuucauucagcaguaauuacugaaugagaacaagucuaaggagccauuauuucuguucaaauaauuucuuuuuucuuucccaaauagaggauagaacagggcagaggaggugaggcaucuucauuugucucagguacagucaucagcaaccuagguuucacccagauucagguucuguaugcuuauauuagcagugguuucauuaacgacguuucccaagaauccucugacaguaggacaguaguuuguuucuccauuucagaguaaaaaauccuagacacagaaauguaaauugauuugcccaaguuuguacaguaaggcugcagccaaggcaggauuugaauuuauaccauggaaguguuccucuugguaaaaggucuguuagacucuguuacaaccucuggaggugaaaaucauaaagguaucuauucccaguaaggucuccuuuucccucagcuauaccuguuacucuguguggugccaaagucccacaugucaccuguaguaaaagcuuccugguaauauuuuuaaguaauuuuguauaacaguggugagcaacugaaagauauauuuuuguucacuucaugguauuuuacuaccucuucuaaaagacagauuauauuuuacuagagauaaauaugaaauaguguuauuagguagcuuaaauuauaauaaaaggaaacagucaccauguguuucugagcuaccuauuuccaaaagaaaucauuuuuaaaacugcauaauuuugagugcaguuggguagaaagguaaggagaaaauacuauagaaaaagucacucauaucuguuaaaaggaugaugaugucuguauuuuccacauagguacuuuaauugaauauaucggaaugcuuccuguaggguaaccuuucugaaaggcagaagaaaguagacuguagaguauaauauaagccuguuggagcagggaugguaggaaaaccguuagaauauuccacuguuucacaaagacuacuuuucuaacaucuuugccuuaaauuuugaauuauagcuccuauuacaaaucaguuuauuauuuaugucuuagaaauuaguuuuauaauaaauugcaugggaauauaacuuauauuuacuguaugaaaacaaaaaguuuggggaagcuucgacugaagcaagauuaacaaacuagagggggcugagcacaguggcucaugccuauaaucccagcacuuugggaggccaaagagggcagauugcuugaguucagcaguuugagaccagcuugggcaacaugcugaaacccugucucuacaaaaauuacaaaaauuagccaggugugguggcgugcaccuguagucccagcuacucgagaggcugaggugggaggauggcuugagccuggaaggcagaggcugcagugagcccacaucaugccacugcacuccagccugggugacagagcaauucugccuccaaacaaacaaaaaaaacuagagggagggaguuguugaacagcaaagaaguaaaagacuauagguaacaugguacccauagccuauuuucauauuguaaggcagucugucuauuaaaauguccuuuagagagcacagagccuacugugagacuaauuucuaaguguacuaaauauuuuggggcuuagauaugcuaaggaguuugaucugaauuaaucgcugcuuucuucuaaaagauugguagaaauggacucuauacugcccccagcauccccuacauacacgcacacacacacacacacacacacacacacacacacacacaaaguugaaauuaugcagauacauugauaacuucuuuuuuuaauuauuauuauuauacuugaaguucugggauacaugugcagaacaugcagguuuguuacauagguauacaugugcaacggugguuugcugcacucaucaacccgucaucuacauuagguauuucuccuaaugcugucucuccccuagccaccacccccugaugugugauguuccccuccuguguccauguguucucauuguucagcucccacuuaugagugagaacaugugguguuugguuuuguuucuguguuaguuuguugagaaugaugguuuccagcuucauccaugucccugcaaagguuaugaacucauccuuuuuuauggcugcauaguauuccaugguguauaugugccacauuuucuuaauccagucuaucauugaugggcauuuggguugguuccaugucuuugcuguugugaauaguacugcaguaaacauacgugugcaugugucuuuauaguagaaugauuuauaauccuuugguuauauacccaguaaugggauugcugggucaaaugauauuucuaguucuagauccuugaggaaucaccgcauugucuuccacaguggaugaacuaauuuacgcucccaccaacaguguaaaagcguuccuauuucuccacauccucuccagcaucuguuguuuccugacuuuuuaaugauugccauucuaacuggcgugagauggauacccugauaacuucuaauagcagguuaauuguucauacuagagauucugaguuggcuauaacuaaaaggccuuauuuuaaaaagauuacauugggauaacuuacuauuccagugcagcuuuucagggagucagggcuaauaauaauagcaucuuaccaugugcuacgcaauggucuagcucuuugcauguaauucucaacaaccuaaugaaauggauauuauuauuaagcucaauuugcagccagugcaguggcacacgccaggaggcugaaguaagaggaucacuugagcccagcaguucaaguccagccugggcaacauagugagacccccaucucuuaaaagacaaaaacaaaaaacucacuuuguagaugaggaaaacgauucacaaaaagguaaaguaacuugucuugcgccaggcuguacccauaaccacugcucuaaugcucuuacaaaguuuugaugccucucaauucauuuguggcauuucuuuauuauaacuaaccaaaaagcauccuaaguuacccaaccaggaaucucuaccaauauaugagauuuagaagguaagaauucuuuuuaacaaauaagugguuacccaacucuaauuagaaaguggaaaauacucuucuagcaauuuguaaacaauuaagaugagaagauaggagauccugagaacuuagaauacuuugaaaaacuguuuagccacaugauaaauugugacuuuacccgucaggagacuuuacuuugacaaguauauuaaauauguaguuguuuuugcaaacacccuuguaggauagguuaguauuaauuacccuauuuaugcaggagauaucuaagcauagaaaagaauguuaauauacuaggaucucauaguaguuccagaaucagaaauacccuuuuuggaguuuuauacuuaguugauagucuuguagucucuuacuucuaagaaaaaccgaacugccaggauuugaauuagaugcuaaaugcuuugcaagcaaguaacagcauuaaacacagaaaaguguuuuccauuuucaccugggaccucguuaccuaaagcauuuuguuuaaauaguguuguuccuuuaaagaaaacucauaccucucaagguuaguguaagucauagaaucuccccauuuuugugucagcaaaaaauaagucuuaugcauagaagaugacuugcuacuuuccagguaucuuuccauuuuuccuucuccaauauuuuccuguguuucuuucaugagaacaucauuccgaccucugccaggaaaacaggcaauauuuuuccacaaaggcaacuuuuuuuaguuccccuuugagcuggagcagaccuauacgguagucuaaagaauggaaauuuuaaguucuucugaaauacuucaccuacccuuagaaacuggaaggaguaauuuuuaaaauuagauaauucaacuaucgccaagcuacauaugcaaaucacaucaaaacccuaaaccggucugguuuuuuuuguugguuuuuuggguguuuuguuuuguuuuguuuuguuuuguuggagauggaaucucgcucugucaccaggcuggagugcgguggcgcagucucggcucgcugcaaccucugccucccaaguucaagcgauucuccugccucagccucccaaguagcugggacuaccggcaugugccaccaugcccagcuaauuuuuguauuuuuaguagagacaggguuucaccauguuggccaggauggucucgaucucuugaccucgugauccgccuuccucagccucccaaagugcuggaauuacaggcgugagccaccgcgccuggccaaacuggucuguuuuuaacaguugagcguaagaacguuaguauucacaauucuacucuuaaagcauguagcuuuuaugugaucauuuugaugccuacuuccaagaaauacccuaacauaaaccucuuacucuuuuuuuauuccuccuguucuccucccgauucuucuucuccucucccucugagagauguuggccccaauuuugugaauuugaggacaagacauucuuagaaugcacauggcuugcacaagaugucugaguuugaggucaugcagaaggaguaauuuagcuucagggucccuugugcacauaauauuuuauaaauuaccuacaagauauuuuuucguauugcauaaguuuaaaaagaugagaccaauuaaauuuuuacugugggcagagggugggagagaaacagaagagaaucaaauguugagggaggaaaucaacuucagaaaacacagaguuucacuggguuccagucuuaaauguuugucguuugcuuuuauaauguuuuacacaacauguaucaaugugaagaaugcuuuaaucagcaucauugucauaauuauuuccucucugcuuuuaauagucgugcuuauuuauaucccaauuaagaauugucucugagaagugugauguucuucauaauaaauuauacucaauugggugugcagaguugguugaugucauuauucuguuuuauuuuaaugcucuuauguuuagcuccccugacuuaacuacacauaccagauggugaaaauagaaguggaggcaaauuaacaaccucuguccugucauaggagaaucuggagaaagaaagcaacuaccauugcucauggcuucuuucccauuagcccuccaugggcggggacacacacacacacacacacacacacacacacacacacacacacacacacacacacacacacacucucauggccucuuucccauuagcccuucaugggugggcacacacacacaccacauucagucuuuuacaaguuguacuuuucacugcucccaaacacaaaugagaauuccugugccuguugcuuugcccaacacauuauucuuccuugccuagaaugcugccuucccuacugaucggcggggggaagccuagaagccuuguaauaagauaaaccugauccagaucucagaucuacuacuuacuuuugacuuuaggcaaguuacuuuauuucacugagaaucgguuuccucauuucuaaaaugaagaugcacaugguuuuuaugaggauaaaguggaggaaaaaauauaaagcauucaaaaaauauuucuuccauuucauguaguuccccuuuuauaaguccugccuauucuuuaaaauucgaguucuaacuacucaaagcuuauucucugaagcacuuauuuggaacaaguauucuuugcugucuuguauuuacugucuccccaaguuguuugucgauuucuugagagcuaaaacucuuaaaacaaagaauccucaauuucugacauagucuuguuaaauaugguagccuccaauguauaauaguguaaaaguggaaaauggaaaaugacucucuaagcaugugguccccuuacucuaaagucauuaaguuggaaaagguuuugaguccauuacauuuucuuggcacaguaagggagauggcauuagaaguacuuccuuaaauugugaaaucugaaagagagccaucagucaagaaagagacaucuuguguuuccacucauguggagagagcuugauuuggugaaucuguacacacagauaagaugauagauagauagauagauagauagauagauagauagauagauagauagauagaucggucuaucuuugagacaacauucucuaaaaauuaaacauagaauguguuugaauguucugguaaaggagaacagcuacuuacacacucuuaaccaaagaauuguccucuaacaggaaaguugugauucuccaaugaaaaugcauuuucauugacaauguccauggaacacaagggggaaagaggacaccuguucagcuugccagaucagcuagaacuaaucaaggguagucaaaggagggacagaugucagccagauugcugccauguuagauauaacuaucugguaacauacuccccuacccagagaaugaccaucagguauagcugaauaguggggguuuggguucauauuaacacaaaacucuuaauaggaucaaaauccuuugacucacagguaaaagucgccauagaggucauucccacuauacaugccgaaaguuauuuuuauugauaugaccagaaccuguuuuccaaaagaaacauugcaaaacauuuccaaaaguuauauugcagccuuaauuguugacuuucugccaucaucccccuuuaauucuuuggcuuuuaauuuuuaauaauuccucaccuuuugguauaucucauuuuaagccaugaugcaaaaauaguauuuuucucugcuauaauuuaucucagacuuauccagguauuaaccugucauuucucacaaauagaaggaaagcuuuuugaugauauuucuaacuucaagaaaauauuucauggccauuaugaauggaacaaggucuuggggcuugaucuuuguuguuacaguuguuuuucuccuccuaaauacuugacaauagccuacagcugaaacuugaacuucagcgcaaaaucuugaaucacaguaaugaucuggcuuugggugcugcagcucacugauuuuuguguguucugcugaagaaaaaccggcauugucacauuuuugcucuucuugauauuuuaggaccuuguacuguaguacuacacgagagauauuucuaaugugcuauaucugugucucuugucauugagguaauugucaugagaaaacccuggacaacagccaugacaaacagaaauauuuugacaacucacagucacuggaugcugcugaagaagagcccucugagagaggaacagaggaggacccuguauucucuguugagaauucagggagggacucagaugcccuuagacuugaaaguaaguugauuugaccugagcugugcuucuggggaaaaaucaacucucaagcuuuaagcuuaggcuuuucucuacuuuuaagaauuuguuuucuucuuuaacaaucauuauauuguagcaucaugagggugaccccuagguggugaggcagaagacaagcuuuagugugaaaguguucacaccucagugucuucuguugcuagaacaaaucugauuuguuuauguaucagucuucuuaauguuacugguauauugaguaaaucauuauaaaaggaagauaaguugcuuuuacauuaaacccaguaaaauaugaagauuuggaauagugggcuuaccuauuacgcccucuccuaagauuccauuuuaugacccacauuuugagcuauauuguacuaaacaguucuugcuaagauuaucagaauugccaaaacgcaugacuucuuuuuaguauucacccacuugaccacuuuacucuaucuggaaccaugcauaacucauccccacuucuugaaacucucuccuuuccucuuggcuucuggaauaucacuugcucuuagcuuucuucuauccacacaucaucuuuuaaaauuucuuucacuuacacuuuauucugcccuuuauuuguuggguuauccaggauccuaacuuugaccuucuauucucauccuucuauguauuaucucuuggugauucaaauacccuugacuacaccaaugucuccagaccuauauuucagcuaagacauucucuacaacuccagaucuuauuucuacuuuuuuuuuuuagcguacucuuuaucuggaugugccauaggcacuuaaauguagcauauccaaaauugaacucuucuucauauuggcccuauuuucugaaaugcuucuaauuucuguauuccugaucucucuuaagaacaucacaacucacccaggcaccacuguauccagucagucucucagaccuguugcaucuauaucucuucauuuauucccacugccacugcuugaauucagacuuucuucauuucugccuacacuauugcaguagcgucuuaauuuggcucucuaaaucuagucuuuuauuuuagucuguaugugaagaaagagaauacauguaaucaauacagaauuuuaaaggcggaaacaaccacuguuaacuaacuuuuugugcguccaaagaguuguuucuaaaauguaaaucugaucagauuugcaaguuacuuaaucuuccugagccuuucuuaccucauuuauuuaaaaacaaaccaacaaaaaugcuguauagagugguuuugaguauuuaaaugaaauaacuuugggaagcauuuauuuuagugccugguacucagaacccaguaaauguucuacaaauguagauauaauugcaucuucaggagucaaagucuuuacaaacacauacacauaguacaugaucaguaaacaucuguucaguucaagggagccauaauacauuugcacaagaauuguuacaggaaagauucccuguuugcuuuucuggguuaucuacucagaguucccaguuuucucuugcuauagugacccagcuaaaaaaaggaagaacgccacugguggcaacaaauacuuaugauuauuguuuucugcucagaagagaaugauuucccuaccuaccuuaauccgaaugauuuaaucuaagccuuuugcgcuuucugauuacuggcuugaaauuuuaugucauuguuuauauguuaaauuguaagcauaucugcagcuuuccaaucugacuucaaaucagaucacugccuuuuaaagagaacccuaggacugaagacagaauugcccaaggcccuauggugguaaucuuuuuuugaggagucucacucugucacccaggcuggagugcaauggcacgaucucggcucacugcaaccuccacuucccguguucaagcaauucuccugccucagccuuccaaguaacugggauuacaggugcaugccaccacacccagcuaauuuuuuuguauuuuagugcagaugggguuucacuguguugcccaggcuggucucaaaguccugagcucaggcaauccacccaccuuggccucccaaaugcaugagccacagcgcccggcuguauggugguaaucuuaauuuggaaucaaguuugucuaauuccuuagaauacucuuucucuuuugugagacaaagggacauauuccuucuacaguauuguuauuaaagauaguaugugccuuacuugccuucagaagccacaaucuuaaguacucuggcacccauugauauuacucaugcaagacuuucuggaggaagauguugucggucagauuuuguuggccaucucuuugaauuuguguucuuuaccucuuucuauggcuguguuuacuucugucuuguuuugaaucuagcacucaucuuuccauccucugcucccuaaacuccuugaaacuucucuuccaagauuguuaauguuguuucuuaucaaauauagucaccuucuguuaauuggcuucugauauuccacucccucucaauaguguccucugcagccauuaacuggcuucuguuucuacuccagguaugaugaucccaguuucuucccggauaaccauugucauuugauccaaaagucuuuccuaauauugagccucucauuucuaguuuugucuuaugaggcuaacagcaucagucuuguuucucauuaauagcacauucccuuaggcguugaagaugguuauuguuccugccuaccuuccuuuccuaugucuuugcuucucuucaguuaaauguccucacuuccuugaauaacuuauguuauggcaucuagucucuucauugucuuugaaguaaucucuuuggaauuuuucaaaaucuuuucaagcccgaauuuuuggugcaauauaucagcuacucuuccugccacuggauccccgucgacuucuucagucugucuucauuuaaugugguuuugaguacuuuugccaaguauauuuucugugaaugugcucugcuuuggauaucucuuaaagugaggugcacagacuuaaacaugaaucuccagauguguguggaacauuacaagcuucuuuuuguuuucaacaggacuacauaugcauagcuucaugucuuguuuuuuuuugguuuuuuuuuuuuuuugagauggagucuugcugugucgcccaggcuggaguacaguggcgcaaucucagcucacugcaagcucugccuccuggguucaugccauucuccugccucagccucccgagguggcugggacuauaggugcccaccaccaccccugggcuaauuuuuguauuuuuuaauagagacaggguuucaccauguuggccaggcuggucucgaacuccugaccucaggugauccucccgucucgaccucccaaagugcugggauuacaggcgugagccaccgcacccagcccguagcuucaucucuuaacacuucuccuagucccugugauucuugauaguaccuaauauggcucagauacaaguauaaaccuucccacuacccuggaauaggcuucaucucaguaaaggaugugaacucauauaaaccucacuguggaugcucacauucucuccaacuucacaauauuuauucuucuucccagugugaaaauggugcuugguaacgaaaaucaagaaaaaauaggcucuguuuucaguuuauaucauaccaucuguccuacaagcagcaagccuaagauuuacuuauuccucuugcuucaagcauaauuugaaaccuucugagaucucucuacaauccagaccuuucaccaaaccagaauucgguauuuucagcuguauaggacaguuguguaggacaguguucuauauaggacaauaucugaagauacauuccuccauccauucuugucuagacuguaaguuccauggguuguuacaaccccagcccucagcacauugcuagauacagcaacaaacauuuucaugaauuaaugacaagugucuacaauuccaacucuuuauccuguugcccuuuccuaacuccauugucuuuauaaauaucauucuguuuacauauucacagauucuaaaccuauagucauauauuaaaaaucccaguuuuucacauuagacugaaaaaucuugaaaucaccuuugagccuauccuauuacuaauuuuucuccauuaacauuuccuuguauaccucuuuacccucucuuuuuuaaagauuccuuuucccuuuaccuuaagacaaccuacuucuguaacucuuauaaagauuauucaauaccuuucuaauuggucucuuugucuucugucuucucuuuccuuguccaacaccccaguuccgauacacaaacugauuuacuacucuaagacuuuaaccuuuguaauuauuauggcccucauccuguuauucuucuguuuaagaaacaagaggcucccuuuacaacaaauccucuucgugacuuucccacacauuuguaacaucaccuaccuuuuccucaguaucuuauuuguuacuauccccuguauacauucuuuauucuaauuaauuugaaauugguaaugcccucacaugugccuuuacuaucccuguauguauguguguagacaaaugagucuaugcauacaugcuuuaaaaaaaaaaaauuguuaacucuggaaggcuggaugcaguagcucacaccugaauccaagcacuuagagagccugaggugggcggaucaccugagaccaggaguucaagaccagccuggccaacauagcaaaaccccaucucuacaaaaauacaaaaaaaguagccaggugugguggccugcgccuauaaucccagcuaccugggaggcugaggcaggagaaucacuugaucccaggaggcagagguuuaagugagcugagaucacaccacugcauugcgcuccagccugggcaacagaacaagacucuaucucaaaaaaaaaaaaaaagucccuauggggagugaccucccugacccucuacucuuaucuguuuaaauccugucucagguaguccgccuuucucuaagaagcauuuugugauuacaugcaaauauuuuuucccucuaaaaaaaaauuaauuuuucucuuauuauuucauguauguaguugucugucuccaacuugauuauaaauucauuauauuucauuucuuaagguuagaaacuuuccauuuuuuuuuguucccaccuacagcuuacagagauagacauauaguaggcugucaauaaaguuugguuuauuuuuugcuaacucagagcacacuuauaaucuacuuauucuucaccugugaggagaaaauauaaaaauauguacauauuuaguguuguuuuuuuaggaauugcuuucgccccaaccccagcagccuuuagaaaagcuuaauggcuaccagcaacagaagccuucagcaagcuccauauucucucuucauuugaauaucaguuuccauuaaugaaagccccucucucucagaauuuuuaaauaacgauaaauauuaccauaugguaggagcacaaggaagcaaucaccuuggguuacuggguuugcagaacucuucguagcuaaacagcaugaauuuuuuccaauguguugcuuaacgacagggauauguucuaggaaaugcguccuugggugauuuugccgucgugggaacaucauagaguguacuguacuuacuuacacaaagcuaggugguauagccuacugcacucccgcguuauauuguguagcuucuugcuccuaggcuacaaaccucuacagcauguuuauguacugcaauaccguaggcaagcguaacacaaugguaaauauuugugucucuaaacauauuuaaaugcagaaaagguacaggggaaauacaguauuauaauuuuauggcaccaccaugguauaugcaguucaucauugaccagaacuucauuauguggugcauggcuauaauaccauguucuaaaucccugaacaagccagaauuaccaacugaagauuauugcacuagaauaaugaaacuggcauuuugugagguaucaacccagagcucucagguuuuccuguggguacauguuacaaaaggagacauuuuguuauuuguucuuguacccuaucuacuuccuaaagggacuagggaugacuuucauggaaugcacaguguaacauccagccaauucaaaauaaacaggaaaaguuaaguagugaagaauuuuuuaaaagaaagccuucuauuaagaaacucgggcuaauuuugccugagcuuccuuguuauucaagcuuagaggagaacucaagagggcuguguaaccuucauuggauaauaaaggaaacauacugaguucucaggagagagaauuuuugcuaggccauuacacugagagucuuccauaggagucuuuauguaagagacuugagccaccuaaauaauaucuugguaaucauuuuagaaagaaauuauuguaguauauugcuauuucuuauaucagccauuuagugaaaaaugggagccuucauguagaauuaggauaguuuuccauuaaacaaaucauuuuucaauuaaggcaauuaagccagcuauauggucuggacacacagcuauguccagauacuugaauaaaccuugaagaaucccauauauuaaauaacauaauaagcuucauccuugccaucuauguuuugaauguagagcaaguggaucuuuuuuaaaaaauaguguaucacauaccuguccccaugcucgcuaauaacagaaucucugacugccugcucucuagcugccacuguucucagccaggcuuuuggcaaacgcuagaugacaaaguugguauuuuauuauguauuuugaagaugcugaauggaauuuuuauuacauugggcuauaguagugccucuaagcagagccaaaacguuucuccaaaagcaggguuggagucacccaaggucuugaaugaguacuguguaccuuuuacuaacgugcuggcccuugaauuucagguacggugguugaggagagcaaugguucugaugagauggagaauucagaugaaaccaaaaugucagaagaaauacuggcuuugguggaugaauuucaacaggcauggccuuuggaaggcuuugggggugcacuagagaugaaagggcggcgucuagacuuacaaggaauacgggugcugaagaaagguccccaggauggaguggccagaagcucuugcuauggagacugcagaagugaagaugaugaagcaacagaauggguaaguuugccaacuuaauucucacaaaauuguagcccaugccuuucaggggauccuaauaugcaaagugggaaguuucuguuggauauguggcacuacuuggcuaugcacuccaggacagccuucacauuggaauuuuauugggaggaagcauuucauguuacuuauguauugcuggcucuucuggaaggcaggaggaaaugggaugggugugaagccacugucagagccugcagacuuggaacuguccaguucagacaucuuucuuuucgguuucuucuauacauucuucgagacuagguuauuuuguucauuucacuaaccauuuuuuauuuaggucuuuaagaauuaaacucaaggagagaacuuaaccugagcacaguacuugguuauucuuaaacuaguauucacaaaucauugacagauuugaucacuggucucauuugucccuaacauguuucuguuucccagauuacauuccaggucaaacguguaaagaaacccaaaggagaucauaagaaaacuccugggaaaaaaguagaaacaggucagauagaaaauggacaucguuaccaagcaaaccuagagaucacuggccccaagguggcaucuccugggccacaagguaaauuugaauguuuaauaugccaguuucuuguuuuagaugucacuaucucauuucucacaaagguuguauuuguaacuugaaauaguucagaugagaugauaaaggggcaaaguguggucaagaaaccagucuaucuucuguaucaaugaaaaaaauguucaaacucuaaaacauuauggaaaugcaaauuccaguggauuuaacauuauguguaauaaaucauaaaggaagaaaaauuaggugaauauuuacaugcucuuuccauguggaaagaacuuucuaaggcagagagagggaaagaaaauaauaauucugacacuggaaaguaccacaaaauaagacaaaggacugaagcaaaguuuuuuuguagauuauuuuuguauauauuuacagaauauaugauaagcagaggguaucaauaucauuuaaagagcaccuacaaaucaauaugaaacauacaguauuucaguaaaauacgugcagcguacauaggcaguucaccaaauacauacacacacacacacacacacacacacacacacacacagauggccgcuaaacuugagaagauauucaaccucaucagcaaucagaggagcgcagacauaaacaguaagauaccaguuuugauuaucaaauuguuuuuaaauguguaacacacauuuuauuuaacugaagugaauuuugcggcagucugacuagacgcaucagaaaauuuaaaaauauaccaguuauucuacuucuaguaauuuacccuaaguaaaucaucuuacaagugccauagauguaaguagaaagauuauugaucaugggauugcuuauaauaaaaauuuguaaacaacauaaauguuguaauugccuaaauaaaucauaacacaucuaugcugcauaauaugcacucaagauauugguaauauaguaaguaaagaaaagcaauuuauaaaguaguaaauguagagaauaccuuaaucauuaugcuauauuucaucaacuacauuuuuuucacauuucaauaucucugaaauuggaauacaucuuacaguugauaguaucuuauauaauaauugccacuguuuuucuuucuuaaauccuguaaaauaauguauguuuacaguuggcagcaucuuagauuugaugaaauaugguauaauaaacaagcacauagaaacaaaacuagcaugaaauacaucaaaauguuauaaacggucaucucugggugcuaacagagcuauaggugauuuuuauuuucuucuguaugacuuuuccauuuucuaaauauuuuacaauaagccuauauuacuuuuauaaacaaaaaacuaaaaauuuauuauaaaagugaaaacuaaagccgaauaugguugagaugauacgagagcacuuaagcaguuuuaaauguauucaaguuggugggcccaaguagggcauugaauguacuugcaaaugagauuauggaacuacuuauuggcauuaaagugaaaagcucuaaagcauagaggacagaaauacuagagagauucaaaaacccaauuuucaaauuaguauggauucuauucacugcuaacuaaucagcuucaugaugaauccuaaccaaguuauaaagcaaaguauuaaauaguuugugagcccaugggggaaaaauggagaucauuaagagccauuguagauuuucuaagaacuaauaauaaugcuuaacuaauuucauuuccuuuuuugguuagggcuacuagacuggaagaccaggaaagugccauagacauaauguaacuggauuucagcaaggcauuuaacagagccucuuaugauauccuugugaaccagauggagagaugugggcuugaagccuucccauugccuacaggauaaaauucaaacuuccuagugugguguacaagacccuuuacagcccgccucuguguacccuucaacaccauucucugaaccaaccaugcucauguuuuuaccucagugccuuugcacaugcuauucccucugccuggaaugcccugugcccccucugcccucugccgugcuaaaauaucacucauccuuaaacuucaaaaucaagugccaucucuuccuuguuaccuucaggcagaauuaguuacucuuuccucugugcaauuguucuauaucuucgcucuagcucuuuuccuguuguauuguaaugauuuguuuauguuuaccuuccuuacuagacugugagcucaagagcaggccgucuuaauuauuccuuucuguaccccuagugucuuuuaugguucucagccccuuauaacaggugcucaauaaauauuuuucaaaugaaauuauuaaauguaaaagaaaauuaagauuuuuugugaaaauuauggcuuauuuaaguuauuaauuuaaacagaguuaauuugaaacucuuccaaaacuguuccuuucuguuuuguuaaaaucucaaucuaaaccccugccuguaccucaaacaguuuucuacuguucguaaauuccuauaauauaaaaagcgcuauacagaacuaaaguucuccuuccugccuauuccauuauaacuccuucagaaaacccuucccagacaagacaguucugcucuuuucuuggggauuugauguaaguaaagggcccacacccaaaaggugguacuuacgaaggauauuaauaaacagagcuuuaaauuuuuuuguagcuuuaaauagcuuguugauugggaacauacacguuagagucaaacagacuccuagcucugccaguugcuagccaggugaccuggacaagucacuuagucucucugagucucuguuuucucaucugagaaaugaggguuaaaaccuacuucaggccagaugcaguggcucacaucuguaaucccagcacuuugggaggccagggugggaggaucacuugaguccaggagguuaaggcuccagaaagcuaguaucaugccacggcacucuagccugggcaagaaagcaaggugcugucucuaacuuaaaaaaagaaaaauggaaaaaacuuaaccacaugagguuaaaaaaagaaaaauggaaaaaacuuaaccacaugagguuaaggauguaaagcacuuagcaugggaucugaauacacaggaagugcucuucaaauaguugauaaccaggcugguucuuggacuguggugguguggugggggcugggaggagaugauaaucuuucauuaacaucauuacucccugcugcucuucuuuauaguagugguucucucuacuggguguggacauuuggcaauaucuggagacauuuuuguuguuauaucuggggaacagugcuaccaccauccagugggugaaggccaaagaugaugcuaaacacccuccaaugcacaggacaggucccucaaaaaauuauccagcccaaaaugccaauaauaccagguugagaaacccugcuuuagagauaaauguuucuacuaaguuggaguugucuuuauaaaaucaaaauacagaggggcaaaaauuaaguuugguaagaauguuaacauugaagaaugccuuaaccccuuauuucauguugaucaaucuuaaaucuagcaaaggacucauuuauucuuacuucuccaccuaucuuuacucagagaugaucuuuaguuccauugcauaaugacgagauuuuaauuagaucauagaugggggaaauguuaaagacuacaggaaugacuagcaccuccaaauacaccaauccaggugaaguaaucaccagggcauaaggcccuuuggguucucuuccuuugcaauuguguggauucauggcauacuuuccuuccaggaaaaaaacgugacuaccagcgucugggauggcccagcccggacgaaugccucaaacuccgcuggguagagcugacugccaucgugaguaccuggcuugcaguuucuucaaaaaacauugaguaaguauguuaagccucucccuccuuuauggcauuugagucccauugaacccagcugacuuuaaggauccccucuuagcagcuaguagaagaguuauccuuucuagagcugaauuuucaaaggaugaccaugcugaccauggcccccagguggacccaacccauuguagcaaagcagugagugugccccccuucccggugccuucaccuguccuuuguaagcuaucuagcagccauguauaaccugcuuaguuugaauugaagacuggauccucucuauagaagcacaaaacccaugguuugucaugaauaucaugcaguuguaagggagccagagcaaauccagauuugcaaacaccuaccaagacauaguagaugccucugauaacugcuuuuuccucacuggacacucgcucucuuuugcugaccccuuuucuacccuuuaaguguuggaguuccccaggauuuaccacuaagccuucuuauuuuguaaucacuucuagucagacugaucuacucccaaaauuccaaucaacacaaagauguacuaacagcucccaaacuugaaucuccagaccagaucuuuuuacaaugcguucaacucauuugucugucucccugaccugucugucuagauugcacucaggcaacccaugcucgggaaaacuaaagucauaauuuucuugcccacucuccauauuaaaaaauuauuguuuuuuuuuguuuuguuuuuucuuuuccuauuuuuaguaaauagcuccaguaaugcuuaggccaaaaaccugggaguuauccuuaaugauuuuccucccuugcucuucaaauucagccuguuaccaauucuuagcacuuuuacucccugaguauuuuucaaaaccaccuacuuuucuccauccccauugcugccuccucaaaccagagcauaaccaucccuacgucgguucauccaguacuuccuagcugguccucuugcucuguucacucuugccucuguucaaucuauucucuccacaguacucagaauucuucaaauauaagucaaaucauucuuaaagcacucuaggaaauucuuaaugcuauuuaaaguggaccauaaagccuuucuugaucugcucccugccuguuuuuucauccucucuuuugcccucucuccugccagggcugucacacguggugucuccuuugucuguggcauuguucucacuguggguucucagcugguuaauucauacuaaaccuucuggccucaacuuaaucuuaccuccacagaauccuucacuagcuacccuccuccaccagugcagaggcaacauauauccuccuggaguguauuaucauugcaccauauuuuaucuuuuauaacuuaccacauguaauaaaugaaucacucacaagagaaugaacaugguaacagcagggacuaacuauguuguuuuacucauuauuauaguccuuguaucugacauguaauaggcucuaaauaaauaaugagugaauguuugccuaauaauuguuagacuuuuuaaauagcugcaaguaaaacauggcagugccaauuugucauauuagugcauaugauagucuauaauaguaagcuuguauauggugggaaaaugaaaggaaguacuuagucuuacaccuaaauacaauguacggcuguaucucuauaagauuuacugucuaagcuuuagguaacuuuuucuguggggaggaaugugcugcugugcauaaaagaaaacuaaaagauauaacuaguuguggguauuuaucaccacuuauaucuuggaagaagaaauccuagaagaaaacuuacuucguuuaaaaucaggggauagcauguugaagcuaugaugagcugauuguuaaugcugucucuccuugauuguuaaugcugucucucuucucuucccacccacucaaaaauuucccauagcuaaugugguaaucuccauuuuucagcaucacagaacacauagauuuugccaccccuauacagcagccagcaauggagccucuuugcaauggcaaucuccccacgaguaugcauacccuggaccacuugcaugggguuuccaaccgagccagccugcacuacacaggggagagucaguuaacagaggugagugcucggcuuuguucaggcuguuuuuuagccucacaguuaggaugcacauugauacuacauagaaagcccaggugaccgggccuuuuaaaaaaaaauaggggcuuuuuucaguuaggcaucaccuagguggguuugggccaagccugauuucuuucaggcccugggacugagcuuauuauucuuuuuuucuuuaugaccauggaauuuuaauucugauuuaccccucaagggggguaguucugccuugccaucaaauaccaacucuugagaaaaauguauggggcaguuaauucuccuguugacauuuuuaagaaggaaggguaaggaaagcagacccaauauauaccuagcaaagcauauaccuagaagaauuggaaaaacacaucacaaguauccaacaguagaggauugguuaaauaaauuuugguuagauguaagauaguauacaguggcaccauuagaaaauauauagaaauauucuuauugaccugaauaaauuuucacaauauauaaugugaaaacauagguaacaguauacaguguaauucaauauuuugugagaaaaaaauguacauagaaaaauaucugaaagacauauaaagguauuaaaagugguuguuaauaccucucuauaugucuuuacaugucugaaugacaagauuacacauaguuuauuucauuuacucuguguucuaguguugcuauaaugaauguguuuuacauucuguaauuuuuguuaaaugugggagagcugaggggaugauaaaacagccuuaaaugugucuuccauagauuaccuuaccaauaggaccacagcauguaucccagaaaaacaguuugccucugugguacagugcccaacucagcauuagcaguaucaucuagauccugcaucguuuucauucuucuaaucuacuaucuuccuuccuuccagguauuacaaaaucucggcaaagaccaauauccacaacagucgcuugaacagauuggcacccgaauugccaaaguuuuggaaaagguaagucaccccacagaaaagcuggaaacaauugcccuccuucuaacuucuuuucuaaguuauuugcuccuaagugucuguaaccucuucuguuaguuacuuagcacuugguggcuaaaaggauaaugugaaauaacuccccucagaauguuucagucgcuuuuucuaucacuuggguaauauucuuuucugucucuuugccugcuuucuguggugaaacuuaccuagucaguuuucucuucuuuaccccaguauguguguauagaggugguaguauuggaaaccauggaaucuagguauaugaaauaagucagauauucuucugauggugaagaauauuugguauuuuggaugauggaugggaaacacacuuugaaaugucuuuucucuugaaaucaugaaacaaaauauuuaccaaauugcauuuucguagagccuacagaaaauaucauugagagguucuaagacuccuuuucuuccucugugugauauuuguguaaagaggagggguuuuuuaauuuaauuuuauuacuuuauggcuaagaaucucucuacuuuauuacuguauaauauuaaagagcuaauuuaacauagucauuuaaacaaucaacccaacuucaaguaugaaugcgacacugugagauagcaacuuccuucaucuuccgaguaucgcacauggaaaaaucaucagcagacuccaguuauaaugaaacuagggcaaacacaugauccccagacuucaaaaaaaguaaggauugccaaaagugguuaugauccacacaaaaaacauacaggaugaauuguagcagaauucaggcaggguuagcaauuucagaaaacgucagcaaaauucuacuaccugaaggaacuuucuacagguagcccaaccaggaaaauccugaguaauaaaaacagagcagacacagcacugauacaaaaauaaaagaaaaccggucgggcccgguggcucacaccuguaaucccagcacuuuggaaggccaaggcagguggaucacuugaggacagggguucaagaccagccuggccaacauggugaaaccccaucucuacuaaaaauacaaaaaucagccgggugcgguggcacgcaccuguaaucccagcuacuugagagagugaggcaggagaaucagugcuaacccaggaggcggagguugcagugagccaagaucgcgccacugcacuccagccugggugacagagugagacucugucucaauaaauaaugaaugaaugaaugaaugaaugagugaaugaaugaaaaccauaggaaaaagcagcaaaacuuacuaaagaacacacagcaggaaaauauuguaauggaacacauuauaauucagacugaacuuuucuccauggauuaaaauauuaggccaggcacaguggcucaugccuguaaucccagcacuuugguggacaaggcaggaggaucauuugagcccaggaguuugagccagccugggcaacauagcgagacccuaucucuacaaaaaaauuaaaaugcucacacacaccuguagucucagcuacuugagagauugagguggaaggaucgcuugagcccagaaaguugagguugcaguaagcuaugaucaugccacugcacuccagccugggcaacagagugagacccugucucaaaaagaaaaaaaaauucgccugcauaaauaaagaucacaaagcaaaaauauaaaaacacaggagaaagauuagcaauggauauaaaaacaggagauagaaaacugaaauauauuaaacuugagugccaggccaaacaggucaguaguagaaaaauuuugucacagaacugacgacaaaauuggaaggagcagcaagaggaauacaucacaaacacagaaagggacauagaggacagaagugacaagugacgaaaauaagagaguuaaagaaaaauugaagauaacauguuagaaacauauuuuaagcucuagauucaaauaaauaagauuugagucuuauucuauuucuauaaaauauauuuuguuaaaagggugcacugugugccauagaaaacugauccagaacagucaacagcagugcuuauugaagcaaaauuacuccaucuuggaagaaaaaaaaaagagagaaagaaagaaaauauaaucagauuuuucaacagcaacucuugauuccagaagacaauggaguaacauauuuagaauacuuaaagaauaaaaaaagaggagcuauggauuuuauaugcuaccaaacugaccaucaauauagaguccacagacaaauugccauuaacauguaacaaauauuguuuccaugagccccuucuugagaagacugucuagagauaagcuucagacagccaaaaugaccagagcagcauugguauaagggacuaguagcaagcauuauauauuugucuauagagccaagacugaauaauggcucuaagagaggcaagacaguaucguauguuauggaagcuccucagcuuaccaugggguuacauccugauaaaccauuguuaaguugaaaauaccauaggucgaaaugcauuuaguacaccuaaccuaccaaacauuauagcuuagccuagccuuuuuuaaauguguucagaacacuuauauuagccuacaguuggguaaaaucaucuggcagcacaguauauuauagaguaucagcuguuuacccuugugaucauguggcugacuggcagcuacagcucgcaagaguguuguacugcuuucuacuguauacccauugcuuucacauugucauaaaguugaaaaauccuaaguuggggauuguuugagcucugaaaauguagguauaguacaauuaucaaaaaauggugagagaauaggagaauauaugaaagguaaaauaagcucacugauuacuuaauagauacugguugggaauuaaagaaugguacuucaaauuaaaugcugguggagaggaaagguagaaauguaagaaaagguuaucagguaauuuccauacuguucauaguaggggaccaacagaauauagcccaaaaaaaguaugaaggaagggagaguaaugguauuauauaaaggccuuacucuauagauacaauacaagccuuccuaaauaccaaaagauaaccugaaaauaguaugcaaauaagauagacaauauaguaaaagaauacacauguacacauauuaaacagauggauucaagggaccaaggacaaacaauuauauccauaauugcaaauguucuuaccuuaacuauuaaaagaacaauauuuucaaauuguuuaacaaagcauagccaaacauuaugcuguauucgagaaauauccaaauaaaauuuaacaagauuuaagauaaaaauaaaagaauggauaaagcauacaaggcaaaugcaaauaagagagcaaaguuuaugaucuccauaccuaacaaggaaaaacuuagaucaaaaagcuugacaugacaaagaaauauacuuuaaaaugcuaaagacuacaguuuacaauaaauuuguaauaauaauuaguauuuauguauccagaaacaaaugucauaaagcagagacucagggagauucagagaaacagauuaaaauauaccacauaauaccagacaaaaaauuaauaaggauauaaagaccuaaauagcauaaucaguaagguagaucuuauuagauauaucaaacucugaacuuugauuauagaaaauacaucuuuuugucauuugaacauagaauauucauucaugaaaauuauaucagagcagugaacaaauuccaaggaagaaaauaaaaguagcauuuucuggccagaaugcaaaaaauaauaauaauaauaauaauaacuaacaauauaaaagcccuccuaccuggaaauucuaaaacaugucauuuaaacagcugagucaaagagaaaauaagaaauuuagaauuucuugaagauacaugaaaacaaaauaacagucuguagaacagacuaaaacaguuuucagagaaauuugcauagcauuaaguacugugucaguaaaaaugaaaaauaagaagaaaagauauaaacacccaaaaccaggaugaaaaaauaaacuaaaagcaaaagaauuaacaaagaaaaaggaugcauuaauuauacagaaaaucaguagaaacaaugcauccaaaaguugaguuugagguauauaucaauaaaauggauacaucauuagcuaaccuaauaaaggaaaaggagauugccaaaauaaaauucgaaaggcagggggacaugaccauaaaaauaggaagcuuagagaaucagacuacuuuaaccaaaacauauaauuuauucaaauagguuugaaaacuuaggugaaauaauauuuuuuagaaaacuacaaugcagaaaaaaugcugcacuguaguuuucuaaaaauauuauuucucaguagaaacagcaucuaaaucagaaagauugccauagaagaaauggaaaaaauaguuaauuccaaccaaaaagcacacuaggcccagauacuucacagaggacuuuuacaaaccguuaaagaccaaaaauuuccaaugcugcuauauuucagaguaucaaaaaaagaaaauguauuuuacaaagaaaacauaucauuguuccccaaaucugaaaaaaaugacaccaaaaaauaaaacuacuaaccuauuucucuuguuaacaauucaaaaguaguaaaauaguagcaaacauaaucuaacagcauauuuugaaaaauacaucaugacuaaaaggcuauucuaggaauacugaauugauuuacuauuuggaaaccguuaauauccuucauauugauagaggggaaaaaaucauauaauuauauccagacuugugcaaacauuggauauauucaguaccaacuuaguuuaagaacccuaagaauugauacuuuucuuagcacaauaacacacacacacacacacacacacacacacacaccacuuagcagaaaagccaggaccuuacuaggcgccuucuaaaugcuuuuccacugaagucaagaaccagacaagaauguccacucuaucuacuacuacucaacaugaguuugaauguauuaauauagacaaaggcauucagacugccuacuguaucuaauaaaaucauaugucuggaaaacccaaaagaauccauggaaaagcaacuacaaagaauacaagaauuuagucaaauaacauuaaaaguuaauacaccuguaaaaguaauauuccaguuaggauguaguaggucaaggcaggucagugcauuacaguaacuugaaugaaccagauaaacuucuaaaaucauguuuuuaaagcuaucacaaaacuaggcaagcaacaagauaugaaagaacuaaauugcuagugacagaagaaccuuuccaaagugagcuggugauugccagcugugucucccugccuaugcccccagcacuuguugauucagggugugagcuaagaacuggccuuagcguagggagaaagccauuacugaggaaaaagagaaagaaguaaagcuuuuagcaguuguuccagguggaauuaacagauuggaaaucaaacacaugaccaguuuuuuuuccaaggagcauuucgauuagaacuaaggccacacaggagucugggggauuaggcucaaaacuuaggaacgguagagugaaaucucuccaucucacacugcuuaggaaauaaggagaugcuggguaacagagccagccauaagcauauggcuuuuuccccucaggacuuucaucuuaauacuacuuggaugggagacugaagugagcuggggaucucuaacaggaaaaagucuuuugggcugaggagacaaacaccuaccuacuagacaccugaggucauuccuguuccucaguuguggcacucuggggauucugauuagaucuagauuaguuccuuaucuagcauuaggucuagauuaguuccuaaucagaauuccuggagugccacagcagaggaacaggaaugacccagacagauugagucuugccaaacuguaugccccaacuuaacauuaucaggcaggaaugaguugaucagucuuacgaccucuuugccuaauagaauuaagggaaaaacugcccugaugaaguauaauaucuggagccgcugugauucuuuuauacagaaagaccagaauacaauuuuuagaaaaaaauacuagauaugcaaagaagcaagaauguaugguugauaauaaggcaaagugcagacaauaggaguagauuuacagauaauagagauauuauacucaguggacaaggacuuuaagauaacuacaauuaauauauucacaaaaauaagggaaaagaugaagaaaguagaugaaaaaaguaccuuuucaccagagaacuaaaaacuacuuuaaaaaucagauaagcauucuagaacuuaaaaguacaguaaugaaaacucauugaauggguuuaauaacagauugaacagagcacagcccagaauuggugaacuagaaaaauauacagacagaaccacagagaaaauaagggaguguggggauugauaagagcauaagaaacgugauggaaaaacuccaaagaucuaacauacauauaauuagggucugggagauagagaaguaacagaaucgggcagaagugauauuugaagaaaugggcuagaauguuccaaaauggaugaaagguagccuacagauucuagaagcucagcagaccccaagcagaauagguacaaugaaaagcacaucuaggaaaauuaaaagcuuaagagccaggaggaaaaauauuauuucuguaucaguuaccuauuguuacaaacaaacaaauggcuguuuacuauuacagaacuuaacagccacuuauuuguuuguaauucugcugucugggcugggcucagccgggcacuucuucugcugaucucacgugaagucacuuauguugcuggggcuacacacacaagagcucuugacucucauguuuggugccucuggggaagccuggaagagugggagcuguccaggcuccaucucuacauggucucuuaaguaccaugugaucccuccaaguccaucuggucucuccagcuccccauggucucucuggcacaguaauaagcacgugaugggucagggcuucagaagggugaaaaacagaaucugccuggcuucucaaagccuagaaacucauagagcaucauuucaacugcauucuuguuggucagagccagucaucacaaagccagcugagauucaaggaaacagauagaacuucacuucuugauaagacaugggugaagaggagggcagauagaauuuuagggcaucucucauuugccugagucuuccuacuggcucacauugcuuaaauuccuccgacaugcaaaaugacacccaccccaagaaccccacagucccauccaauuauggcaucaggcucagagucuacuuguguacaguaguucccccucaacugugguuucgcuuuccacaguuuucaguuacccacagucaacugagguucaaaaauagaugaguacaguauuaauaagacauuuugagguagagaaagaugcagaccacauccacacaacuucuauuacaguguauuauuuuaauuguucuguuuuauuauuauuaaucucuuacugugucuaauuuauaaauuaaacuuuaucauggguauguauauaggaaaaaauaauaguuuguauaagguucgaauaguuuguauaagguucgguacuauccacaguuucaggcauacaccgggggucuuggaacauauuccccucagauaagagagaauuccuguguauggaagagacuccucagauacagcuucucuucaacuguaaaccuaugaauuaaaaaaaaguuauugguccuauccacccccgcacauacaaccuacauuguuauggcaaggauacgaugucacaugaauugacuaaguuuacaagagaggaaauugaaggcauguagcaaucccauggcaguugugaaauccaucugccuauaugucaccaauucccccaauuccagggguagggaacauuugauuagucuacuuugguucucugaaguuggcucccuuuucuuuuucucaguucuugacuuuuuucuuugagcugucuuuccuuuuccaugagaaauguccucuuuuuguagcuuucucagccugcuucuaggcucugucccaacuggcacaguuauccacacuggcacaacuucuuuaaaaagcuuuguggacuuucaaauuauaaaccacucacuccaccagagagaagccacacccacaaauuucuucaagaaguccucuauguacuuugaaugucaaucagggaaugauacccuuuagagucauauaugucuuuugucuaccugagagcgucagcuagacacuggcuuaaaucuuucugaaguacagguggucguccacuuaugaugguucaacuuagaauucuuuuacuuuaggaugguaugaaagcuauaugcauucaguagcaaccauacuucaaguacccauacaaccauucuauuuuuuacauucaguacaguauucaguaaaucaugaaauauucagcacuucauuauaaaauaggcuuuguguuagauuacuuuguucaauauaacauaaugcaaguguucugagcacauuuaagcaaugacagguuaagcuaugauguaugguagguuacguguacuauucaacuuaauauuuucagcuuacgauggguuuaucaagacauaaccccauuguaagucagggagcaucuguaguaguaacaagguuguauugcaugugcuuuauuuuaucuugauccucagaccauaaucuuacaguuaacacccuggauuuuuuuuuuuuuaacuucagaaccuuuugcugaagaagcugguaacgagaaaguuuuauuuuguaacccugcaagucccagguugaaaguauuuuccucuaaauucugcuugaaacugagcaguuccuuguuuaguucuucucucuuuuaauaccuuucuacagguguuuuuugaaaaauugcuuaucacuuucagcauuuuuccuggaaaccuuagccagaucuauaacuucaauagguacuuuuucuaucuuccaagauacugucucacuuguuuugucaguagauuacauggcuucuguccagccugaaauaccaauuuccucagugguuuuccagccuccguuaguagucucuuugcugcucuuccaccaaaugucuauaacccaguccccaaacuagugcuacaugucuuaaguuucugucauggcaaugcccuguuuaaauaccaaauacuauuucaguuaucuuuuucugccuaacaaaucaccccaaaauuuacuaccuuaaaacaaaacuauucuuugcuuaagauucuacugucugaacuggacucagcugggcauuucuucuggucucaccuggagucauuuaugcaacugcagacauguggggacuccaccaaagauggcuuuacucaaaugucuggggccucaacugggguggcugcauuagcucuggcacagcugcaguucccucuccagcaggguccugggccauuucacaugaugacugagggcuccaagagggugaaagcagaagcaucugggcuaggccucuuagagccugugcauaaaacugaaacagcacuacuucauccaugcugccuuucaaagcaagucccggggccugcucaaaauuacaggcagggaaaauauccucuaccugaugguagugacaaagaauaugugucccaucguuaauucaccaguugccuucacaguugcaacaaugagacuguuagcuuuuaaacagaaaugauaaaaacuagaagccggccgggcgcgguggcucacgccuguaaucccagcacuuugggaggccgaggcggguggaucaggaggucaggagauugagaccguccuggcuaacaaggugaaaccccgccucuacuaaaaauacaaaaaauuagccgggcgcaguggcgggcgccuguagucccggcuacucgggaggcugaggcaggagaauggcgugaacccgggaagcggagcuugcagugagccgagauugcgccacugcaguccgcaguccggccugggcgacagagcgaaacuccgucucaaaaaaaaaaaaaaaaaaaaaaaaaacuagaagccauuguaacaacauguuuaaagugcuagaauaagaaaacugcaggcuuagaauucuaaaccagccaaaauguucuuaaaagauuaaggcaaaacaaauauguguucaaacaaacaaaaacagagacaauuuggcaccaguaggccugcacugaaaaaguaaaggaaguuuaucaggaaaauaauccaagauagaaauauggacuuggaagaaagaaugaagaacacugggaaacauauguaaaugaauaguaacuguacaaaauaauaaugguacacccugaggaguuucaauuuuauguacuguauaucuaaaauucaugguagcaauaacuuaaaugaugagagggaagcaaauagaguuuaaaaguccuaaggcuuaauugguaucagccaaguaguaaaaguaauaauuugcauuggccuuaauaaguaaaaaagcauguuuuaaacucuaggcuaacaacuaaaaauuauuuuuaaauguaacuuaauagaaggaaaauggaaucauguagaacauuugauuaauccaaaggaagucaagggaagauaaagguacauaaaaguagagcacaaauaguacaauggcgaauauagacccaagcacaucaguaguuacauggaggaagacuguguaacuuaagaauuaaauguaggcuagauuaaaaaaaaaaaaaaaacggcuauauaacuauacccuugucagaaaaaguaaacuuuauaauaagaagcauuacuggaguuaaaguggaauauuuuauaacacuaaagggaucuguggcaggcugaauagugccccccuacaaagauauccacguucuaaucccuggaaccugugaaaacuauauacauacacaguauggaaagaagaggacuuugcagauaaaauugaggaucuggagauggagcgauuauccuggauuauccaguuggguccuaaagccaaucacauguauucuuauaaagaaggagacagagacuuaauccugaagaguagaaggcugugugacaauagaggcagaguuaugcagccacaagccaaggaaugccagcagccacgagaaaccagaagagggaaguaacagauucucuagauccucugaagggagcacagcccugcugacacauugacuuugacccaaugauauugauuuuggaccuccugccuuaagagcugugaaggaauagauuuuuauuguuuuaaaccaccaaguauguguuaauuugucacaguagcuauaggaaaguaauauagauuuaauucacaagguagguauguucuguaaacuguaugcaccaaagaacauaaucuaaaauauauaagguaaacauugacauaacuggcagaagaaauagacauauucccaaucaaaguagauuugaauaaaauuauaauaacugauagcaguuauuauuguagcagaccaaaaacaccacaauuacaaacugaaccuagcugccauauguaagcacugaauccagcagugacaaaauucuuuuuuuuuuuugagacagagucucacucuauugcccaggcugaagugcaguggugcuaucuuggcucacugcaaccucugccucccagguucaagugauucuccugccucagccucccaaguagcugggacuacaggcgugcgccaccacacccaggaauuuuuguauguuuuaauagagacgggguuucaccauauuggccaggcuggucucaaacuccugaccucaugauccacccgccucagccucacaaauugcugggauuacagcuguaagccaccgugcccggcccaaaauucauucuuuuacaugcacaaggaaggaacauuuaucauaugugaacacuuaacauaugacugagccauaaaaaaggccuuaacaaauuuccaaagauuuaaauuucuuagcauggaaauggauauugaccaauacagauuaagccagaaaucauacaaaauaaaaauagcuuacaaaauaaaaauagcauacaaaauaaaaauaucauacaaaaauaaauagcuuucauauauacaauuuaaaaaaacagaaguuguaagagaauuuuaaaagaaaauaccuuaggcaauuuuuuuuuuaaucuccaaaauuuaaaacucuucugaaaaauacaaaacuaggcuugaacaaauggaaagacuuaaccauguucuugcaugugaagucucagcaucauauaauaucaguucucuuaaguuaguuugucauuuuaaugcaauaacaauaaaaaugccauguuauuuucuggugccaggcaagcuauuaauaauuguuuaaguuuaucucaaagaagaaacaaucaagaauaauuagagaaacugaaaaaaagaacagugggagaagaggaggauuuaaccuagaagacauuaaacauacaugaagccuuuaauuaauguaguuugauauugcugcaugaaugcacaaaccaaugggaaagaauaaaagacuaauugcauauggcaauuucgaauacuguaaaggcagcaucucaucagugaaaggaaauguauguuuuaaugcuaaauaggggaaaagauaaaauuauauccauuccacggggcgugguggcuccugccuauaaucccagcacuuugggaggcugaggcggguggaucaccugaggucaggaguucaagaccagccuggccaacaugaugaaacuccaucuguacuaaaaauacaaaaaaaaauuagcugggcgugguggugcacgccuguaaugccggguacucgggaggguggggcagaagaaucgcuugaaccugggaggcagagguugcagugagcugagaucaugcugcugcacuccagcuugggcgauagagugagacuccaucucaaaaaaaaaaaaaaaauuacauccauuccuucuacuacacaccaagauaaauuuuaaguggaucagagauuaaaauaaauguaacaaaaugacuucauacaaguacaaauaaaaugcaugggaauuucccuguaacuuggauguagggaaaauuuccuaauagacucaaaauucauacacacuaaggaaaaagaugaauaacuaacuuuuuuuaaaaaaacuugcauuucaaacaggcgcaaugaacaaaaugaaaagcugggaacaguauuuucaaauuauauuacagauaaagggauuuuaaaccuaauuucuaaggagcuuuuacagggaaggaagaaggucaacaaucuuagaaaaauggacuagaugcagcagaaaagaaaaugaaagcagaaaauuauggaaaauugucaaacggaauuauaaagaggaaaaaaauggaaaugcaagcuuuuuuuuuuaaagagagaaugaucugcuacaauacaggaggcugaucugggcagagaaaccaacagccuuuaaaagucaugcagggcuagagaaauaagauuggauacuagaaaggcuaagguccugcugagaagggaaggacagagaugugagccuaguacccuucacaauacauuggcaaauucugaagcuacaaagcacaagagaccagaaagccaaguagaaagcuaugaaaaaccauuuuuaggaagcuaguauuagaguucaagacccagcagugaggacaagaggcuuuuggugacugucuggggauuucauuuggaaagucuggagauuggugccuuuuaagaagggacaaaacuaaggguaagugaacuuugguucuaggaauggcaagaccagcaagaagaucaccauugccaacuguagccuuuacacaaugucauagcagcccaaauucagucagcuauugaauuaaguuuauugucuacuugccaagcuaaagaauguaugaaugcugucuuuagaagauaacaucauauggagguucuacaacuucuuagacacaaugucaagcuuuuaguaaaauuauacuagacauucaagagaugggauugaaaaccaagagaaagggcagacaauagaaauauacucacagaugauucaggcaguggaguuaagaccaggacuugaaauaacaaugauaauuguucaagaaaauagaagacagggagaaaauaaauaaaagggaaauuuccccccagauaauuggaacuugugggggauaaaaagaaucaaauggauauucuagagcugagaauugcaauaacugaaauuaagaacucaauugauggguauaaaaucaaauuagacaauggcgagcccaaaaauaaacccucauguauauaaucaaauaauuuuccacacggguaccaagaccauucaauggggaaaagauggucucuucaaaaagugguguuagggaaacuguauauucauaugcaaaagaaugaaguuggacccuuaccuuauaucauaggcaaaaguuaacucaaaaugguccaaagaccuaaguguaagaccuaaaacuguacaacucuuggaagaaaacagaggaaaaaagcauuaagacaauauauguauuucuuggauaugacaccaaaagcacaggcaacaaauguaaaaauagacaaaguggacuauauuaaaguuuaaaacuucugggcaucagaggacacaauuaacagagugaaaagacagccuacagacuaggagaaaauauuugcaagucauacaucuaauaaaggguuaauauuuccaaauuauauaaacaacuuguacaaauuaaaaacaaaauaacccaauuaaaaaauauacaaaggacuugaauggucauuucuccaaagaugauaugcaaacagccaacaagcauaugcaaauaugcucaauaccacaaaucaucaggaaaaugcaaaucaaaccacaacgagauaucaugucacaccaauuaggauggccacuauuaaaaacauaaaauuaauaagcauuggcaaggauguagaaauuagaacaccugugcacuguuggugggaauauaaaaugaugcagcuggcuuugcagacacugcugucccccaacacccccugucacuaggccauggucaucccgacugugcccuucaacaucaccaucaacagcaagcccuuaggacacaucuccuuucagcuauuugcagacaaauuuccaaagacaggagaaaacuuucacacucugaacaauaaagacaaaggauuugguuccugcuuucacagaauuauuccggaguuuauaugccagggugaugacuucacaccccauaauggcauugguggcaaguccaucuacggggauaaauuugaugauaagaacuuuauugugaagcauacaggucuuggcaucuuguccauggcaaaugcugcacccaaaacaaaugagucccaguuuuucaucugcacugccauggccaaauggugggauggcaagcaugugaucuuuggcagggugaaagagggcaugaauauuguggaagccauggaaugcuuuggguccaggaauggcaagacaagcaagaucgccauugccaacugcagacaacucugauaaauuugacuuguguuuuaucuuaaccaccagaccuuuccuuuuguagcucaggagagcaccguuccaccccauucgcucacaauauccuauaauauuugugcucucacugcaguucuuugaguucuauauuuucauuaugucccuccacguauagcuggauugcagaguuaaguuuaugauuaugaaauaaaaacuaacaaaaaaaaaugaugcagccacuauggaaaacaguaucacaguuucucaaauaauuaaacauugaauuacuauaugauucagcaguuccacuccuggauauauauccaaaagaauugaaagcagaauuccaaagaaauauuugcacauccauguucauagcuauaccauucacaguagccaagagguggaagccaucugugugcccauccacagaugaauggauaaacaaaauaugggauauacacacuaugaauacagccuuaaaaaggaaggaaauuccaacacaugcuacaacauggaggaaucuugaggaauuaacgguaagugaaauaagccagucacaaaaaggccaauacugaaugauuccacuuaugugagguaucuagaguagucauauucauagagacagaaaauagaaugauuguugccagcaacugggaggaagggggugugaaaaguuguuuaauggauauugaguuuguuuucccagacgaagaaguucugaagguugguuacaugaugugaauauacuaaacacuacugaacuguguacuuagaaugguuaagauaaauuuuaugcguuuucacuacaauaacaaguagaacaguagaacagaugauuagucacagcagaaaagaugaaagauaggucaaaacagguuauuagaaaauauccaaacugaagaugaagaagaaaaucauuuuuaguagaaaauauccaaacugauauauaaagacauaaaggaauuuguggaggcagaggggagauaaggcaauaaaggacaugugggacacauccaaaaaaaaaaaaaauccaacauacagaaucccaggagaagaggagagagaacaaggcaggagcaagguuugaagagguaauggcucagaauuuauuuccuaagaauuaugaaagacauuauuucacagacucaaagugugugauccacagauuuaaauacaaagaagccuuacuagaauaucauagcaaauugccaaaaacaaaagacagagaauagaaucuuaaaagauagagaaaagaacucacuuucaaauguccaagacugacagcugacuucucagcaggagcaauggaaccagaagacaacaaagugacauuucaauugcuggaagaaaacagcaccaaccuagaccucuguacccugcaaauauccuuuaaaaaugaagcaaauaaaguaaucauuauguauguuauuggcaaaaugauagaccaauagaacaguggaacaaaagagagaggccaagaauaaaccuuuacauagauggucaaaugauuuucucaaagggcacgacagcauuugaaugaaguaaaaucucuguaauaaguaugucuggaaugcauggauaugcauauagaagaaaaaacccauaccucacaucauccagaaaaaucaacuugagauaaauuauagacauaaaaguaaagcuaaagcaauaaagcuaccagagcaaaacauaagauguucucuuuaaguucuugguguaggcagagacuucuuagaaaacaugaacuauacaagaaaaaaaaauugguaaguuggacuucauuaaaauuucucagcugggcaugguggcugacaccuccaaucccaucaccuugggaggccaaaacagaaggauuacuugaagccaggaguucaagaccaaccagggcaacauagcaagaccccaucucuacaaaaaauuuaaaaaucagccagcaacgccuguaguccuagcuacacaggaggcugaguugggaggauugcuugagcccaggacuuugaggauguaaugagcuaugauugugccacugcacuccagcuuaaaaaaaaauaaaauguaucuucaacagacacuuaagaaaauagacacagacuuaaagaaaauauucacaauacguauauaugauggacuugaguucaaaauauauaaagaacuacaauuuaguaauuuuuaaaaagacaacgcaauuuuuuaaaggugaguuuugugaauagauguuucacaaaacacaauauauguguaguaauuacauuuuaaaaguacccaguguauuagucaucuagaaaugaaaaacaaaaccccagugaaauaccaguucauacccuguagaagggcuagacagugaaaaagacugauaaugacaaauguuggagaggauguggagcaacuggaacccucauauguugcuagugggaguagaaaauaauaugauuauuuuggaaaacaguuugucaguuuauuaaagaguuacauauauauacaugacccaguaauuuugcugcuagaaauguaucaaagagacaugaaaacauaugaccacaaaauacuuggaaaaaaaauauuuacagcagcuuuauucauaauagccaauaaaacugguaacagugaggugcccaucaauagaagaauagguaaacaguggucuauugagaugguggauacuguucagcaaaaaagaaccaacauccacaacauugacgaaucucaauauuauucucacaaaagaaguugguaacaaaaaaaugcauaguuaagauucuaacuauaugaaauuccagaauagggggaaauaacauauagggauagaaaucagaucagugauuacuucgugggggaagguauugacuggaauaccgcaugaaagaacuuucuggaguguuggauauuucugugucuuuguuacuuaauugucgaaagugaauguuacacuuaggaucugagcauuuguuuauguaaguuauaccucacuuuuuaaaaaugaaaguuaaauaaagauuuuagaccacuaaaagcuggaagaugcuuuuaccaacagauuguacuaaaaaaucaguaaaggauuuuuucaggcagaaggaaaacuaucccacauggaggcucagaaauauaggaaagaacaaaaagccacagaaaggguaaauguucgaggagacagagaaaugaggauggcuuuacaaaauauggacgguaacaucuuccaaaguaaaaauguaugacaacaauaauaaaacaauaaaaggcagaugggaacugaaauaaaaaugaaauaucauugauaauaaaacaauaaaaggcagaagggaacuguacugaccacguuagauaguccuaggaccaguuagacauuucacauucaugccgcugcagcagcaucagagguauaccuccagagugagcccucacauaguucgcaccuuaguccaggggccauucucugcccacccgcauuuucugccaagugucaguucagauagaagggaacaaaucaauuuauuaauugugggaacuacccuaguuuagauacccuaaguuccaauaaagaaucaauaucuuuuguaauagccucaugagcauagaguccuggagagggacauggcuuggcuauaagaaccgugacacucagaagcucaaagcuguggcuuuucaucagguauuuguaguuuauuuacaaucaucucaguccagauagguuuaccaaccaguguuauuuuuuaccauauguuaccuguaacagauauuagauauuuagggaaauaaagcuagaaguuucauccaacauuguuuuccauuuuaggcucacggacggacuuccacgaccuugaguuaaaacuuuaggguagauaggaauuaccuggaggccuuguuaaaacacaaauuguuggugcccuaugacuuacuuccuagcucaguagcuuuagggugaggcuugagaauuuacauaucuaauaaguucccaggugauacugggugauacugcugaccugaggaccccacguuaaaaccaaugccuuauucaauggcagugauaacaaaguaaaagugccccuuuccuguuuacuaaaggguccccauguucuuuuagcuucagccuuuaaaauacuagucauuauuuauuauuucuucaaaagcccaucucuaauugucuccuuagggaguuuuugaguucacauugacauuaauugucacuaacugucagcaguuggcauuaaccagacucuauuuuaggauuaaauccaccugauccaccugcacuaucagaacauucaggacgcgacucaggcugcagcucagagggcuccaccgguggcccuagacuugcaucaagcugcugccauugccacugcaccagcuuguaugccagguuaccacauaguccuauguaaccaugugggcugcuguagaguaauuccccuacuuuugucccccacuuccucagguagaggcucguagacauuacauuggaugagcaggcagcucagcuuggucagagccagccgucugcuccacccacuuuguccuaucacagacccagucgcagacauaaauucucaagcucaugugcuugucuccuucccacccccagcccgucaucaaugccuaguuuggccuaaugcaucagcugcaccaaggcaaaaucauuuuugccaaccagcccagcugcaguuugguuucuggucaaguccaauuuauggacagcggagaggaguggacagcuucucucagcauaaguuugucuccagcuuucaucccuucccacgggggaagauuucgaagccaaaagguuaacaugagaucaacuucccaugaguauucacggauaaagugcuagguuuuagcauuaucaagaaaguaaugaaauuaaaguaauaauacguauuuucaguguguaauagguugaagaugcaaguugcaaucucuaggcuaaccacuuaagagcaaaacauguauaauuaaaggaaaaggaguaauaaacauuugaucaauuuuuaaaaagagacaaaggaggacaaaaggaaugugugaaauggaaggcaaauaguaaaaugacagauaaaccuaauauaucaguaagcagaauaaauauaaaaggacuaaguacuucagguacuggaguacugacauuaucaacuggguuuucaaauaugaaccaaauugugugcuuuuaaauauaaaauauacaacaguuaaaauuaaacaaauuuuaaaaagauauaucagccaggcacaguggaucaugccuguaaucccagcauuuugggaggcuaagacaggaggauugcuugagaccaggaguuugagaauagccugaacaacagagaccaucucuacuaaaaaaagcaaacaaaccaaccuagccaagcauaguagcauaccuacucuggaggcugaggcaggagaauccugagccuaggaguuugaggcugcagugagcuaugauuguaccauuucccuccagccugggugacaaagugagacccuguuucagaaaagaaaaaagauauaucaugcaaauacaaguaaaaaggaaguugguguaguuauacuaauaucagauaauauggaauuuaagguaagaagcauuacuacaguuaaagacagacauuucauaaugauaaaaugaucacuagggauauagaaaguuguaaauuuauauguaacuaauagcauaguuuuaaguucuauaacaaauauuaaacauaaaucugcagucuuaguggaauuuuacauaccucucaauaggugauagaauuaagcagacaaaaaaaucaguaaaaauauaaaucaucuuacuaaaaagcaaacuugaccuaacugauauuucuauaauguugauaucaacugugacaaacuacucauuuuuaaaaagccacauggaacauuuaccaucuugaucauaaccugagucauaaauuaagccucaguuaaauuuuaacacauuuaaaucauuuacaguauguguucucaccauaguggaauuaagcuaaaaaaaaaaaaaaaaagaucagaaacaaaagaagagauaguaaaucuccagucugggugcgguggcucaagcuuguaaucccagcacuuugggaggccaagaccugcagaucaccugaggucaggagaucgagaccagccuggccaacaugaugaaaccccaucucuacuaaaaauacaaaaauuaaccaugugcgguggugcgugccuguaaucccagcuacuugggaggcugaggcaggagaauugcuugaaccugggaagcagagguugcagugagcugugaucacuccacugcacuccagccugagcgacagggcgagacuccaucuaaaaaaaaaaaaagaaagaaaaucuucaccuguuuugguaacauuaagcacuacaccucuaaauaauccaugggucaaugaaaaaagcacaaagggaauuagaaaauauuuugaaaugaaugauacaguguaaaagauaugguauaucagcacaugugggaugcaguuaaagcaauacuugagggaaguuuguauccuaaauggauauauuaguuuaaaacagaaaggggagaggagaugaacgucagugaucuaugcuucuaucucaaaaagcuagaaaaagaacaaaucaaaaccacacuacauugagauauuuuucacccaucacacuggcaaaaauucagaaguuuuauaagacuaaaaccucuuagacuguggggaaacacacugccauacauugcuaaugaaaaugugaaaugggccgggcacaguagcucacgccuguaaucuuaccacuuugggaagccaaggcagguggaucacuugaggucaggaguucuaaaccagccuggcuaacauggugaaaccccaucuucauuaaaaauaaaaaaauaaaaauaauuagcuaggcuugguggcaagcaccuguaaucccagcuacuugagaggcugaggcaggagaaucacuugaacugggaggcggagguuucagugagccaagauugcaccccugcacuucagccugggcaacagaaugagacucugucucaaaaaaaaaaaaaaaaagaaagaaagaaauggaugaccuuuacagggaagaaacugacuauaucuagcaaaauuauacauucauuuacccuuuuagccagcaauucuacuuuuaguaacuauucccaaaaaugcauuggcaaaaacauuaaaacaaaaauacuuuugaaugaggcuguuuauuguaaccugauuuguagcaaauuggaaacaacccaaaugcccagcaguagcggagugauuaaaugaaaaguucccuguggauguacauuaugugugaacauccacacaguggaggcuuccacacaguggaggcuucugcagcugucaaaaagaacaaggaccauuucaguggaauaaaaucuccaggauaucaaguggaggagaaaaaguggaaaaaaauaauaucuuaggauacuauuuaucuuuuuuaaaaaauggcaagggaagaguggauauauguagagaaaaagauauuuuaaaaugaaagacuaaaucuuaaaaauauuuuuaaaugguuuuccauagaggaaagaaaaugggguggagaggacaaggaaugaagcuagguuccuugaaucuacauuauuuuuucaauuugacuuugaaaccaaguaaauauuuugcacaauuacacaaaauuuuuaauaaagcaguuucuacuuaaaauuaaaugagccuauguauucaguugguagcauaaccauaccaaggggaauuaucaagaggaauuauuccaaaugacuuuaaaacacaauuacaguugacccuugaacagcauggaaguuaggggugccaacucccuacacaguuuaaaauccacauauaacuuuugacuccucaaaaacuuaacuacuaauagcccacuauugacuggcagccuuaugauaacauaaacaguugguuaauacauauuuuauauauguauuuuauauuguauucuuauaaucuauagaaaagaaaauguuaagaaaaucacaaggaagagaaaauauauuuacuguucauuaaguggaaguggaucaucuugaaggucuucauucucaccaucuucauguuaaguaggcugaggaguaggaacggaagaagagggguuggucuugcuguuucagggguauuagaggcacaagaagugaaggagauggaaggggaggcaggagaggcaagcacgcuuggucuuuuauugaaaaaaauccguguguaagugaaccugcacuguucaaaccuguguuguucaagggucaacuguauuugacuauacaucccuaaugagauuuacccuaagaaccaaaggaaaccuuguacagauugauuauccuuuauccaagaugcuugggaccagaagugcuuugaauuucagaugggguuuuuuuuugaacuuaagagagaugauuuaggguaucugguggaagaaauuucuaagcagcaaagcauucaagaggugacuugggugcuguuaaaggcauucaguuuuauaaggaaagcagucgcccaggcuaaaggugcaguggcgugaucaccacucacuacagccucaaccucccagguuaaagcaauccuuccaccucagccucccaagcagcugggacuacaggcaugugccaccaugcccagcuaauuuuuaaauuuuuuaaauagagacaaggucuucccuguguugcccagguuccuggacucaagcaguccacccaccuccaccuccaaaagugcugggauuacagaugugagccaccacaccuggccucaauuucagauauuucuggauuuuugaauauuugcauuauucugcuugagcauuccaaaucugaaaguccaaaauguuccaaugagcauuucaguuaucacguuggugcucaaaaaguuugggauuuuggagcauaucaaauuugggauuuucagauuagguauacucaaccuguacuauuuucaauaauguuguuaaugauauugauaguguucuucugagauucuaaguguauguauugugaaaugaaugaguucuuuuuugguguugagaacuagaauuuuugguagagaugaaaggagauacagaugugagaaugauggcguuaacaccugugguccugaauuggaaauauugguacaaauucugauguguuuuaucaguuuuaaaauacaaaguuccuagcuuuauuugcugaaaaaacuagagguaaugacagauccaguacuaauaagcaccuuuagucucuagauuguggacuuuagcuuccauuuuaguggaaagugguaccuaaaggucacaaucuaggugaaccaguuuuccuuggagaaauagcuucuaccaaguauuugaaccaguauucuuuggagaaaaagcuucuaccaagucugggaaagcaaggaagcucgcaaugacaacagguuguaucaaaagaauuuggaaugaacuugaauaagcucccauuggccaaacauaagacaguuugagcaacaggaggauaauaacugcaaugaaugaaaugcaucaccuacaauuaaacuacugaauuugcagugauaauugugccuuggagaaugcaugguguauucguucguuuucuugcugcugauaaagacauaccugaaacugggagcaaaaagagguuuaauuggacuuuccguacaucuucugaaaucuagguggagguucccaaacuucaauucuugacuucugugcacccacaggcucaacaccacauggaagcuuccaaggcuuggggcuuccacccucugaagccacagcccaagcuguauguuggccucuuucagccauggcuggagcagcugggacggaaggcaccaagucucuaggcugcacgcagcacggggacccugggcccagcccacaaaaccacuuuuuccuccugggccucugggccugugaugggaggggcugccgugaaguucucugauguggccuggagacaucuuccccauggucucagggauuaacauuagacuccuugcuacuuaugcagauuucugcagcuggcuugaauuucuccccagaaaauggguuuuucuuuucuaucgcauagucaggcugcaaauuuucuaaacuuuuauguucugcuuccccuauaaaacugaaugccuuuaacagcacccaagucaccucuuaaaugcuuugcugcuuaggaauuucuuccaccagauacccuaaaucaucucucucaaguucaaaguuccacaaaucucuaggacaggggcaaaaugccaccagucucuuugcuaaaacauaacaagagucaccuuugcuccaguucccaacaaguuccccaucugcaucugagaccaccucagccugaauuuuauuguccauauugcuaucagcauuuuuggcaaagcuacuccacaagucucuaggaaguuccagacuuucccacauuuuccugucuucuucugagcccuucaaacuguucuaaucucugccuguuacucaguuccaaagucacuuccacauuuucagguaucuuuucagcagugccccacucugcuaguaccaauuuacuguauuagcuuguuuucaugcuacugauaaagacauacccaaaaccaggaacaaaaagguuuaauuggucuuacaguuccacauggcuggggaggccucagaaucauggcaggaggcaaaagauacuucuuacauggugguggcaagagaaaaaugaggaagaagcaaaagcagaaaccccugauaaacccaucagaucucaugagacuuauucacuaucacgagaauagcaugggaaagaccggcccccaugauucaauuacuuccuccuggguccuucccacaacacgugggaauucugggaaauacaauucgagauguggguggggacacagccaaaccauaucacaugggaauaguuuuuuuucaauguagauauaauuaaaaguaaaaagcauguguccuuccuuuucuaaauuaauuuuuuuugggggauaagcaauugaugagggaaagucucucuaggaauauuacgauuaauaaacugaaagugauaauaacaucaguauauuacaguuuuguagcccuuaaugaauaucagcagugaucaucacuugcugcuaacaucugagacacccagacaguauguguguaucauuagaaguacacaccuauaaaguaguuuugucccacucuucccccaaaaguuaaaucuaaaccagucacuucuguaauuacaauuugugagaaauaacagggaacaaaggagcauguuaaaugguaccaugaggaugcaauaucagagucuaaugcuggaaaccaacaggacagauaacccuauuucuucuacaaaaauaaauuuguaaagaaaaaacuaaugaagauggaccccagagaucacaacagauuuaaggagaaagcagccaauuaaaauguauggcgcucauuuagauugugauucaaacuguaaaagcaaaaugaaacuucuguaagacacuugggguacauaggaacaaccaacugaauacuugaugauauuaaagaaucauuuucacuucuuuaggcauaauguacauaagcuuauguucuaaacaugaguuuuuaucuuuuagaggcacacacuaaagaauuuacccaugaaauuguaugaaaucuggaauuugcuucacauuaacauggaugaggguauagaugaaacaacauggccaugaguugauaaguguugaagcugaaugaugagcacaugaggguucauuauauuguuuuauuuauuuauuuauguaauuuaaagugacagggucuccaucugucacccaggcgagagugcagugacacagucuuagcucgcugcagccucaaacuccugugcucaagugauucuccugccucauccucccugccccaucccgcaacccccaaaguaguuaggacgacaggcacggaccaugccaagcuaauuuuuaaauuuuuuucauaaaaauguagucucgcuauguugcccagacuggucucaaacuccuggccucaagcaauccucccaccuuggcuucccaaauuacugagauaacaaggugugagccaccgcacccagccaggagugcagcuuuuaaaagaguaguuccaggccgggcgugguggcucacgccuguauucccagugcuuugggaggcugaagcagguggaucaccaagucaggaguucgagacuagccuggucaacauggugaaacccugucucuacuaagaauacaaaaaauuagcaaggugugauggcucacaccuguaaucccagcuacucuggaggcugaggcaggagaauagcuugaacccgggaggcagagguugcagugagccaagaucacgccacugcacuccagccugggugacagagcgagacuccaucucaaaaaaagaaaaaaaaaaguuccuuuauuuuuguauauacuugaaauuuuucauuauaaaacauuuaaaugaugugauuacaaagaugagaaacaaauagcaucagaaaugaguagguaaauuuaaaaagcaaauuagccaucuuaaacuaaaauaaauuguguaagucagauauucaguugauggguuacaugaauuagacauaauuaaauagugaauugcaagcuuuguaaaaaauuuaccugaaauauuauagagacaaggagacaaaugaaucaacagacuuaggaaguaccauguauuccaagcuggaaaaguaaaaagaaauccauaccuacauacauuauaguagaacuacaaaauagcaaaggcaaagguaucuuaaagcauccauuucagucaggguacugucaggaaaacagaaauaacacuagguauuucagaaaagcaaauuugauuuagagaauugaugacguuguagagggcugaaagagaaaaaggaaacaaggaaguaaacuaaagauaacuguagggaacagcucccaccucuagguguggaaaagggcagcaagugauuaggguuuucagaauuuagaaguuuacaggagaaacugaggagcuggagcucuugcuuccacagagagggacagccuuguggcagaagggugcagugagccugggucugggagugcuuaaagaaccuggagacuagagugcuguugcuggaauaacacugacaggagcagcaugcaaauaggaagaaagaagucccuucucccucuugccuuccaaucuucuagugcacauguuugcugaaccuaacaagaagccuguuaacaaaggagaaaugugguuugcagagugccagcaguuaucgcaaagcagauuuggaccugaaagacaauagcucaauaaguaucacaguagccauguauucauucacucauucauuuauucauucauucagcaaaugguuaguagaagcuuacuauaugccauuuacuuuuuaaaugguugggauaaaucagugaaaaacaacucaaaagaucucugcccucauggagacagaaagaaaggacagaucaccuacaaggaaugauggcuaaaaugacaaccuauuuaauagccacuauuaaggccagaugaauugugaaaggauaccagacccccuagaauugugugaccuacaaugaagaaagaauaaagauauuuaaagauaagcaaagagcuagaaaaauuuacuaccaagagugccguucuaaagaaaauuuuuuauaugauggcugcagaagaauuaucugagacccaagaagauuugcuaagcaaauaaaaugacaaaaugcuaagcaaauaagauacaaacccaaacauuguggaaaauaauaauuugugggauuuuaaaagaaaugacugaaauacuguacaaaguagaacguauauuuaagagugggaugaucagaucuuagguuuucaaaagcccuuuuauuaugcaggagaagagaguuauaauacauuguuuagacuuuguuaaauuuuuacaguaaaauuuaaggguaucauuaaaagaauacacaaaucuaaaaccugugaggauaaaauaaugaaguaagaagaggaugagccaaaaaaaaucaauacaagaaaaugcaaaaaaaaaaaaaagcauucaagaaucuggacaaauauaaaaugaucuauaauacagcagugacaauaaugugaaaucagaaaacuuuuaaaggaacugcauauuuuuaugacuacaucuaaaacaaaaaaguuggaaaagaaauaccagguacaaacuaauaaaaaggagguaguaggcauaguuauauuaauuaccugaaaaacauauauuucaaaacaauaauuauuaggaguagagagaaugacuacauaaugauaaaauguuucauucaccagaaagauauaccaguucuaaacuuacacauauucaguaaaauacccucaaaauauguaaagcaaacaaaagaaagauagauguacaguuagaaauugcaaaucugucaacauaaacacucuucuccauuaugcauaagucagucaguuuguaccuguguuuauguucaugagggauauuggucugugguuuuuuuuauuauguuuuugugaaguuuugguaucaggauaauaaugaccuuguuuaaugaguuggagguguuuccuucacuuuaguuuucugaaaaagucuguagagaauuccuuaauauuugauagaauuugccagugaagccaucugguccuagaguucucuuugugggagguuuuuaauuauagcucuaauaucuuuaauagaucuagggcuauucaaauuaucucuuucuucucuggugaucuuugguaauugugucuuucaagggauuuguuuauuucaucuaaauuguuuauuggcagaaaguucuucauauuauuuucuuaucauccuuuuacuaucuguaggaucuguaguaauggacccucucuuaauccugauauugguacuuuguaucuuaucucuuuuuuucugaucagacucgcuagaaguuuaugaauuuuauugauuuuuuuuguuguuggggaauagggggacagagucucgcucugucgcccaggcuggagugcaguggugcgaucucagcucagugcagccucugccuccuggguucaagugauucucgugccucagccuucugaguagcugggguuacaggcuugcaccaccaugccuggcuaauuuuuguauuuuuaguagagaugagguuucaccauguugcccaggucagucucaaacuccugagcuccagugauccacccaccucggccucccaaagugcugggauuacagccaccaugcuuggccauuuuauugaucuuaaauaaucaguuugaggauccacugacuuuccaccaucuuuuuguuuucucuuucauuuaugucugcucuuaucuuuguaauuuccuugucuuccgcuugcuuaggauuuaauuugcuuuucauuuuuuagguuuuuaauaguuuuuuuuuuuuaggcuuuuaauauaagcuuguauuauugacuugaucccugucuucuuuucuaauguagauguucaaugcuaaaaguuuccuguaaauuuaugacaaauuuaacuugucauauuuucauuuucauucaauucaaaguacuuuauaauuuuccuucuaauuuuuuugacccaugaguuauuuaggaguaugauauuuaguuuccaacuauuuggguguuuucuagauaucuuucuuuaauugauagcuaguuuaacuccauuguaguaaaugaacauacuuuguaugauuugaauucuuuucagcuuauucaagcuuguuuuaugggccagaauguggccuaucuugguuaaugcuucaugugcacuagaaaggaauauugucuucugcuuuuguuagguagagcauuuuagaaauaucaguuagguuaagcuccugauaguauuguuuauauuuucuuuacugauuuuucuggucuucuauaaguuauugagaggcuaauucaacuauauuaauaauuaugaauuugcuuguaucuuauuuuaguccuguaaguuuucgauuuguguauuucuaaguucuguuacuagauguagaaaucaaugaaauagaaaacaaagauauaauagagaagaugaacaauccaaaaguuguuucuuugaaacaaguaguaaaauaaacuuuuggcaaaauuaagauaaaaagaaaguacaaauucucaauaucaagaaaaagggcaaaacaaaacuaugguuauaucaaauuaagggauaagaaaagcauauaauugcaacuuuaugccaauaaauuugaaaacagguagacaauuucuuagaaaaauguaauguauuaaacugauucaagaacaaaaagaaaaccugaagaaucucauaauucucaaauaaauuaaguaguaaguuuuuaaaaaaucuucucacaaagauuacaacaaggucuguugauuuugcaagugugaauucuacaaacuuuugagaaauaccucauccuaauauaaacagacuuccagacauuagaauaaggaaugacauaccaguuaauuccuugagacggguauaaacuuuaaaacaaaaccagacauuaugagaaagaaaaauaauauauauuuauauauguugucauauauaauuuuuaaguuagcacuaaucucacucaugaacuuagguaucaaaaucaaaaucauaagcaaaauguuaacagacugaauccagcagcacauuucuuuaaaaagagauauaccuugaccaaauuggguuuaucccagaaauacugaaaauggucuaacucuaggaaaacgcaaaauuugagucaccaaauuaaaggaaaaaaacuaugaaaucauuucaguagauugcauuugauacaauucauacccauuuauaauguaaaacuuaguaaauuccuuaauguggugaaaauaaucaacaaaacaucuacuucaaagaugauucuuacugaggaaauaugaaaaauaauuacuugaaaucaagaaaaagaaugcagacuaucaccacuucuuuucaaccuuguacugaaacuccuagcaaguauaguaaaucaauaaaaagaaauuaggcugggcgcaguggcucacgccuguaaucccagcauuuugggaggccgaagugggcagaucacuugaaaucaggauuucaggaccagccuggucaacacagugaaaccuccucccuacuaaaaaugcaaaaauuagccaggcgugguggugcagcccuguaaucccagcuauucaggaggcugaggcagaagaaucacuugaacccaggaggcggagguugcagugagccgagauugugucacuguacuccagccugggcgagagagcgagacuccaucucaaaaaaagaaagaaauaaauuaauggcauaaguguaaagaagaaaaaacaaaaugucauucagaggugauaugauuaucuguauaguaaaccccaaagacuccacaguuuuuuagaaauaauauuuuucucaaaguggcuucccguaaacucaauaaauaaaaaguugcauuucuguacagcagcacaaaauuuaaaaguguaauuuuuaaaaauauacaucguuauaaaaauauaaaguucucaauaaaucuuacaaaaguuaucaagaccuccgugcagcaagagauaaaacuucuauuaaaaaccauuuuaaacaaucuaaauaaauagauauauaauguucauggauaagaagacacauguuauaaacaugucaguuuuccucaauuugauuuauagagucaaugcuauuauaaucaaaguaccagcaggguuuuuuuauggcacuugaaaagcaggucuuuauauggaaagguaaaucaugaagaauagaccugacacucuugaaaagaaaaauaaagugagaguugccuuacuuuuuugauaaaacaagacauuaugcuguuugcucaagcauaaauaaaaauggcuaggaagacuaaauaggaaggccagaaauagacucgaauacagggguccaacucccaggccacggauggguacuggucuguggccuguuaggaauugggcuacacagcagaaggugaguggcaggugaacuucaucucuauuuacagccacuccccaucgcucgcauuacugccugagcuguacaugcgagggaucuagguugcacggaaguuccuuaugagaaucuaaugccugaugaucugucacugucucccaucacucccagaugggaccaucuaguugcaggaaaacaagcucagggcucccacugauucuacauuauggugaguuguauaauuauuucacaguguaauaauaauagaaauaaagugcacgauaaauguaaugcacucgaaucaucccaaaaccacccccuaccccauccaugguaaauuugucuuccaugaaacuggucccuggugccaaaaagguuggggaccucugcucuaacauacagaacugugauauauuaaaaaaguaauauugaaaauuggugggaagagaagggacuauucaggaacuguacuggggcaauugcuuacuuaauuucaaucuucauaucuuacacaaaaauucaauuccacaugaauuaagggcucaaguaucaaaaacaaaauguuaaaacuuagaguaaaauguaggagaugaccuuucuggcuauggaguaaggaaaguuuucuucuuaaaggagacacaaaauaacuauaaaagaaaauguuaaugaauuaaaguauauuaaaguuuaauuguuuuaauuaaagaaaggcaggccagggagaaaacaugugcaacacauuuaaucuacaaaagauuaauauacaaaacauauaaauugaugaaaaguaauaaaauagaaaaaugcauuaaagauauuaacaggcauuucacagaagugauaugugugaugaauaaauaugagaaacaauucucaaucucacuagugaucaggaaaugcaaaguaauaccacaggaagaugccauuuuccccucaccaacaguaccuaggguuaggaaggacauggaucaagagguccuuuuaaacaaugugaaugggguuguauguuggcauggcaccuuugggaaacaauuuggcaaucucuugguuuuuuguuuuuuuuuuuuuuuuuuuugaacauaugcauaucccguggcccagaaauucuacuccuugguaucuacucuagacuauaacaggagacaaccaggaagcaaucuaaaugcccaucuacagaaaauggauaaauaccauguaguauauucaacuuaaugagcauuuaauugugcagcaaggaaacugaauaaacacaacaugaaugaaucuuagaaauauaauguugaauaaaaagccccaaguuugucaagucugcauacaauacgccauagucccccccuuauuugcagcuucauuuuccacgguuucaguuauccacagucuauuaugguccaaaaauauuaaauggaaaauuccaaaaauaaauauaaguuuuuaaguuguccaccauucugaguagcaugaugaaaccaccugcuguugggcucaguccacacgggaugugaaucaucguguagaagcucccugccugucauuaucagauugaaaaaaaauaguagauguaaaacuggaugcuauccaugguuucaggcauccaccgcgggucuuggaauguaucccuaucagguaggagggacuacuauaccauuuucauaaaguacaggaagaaguaaacuaauguauauuguugagucaaguauacauguaugucagagauagaacuauguuuaaaaggugaaauggaauaauaaagauaacauuuagaauagugugugaggauagaaugguguaagaacacguaaguaaauacaaguuccauuuuucaguaagguggucguuucuggaauauucauuguauguuuuacagcaugaauauguuuuacauaguuauauaccuaauauuuaacuauguuauauaauuauauauuuacuuggcacggugacucauucugauaauccuaacacuuugggagacugaggcaggaggaucacuuuagcccaggaguucaagaccagccuggacaacauggcaaaaucacaucucuacaaaaaauuuaaaaauuagccaagcaugguggugcaugccuguagucccagcuacucaggaggcugagguaggaggcugagacaggaggaucacuugagcccaggaguucaaggcuacagugagcuaugaucacaccacugcacuccagccugggagacagagcaagagcugccucagaaaaaagaagaaauuauauauuauauguguauuuaauuauuuauguucuuuugugugucagauauuagcauuaaagaaauaacuuuuuuguuuguuuguuuauuuguuuguuuugagacagaaucucacucugucacccaggcuggaguguaguggcgcaaucuugguucucugcaaccuccuccucccggguucaagugauucuccugccucagcuuccugaguagcugggauuacacacaccugccaccacaccaggcuaauuuuuguauuuuuaguauagacggguuuucaguguguuggccaggcugguuucgaacuccugaccucacgugaucugccuucuuuggccucccaaaguggugagauuacaggugugggccaccacaccuggccuaagaucauuuuauuuaaaauccuuuuggaauaccagucaaaaagaacaaaucauuuaacaaggagaaacaaguugggcuagcuucagauuucucugcagcagcauuccacagcaagaggcaauagagaaaugcugacacauuauuugaggaaagaauaagcugugguuuuaaauccaaccaagcugucuuuuagcucugaaagcaccagacagaaguuuuucaacauauaugaguguauuaguuugcuagggccacuagaacaaaaugccacagacaggguggcuuaaacagcagaaauuuauuuuaucacuggucugggggcuggaagccugagaucaaagugcuggcaggguuggucuccccugagaccucucucuucggcuugcaguuggccucuugcugccucuucacaugguugucccucugugcacacaggacccuggugugucuguccuucuucuagcuccuucauauaaauccagucauuuagaguuagggccccacucuaauagccuuauuuuaacuuaaucauugcuuuaaagaccuccacauacaguuacauucugagguacaggggauugggacuuaaaaauaugaauuuugggggaacauaguucaacccauagcagugaucucaaagaauauuguucccaugagccguucuugaggaaacuauuagaagaugagcuuuagccaaccaggagaugauugggaaaaccacacaaaaguaaugucagugaccacugauuauauucagcuguaaaaccaauacuaaaaggugaggcauagagugauaggucagaauguaaauacuauacgcccugaaaauguagaauuauaaaauuaacaaaaauguuauugaaaacacaaaucagacaagcaguuaaguuuucugagugccucuucuguaauggcugggagucagagaucaucaaccaaaaguugcaaaugaaauagauuuuaaaaauccaaaguuagaccuaaauucaaaauucaaccuaaauuaaauacuguauuuauauauaguauaauauauauauuacuuuauauauaguaaagguaguaucucaguggggagagaggugaauuauuaauuaaauuuugagacaaauuaguagcuaucuggagaaaaauuaaguuggagccauaucuuuuacuuuacagcagauuaaauuucaaauggaucaaauauuuaaauguaaaaaaugaaauuauaaaaauucuguaggggaaauggugaaauauuuauuucuuuugcuuuuuaagagacagggucucacucugucuccugcaggcugaagugcacuaaguggugugaucauagcucacugcaaccucaaacuccugggcucaagcgauccuccugccucagccuccuaaguaguugagacuacaggugcacaccaucaugcccagcuguauuuuuuauuuuuuguagagacaggaucuugcuguguugcccaggcugaucuccucuugccuuggccucccaaugcacuaaaauuacagccgugagccaccaagccuggcccaguaaaauuucuuuauauccuuggaaugagguagggcuuccuaacuacaacugaaaauccagaagucauugaagaucacuaaaaaaccaaauucuguagcaaucaaaaucuacaucacacaaaguaccauaaguccaaagacagacuucaaacucgggaagcuuaucuguaaaucauaggcaaggaugaucucccuaaaauauaaagaacuuuuuaccaacagacaagacaaaaaccucacagaacaauuaacaaaauaugaaugcaaauaguuuacagaaaagacguucaaaaggcuaacaaauauggaagaauggucaacucuacucauaagaaaggaaaugcagauuaaaaccacauuucucacccaucagauugucaggggccuaagaguuuaguaacaaacucugugauggggcuauaaggaaauggugauacuuagauauuucuggcaggagauuaaauuguuauaauccgggugggcaugguggcuuaugccuguaaucccagcacuuugggaggccgaagugugcagaucaccugaggucaugaguucgagaccagccuggccaacauggugaaacucuaucucuacuaaaaauacaaaaauuagacaggcgugguggugcacuccucuaaucccagcuacucgggaggcugagacagaagaaucgcuugaaccugggagaugaagguugcagugagcugagaucauuccacugcacuccagccugggcgacagcgagacucugucucaaaaaaaaaaggacaaaggaaaggaggggggaggggggaggugaggggaggaaauucuagaaggaaacguaaaaaauuaaaaauaauguuuacuugucuaccauagagacgaggaugggagagagacuucaugguauaacuuuguauacuuccugguuuuugaaacgugugacuguguuaccuauucagaaaguuaaauaaaauagaacauagauaugagauauaguucugcuauucaguaguugagugaacuugggcaagacacuuaagcucucugagucauaguuuucucauuuauagaagggcuguaauaguaguaucaagcucacaggauuguucuaaggauuaaugaaggacagguggaacagaaagugcugagcagagugccagcacuuaguaaauacucaguugaauggucaugacuuguguuacugaacuuaaucuugguaauaaaugaguauguucuugaaaggacaccagccuuggcuaacauuccuuugcagaaccagacguccuggguccucuccagcauggcagcccucuacuggagggugaaaggccaaggaaagaaggcaaucgacugccuccgccaggcucugcacuaugcgccacaccagaugaaggugagugggacucagaaggugggaacuucugccccuuuguccuuuccauuccccaugguuuauucugcccuuugaaccagccucccucaugcucagccagugaggacauauuccaaggagagaauggggcaggagaccuucugacugggcuugugccccagcaagccuaugaacuaucccugcugccuucccagcuucagcagguuggaacguggggaaggccuuccagaucacuguaagacaguacugcauuuaguccccuuucugcuguguucagagccacccaacauacagcaaaugcacuggccuaagugggcugacacauagaagucaaucugaauuuagcuugucaucaggggccuggugaccucuuagacuuguuuugcuuauccucuuggcuugagcuugcuuccaagcacagagauagaagcaaauuuccauuuauucauguacauuggccaguuccugguccuugucugacuucuacuuuuuccacaaaaaaaaaaaaaaaaaaaaaaaaaaaaccggcuaacccugugugacaccagacuuuuccagaagaccgguuauuguuaugauggaugagaaaauacaguguuuuaucagcacauuuguauucauguguucugaguucugcauuaauccagaucuuaugcuuuuuaaagacauggcuggugucuucuuuguucgucaaggcaauguauggaaugauggaaggaacacaggauuuauugucaggcauugcugaguuuuaaacacagcucuaccucuuacuagcuuugugaauuugggcaccuuauugaacuucaaugagcucaucuagagucaugcauucuauggcugucacaaagauggguccuuucuguuucuucugugucugcuacagaacccaauauggcaugauacagguaacaguugcucaaguuagacauuuaaagggaaugauauuugugaugauagcaaucuugcuacuuguuccauccaucauuuuguacucuauacuguuaggcaauagggaagggcugaggcucuaccucugggagucagcaaacuucccgaaaagggcaagagaauaaaacacuuggacucuggaggccagacagccucuggugcaccuacuuaauucuagcauuguaguaugaaaacagccacagaaauacguagaggacugggaaugauuguguccuaauaaaacuuuuuucaaaauaggcaggagacuagguuuggccuaugggccaaaguuugccaacccguaaugauauaaugguucuugcagaaauuauuuuggcuuucugacagcaugacucuaaguguggucuguggacaguacacagacuuuuuauuagcagucugcaaugagacaaggagcuucaccagaagaaaccaacuacauuauucagcagauuguuuacuucagcugacauuuuguuguguuuguuuucgaagcaagacuucgccaaugaaagaaguaauugauuuauauucugguacaagcaccuuaucuaucacagaccaguagcaaacagcacaaaagcacuuugaguggcacuguucuaaucauucaccaggaaacacagacuguauucuuuaugaucaccaaaaacaagaaugaaagcucaaaacccaauuuucccuucucaccauucuccuucuucucccaggaugugccccugauuagccuggccaacaucuugcacaaugccaagcucuggaaugacgccgucauaguagccaccauggcaguagagaucgcaccacacuuugcugugaaccacuucacucugggcaaugucuacguggcaauggugagaugggggugugagcaguauguaccaacucugccaaacaguagcacaucuuugauuucaaaaccucuuugaauaugucauugcccaccaauuuccuguaagcuugucuaaaauugcugguuccaccaauguuauauuuuauggauaaggguucgagagguuuuuuaaaacauaauacaugaaauucuucuaaguauuugcaacuacguaguuccucaacaugaguugaacauuaacagcagagucagauuuaccuacaguuuccuggagacaccaccuguuccagaaaaccucuccuaacacuccauguagacacacauacaugcucucuugcuuccagguugggcuaagguaccugucaucgcacucaugacacccuuugcauauuuuucuugcuggauuuucacuuuguuuuauaauuuuuuguuuaaguauuugucuuucccucuagccuacgggcucauuggggacaagacuccucuucaccucccuguucccagugccucacaguguuuuuggcacaugguaggugcucaccaaguaguuaaugaaugaagaaauuccgcuaguuucauggaauaccauuuacagagaaaauggcaaagucauccagaucccucauucugaucagaaacaagaacugcuuucagaacugaaaaucccagggggacccccuaaaagcugucauaacccaauuuagcaugagaaucaugccauucgcuuucaucuaaaauguggcaucacacauagggcuagucccaagaugaucucaguaauggcuuauagagugagcagcccugggcuaccagcuucauguaucguucuugacuucagaggcgagaaguauuuugccagggagguauugccgaauaugcagauuucccucugcuucuugaagaaucuguuguugcucccaguaaaugugaaguuugcuacuaugaacgaggacuuaugucucucauuuggcuagaagaagucauuaaaccaguagauuugggcucuucuuuuagaguguaacucuaaguaaaagauuaaccuucaauauggcagggaucauuucccaaucuuuguuggcaucuuuaaauguuaaagagaauuuuaaaacucuucaaaauguacaaguccaguugagauaccggacuuaguuuccgucuuuccagcuacauuagaaaauuuaggcagaugcauaaugggcauuugucaggcacgguucuggagguuucugugaggauuaaauggaaggauuucauaaagcaccuagcacagccuggcacacuucaggcacucaggaauguuaggucucauuauuaccacaauuauuacuguugcuggguuuguaaaagcugcucuaccccuuuuccuuuuguucuugggcucugccguaguuuccuuuguucaucccauaccucauucccauaccucgggaaugaaggcagcuguuuccucccagaggaaccucagaguuuuccacaaagacuuagauccguugagcaaaugcugcgggauugucccuaguacagaggugcuucuugagaaaaaagaggucacaguauauauuuagucugcuggugccauccccucacauuucucuccuuggcccucacaggaagaauuugaaaaagcacuggugugguaugaauccacauugaagcuucagcccgaguuugucccagccaagaaccgaauccagaccauccagugucacuuaaugcugaagaagggacggcgcucuccuuagugcacuucuuccuucucucuuucucuuuacucaugcucuaaaaaaaaagaauaagaaaagaaaccaaucauugucaguaucuacuauuaaugaugugugugaaaauaacuaagacuuauaacaggacuuuuacauaugugggaauugguuuguuuuuguuuuuacguuucuccuuucccccaaccaaccucagaagaggcaccuucagaaacacacauuucuuaaaaggaaagugcagcuucaagauauuguguaaauacugagccaagacauuucuggagcugugcucugucuccaaaaaccucaaugccuuuagggcuuuucucagugguccagcuagccuucucuuuggaggaggaugaagccgcauugcacauucucugcuuccugucguagccucuguugucaauggaaaugcggaagcccaucuggugcccgucagugagaagcaacguucugcgcucucuccguuagaccuccaugcuguccccagucuuguccauuccaugcugcuguguuacaaacucucagagguaguuugcaggggaggaaggggaauaugauuuuaaaaacaaaauauuuacaacaacaaaaauucuuaggaucaccugaccuuuguaauguuauuuauguuggggagggaggggggcugagaaggggaaaucagcagugugcaacaucuuuauaauuuguacuuuaauuacaaaucacaaggaaaccaauaaguugaaauccuauauaacagguuuauauauauagaauauguauauuugaagcccucuacagacugagucuauguuuuacuaauucuuuguucacuguguuacccaucuuggaauaaguugugaaugucagcucccucucucugaggccuccagacuuagcuccucaggaggguaaugagccaagguugaguguuuccauacaaugcuuuuaccuuugaucccaggagaaucagaaacuccaacauuuuggaaucuucaagggcacauacugagaaaaaaaauaaaauuguuuaugagcaaaauagg
